United States Patent 8,071,291 (GENETIC POLYMORPHISMS ASSOCIATED WITH VENOUS THROMBOSIS, METHODS OF DETECTION AND USES THEREOF) - sequence listing, part 2

SEQ ID NO: 427 - DNA, 42657 bp, Homo sapiens
gtctcacatgttgaaatacatggagtgggtcgttttaatcggtttctgtctgaaattatatctaaactctttatctttcctatctatttattcccaaatatttattcagttattcttaaaaaatgtatttttgctttggcttgaaaaaaaattttagggagacttttaagcatcttacttcattataaagatcagttgcttgactttgcatgaagcagattgggcccttctagggctgacaagcccgtgcaagaccacccgctcctcagtgttagtagcgttcccgtctcccaaaaccatgttctcccttgatgctaatggccgggagcacaggcaggtgtgtcgtctcactatggagaataatatttgtgtcattctttacagaagaaggtagcttgccaaactgtctccatctttcccgattcagtcttttgttcaagtaattcacatttttagattttttattggtaatctgagacaagaagaaatttaaagtaatcttcactaagccatgaaagctcccaacattgttctccatgagagatgctggcctgcatttattcaaaaacaaaagacccctctgttgccaaagctcggagggcttttcagaaacgatatagttgtaaattataattttgaatatataaagcaaaaaaatgaaaagtgagaacttccaggctttggattgttgtaggtgataaatataaaatgggatttctggggggctgctactgagatgaggggatggcagaaaacatggaagcaaggtctctggtcagcccagggtgctgggcttgtcccaacaccacgtaggcaataagaggacagtacagggtgccgtctctctccctcttcctctctctgtctctctctctctgtgtgtgtgtgtgtgtgtgtgtgtaacactaccttcccaatttttactgtctatttgtattcaaagataaggtccttatgaaaaatacactgctctgattcactttaaaacttatttccatatttattatttattgtgggaataataatattcccaatattattatttattatttaagttattattattaacttccctctgaggttatatattggttactcacaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaaggtaactcatgagattatgaaaaacacaataggctgcttgagaaaattcatttcaaaatatattttccaatagcataattcaatcatagtttttaaaaaaattcagagacaaatgatctgataaattgataagcaacttttaacaaattgaatatacataatatatatttatattatttatgatatatgtcacaatctatgcatgtgctatttaagaggggcaaatatacatgcaataattgtgctagaatataaaaacattagacttcatcattgggatgatgatatcaagatttctttgttagatttatttcagatagaaaaggggatacgaaaaatgcaggcacatgagatacttggagaactttaagaaagagtgagtgtgtgtgtgtgtgtgtgtgtgtgtgtgtgtgtgtctggcaagcaaggtcttgcacacacacagcactttgggaggccaatgcaggtggatcacttgagcctaggaatttgagaccagtctgggcaatgtgatgaaacccatctctacaaaaaaatatgaaagtatctgtgtgtgtgtgttgctgtgtagtggactacagaactttagaggcagtcacttatttgaatcccattgtcgtaactttctactattttatttttccactgtgactcagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcacgattagcaagtgttttcttctggttgtgaaacagaactgaaagtaagtggttgaggttccagcacagttcctgggatccctctaattgcactgcttcctctggaactcagtatatctcaaagatgtaatttcctctccgtgctgcacctggtcggccactgaaacccactattgcctgcttcacgtgtggcaaagagctagcgggcttgggttttgttctgccgagaggaagggagaacacccacttttataagaaagagatgggttacctgaacccatgggcacctttgcctcttggcctcctaactttgctaccagggcatggctaggagggtccaggctgcgcgtgctgaggagctcgaggggctgcagcattgcacagccttcatggcaggcaaggaatctgctttgcaaggggcattagccctggaggctcagtggatatgggctattgcaatagtaattcaaggagcatttttaggcctggcgtggtggctcacgcctgtaattccaacagtttaggagatcaaggcaggtggatcacttgagcataggagttcgagactagcctggccaatgtgacgaaaccccatctccacaaaaattagctgggcatggtggtgcgcacctgtaatcccagctcccccagaagctgaggcaggaggaccgcttgagcccggggatgtcgtggctgcagtgagctgagatggcaccactgcatcactgcattccagcctgggcaacagagtgagactgtctcaaaaaaaggaagcattgttaggtataaattattattattattattattagtagtagtagtagtagtagtagtactgagacggagtcttgctctgttgcccaggctggagtgcagtggtgcaatcttggctcactgcaatctctgcctcccgggttcacgccattctcctgcctcagcctccggagtagctgggactacaggcacccgccactgtgcttggctaattttttgtatttttagtagagacgggtttcaccatgttagccagaatggtctcgatctgctgaccttgtgatccacccgcctcggcctcccaaagtgctgggattacaggcttgagccaccacacccagccctgttaggtataaattatttcataaaattcagacttgtaaatttatggtagcctttggaatgggtgatagatgtcctatgccacacaaattcctcacatgccgaggctcaccgtaactgataccagctcgcttgattcagttcagttaaactgaacaacatttacacagaattggcgatttacaaaatcttatgtaagttaagtagaaaaacagaaaaaagttttctgaaagagtttgggtttttccttcaatgctcaagacagaggtccccaacctttttggcaccagggaccagttttgtggaagacagtttttccatggaccagcatggtggtgggggatgattctggaatgattcaagtgcatgacatttattatgcactttatttctattattactacattgtaatatataatgaaataattatgcaactcaccataatgtagaatcagtgggagctctgagcttgttttcctgcaactagacagtcccatctgagggtgatgggagacagtgacagatcatcaggcattagattctcataaggagcctagatccctcacatgtgcagttcataacagggtttgagctcctatgagagtctcatgctgctgcggatctggcaggaggcagagctcaggcggttatgcttgctggcctgccactcacctcctgctgtgcggcctggctgctaacaggccatggaccaggtactgttctgggccccgggggttgggaacccctgctcagagacacaccgggtggtaggaggagctaaaggtggagagggtgaaggaaaatatgaggtctgggctatccacaaaccagatagcaggaaactgaagagttaaacatttacttcagaattgaatggcttttgtaaaatctggctagattccatgaaacgattttaaaaatgcactatttaaattttgcctttgcatgcgatgaagacattagtctttgttcatgtggatgtttttttatgtttaaaagggaaaaaatggtttgcaatgaaacttttatctcagtctttgagtattgatcatggggtgttggaacaggactttggaatgcttgcagggtaaacctttggcctctgttagtcagggaatgacctagtttggcaaaacagaggagagttttgaaatatggaactttcccgaggcatacattgtcattttaaagtggtcaatcaaagcccagtaggactgggctggtgtcttggtgactcactgtgtgctcatatacaggggtaactgaggagcccttcacacaggtctagcctcgtgggactaaaaagtgtgacatgggctaggaaaatgcgaggctgggatgccttcactcccatgaggaagcgtgacgggaggaggcgtgggccactggcagttctacttcacaaaggctgctggcagtgtcaatcctgcaagctggccttgccctcctgtggcggcagtgtacacgtggcatgcaagcacatgcacaagccacctggctccaaggtcagccaagggctccaacatctgtctcagtccctgccaaggcatgggaaccccccacgtaaacttggaacttttcctttcaattgttgcttatgtctgtcactttacttgactgtgagcagcttctagggaggctctctcattcatagtgcatatcatgggcatccagtaaacggctaatgatgatgatacacctttattacaaaaataaaggcaatggagactgaagaggtgaaatgattagctcaaggtcactggcaaggacagagctggaacaaagctcagcattcctatgccaggcaatgtcctctcactgatatccggttgcttctcactaggagaaggatgaaagatgacagagcatttataaccaccatttgttattttcattatcaactgacactggtgtttctctgcccggagcgattttgtcctcccttcacctcaggaaacattcggcaacgtctagagacacttttggttgtcctaatgggagagggtatgcaactggctgtagtgggtagaggccagggatgcagctaaacatcctgcagtgtgtgggacagcccctcgcaagagagagttatcctgccccaatatcaataatgccagggttgggaaagcctgatctcatgtcagcattaaaaccttgtaatgaaaagaggacatttcggccgggcgcggtggctcacgcctggaatcccagcactttgggaggctgaggtgggcggatcgcgagatcaggagatcgagactatcctggctaacacggtgaaaccccgtctctacttaaaatacaaaaaaaaaaaattagccgggcgtggtggcaggcacctgcagtcccagctactcgggaggttgaggcaggagaatggcgtgaacccgggaggtggagcttgcagtgagccgagatcacaccactgcactccagcctgggcgacagagcgagactccgtctcaaaaaaaaaaaaaaaaaaaaagaaaaagaaaaacaaaagaggacatttcaggaacagcaagaaaggggttgtaggacatggcgggctgtgccctttctcttcctttattttttactttttgatacattctatttgtacatatttgtggggcacatgtgaaattgtgttatgtgcatagaatgtgtaatgatcaagtcaggatgttggcatacccatcacccaaccatttctatgtgttgagtacatttcaagtccttttctagctatttagaaaactataataccttgttgttgactgcagtcaccctactcttctgtcaaacattagaaagcattccttctatctaactctgtggttgtaccccttcaccaacctctcttcgtcctcaccaccacccccccacacacacccttcccagcctctcgtaaccaccatatactctctacggccatgaaatcatctttcgtgggatcatgcaatgtttgtctttctgtgcttggcttactttacttaacataatgacctccagttccatccacattgctgcaaatggaatgatttccttcttttttattgtgtccattttcaaagcaagttctgaaagacaagagaaggagctctgagagttgattatggccatgcctgagaaggggtctcagtcaactaatgccgttgtggacattcctgtcccaagcagaaggctttaggtcacaatatgtccaaatgtccaatacatctcccacctatgatccattggaaagaaaacaaacctcgggacccccaaaatcactaagccacatggaaaagtaaagctgggaactgcattgggcaaaccttcctcccattctattcctaaataaaatagctttcttaagctataaaaaaccttttttaagctttaaaaaggttttaaaaagctacattcctcacaatttgcccatgaggaaattccttgtggaaaaaggacaggcagaagtcagagtcacccctctgctgacatgagacaggtgcgtatctgattgcctcgtttgccatattgtttcactgggccacactaaggcatgagtgactattcttgtaaattgcgtatttggtgaaaggctaattggaaactcgaaaaaatgcttctgtttgtctcttatctacctatgacctggaagcccccttcccttcttcgagttgtcccaccttttaggaccaaaccaatgtacatcttgcatagattgattgatgtcttatatctccctaaaatgtacaaaatcagcttgggccctgaccaccttggacacatgtcatcaggacctcatgaggctgtgtcataggtacatccttatccttggcaaaataaactttctaaattgattgggacctgtctcagatactttttgatttagaatcctaacttctgacttgtacttgggtctctgcagactaacttctatattcttcctaagactttgtctagttattcctcattttcatcagtcttcgaatattcaaaaacatttcatttcattgaaaaaaaattgaaaaaagtagttgatatcagaattttaaactgcaatgcattagttgaaaataattttttaaggatatctatggtcagtttaaaagaaaggtctatttaatctcaaagagtttctatgtagtcaagacttttattctaggctgggcacggtggctcatgcctgtaattccagcacttgggaggccaaggcaggtggatcgcttgtgcccaggcattccagaccagcttggggaacacagcaaaaccctgtctctacaaaaaatacaacaattagccatgcggagtgacatgcggctgtattcctagctattcaggaggctgaggtgggaggatcacctggtggctgcgttgagtggagatcacaccactgtactctcgtctgggcgacaggagtgagaccttgtctgaaaaaaaattattctacttttatttgaatagacaaaatttttttgaatcctgatactatttcaaagaccttaaagatttcactaactagctaaatcaaacttaggaaaatattatttggttttccagtgaagcatttctcttatttagagcctttctgtttctctcaatagggttggagagttatccttatcttctttttattggggcttaagaagagagatgaggttccatggagtaaacaatacaaggatataaggacctcatataatctcacgtatccattttccatgaaagccattcttggcacgaatttgccattctatgtttgagcctcataaaaggcaatgcatcataaatatgcactttttgggtagctggaatgtactttaaacgggaaactcaagaaaacagctaggaactctttatgccaggataagtcaaatgcactggcaatagatcaaataaaaatatctgagtaaatgccttccagatagaacatcaccctagttcttcagcactttacaaaaagatctgttctcagttcacattctcttaattccctgtcatttctccccggtcttccaaatatgttttttaaattatgattccatgtataaacacaagatcgtattttgcttttctatgaaaaattgagagccttctctgaaccataaacgtatctttctccaaaatgtattcaaatcaggcatattgaaaactgttttgtgttcgtgttgtgaggttttttaggggaccgcacagaaaccctcagcactagttagtgccttgtgttctaaatgaggaaacggaagccaaggacctgcaggtggctggggactgtgcacaggctggttccgctcaagtcacatgactcgtcagccagtgagtaggtctgggtagcagttggcatggatgaacatgccctccataggctttcagaccttcttcaaggccaaagggaaggccttcatggaaatataattatgtgaaacaccccagaattttttcacaaactttcctgcctataaacgccaggtcctaccactgtccagtgtcccacttcccactgtccagtgggaagactccctccaggacaaaaccaccctttccttcagggatgtgacgtgctgtgctttcgttgacagtcatgcagctgctagacatgtcacttcctagctctccattcgggtctgtgtcccaggacctaaagaaagctaaaagaagccgggcgtggtggctcatgcctgtcatcccagcattttgggaggctgaggctggcggatcactggagatcaggagtttgagaccagtctgaccagcatggtgaaaccctgtctctactaaaaatacaaaaaaagaaaagaaaaaagaaaaaaaaataagctgggcgtggtggcgcgggcctgtagtcccagctactccggaggcggaggcaggacaatcacttgaacctggaaggcggaggttgcagtgagctgagatcgcgtcattgcactccagcctgtgcgacgagagactctgtctcaaaagaaagaaagaaagagagaaagaaagaaagaaagaaaagaaagaaagaaagaagaaagaaagaaaagaaagaaagtaagaagcaagcaagctgaaatagcttatttttctgttttaaaaaatagacttttagtgttcacaagtaagaataaaaaaaaaaaaagcttggccttaggaggaatcctatctgcttaggcctctgagaggcagcgtcacctgaagggaaactgactgggcaagagccaggctcttaggagctgtctgtactttgcttcccatccgtccgctctcccccagcagccaaagtctcctccctccattatattgcaaatcaatgaatccattagactttccatgttttctttttagactttgagattcaaggtcagctagaattaatggttaacagctgacaggtgaaagtgtggttaaatgcagctttggctagcaggcacacaggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggtacagtttcagaacttactatttaacattcctctcaagcaaatacgccttgaaatgctttttttaaatcataggaatttaaaaacactttacaatagagaatgattgatttttaaaatgtgtctgatttagctttgtagagatgttccgctaatatccataactaatctgagaggaaatgtggaacaacagaagagtaacagtgtctactcagtaacaagcgttttacgagttaaaaagacatccaaatgcagtactgaaaaatcagaagtcttgatttgtctcactgatgactccgtttttcctagagcagtctgtttaatgcttactggagataaatagatttataggtgaccaagacaatcgattaatgtatcagccacagacttttttaaatagaaaattttctaagtaggaaatcattcatagctctttgaaagatatagggagaggcctcaaggaaagaaagaaaggaaaaaaattgggaaaggaaacaaagatgaaaaattggggtggggagagcggtcagatggtggccatgagaaggatctgaacacagagagcggcggggccggcggggaaggagggaggaggggagagcgctgcttccctgtgggttccggcttctgcagagctgtaagagttgaatgccacacacagtcacactaaggaatgctccaggattgggaaagaaaattcaacattataatgagaacactgtgaatgctattgaattaactactcccctctctccctatttcttgtaagtcttagtgtcagtaaactaattataaatttacattttatgttctaaaagcatgcacctttttctcattgtaggatgattttcttatatcaagtggtacatttcattttatttacttcagtttctggtggtaagtagagtgttatcttaactatgggctgggagagggaaatcacactgcaatctccacacatgtgggagaatcccacaccatttatgccgggaaggaaataaaatgtttttattaacttcctgcctgaggctccagaggttttcaaagcagggtaggaattgaggtgaaaaaattgtttgtactggtaggaatctgtgtctatatgtgtaccatatctacatccatgcctacatacatcattcatttaaatgatatttaaaagcaatattaaaaagaagaaatcttgatttgcctcactaattagttggtttttcataaagcagtcagttcaatggaacatacacacacacataaaataggaattttgtactgaaaaatgttatgtaactattcatacacagtttatgcatttcaataatttaactaccctgttaattctccaccctatgtcacatctgctaaatttgtttataaattacttagccaatattaagtaggatatatcagtacaggtattgtttagttccatgaccattctttatttaaaatgaaagctgaagcattcctttagaaaaatagcttatgtctacatgttatatttaatttctgatactattgctagcattttaagcatagtaaattctttttgctggcctatgtgaaaaaaggcaaacctaggtgaagatattaaaagtaaattccacttaatatattaaattacacagctcataatttcaattttctctgtgacaagactactgctcaggttataatattcctttgttataattatctggaaattgtattgttatttcattgataaatatgtcagcgctaaataatttgatatattttgaacactggacccaataactacataaacaattgaccctgaatcaggggttccacatccatggatttaaacaacattgaagtgaaattttttaaaaaaaattatatctgcactcaacatgtgcagagttttttcttgtcattattcccgaaacaacacagtataacaacaatttgcatagtatttacattgtactaggtattataagtaatctagagatgatttaaagtacacaggaggctgtgagtaggttatatgtaaatactatgccattttctatcagggacttgagcgttcatggattttggtatctgcaggaggtctggcagccaatccctcatagatatcaaggaatgatagtgtacatatttaggtcctttatacatgcacatggaacatttacaaatattgaccacacacaagcctctgaaacaaggctcaacaaattttaaggggttaaaattatactgatcatgttattcaatcaccgtgaatgggagctagaataataataaaaagggaattgaaaatctgcaaacgtttgaaaattgagtatttataatcaccgtgaatgggagctagaataataataaaaagggaattgaaaatctgcaaatgtttgaaaattgagtatttatacctttttagattaagatgaatcagagatgaaatcacaatggtaattagaaaaggaattgtacaataatgaaagtacagtatatcaaaactttgagatgtaaccgaatcagtgttgagatcaaatgtatagatttacatgtatacattagaatacagaaaagggaaaaattaatgatataagatgacaagaagatagagaatagcaacttaagtgctaagaaattagaaggcagaaagaagaaatcgcagaaattaattaaatggaagacacacatatttgagaggtcaacataacccctttctagcccattttataaggtcagggtaatcttgacaccaaaatctgataggaaaattctgaggaaaaaaagtcacaggtcttttatcttatgaacatatgtacaaatgtcctaaacaaaatattatccaacttaacccagtagattgttaaaaaaattaaaggatgattacattgtgatattgtgacaaagttgggtttattccaggaatgaaaagttgatttaacattcaaaaatcaatagatgtgtgacttcggggtacataccgaaaaaaaagaagggaaagcaggaactcacacagatatacttgtacacccatctcatagcagcattattcacactaacccaaaggtggaagcagcccatgtgtttatcaacaggtgactggataaagtgtggtacatacatacaaaggaatattactcaaccctaaaaagaaaggaaattctgacacatgctatgacatggatgaaccttgaggacattacgctaagtgaaataagccagtcacaaaagaacaaatactgtgggatctcactgataggaggtacttagggtagtcaatttcatcaagacggaaattagaacagaggttgccaggggccgaggggccaggggaagggctgagggttggtgtttaatgggcacagagcatcagctggcgaagttgaaaagttctggaggtggatggtgctgatggttgcacagcaatgtaaatacccttagtgccacagaactgtacactcaagatggctacatggcacatggtatgctatctgtcataataaaaaataaaaataattttaaatgttaatatgtgccgaaaaatgcttgctaaaattctattaatgatcaaaactttaaataaactggaaatggaagagaactttcatcagctattaaacgatattttaaacaaaagcaaacaaaaatccaaaccaaaaatcttcaagaaacataatacgtaatagcggaatattgaaagctttcccaagggattgagaataggacaagaatacttcccattatttccatttactcttgactggaggtactcgttggtgcggtaaggaagggaaataaaaggaaaacgattaggaggaacataagctctcgtttttcacagatgatgtgattgagtacctagaaaaatccaaaattaaccatcacataaattatttgagccaattaattaaatgagtaagaagtctcgatacaacgtcaatatacaacagcaagcacttgctcgttcgcaaaagcagatgaactagtttttactgacactagaagcagcatgtgttccatgtgttccacatccatgcactcaaacaaccttgacgtgaaatattttttaaaaaattgtatctgtactcaacgtgtgcagagtttttttccaaaattgttttccaaaaatttttaaatgtttatatgtttagggggtgtaagtgcagatttcttacatacatatattatgcggcggtgaagtgccggcttttggtgtacccatcacccaagtagtgaacacagcctccaacaggtaatttttcaacgctcaccccactcccatcctcccatctagtggcatattgaaaatcaatttgtcttgtaaaattaaataatccaattaggagggggatatattctaaggaaattagtgcatgatgcacacacacacacacacacagaacacgtgtgtgcgcatgtgcacatgagagagagtgagagagaaactgggtcttgctctgtcgcccaggctggattgcagtggtaaaatcacagctcactgcagcctcaaactcccaggctcaggagatcctcctacctcagcctcccgagtagctgggattacaggtggaaacaaccatgcccagctagtatttttttttttttttgtattttttatagagacagggtcttgccatgttgcccaggctggtcttgaactcctcagctcaagcaatctacctaccttagcctcccaaagtgctgggattacacgcatgagccactgcgcccactccgcattattaaatatagaacatttatttgattcatcagttaatattcttcttaaaagtactattttaatgtagcaagattgctttccaccaaaaggtggggtttccacggtggggtttccaaattattctcaatggggtgaggatgtgtgttatcacacccccgagccatcagatgctgtcagaaagtgatcactctgaagtctttgtttcaaataagcacagggtttggataaagagacgcaattaggaaaggaaaaagcagaaggctcgttccagacctggatgagatcctaaaaagcagcagcttttgccagtaaagatccttgaaatgattcaattaccctcaaagcactccttgtctccaagacaatcactcataagcacaattccattgaagccaacgtaccattttgtgattttcgtttccacctgaggctgttcattcaataaactcacataaaagtgtttattgccttgatttccaaattcaggcgtatttcctggtaagtagagctacttgccttgcctttatgagattaccacctaactagatgtatgcccagtaaaatccaacataacgcatgccatgtactacatcacagaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtaaatgcttatgtttctacatcgaggagacagatttttaaagggagattgctattcttaacacatttccatctaacattttataaaatttaacattaacaactggaagataaattgtctttcagttgaaatattgttacagaaagaagtgatggtgtttacgcaatttagaaaagaataaatatgcctccaagtgtagactttccagcctctcctatagtctcatattaatggtatgtttcttctgtttgtctcaatttttacacttcttaaacatttcacactttgcttttctatcgattattaatttttgtcgtgcttctcaacaaactggaacttctcccaactattttattagaaaaaaataaaatatttaaaaagaaaatttgaaaaaaagtacagtacagtgatccccctgccaccaccaaaaccgcaatgtttgctatatttgtacagcaatatacaatatacaatacctatatttgtatacatgtttaaccgtttgaaataattttaaaacatgacactttacccctaaatacttcagcatgcactatcctacacaaaagacatacgaaatttaacaagaattcctttatattatttcagttttccctcaaatataatttatagtaattaaccagaatcttaccaagagtcactcactgcattgggtggtttgtcaggtttaaaacattttaaacagtccaccaaccatttgtattcccatcctgagcttgaaaatttaataataagcctttctgtagaattaagttttcaacatctttattattgctacattcacaggcatttatgtagcacccagaacttataaaatttactattccagaacctagagcagggattggcaaatgtcttcttaataacgcagagtaaatatgttaggctttgtgggcaaaacccacagtaaagccaaggatattatttaagtatttatgtcaccacttaaaatgtaacaatttgaaaatataaaaatcattttgtatagctaacaggctaaacagaaacacacagatttttggttgcattttaccaacaggtcctagttgacacattcctgtttgttcctattagaaaggagtattacatgcagtctcttaagtgtagggatattgaagtaaaaaacaaactcagaatcttgctaagaaaatatttgttttggcatgagataaagtagtttgtttccttctttttggctttctgtgtgctgacttttaagatccattattttaaaaacataaattcctattcattaatatgtattttttaaaaaaacaggtttacttgtgtcctgaaagacagtgttacagaaacactgccaagagtgaataggacagcagcgatttctgggtattctttcaagcaatgctcacaccaaataagcggtaagatatgttctcagaatcaacaaataccagctgtgatgtacacatatcgccacatcggatgtggttttaaggctatgaaatgaaacactgctatgtggaaataaacccccttaatgaagttctttcagtgtagagtataaactagtatacatacatgcctgccctccaacacactgtaaaaacctctttacctcatagaaagacatatcttactacctcacttcccatcatttatttatattctttctatttcccagcctaaaatcttaaatgaaagtctttttttttttgagacagggtctcactctgttgtccaggctggagtgcagtggtgcaatcacagctcactccagcctcaacctcctgggttcaagtgatcttcctgccttagcctctggagtagctgggaccagaggcatgcaccaacattcccagctaatttgttcatttttcctagagacagggtctcactgtattgcccaggctggtctcaaactcttggcctcaagtgatctgcccgcctcggccttccagagtgccgggattccatggtgcccagtcgaaattctttattaaacgtattaatccaaattgaaaggagcaaatataaaggttgaagtgacacttgtcttaatagtgaatagatacttgaatcagttaattagcgaaataatcagtgcagttagggagaagagaggctaggtcagaaaatcaaaatgtgaatttacaagtctaaaattgttacagtgtaagaaggacattggcattcttttactgcttccattcaagaataagaattttgcagattaatataacgaaagacctctgaggaaaggtgggtgaaaaagttgaaaggatgagtcaggagggacagttgcttaggtcattgcccctagaatctggaaggtactcatgtcttctgcttttatttccagcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcggtgagtgagtcccaggacattcgagtggtcgatgaaaaacagaatcgtgatttactaaaaagcttttgccatcaactttatgccagaatttattttgaacccctaaaagacatttctataatagtactcctagttttcttcatgaaaaatacacttaaagcctaatttggatgcatttcatttatggtaaggagtctatcttttaataacactgtcagaaaaatatatatacttggctaatttcaaaagcgctacacttttaaattggcacttttgaaacagctgcaattggtatgattgtcagtgcccttcccagtctaaaaaatgttacagtctaacagaataaaaataaaaacctactctctctctctctaaataacagttccttacctaagacaaaatactcatgtaaaaagtcttatcctgctccatactggattttgaaatatttcaaggataaatctatcacataaggatttaaaaattatctgatctctaataaccaaatctgtgttctcatctttaaaaatttactagggaaatagattattaatttgtatattcagaaatatttgagatgatttagattttcatagtaaactgcatttatctggaatcaacagaaaagtgaaaaacattcaaattactaatacttgcgttttaacattggattttaacattctgctctccacattcacaaagaggagtgaacagaaagcaaacaaagcatcaacgagttatttcaaaaacaacagtggtgaaaaacacacacaccaaacccctaaattcatgatttgacttgtaaggcttatctttagctcagctcagacgacagcttttatgtctaagacttaacagaatgtgaactgcaagacaagaaattggaggtttctaagcaagataaagttaagtcattaaaagtaagaaggacttagccaggcgcggtggctcacacctgtaatcccagcactttgggaggccgaggcgggcagatcacctgaggtcaggagttcgacaccagcctgaccaatatggtgaaaccccgtctctactaaaaaagaatacaaaaattagccaggcgcggtggtgggcgcttgtaatcccagctacttgggaggctgagacaagagaatcgcttgaacccaggaggcggaggttgcagtgagccaagatcgtgccattgcactccaacctgggcaacagagtgagactccgtctcaaataaaaaaaaacaaaaaatgagaagggcttgagaagtcattcattcatgcactctccttcttcatgtggtcactctctcaagctgtcattatactgaagaagaaataaacttacacaattcacaggtgcttagcaacactgctgggaccatgcccagccattcagcctcccagatggatgcttcggggtctcgcaggtcctctctccaaaggggactttcttaatatctcatgttttttcctccttgcagttggaagaataagacacttttcctttttctttttattcagtaacatttgtctactgaagcacacccaaacagggacaccaaccagaataacgaagctcgataaagtggtgtctggattttcactgaaatcctgtgcactttctaatctgggtaattatcgacttcttgatgatgtaattcaaccattaaatatgctgatgattacagtagatctcactcaggataccagcttatgctcacgatgaaacggacccaaagatctttaccttcttcatgtgatagatttcatcatgtcctatacagttagatcctctatttaaatttccagtttaaaataatcatgccattttcttctaaataaaaaaaaattaaaagatcttgggatacacttaaattttttaatatggaatttacacatactgtgaccggaattttcctgatagctggtgaattgagtccctgacatagttcttccgtcgcgcagcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaaggtaaggagttaacaagtaaggataatttgttatcttctaaaaatagctgatcaaaatccatcattaaaaattccaagtaactaaaaatttactctaaatgtcagtataggataaaagttgcaaagaatttctagcccctctccctttctattccccacctacttaccacaaacccaacattaccgaggactcttttttttttttttttttttttgagatggagtctcgctctgctgcccaggctggagtgcggtggcatgatttcagctcactgcaaccttcgcctcccaggtccaagcgattctcctgcctcagcctcctgagtagctgggactacaggcatgggacaccacgcccagtaattttttttgtatttttagtagagatggggtttcaccatgttggccaggctggtctcaaactcctgacttcaggtgatccacctgcctcggcctcccaaagtgctgagattacagggttgggccaccgtgcccggccagtaaattttaaaataaatataaatattacttcacctaaataaattttaggtacaggtacagttgtgttacatggatatactgtgtagtggtgaagtctgggctttcagtgtagccaaatagtatacattattcccattagataatttctcctgcctcaccctcctctatcctcccaactctctgagtctccaatagctttcattccactgtctctgtgcctgtgtacactttatttagctcccacttaaaagtgagaatctacaatatttgactttctgtttctgagttgtttcacttgagataatagcctccagttctatccatgttgctgcaaaagatatgattttatgatttttttatggctaagtaacattctatagtatattctatacaccacattttctttatccattcatttgctgatagactcttaggttgatccatatctttgttattgtgaatagtgctgcagtaaacatgtgagtgtaggtatctttgtgacatgatttttttttctttcttttcctttggctatgtacccagtagtgggattgctggaggtctccaccttggcaaaggggcagttgtctagttctaaatgaaatgaagagattccatttccatttcatgacaactaaaagacaattcagtccaatgctttgtttaaaataattgaaccaggaacagaaagagctgaaaatgtcagtgaaatgtcaaacccaaagtggagagagagagagaggtggaaatgaatgtctccatcaagtgggttagggtggtggtggagggaggtttgagaattgagtccctgtttccttaccaatggaaattaacataggacatcagaaacagcatggaaaatttctttgattatcaaaagtacactagctaaggttgctgtccctcttttatttatttatttatttgagacagggtcttgctctgtcactcagatttggttgcactgggtgtgatctcagcccactgcagcctccacttcctaggctcaagcaatccacccgtctcatcctcccaagttgctgggaccacaggtgtgcaccaccacccccagctaatgtttgtttttttgtagagacagagtttcgccatgttggccaggctggtctagaactcctggcctcaagcaatccacctgccttggtctcccacagtgcagggattacaagcctgagccactatgcccagcttgctattcctcattgacaacattcacttaaacaagcaaacaaatatccgtaaaattaagtcagctttaaaacctggcttgtatatatctctgaattggaactctcagagccctcagcacttgcctgattggcctcctgttgatgaaaagttgtcctccagacaactcagccaagggaggccctgtgtgccttgcctatcacatgagcctcactttccactgagtgaggctgtcatttcagaagcaccgggtctgtcacatgaaaatatatctgttaccatcacttactaaacaaatttagtagaatttgtttggtgcttattatgtatcaggcattgttctgaaggctggggataccatttagtgaactaaatcgacaaaaactttgcctattggaccagagtggagatgagagagaagtgaccagatcgatctgtgttatcagcagacagccaataagatttgctgataggttggaccacggattgtgaaggagtcagtgatagcaccaagacttttggcccaaggaactggaaagatggaaatgtcaatgacagaatgtggaggatttcgcaagcagcagagtgtaggagaagcaatgcccttggctcatctagggcaaagggttgaattggcaactggaaatagaagtcaaattcagaagagaggtttatgtggacatctgtgtttaggtgtcaccaatatacagctgatactttttaaaaatctagtgaaattatcaaagggttaaatgcagagagggaagaaagtaggtccaaagatcaagccttgggacattggaagtttagaaataagaaagatgtcattgtcacttgtaattttgtgctagtcactgctctttttctttgtcttattaccttactgaccaattcctagaataggaataacacatttgatctttaatacagtatgtgataggaacatggcttctataagcccaaacttggcaatttaaatttaaatttattaaaattaaataaaactggctgggtgcagtggctcacgcctgtaatcccagcactttgggaggccgaggcggtgaatcacgaggtcaggagtacgagaccatcctggccaacatggtgaaaccccgtctctactaaaaatacaaaagttagccaggtgtggtggcatgtgcctgtaatcccagctactcaagaggctgaggcaggagaatcacttgaacccgggaggcggaggttgcagtgagccaagatcgcgacactgcactccagcctgggtgacaagagaaagactatgtctcaaaaaaaaaaaaaattttaaataaaactaaaaattcaccttcccagctgtgttagccacatttcaagtgcccaatagccacatgtagttggcagttactgtattggatggcacaggcatagaatatttccatcactgcagaaagatctatggacagtcttgctctagactgtgattttgtctacttaggaaaagtcactcttttccaggaagatgcttccagggtgtggagtaaacgacggacttcacccatctccttataaacctattgcaaccctggataggaggtttctaggtagcatgaagactcttgaatctttaagataggctgggagtgttgaaaggaaggaaatgaaaagggaagatactaggaagactgacaatagagcaagctcagaaaatttttatggaggtgatttagttagaaaatttgtctgcaacctaagggccatggagtgtgactccatggtttatgggtgtaactccgtggtttatgaagagtactttcaaaataggaaaatcttcacaactaagtgctagcatgagctgactttactttctctaggtgctgtaaaaatgtttttatgtgtttgatatgatatatttctacttcccttttgtttttgttagaaatctttgtctccttaaaacatctgagagtggattgcccagtacacgcattaaaaagagcaaagctctttctggtttcagtctacaaagctgcaggcacagcatcccaggtaaactgagagttctgcattctggctgagagtgaccagccccgaggaggctgatacatgctgagggagggtctcactctgacatgtggtctgctgtctagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagtaagccatatgaagggttatgcagacacccttgtcccgtctgcctgtgaggtgcattatgtttataccgttttgtttccaactgcaggggcaagtgttacttaaagctttcttcaaacggatctccaactaaaatacttcacgggagaggaggcatctctggatacacattaaggttgtgtaaaatggataatggtgagtataatgtcacttgaaaaaatatagctgaaggaattattccatgcttcatacatcacaatcaagactgtcagttatagccacagaagggagaacattcaggaaataacaaattttgcaattttctattattttcactcctgtcactcaagctgaccatgttttaaaggtaaatattgaggcttgactaaactgtacattgcctagtattaactaaatatatgctttaatttgacacatttatacacctggcatttctgttttctttctttcttttttttttttttttttttgagacacagtctcactctgttgcccaggctggagtgcagtgatgtggtcagtgttcactgcagcctctggcttgaactcctggactcgaacaatcctcccaccttagctccctgagtagctggggctacaggcgtgcaccacaacactcggctaatttgttgtagagatgggatcttgccatgttgcccaggctggtcttgaactcctgggctcaagcaatcctcccgctttggcctcccaaagttctgggattacaggcttcagccactgcacccagccacaactggcatttcctaatgagacccagactctgccaacactcctgttatcaaggccagtaatctttcctattatcctttgtaagggaattatcgatcagcactttggttagtcaaattactaattttcttccaaaaattgtgtatctattcaagaaatactggagcacctcctttttagggtctttattcagattccatgcagggttctggagacttagggattggcaaaggttaaggtaaaactttactagtaacaatgagtgtggtaggatggaaataagtgtttagattacacgagacctgtaataacataaaagttacaataaaaatccaaccagcagtgtttccatcccagtggccaatttctgagcatagtcacgagagatgctttgtaggcaaacagaattgttctaagggacaaaatccccaacaggaaagaacacaccacaaacactcctgcttaaattaccatagtaacttaggatggctttactatatattgatttacataaagctgcatgttcttatactgtttattgccaaatgtccaatattacaatacactataaggtgcaactgagatttaatgaataaaatggaagtaacaatcctgcctcgtgatagttttagaagcacaaaaacattctgtgtcagattatctgctgtaccgagaaggcgaatcaatccttaatttctgagaacttgttttgtagaacataaagacgttatattgcctccaacactggtatcctaactaacagactatgccttcctagagcttagaggcgctccgatgaaaatctctggatggctcaagacttcttaaaaagcaagtcaattacgtcgtatctcatacattctgttttcctcacaataaatttccctaagacaagaaggagcattcggcaccattctgttgtctttcttctacttctaagcgttagaagggacacttagcaaatgttgctgttaagtaatgttgacatggtttaataaaatgggaatgagcacgtatacctcaatacattgcagactgcattttcccccttccttcttcattatggttttctctgttggatttatagactctggcctgtagaagttacagaatatgccaggtatagattgatagctacaggagaaaatgtaagataaaggaaaataaagtcttacgtcttttcagtgcaactttggagggagtgaattagataactaggtttttactgcgctgtatttgatgaaataaccccctaatgtgaaagggaatagctgcgtgagatatttatggtgccttgtctgtcactggtctacaatgtaacttaactttctgaagatagatagcagcaccattaaaataaacatttcttaccacaaaatatgattctaaacacatattttcagcatttcgtttaaactgagaaacagcataggatgaacctcaaggcctctcacctggaccttgagttatttctaaaatatcttagttactatttacctattaattttcctaaaatttacctttatgacgcttcccaccttgcagaaattccagaatagatggccctccaaaatgaatgttcacccttccggctctaaaatgagagcctctgttcaggcttccgaagtcacatcgtgctcgttctcacctcagttgctgttagctgctgtttccttccgaactccttctctcatcctctcctcctatttgaaatctgccccagaattatacactcattttcctaccaaggaaaaaaaggcctagaaaggttgttttacacccacaaaactagtgaatggaccttctaggacccggcttctcatcagtgattcttctgttaacttagactcctcccttagctcaggacgcggagccttctgagcacctgagcctggttattctaaatgtgatctgggcacagcacattgacatcacctgggagcttgttagaaagaatttcaggacccacacagatgttactgagtcagaatctgcattttgaaagctacacaggcaacccacaggcacataaattttgagtcgcataggtgtgtgcgtgtgtgtgcgcatgtatgtgtgcgtgtgtttgtgtgcacgtgtgtgtgtgtgtgtctagaatactgctgtctacgaacaccctattcccatccatctgtgttccatggctccaaccgggagggtgggttcttgtgtcgggcatccagtaagtagaaatagagggcactgtcctgtctaggcagccccaagagaaaagaaacagagggatgagcctgagtcaaagtccctgaaaagtaccaaggaccccagagaatcccaaactgtcaacaaggccaaaggtcagaggaagttcatagcagatcagtcttactttggacgtgggtggagcaggagtgactgggatcatggtcagcagagtcactgggacagggcaggaactggacaatggctgcagcctgcgggcaaggtgcttgccttttctttctaagagcagttctcaaacgccagcagggctggttcaaacacagatggctgagcttccaggctggagtttctcattcactggatctgaggttgggctgaagaatgtgcatttctaacacgttcccaggtgacgctgttggtctggagactgcacttgacaaccactggtttaaaaacaccattcacgttatcatttgaaggagggtaagacagccttgtagtaccacacaaggagggctacattcttaggggtgtgtaattacaagatgacttagtcaattccatttttcatgtgcatgttttgctttggcagcttgattataaagtctctgtaactcagggtcatgataaactattgacttgaggaaaggttttcttcttgttcctgaaggagcataattactgatggaaaggaagatgtaggaagctgctcatcacaatgcttctgttgcagagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatgggtcagtaccacggctgtttttattagttcatcttcttcacacatttataaaaaatattactagcatgttaggaaataaatactttaaccaattagattgtcttatttgcaaaattaattaattgcttcagtggtaaaaaacgcaaaaaggaagagctcatggtctcccagcatcagaacaggtgcaggtacaaggctgcttgactgcctgctattccgcttcccatttaaccgcattcacatccccaagggccttcatgttattccctgcaagagcatacctccctctgtgcctcgctctgtgcactgtgcccggaactaaactcacagaggatttaccattgtctgaatcaaatttctaatatgtgtgtgtgtgtgtgtgcgtgtgtgtttaaatacagaaagtggccaggtgtggtggttcacgcctgtcatctcagcactttgggtggctgaggtgggaggattgctcaatgccaggagtctgaggtcagcctgggcaacatagtgagacctcgtctctaaaaaatatttaaaaactagcctggcatggtgttttgtgtgcctgtagcaccagctgctcagaagtctgaggtaggaggattgcttgagcccaagagttcaagggtgcagtgagttactacagtgccactgtgctccagcctgagcaacagagcaagaccctatctctaagtaaataaataaaatacagaacgagttcggtatgcatcctcacattggattccttacttaggtcactttcagcgttggccaaacaaaaaggctccagctgggggtatatatattccagggaagttaagttggccaaactttccgtttgctacttcagtatcctccgagttgtttccagacacagttttgtgtgctttttagttttggttttcttttttaatcaatctgcagcacactcatgttaaactcaagaacacatgtgaggccaagagttcccgttacctgtcacatatgggaatggagtagcagaaagcctagtttctgtcacagctagttactggcgagattgagactgagtccagcggtcttcgtgtgtgtgtgtgcgtgtgtgtctgtgcagtgtgcgtgtgtgtgcgtgtctgtgtgtgcgtgtgcgggtgtgtgcgtgtgtgtgtgttggagcacggagggagtgctcattcattttttgtgtataatggattttctttatagggtgaatatgttttttatcccgaaaaatcttaggataaaatcacttttttctacctaaatgtccatcattggcagaaaatattagtaataattaaacagccacacacttcacaatgtctgggaattatttttagtaaaggaaatttctttccctctgttgtttgctccttagggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacaggtacggagaattttatccggaaagttgtctccaatggtgaactggataaaatgtttaacactactagacttacggcctgaccctgccaatctctccatgcgttatcatcatgaaagggagagggcctggaatgctagtcattcactctgctaaggctgacacactttcctggctattgaaacttattttgggaatgtgggtaaagagatacgttttcctgagtcttcttcaggtgcatagaatgacataatttcataatactttggaatagtaaagataatttagtctaaagataatttattaaagataatttagggatgaaggattgaaggttagaacaattaagcaacttgtgcaggatcaaagtgagttggatgaggagttagcggtgagggtgaggcttgtctctctctcgccctctcatcctggcacatgtgcgatatcgtgctgaacctgagggaggaaaatacacgacaacaaggcaaaaaatgaatatagtaaacaaagaaaacacagataatgtacagtggaagaagagtctcttctggaaaagaggatatattttgcgtctcatatttaaaccacgattttttaaatttagattctcaacgacccatatgcctgccttccaaaggagatagaaatgtaatatacactgattgctgggtgactggatgggggtacagaaaactaagaggtaaaaatgatgttgttatatgtgctccatcctagaaatgaagagcggaaccttttctgccctgtcaagtcatgtagctgaagcacaactcgagtcacactactcagttgcaggaagcggattaataaagatggagaggcaaaaatcacccaagtgaggctggtgcctcatatgtttgattggaaattttaaatgtgactaaatctctttaaagactaattatatttaatgaagtttaatgtgaagcctagcacttttcagtaaatgttctagcctgctatccaattactttcttgggaagtcattccagttagagtcataattaatttttgaacttaattaacattaacaaaatggtacacgcaatagtgggaataatgtcttcttcatacttgtaattataaaaggtctgtgaagtaaatctaacattttttccttctagatttttatatagacatgagttttgtgttgttgttgttttgagatggactctcgctctgtcgcccaggctggagtgcagtggcacgatctcggctcactgttacctccacctcccgggttcaagtgattctcctgcctcagcctcccgagtagctgggattataggtacccaaccaccaccccaagctaattttttgtatttttagtagagacggggtttcatcatgttagccaggatggtctcaatctcctgacctcgtgatccacctgcctcggccttccaaagtgctggaattacaggcgtgagcccccacacccgtccatgatttttattttaaatatatgtggcccagcaccactggtggctcacgcctgtaatcccagcactttgggaggccaagatgggtggatcacttgaggtcaggagttcaagactggcctggccaacatggtgaaaccctgtctctactaaaaatacaaaaattagctgggcatggtggtgtgtgcctgtaatcccagctactcgggaggctgaggcaagataatcgcttgaacttgggaggtggaggtagcagtgagctgagattgcaccactgcactccagcctgggcgacagaaagagactccgtctcaattaaaaatatatatatatatatatttatatgtatgcatatatgtttatgtgtattgtgtatggttattctacaaacgaaccaaaaaaatttttttcagacaaaatacaaaatactctccagaaagccaagatacccttagtgaccaacgaagagtgccagaagagatacagaggacataaaataacccataagatgatctgtgccggctacagggaaggagggaaggacgcttgcaaggtaacagagtgttcttagccaatggaatatatgcaaattggaatgcttaatgcgttggggtttttttgtttgttttgttttttttgtttgtttttttttgagacagagtctcgctctgttgcccaggctggagtgcagtggctcgatctcagctcactgcaagctctgcctcccaggttcacgccattctcctgcctcagcctcccaaatagctgggactacaggcgccagctaccaagcccagctagcgtcttttttttttttagttttagtagagacggggtttcaccatgttggccaggatggtctcgatctcctgacctcatgatctgcctgcctgggcctcccaaagtgctgggattacaggcgtgagccaccgcgccgggccgcttaatgcattttaaaaagcagtcttctgccaatgagcagggaacacagtgtatttgtttgacttagactgaaatcaaaagcaaggagattgactggatgaacgcaagcacccaggttctctgcagtatattaaggggccaagacaacattttaggcaaaatcagcctgagcaagatgtgctgaagatgggaagcgtctgagttgatctgtgcaccttttcttgtctcccctcgttctagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtccaaaactcccgttctatgatcgttgtagtttgtttgagcattcagtctctttgtttttgatcacgcttctatggagtccaagaattaccataaggcaatatttctgaagattactatataggcagatatagcagaaaataaccaagtagtggcagtggggatcaggcagaagaactggtaaaagaagccaccataaatagatttgttcgatgaaagatgaaaactggaagaaaggagaacaaagacagtcttcaccattttgcaggaatctacactctgcctatgtgaacacatttcttttgtaaagaaagaaattgattgcatttaatggcagattttcagaatagtcaggaattcttgtcatttccattttaaaatatatattaaaaaaaatcagttcgagtagacacgagctaagagtgaatgtgaagataacagaatttctgtgtggaagaggattacaagcagcaatttacctggaagtgataccttaggggcaatcttgaagatacactttcctgaaaaatgatttgtgatggattgtatatttatttaaaatatcttgggaggggaggctgatggagatagggagcatgctcaaacctccctaagacaagctgctgctgtgactatgggctcccaaagagctagatcgtatatttatttgacaaaaatcaccatagactgcatccatactacagagaaaaaacaattagggcgcaaatggatagttacagtaaagtcttcagcaagcagctgcctgtattctaagcactgggattttctgtttcgtgcaaatatttatctcattattgttgtgatctagttcaataacctagaatttgaattgtcaccacatagctttcaatctgtgccaacaactatacaattcatcaagtgtgattttttttttttttttttgagatgaagtctcaccctgttgcccaagctggagtgcagtggtgtgatctcggctcactgtaaactctacctcctggattcaagcgattgtcctgcctcagtctcccaagtagctgagattacaggcacatgccaccatgcccggctaatttttgtatttttagtagagacggggtttcactatgttggccaggctggtcttgaactcctgacctcgtgatctgcccacctcggcctctcaaagtgctgggattacaggtgtgagtcactgcgtctggccatggaaaatatttattgagcacaattatgtgagagcatcatgctgagctttgaagatacagtggtgagcaaacatatatcctggcttcatgaagattatactctagttaacatgagcaacaaaataaaataatcacacaaaatatataggttcaagctgaaatgagtggctgcaccagattctatgagataagaaaggaagaaggacatttttcaccaagttcaaagactgggatacaaaggaatttgtcctgacaaaggcaaaacaaaaacaacaacaaacaaaaaacccaaaagagcaaaatgacagtagaacataacggggccagatcaaaaatgctgacaggttcccaaaagaataaaatgacggtaggacatgacggggccagatccaaaatgctgacaggttcaaacaaaattggaattgaaaatcagagtgcgttcaagagtatcaaacaatactatcttgttacttgcttattaccttagtagactggaagcaacacttcacacaaaaaaagggtttggatgtaatttcggataagaagagatgtttctgtaaagtctttcctgagaagcatattatttgagaaaaacacatatttctgtttttagtatttcactttgtataatgtcttaatttttgaagagctggtatattcctatgattcattaatgaaagttctataagatataaaatatacaatgaggagatctcctcttctgtaccagaagagtgcacattctacacactgcgtagcacctttctcacttacgttctgtctgggcacacttctgattgacacgcagagggctctctctgtctggggatatttctgatgggtaccgagagagcttcctctatcttgggttatttctgatgcgtagagaagggctgcctctgtccattatggaaggctggtgttcactgcagggattccacacttcatttaaccagagtccccgtggacggacacttgggttgttttcaatctttccctctttcatacacacgcaggaacatttgtaggataaagtccagatgtagaattgctgaagacaaaacaaaacgaaaacagcagatgcatttgtaattttgaatattgccaaatttctcttcaaaaatctgtagccattttttctcccaccagcaatgtaagagagggccacgttccagctaccataacaccacaattaggaatttttgacaatctgacaggtggaaaaaggtagctcactgtagattattttgcagttctcttactatgacaaattaatataaatgacgtgatgttaatgtggtgtataagatcaccaaattgttcaccgcttcattgtttacttaaatgctaatttggtggttatgacgtagacaaacatagagtatgctccttgcagtcatgtaaacatggtaagagttcttgccaaaggacgaagcaaacgttccagagcttatgttgttcaagcttggtagtggctcagtgtggcagacatactggctgtccagccttctccctgtgtgttatggacataaatttggggtacaagtggcctcatctccagttccaggggtggatcctgattcctacacattccctgatggaatcgcatcctcgttgccctgggaatcagttcctggcagtgcaggccaaggcagtgggcacacgccttcaccccaccagagtgactggctcagagtcagcaacctgagcaaaggttgagaatttggatgttgtgtcggaataaatgctttctctttcccttccatgtgaatgaggaagtgttggccctggaagtggtggcacttatcatgagaagctgccggaggtcactgatgcccaggtagaggggctgaggtctgcaccaactctgggcttccctcttccacagcaatggcccctttcattttaagccatgcatttcctaccacctgcagtggaacgtcctgtgtgccaggactcgggttattgatcacaaccctgagtcaatgaaatgtaattgacttttattaggcatgcattttaccatagtgttctatgggacacagttttgtgttttccaattttaaaagttggaaatgttcttgaatagttttgatcctaaagcctcagagaaagtctgtctgtgacccgctccagagctgcctcactttctgacatgagcggtgctcttggacagccggcaacgaagccacgcttgtgaaggacacagcggttctcacctgtggcacccggggcaccagtggctggccactgccctacactctaaagagggaaactaaactttggactgagaattatatatttaagaaagccttcagaaataatacatttacattatacatgactcatttatggccttacctgtggtcctgcctcatgaaagcatcagaggaaacgttccccatttgctaaggggcatgtctccatctcgcctgttcgggtccacttctcccttcatcctcgctttgttctgtgattttccgctcccttcacaggtctcactcagaatgggtctttcccaggccgggtgcggtggttcacgcctgtaatcccagcactttgggaagccgaggcgggcggatcacgaggtcaggagatcgagaccatcctggccaacatagtgaaacgccgtctctactaaaacacacaaaattaaccaggcgtggtggtggcacctgtagtcccagctgctcaagaggctgagcacgggaatcgcttgaacccgggaggccgaggttgcagtgagccgagatcgtgccactgcactccagcctgggccactgcactccagcctgggcaacagagtgagactccatctcaaaaaaaaaaaaaaaaaaaaaaaaaggaaaaaatagaatgcatctttccctttgctcgtgtgagaggattttcaacatcccagcccgcagcatcccagagctcaggtgtagggaatttcccgactgcacggacgctctgccggccccatgtggtcagggcaatcctctctttgaatgtcctttccacaagatgtctgtgaggccacctgtcacctgggagggcttccctttgtccaggcagaggtggtggccacagcatcacggcttcccagtgcgccctgtgagccccaccccaactctcccgcctgcttcccgcctgttgtatgcacgcgtgttcattaaccacagcaggccaagcttctttcaggagaacatttcttccttttccaaggcaatcccacaaactaaaaataactgtttagagcaattcttcaatgaggaatgtccgtgtgtgtgtgtgtgtctgtgtgtgtccgtgtgtgtgtgtgtgtgtgtgtgtttgagagaaagagagagagagaatgaaaatgaaaacaggccgggcacggtggctcacgcctgtaatcccagcactttgggaggctgaggcgggcggatcacaaggtcaggagatcgagaccaccctggctaacatggtgaaaccccatctctactaaaaatacaaaaaattagccaggcgtggtggcgggtgcctgtagtcccagctactcgggaggctgaggcaggagaatggtgtgaacccgggagtcagagcctgggcgacagagcaagactccgtctcaaaaaaaaaaaaaaaaagaaagaaaatgaaaacgaccatttctgatacctgtaatgcttacgcactccagcttcactgcctgtctggtccctgggtttcctcatcttcagatgctgtgttactttcctctggattctgtaacaaattaccacaacccaccagggtggctgaatagcccagatttctccccgtggctctggaggctgtaatgctggaatctcggtgttggcagaactcggctcccttcgaggccttaggaaggaccctgccttgcctcttcctcgttcctcggctgcctccttctccacgtgggcctctcccacatttcttatccctttcttgtaagtaaactagtaatattggttaagaacccaaactgctgtatacggtatgtactatatgcggcacacagtacatagcttactgtcattttccatttaattctaactttcagagaaaagactatattcaaaatgcctcccacagtaacgggcacacatagtgctcaacaaactagttccctctcttttgccttggggtatccggcaactgtcttacaaatgtaacagtgtatggtggacctactgatggagagacttgttcgtgtatgtgtttgtcttacctcatctacccagagaggtgtcaaaatgtatcttatatgtacggatgcagcttttctgctgcacccagcactccccaggaaacatgagcacgctttgtaaccaccggtaactttcaaatgctgtgcacaggtagagattttcacaggctgtggtgactgcgtgggttccttccatgctcagacactgtcaaaacggcagtcagaatgactcccatgagcttggttgggaaggcacctttacaaacaatacagactagaaaacctttgtcatcccacggaaaacactatcaaacacaacacagaagtatgggttttgcggtttagagggtttttcgataagtttctgctgccaccaacggaaataattatcttcactattagaacgagaaagcagtaaagaaagaatcaagacaaaaagtgactttctcagaaatatttatatacttgagcaaattaatatttgatttgggtgaatctgaatgtatttctccggtaatcgcttcattaaaaataaaactgtgggctgggcatggtggctcacgcctgtaatctcagcactttgggaggccgagacgggtggatcatgaggtcaagagatcaagaccatcctggccaatatggtgaaaccccgtctctactaaaatacaaaaaattagcggggcgtggtggtgtgtgcctgtagtcgcagctacttgggaggctgagacaggagaatcgcttgaacccaggaggcagaggtagcagtgagccgagatcgcaccactgcactccagcctggcaacagagtgagattctgtctcaaaaataaataaataaataaataaataaataaataaataaataagctgtttcgcagaaacagaaaacgaaatgccgcatgttctcacttctaagtgggagctgaacgttgggtactcatggacatcaagacgggaacgtcgtctcatctccagcagcttccagcccagcactggggattctaaaagggaagaggaagggaggggccaaaggctgaaaagctacctattgcgtgttatgttctctgcctgggcagtgggatcagcagaaggtcaaacctcagtgttacacaatgcaatgaacctgcatgcgcacgcccagaatctaaaataaaaataaaataaataaatagaaaaaataaaggcattaaaaataatttttcagctatatatatatatatatatttcatcgtgtttgtgatttggcaagaaaaatcaagagaggtctatttttcagatttgaaagttagtttttctttattcagattccgttttataaatgagtaatttgtgatgtgatgggcagcctttaacattttaactgacaatcagtagatggatttatcatcatgtttatggctgtgctggtgtctgtaaaaatagtatacagataattttttttttgagacagagtctcactctgtcacccaggctggagtgcggtggcacaatctaggctcactgcaacttccacctcccgggttcaagcgattctcctgcctcagcttctcaggtagctaggattacaggtgcactccaccatgcccagctaattatttttttgtatttttagtagaaacggggtttcaccgtgttagccaggatggtcggcttccggtgttgtttcagcatatggctaaattaaaggcttagattctcagtttgctcattctaatttagctgaattctgagtattatgcatttgtatctgaggttccaggcctctccctcctccttctcggggtattaaaactcatgttgccaggtgcatgactgtagtcccagctactcaacaggctgaagcaggaggatggctggggccaggagtttgagaccagcctaggcaacatattgagaccccatctcaaaacaacaacaaccaacaaaataaaaattaaaaaaacacctcatgtgaagagagatctctctgctacccttgaagatcagaataacataagttcaaagtttctctggtatccagtgaaatctgctccttcggtttttttgcattgaccaaattgctaatggtgaggaagtaacgagaccaatggaagatgttatttggcacattaattattggggacccataagctgttagaggtgaaagagacttcagcaatcattccatagaaatgaagctccaggcggggctgtgacctctccccgctcacacggcctgtgagggtggacgctgagcccaggaaatgtaggtctcctgtgcctcagtccttcaggggccaatttaaatgagaagggaagttggatggtagagttcatggaatagcagttcctctgtcaggcctgtgtttctctttgctgccactaacatataagaaagaaacatgtttctgagatgccacagttatcacttaaaggcacttttcattgtattgctgtcggtctgtgctcactgctgacagcaatggcaggctgccatccttggagtgaggacctgtgcttctacttcctgcttcctctgaaccccagcagctgccagcacagcgtctaggagtagtggctgtggacataattaggagtttcttgagcagcctagttaacagccccacagagggcatgatcatataagaacgtcactcatgtcattatcatttaattctatccgaaaagagttaaaatcaacattctggagttaagtgaacagcttgttaaatgaataacatagacataaaatccagtgggtccaacaagcagtgattactatagttaataataataatatcatcttgatgaacaagaacaggaaagagaatacagataagactatcgccatattcacgtcttttgggatcttgctatgtgctctgcatcatgcagtgggctttccttctcaccagcactgtgcaagtaggatattattattattccctttataacataatccacgtgttttacaagtggaaaagaaagacaagacaaacctgctggtaaatattttgaacccaattctccatttccccactagatggcacttttatacctctctttgttccattttaaactcacagcagatgggcagagcgcacttaatttatggtaagtttaaacaaatcctatgtatatataatatctgggaactttaaatcaaataaacggcttccattcaaatatgctttccttttcaaatataacacttgtaaatatctggtccccggacagcaggttcgcctgtccaccagatgctccaggacggcgctgggcccttgctcctgcgctgaccgcccagcccgagccccggggccaggtccacggtgcccacgcgcgctgtgttctgctggggtccggcttagggctgcttcggccctcggcggcttcctctgcgctgttgctgccctccccacacccctacccctgctcactcagctccttcacctcttccctgatgaactggggaacagtatccccaaccttgatcccgcaatgtattgttaaggctgtgttgtatttttaaaacaaacaaacataaacatttgaatgctgaaggcttagtgataataaaaatagtctacccacccccccacatcacatcacaacacacacacgacacatgcacatataaaacacacattcacacacgaaacacacataaaacacattcacacacatgaaacacacaaaacacacacaaaaaacatgcacacaacacataaaatacacacaaaacacacatgaaacaagcacacagcacacaaaatacacacatgaaacgcacatacatatgaaacacgcaaacacacacatgaactacacacataaaacacacagagatacatgaaacacgcacgcaacgcacaaaatacataaaacacagatgcacacacacatacacatggaacacgcacacaaaacacacacatgaaatacacacagaacacacacatgaaagacacaggaaacacacacacacacacggaaggcacacacacatcgggaagcggcgatggtcacgctcactccaagaccccagctccccgcggaggcctcccgggccggtgttcgctgccagccaaacctaagcccgctcctcgcggggcccgcggggcacccccaggttctgtgcagctgaagcttgtaccattttgtgactgtgacacaggaagcctcctagggacaaacttcggtcagcatttgaatcagccctgactcggtgacagtgtctcataaacgggtcagctggttagggacttggaaagagagcggggaaacgggtgagcagaaagcctggggaacggagcccagcggcgccaagtcgccccggcgtccacctgcgcccaccagagagcgccgggcccccgcgagcggaacctcgaaccgcagcctccggagggctgggcccggcctgaagcttacacgcactcccttctcagtcccacttttgccctgtcttcaccttggagcccccgagtttccaaaagatactggaatccagtctcagcctgagcaccctatagcaaagttaggagtcagccccactaactggaggtaagtggatcatgtgggaggcccaggtgtgcagagcccctgaaaagttacagcgtctcc

SEQ ID NO: 428 - DNA, 48046 bp, Homo sapiens
tcagttttactcaggaaacaatgtagctagcatatgcaacggactgcatcagcattagaggatgaaaatgtaaaacacgctttcctctttcaaggcactaaggtgcttgtggagatagtcataagcagaacttttcaatacactgtgagacacagaaagacaaatactgcatgattacacttacatgaggtaactaatatagtcaaaatcacagaatcaaaaagtagaatggtggttactgggggaggaagaggggaaaatgaggagttactagtcaataggcataaagtttgagataaactggattaataagctctagagatctgctgtacaacattgtacctatagtcaaaaatactatattgtgcacttaaaattttttatagggtggatctcatataagttttcttaccacaataacgtttttgaaaaacccaagttaaaaacaaaaaaaaagattttgttcaaacaactatatatatatgtgtgtgttttatatatacatagtacaaatatatattaatatatgcattattaattaatatgcattattaaatacacaattaaaaggcattattaattgaatagtaattaatatatgcatatataatatatatgcatgcatgttatacacaactgcatatataatatatataatgagaaatgacacaatgtaaatgtgttcaaggagggttgatgagcatatcatccaatctggaggaaggagagtcaggaatggtttcctgaaagagatgactgtgatctgactctcagtagctgagtgagagttgttggggatgagtataacattcttggcagaagaaatcaaactaccaatatgcagagatgaaaaagcacattttgtatgaagagaaatattaagtaagcttatattgttgaggataaagagcacactgtaataagagcaatgtgatagaaaagagacaatttacagaggacctgcatgctagaataaaaagtaggcttgtcctaaagagaatgcagagattttgtagggttttagatagaatagagatgaagaaagtttgcatttagtagataattctgaaagtcatgtgaaatatgattcagagaagaagcaagactagaggcagatagataaatttggagtaggctaatttcattagtccaagagtaagactatgagaacctgaaccacagtcatgatagcaaaaatgaaagaaactgtaaattcaagaattatttcagaggtaaaattagctggatttagtgattgaataaaagtggtataggaaccaagtggataaaggaatcaggacaaaagccaggtttataaccttcatgattagatgaatgattatatccatagcaagaggaggaagagagagagagagacagagagagaaagaaaccaagacagagagggagagaggcgggggatgcgggggagtggtaacataaattcaatttttattacttcactttcatgaagttacatatgagtctgaacctgtgagaagagttttgggaaaagatgtggattgagaagggcaaaaagcagatgatgaaaccctaagtagtgcaaactttatttaatgggcagaagtaggagtaaaaagactacgtacaaggtcaagaatagtaatcagaaacgtagaagcataaccaggagaaagtggaatgatagaagccaagaaaaagcagttttccaagaaggagggaatagtgaatattcactgccacagaggcacctagtaaaataaaggctgaaacatacatgtgttcccaatacatgttcccaaacatatatgcatttcagattaaaaaaaatgaataataagtatagaagacaattttcagttagttgagaagttatttactccgtattatttcttgttatttatatttgtttcatctgtatctttctattgtatcgtttttaaaaattcagacttttatatactacttttgtatttcctagttcattaaggtttatatttagttgtattaatttcttcctttttctctttggctttctttgttgttctttctctagtttacagatttatttgtttagaattatttattctcatttttatattgattgatatatttgaagctaatattttactctgattactgctttagttaatatcctataaattctgatatgtgatgttttctttattgttttctagaaattctgtcattttagtttatatttattttttgaccccagagttgcttaatagaaagtttgtacatttccagggaaaatagcctttctattttgcttaagttttaaatgtgttgcactatgatcagagaatgtgacctatattaatttatttggaatttaattagattttctttatgacctaacatatatggcaagtatttatgactgttttatgtgtgcctaaaaataagtgtattctttattattagggaacagtgttgatatagatccataaggtataaagtattgattgttagaatcttctatatctttgactaatattttgttcacttgaaatcttttagataataaattttattaaattttcttcctatttcctgtcttataaagtttctgctttatgaaatttaccattacattaatttattatggatacttataactgaattgtgtctccttttgcaattaaggttttataaaaggtccttctttgattaatttattgtttatggcaggattttcactttgtcaagcccagtatccttgatattttctgttgtttaaattggttgtacttttaaataatgtactttttttaaaaagtacacttatggtacagtacacttaattaaaatttaccatcctaaccatttttaagtgtatagtttagtggcattaactacattcgcgctgttgtacaactgtaaccagcatccatctccaaaattcttttcctcttgtaagactaaagctccgaacccattaaacaacttagcatttccctctccttccaattcttggcaaccaccattctactttctgtccctataaatttgtcaatgctagctatctcatatgagtaaaataatacttttaatgcaatactatataatatagtaatattttcttattgtaactggcttatataatttaacatgatgacctcaagttgatgtcttactgtggttttgatatacatttccctaatgattagtgttgggcatcttttcatgtgtttgttggccatttatttatcttgactgaagaaatacctatttatattcttcactgtttgtttgtttgtttgtttttgagatggagtttcgctcttgtttcccaagctggagtgcaatgacacgatctcaggtcactgcaacctccacctcccaggttcaagccattccactgcctcagcctcccaagtagctggtattacaggcatgtgccaccatgcccagctaatttttgtatttttagtagtgacgaggttttgccacgttggtcaggctggtctcaaactcctgacctcaggtgatccaagtgccttggcctcccaaagtgctgggactgcaggcgtgagccaccgtgcctggcccctcactaatttttatattctgttatttgccttcttattttgagttatgagagttttttatatattctggataaaaatcacttatgaaatatatgatttttaaatattttctccgcttttgtgggtggctttctcactttgctgattctgtcctttgatctttactccatgtacttttttctaccccttcttttctttttaactattttgaagaagttagttttagttgtgccttttgcacacaacattgagctgggttttgctttggaaccaaataagaaaatgtttttctcttctaatagaagatttaagttctttataagaattttataggttttttaaatatctatagtgtgtgcagatacagctttttaaaacttttcactatatggtctgctttcgttgctcattatattgctgctattgctgctgttgcagtagtttttacatttattttgctatttaggaagaagggtatttttaggtagtttatttatgctattattttaaaataatatcctacttccacaggttttgggcaatgtctatttgttatcataaaaaataaaataaaattggcttacaacttctttctttcgtctccttctttccaactcctccatcatctaagtttattcaatgttaagatctttcttggtgtttatattggttcttttaaatatgtttagaattctactattctatttcagctttaaattttattatttgactcccacctataacctatgaaggaagaaatgaagggaaggaaggacagaaaaaagaaaagtaaaagaaagaatataaggaagataaaaccattgaaaagtccatcagtgaaagaataattaaataaattatgttacccccagcttataaaatgctattcagttattataaagtcaacctgtatatgttaacattacaattgcttattttattttgggtgaaaatataagtcctacaacaatatatacactatgatacataatatatagcccacttatatataaaaaccaatgtgtatataaatacatatttaagtgtgtatatttacatctgggaagaaacagagcaaactctttacagtgctaatctcaggaccaaggaagtagatctgaggtatttgagagaataagggaaattatatcactaatgttatttacatttgtattgtttggattgtcttacaatgtcaaagagctgctcctttattttaggaaaataataaattactttaaaattgtaattttaaaaatatcttgtcatagagtaatttacttgatgctaagtatacacattaactgaatttgtattttctcataaattgtttctaaagtacataatgacaaaatgcctgtcaaattgaaaccttgcatattgtctaaaaactagtctttcatttaaatttgagaagtgtattaggcaaactgcttctcagttttggttagactttttacgcttcccattgcctccattttttctcaaaggaatcaggctcggtttccctgaatttgggtttaatgtgtaatgttctctagcattttgatctttctttttcttgaagaaaaagacagatatcaataaattcttaacttctctttgagaaattaaagtttctctgggcagaaccaggtagcatccttctaagctttggaataccctggggcaatcaccatgttagtgattctttgatctttgacttagtgtcctatgctacaaggatggcacatcttctaagcaaagtttgctttcatattcatcagaataaaatttatctcacaaaataaaactatttaaaaagcaaaatggtaattattgtaacattattttcaacatctcacaaatctaattgaagtgataattcaatgaagctattacaatttgccaaatcacctggctagattgtgccttttcatcaagctatcttttacttctgccatcatctcactttctacatgactttttcaaactttctcccctctcctcagtccttcaacttgtctcccacgatagccctccacaggggaaataaaaaacacatgacatgaatgtgcttattcctgccacaaattcacttttcctagccaagggccatccctttacttatggcactggtcccatctcttcttattttttcaagaatcttctacaatctgttatgcaatattttctcaacatcttccacctggttcttcattctaatgtaatgtaaacatgctcaaactgttcaaatttctcccattttattaaaacaaaaatcttctttatgtatttcttttttctttctttttttttttttttttttttttgagatggaatcttgctctgtcgcccaggctggaatgcagtgactcaatctcggctcactgcaacctctgcctcctaagctcaagcaattcttctgtctcagcttcctgagtaactgggattacaggctcatactaccacgcccaatttttgtatttttagtagagacagggtttcaccatattggtcaggctggtcttgaactcctgacctcagatgacccacctgcctcagcctcccaaagtgctgggattataggcttgagccacagcgcccggcagacctcctttatttctatccctccattcactgtcacacatattggcaagctcactacattcatatttctgattttttgtaccttacatttattcctcatcctactctcgtctcaatttcctactggatgctctttctttcaaggtaatcaataataaccaaacagcatttttagtccccatctcttctgcttttcattcaaatagtttggccatttcttatcagtttcctttgttgtatcttgtcctattcccaaacactaaactttggtgcctcaaagccctgaagtaggcctacatctatcttcaccctgaaaaactcgtctattaccttagttttattaaacacctactgacttatgactccaaattatgcctagtgctctgttctgatacccaggcttatgtaactgttacagattgagctacccagggaagtcagccttgagatggaaattagcagacaagaggactttcagggagtattcttgggcttcacacctggggaagggaaacgaaggaagtcaaaagggagaagttgagttgcaatgtcatttcaaccagaggccccagtcaatactatgaggaactcagaagctgaaattactctttagaactgtcctgagtttgggtgaggagccttttctttataagtcctgttgatcaatcattagtgtaggccaacctgggaagaagctatgaccttagggaaagaggctcccttaagctgaggcaaccccttttagggaactgataagtgagagctcccagtagctggaaaagtaagtctttgtgtttctgaaggaaatctaggtggttcatcaaagcatcaaccataagaatcaagtgcttcctcaagaatcacttgaacctgggaagagaaggttacagtgagctgagacggtgccactgcactccagctctgtctgggtgacagagcgagactctgactacaaaaaaaaaaaaaaaaaaaaaaaaatcaagtgcttacttagtcttttcactttcctatctcacagatacctcaaaagcacatttccaaaattattaataaaactcttcatgctaatccccactccctcccattgcttctccttgccattcttcctatcatatttagatagccacttagtcaagccaaaacctaggagtcctcctgaactcttttctctgcctcactgtcccccacatctaatcaattatcattataatgatgtcacatcctaaatatcttatttcagcctattttgtaccatcctgctgctgccaccggtgtaagtgactaccttatctttgccagatgactgcctcgttttcctcagtgatttctctttgcccacactttttgcccttcagatcagtctctccatattacagtcagtgatgtcttttaaaaattcccagtaagcatcgcattctatttagtgacttccaaaatctttaatttgacctacaaaggccttcacaatcagggctccaacctctccaagtttcgcatactcctctctgtccttcactcctttccactcaatccatactgggtttttattagcttcttggaaatgtcatgttctttgctgtatttcatgttctttctctacatgaattcttatcatttctcccatccaatctcagcctatatgtcacttatatatcacttcctcactgaagactttttaaacacccagtactaggcagtatcatctggtgtttactgacaaagatggtgtctttgctgccatgccttattttgtaaggatttgcttatatctttcttccgctccgagagacaagctccacaagagcagaaacagtctgtgtcttattcattgttttattttcagtgctcggtgtaatgcctagcatagagtatgagctttgactttgcaaatgccattccttctacttgaagtgtgttttctagttttgtaaacctcagatttactttaacttttttccaagaagcttcctataccacattcatacaaaaaaaaaaaaaggttaaatactacctactttgtgccaccactttacttcgtacatgcttccactgttgcacttttcaaaatttttatttctttagcatgtggagtttactttgagctgcactgcctaaataattttttatctcctcgcaacatataaaaatcagtgcatttcacaattaacaaatcagaacatatggcaatactggatacaatattcccccatgacaattattcaccttgagcgaagtagttgtccaggttaaacagtgcatgccatctccagttcactagaaatatcactagataagccacaatcatcacccattttgagtctgcaatcactagtacaagtttatctcttttactaagtaagtagttttttactttgtgagttctttgaaataacgaggtgaattttaatcattttgaatcctgtactacccagcatgttccctgggatatagcaggtgctcaataatgttatttaattgatagattgggaaatttatttaaaaagattaatgcttttctgttgatatttaattttaattaaatttccatttttatgagatccactgtgggaacctactacaggagattaattaaaataatgaatatgaactcaaggacagttctgaaatatacatgtttaacattgaatgaattaatacttatttaatccacagagttaggtcagctgtggcatcatttccaaaagaagctatttcatacccagcagtagagaattgtacattgggcatttgagaatatcatcgtaatgagaaactaagatcttgagttagaaaaactgagtagtttctagaaaggaaaactcgttctaataccaacaaccaatcctaatcggggtcctagtatctgggtactagtgctattacatatgcttatgaatgagctgaaataattagaagtataactctcacttcaaatgaaaaagtgacagtgttgctgtttcatgtctctaacagaccttgataatactgacactcattttttgatgcttgtagaactctcttatttcagattttgtagtctgcataattccaaaaattatttgatataaaaaaagacttgaaagtgtaaaatgtaaaaatgccaagagtcctgggaggccaaggcgggtggatcacatgaggtcaggagttcgaggccagcctggtcaacatggtgaaaccttgtctctactaaaaatacaaaaaaaaaaaaaaaaccgtagcgggcgtggtggtacacgcctgtaatcccagctacttggaaggctgaggaaggagaattgcttgaacacgggaggcaaaaattgcagtgagccaagatcatgccattgcactctagcctgggcgacagagcaagactctgtctctaaataaataaataaataaataaataaaattaaataaaattccaagggtcattctttctttaattgtgtctctttaacaatatttgagcacatgttcaaatatggtagtacaccacctcataaacaatttggttattaacgttgtagcaaatattacagttaattttaaaagttttttacatttagaaagtctgaagggcagtctcttctgcctttaataaggcagatcctctaatacagcatatagtttcttatctctagtgtgtttggccctttaatagtgacataaactttgaattaagggtaacaaaagccttaatattaataaagatgatgacgaatgtgaatgtgaaatttttgcacatacagtatattgaaaacaactatatagtctagtcaatgggcattaggaaatgaaaatatgatgtgtagattaatttgtaacagatggaagacatacaaaagagattaagttctacatcaaatcatacaaactaaaaattagacatttattggttttcatttataaataacgaaatgttcagcacaaataatttagattcaaatatttaagcaaggaaaaactccgaagtttttaacttatttcctcaaaattatattttataaggaatttcatgatgtattgaaatatgactcctctttctgccattcatttctatgttcttaagggttcttgataagacagagtgcttgaggggaaaaagagagatttttgaaataagcatcaattgcagtcaggtgttaattacaatctcagcctttcaatttttcatataatgagtcattgtttttattaagtactaataagaataaatgatcttacttagtaaataataccaccagttcccttttaaaaatgcaatattatttactacactactcatgattttttaaatattttctacgtgtttacctttttctcttaaaagtgagaaattcatactgtaccaaaacatttaaatagcatataaaattttttccaccctgatgctaccacaattagaaataaaaataaaaatttttcccactattgtgtgtcttttaaatatttttttactagagtggtcaaagcatctaaaaaactgactttatgtagttcatacagttcattgtttgcattttttaaaacaggaccacatgcactttgccactacttatatttttaatattcttagttgaacaaaaaatataatttccattttttatatatagtgtcttcaaaaagggttaaaattgtgatcctacaaaatggtttacatcattttattatacttttttaacatttctctaagaaaattgttaaattatttcctgtaagtagcagaggatatattttttaaactgtcatatgaggaaacactttagtatgtaatttccaaaagttacacaaaaatgtggtcctgaaaataaataccacattttccaacctttattagtagtgcttgaacttatattgagaagtaggagaaagtgtgatttttgtccttatcacagaacatataggttaatttttgcacattgaaatattgcacgtataaattggtttatttttccatttgccaaagtgtcacaaatatcaaatggcaaacgttgctttcacttcagacaattcagaaggcctgttgaattgattaccacttccagttgtttgtttggtgtaaaaaaaatgaagaaaatattattattttttctttgcaattgccataaagtatgagtggtatagaacataacatttctgaaatgttgaataacaatctgaccaaaaaaaataatctgaccaaaaaaaaaaaacttcttacctttgtcttggaatacatcttggatattttaactgccctctgtcacattgcattctaagtatagatccagtaatatataattcagctggataagtatctcctctacaaataaactcaatatattcaccatgcaaaatgtgtggtctattgtcaaaatcccatttcagaagtaaattattcttttccatttcagtaaaagataatgtgcatggctctgggaacaacaatttaaaaaaaaagaaagaaaaagaagaaaactatcttgttacatcttggtaagaacaggaatcgttgtgttgcctactcatgaggaccttaaaattctcaggcctaagagcagcaagtcagttaatcagaattaatatttgagtcagaaaatatgttcaaatctcacagaaaacagtgagccatttctctctgtggtcctggatttggagaaaaggtattttcttccagttttaaaaactaaaaggtattttagttttatgtcattagctttttcaaagatagcaaacaaacaaaaaggtatttggggggaagcattgacagttactaatggtcattgatatcatgctcttttcccttttccttcttcagaaagttcaaataaaattctcatgagacaaattattaattgctgtataaataacattttatggaaatgtagattctcaacactgacccaagctttataacctcatgccatccaaaatggttgacagttacttctctttcaaatttctagttaagaaatatcaagactggattaagacgttttaaattctaagcatacaaagtatagttgtgtcctttcccatgtatcgtaaaccaaagagaatggtaaagtatgtattaaaatacacaaaaaaacctcttcgattttttttacagaataaaaacattaatatttctaaaatatcaaatatcaaattatttcagaaaatgggatttcttatgtccttatttgtctcctggatgacctagcattaaggaataacttctgagacaggtaaaaaggtccagagttgctaatatggcatatcaatcatatacctgtagtacattaacaaacttacttacagtatgcccctccctgattgcctacaggggatacatttcaagagccccagtgcatgcctgaaaccgcagataatgctaaaccctgttgtcattcttttggaacatgtttctgttcatgtcttctgcccacaaatttaatgcctcttccacctcaactaaacatttattatacactgtggcttgtaacttttgcagtttgaggtgcaacaacgaaactagcatggatttctttttccttcttcacactttcatagacagaagactcattgttaccatggatcttagcaacctcagcatacatttatttttcctttctttttaagttaagaatttccgccctttcacttaaaggaagcactttacagcttctttttagcatatctggggcaggaaggatggaatggcatgaaattttattatactactaagtgcataatttaaaatttataagttgtttatttctgaaattttcaatttaacgttttcagactgcagtttatagcaggtaactgaaaccacagaaagtgaaaccgcagctgagagcactgtgttcagttactttcttcaacaactacttattaaatgcctatgtgtcaaacattatgctggaagtgctacaggtgatgaaaatgaacaagaattattacactcattacaaaatagttgtgaaaatgaagtcgaatagcactataatttacgatgtcactgttctacagaacatgagatttaaattaaaataaatttaaaagttgattcatggacctttaactttcagctatgacagaggagattatatcaaaccagcacttctattaagaaccagaaaatctgaaaaacaggaagcatttcgaggtatcagaaaacctccaaggaacttagtcaaggaagtaaggttctggaaaaaatgtattcaggtgagttcaacatctatgtgaggctgggcgtggtgactcacacctgtaatcccagcactttgggaggccaaggcgggcggatcatctgaggtcaggagtttgagaccagcctggccaacatggtgaaaccccatctctacaaaaaaaaaaaaaaaatagccgggcatggtggcatgcacctgtaatcccagctactcgggaaagctgaggcagaagaatctcttgaacctagaaggtggaggttgcagtgagcagggatcgcaccactgcactccagcctgggcaacaaaaggagactgtctaaaaaaaaaaaaaaattctatgtgccatttttttctcttgaggtgtttgttgactctaagtctgacctgagaggttagatgatagagaatggtaagcttaggcatacagccagcagaacttctgaaaatctcatggagttgaagatagaaaaatgagaatttcggtaaaccaaagcagccaggacttgaagaataaagaatttagaaggataggaagtgtagagatatgagtttgaggctctgcactagcttttccctaaggtactgcttatccttgacttgtatagaggcataggatgagaagccaagcagaaagtaaataaaaagttacagtgggcatttggcagtctcccagtaatatcagagacagtcaaggagaaaaagctttaatacacacaacaaaccctctgtaaagagccctggagagttacagtctgtgagaaaaggcaaacagaggtctgaaaacaaacatagagaaagctttatttctaattgtattaaaaccaactgcctctacactaatcatcagccagaggatgagatgagtcttctttggagtaagctgacatcatccaaacatcctgaaattttccacgtataatatttggaattcaatcaactgttaacaaaaatatcaagaatttggggctaaaaaatagatccagatattggagtttgcagacaagccttaataaaaagtatgaattatatgttcaagaagttgatgttaagctaggatctttcatcagataactcaaatctacaaaaagaaaatataaaatagaaatgcaaagatgataactgaaattgagaactcaaaagatgagtttaaagcagattggatacatctaaagagaggattgttaaactagaagaaaattaccaaatagaaacaaagaaatgatacaatgagaaaattaccaaaaaattactacagtgaaacaagaagaaaatgagagaaaatatagatttaaagagacaatggcatagcaaaaagatgtaatatatgtaatatggcatcacagaagaggtgagaaatgtacattttaaaagatattagccaaacatttctaaaacccatgaaggatatcaagtacatcaaggttcaaggaatgctactaacttgaagaacaaaatgtacaaagagagtctcattgtgttgcactgatctccctgggagctgcagaccggagctgttcctattcggccatcttggaactaactcatatatatatatatttatatatatatagagagagagagagaaagagagagagggagagatttgtttctgatttgtttctaaggaactccagcctgggcagcacagtgagaaatggtacactcctgaccaaatactgtgcttttcccaaggtcttagccaccgacagaccaggagataccctcccttgcctggctcagcagtttccacgcccatggagccttgctcactgctagctcagcagtctgagatcaacctgtgacacgacagcgttatggggggagggtcgtctactattgctgagcaggggttacaatcctagtctctgataaaacagactttaaaccaacaaagatcaaaagagacaaagaaggccattacataatggtaaagggatcaattcaacaagaagaactaactattctaaatatatatgcacccaattcaggagcacccaggttaataaagcaagtccttagagacctgcaaagagatttagactcccacacaataataatgggagactttaacaccccactgtcaatactagacagatcaacgagacagaaggtaaataagaatatccaggacttgaactcagctctggaccaagcagacctaatggacatctgcataactctccactccaaatcaaaagaatatacattcttctcagcaccacactgcacttattccaaaattgaccacataactgcaagtaaaacactctttggcaaatgaaaaagaacagaaatcacaacaaactgtctctcagaccacagtgcaatcaaattagaactcaggattaagaaactcactcaaaactgcacaactacatggaaactgaacagcctactcctgaatgactactagataaataacgaaatgaaggcagaaataaagatgttctttgaacccagtaaggacaaagacactacgtaccagaatctctgggacacatttaaagcagtgtgtagtgggaaatttatagcactaaatgcccacaagagaatgcaggaaagatctaaaatcgacaccctaacatcacaatgaaagaactagagaagcaagagcaaacacattcaaacgctagcagaaggcaagaaataactaagatcagagcagaactgaaggaaatagagacacaaaaaatcccttcaaaaaaatcaatgaatccaggaactgtttttttaaaaaagataaacaaactacatagactgagagcaagactaataaagaagaaaagagagaagaatcaaatagatgcaataaaatataataaagggaatatcaccaccaatcccacagaaatacaaactaccatcagagaatactataaacactctatgcaaataaactagaaaatctagaagaaatggacaaattcctggacacatacacccttccaagactaaaccagaaagaagttgaatgtctgaatagaccaataacagggtctgaaattgaggcaataattaatagcctacaaatcaaaaaaagcccaggaccagatggattcacagccgaattctaccaaaggtacaaagaggagctggtaccattccttctgaaactattccaatcaatagaaaaagagggaatcctccctaattcatttaatgaagtcagcatcatcctgatatcaaagcctggcagagacacaacaacaacaaaaaacagaatttagaccaatattcctgatgaacatcgatgtgaaaatcctcaataaaatactggcaaaccaaatccagcagcacatcaaaaagcttatccaccacgatcaagatggcttcatccctgggatgcaatgctggttcaacatacacaaatcaataaacataatccatgacataaacaggaccaatgacaaaaaccacatgattatctcaatagattcagaaaaagccttcgacaaaattcaacagcccttcatgctaaaaactctcaataaacaaggtattgagggaatgtacctcaaaataatatgagctgttcatgacaaacccaccaccaatatcttactgaatgggcaaaaagtggaagcatttgctttgaaaactggcacaagacagggatgccctctctcaccactcctattcaacatagtgttggaagttctggccagggcaatctgtcaagagaaagaaataaatggtattaaattaggaaaagaggaattcaaattgtccctgtttgcagataacatgattatatatttagaaaaccccatcgtctcagcccaaaatctccttaagctgataaacaatttcaggaaagtctcaggatacaaaatcaatggcaaaaatcacaagcattcctatacatcaataatagacaaacagagagccaaattatgagtgaacccccattcacaattacttcaaagagaataaaatacctaggaatccaacttacaagggatgtgaaggacctcttcaagaactactaaccactgcccaacgaaataaaagatgacacaaacaaatggaagaacattccatgctcatggataggaagaatcaatatcgtgaaaatggccatgctgcctaaggtaatttatagattcaatgccatccccatcaaactaccattgactttcttcacagaattggacaaaactactttaaaattcatatggaaccaaaaaagagcccgcattgccaagacaatcctaagcaaaaagaacaaagctggaggcatcaggctacctgacttcaaactataatacaaggctacagtaaccaaaacagcatgatactggtaccaaaacagatatatagaccaatggaacagaacagaggcctcagaaataatgcacacacatacaaccatctgatgtttgacaaacctgacaaaaacaagaaatgggaaatgatttcctatttcataaatggtgttgggaaaactggctagccatatgtagaaagctgaaactggatcacttccttataccttatacaaaaattaactcaagatgcattaaaaatttaaatgtaagacctaacaccatacaaaccctagaagaaaacctaggcaatatcattcaggacataggcattggcaagtacttcatgactaaaacaccaaaagtaatggcaacaaaagccaaaatagacaaatggaatttaattgaactaaagagcttctgcacagcaaaagaaacgatcatcagagtgaacaggcaacctacagaatgggagaaaatttttgcaatctatccatctgacaaagagctaccatccagaatctacaaagagcttaaaaagtttacgagaaaaaaacaaccccatcaaaaagtgggcaaaggatacgaacagacacttctcaaaagaagacatttatgcagccaacagacatatgaaaaaatgctcatcatcactggtcatcagaaccacaatgagagaccatctcactccagttacaatggcgatcattaaaatgtcaggaaacagcagatgctggaaaggatgtggagaaataggagcgcttttacactgttggtgggagtatgaactagttcaatcattgtggaagacagtgtggcgactcctcaaggatctagaactagaaataccatttgacctagtgatctcattactgggtatatacccaaaggattataagtcattctgctataaagacaaatgcacagatatgttttttgcagaactattcacaatagcaaaacttggaaccaacccaaatgtctatcaatgatagactggattaagaaaatgtggcacatacacaccatggaatactatgcagccattaaaaaggatgagttcatgccctttgcagggacatggatgaagctggaagccatcattgtaagcaaactattacaaggacagaaaaccaaacactgcatgttctcactcataggtgagtgttgaagaatgagaacacatggacacagggcagggaatatcaaacaccagggcctgtctgtgggggtctgggggagggatagctttaggagaaatacctaatgtaaatgaagagttgatgggtgcagcaaaccaacatggcacatgtatacctatgtaacaaacctgcacattgtgcatatgtaccctagaacttaaaatattatatatatatatgtgtatatatatatacacacacacctatatggagagagagagagaaagagggagatgaccaatgggatatacatggagtatagtaacatacacctagtatagaaagttggtagggttggtaggtataaacagaaatatattagtaattacatgaatatgtaaatagactattccattacaagggaaaaaattataaactgcataagtatattttaaaataaggtatatattgcttataagagaggcacactaaaagtaaaaacccagaaggttgaaagttaagggatggaaaaatgtgtactacatgaatgcttgtcaaaagccccttggtgcagctaaaggagacctcaaggcaaaaaaaaaggcaaagcattactatatatgaaggaggtcttttaaaattagacaatgccaatacaccaagatacgaagatttagtgtctcaatttgtgtgtgtacctaatgaaatagtatcaaaatacaaaagcaaaaatggacagaactaaaattagtaatgttttaaaatgccaagtgagactttaacatgcttctctccgtgattgatagaaaacaaacacacacaaatcagtacagctttggattaacttaaacatcaaaaacaaaactcaatccaattcacatatataaaacagtgaacccaacaatgacaaagttaacttttttcaagtatgaaaagaacgtttacctaaagcaaatacatgcttgttataaagcaaatatcaacaaattttaaagtgcagatataattcaaagtatgtcttaattgaattaaactagaaatcagtaaccaaaagaaaactagaaaatcccctaaatattcagaactttaaaaagaaacttctaaatgattcagagcacagagaatatatcaaaatgaatactataaaatttttgagctgaatgacagtaaaaatccaagatataaaaatggtttggatgaagttaaagttgtgctcagagagaaatttctatttttaaattcatgtattagaaaaaatataaatgctgaaaattagtaatctatgtattcatctaaacaagccagaaaaagagtaacaaaagaaatccaagaacatagaagaaaggaaataataaagataatagcataattaataaaatagaaagcaaaatttgatgaatcaacaaatgcaaatgttggttttttgaaaacactaataaaatgtatagacccttagcaaggcatgtcaagacagatacatattaatagaagtaataacaaaagatacatcaataaaaacatcaaaaagaggataggaagatgtcataactactttatgttagtagatttgacaatgtagttgtaatgaaccatcaagaaaccactccctaccaaaactgacagaagaagaaataattaccattatttgttaaacaaatcgaagctgtcaatttgtcttttcacggaaaaactcaagtcccagatggcttctctggttaactcttaaaattataaaggaagaaatagcatcaatccagagaaccagaaaagacggaacacttcccattcatgggatgaggtcagcacagacttgatatcaaaccagaaaggaaaataaccaaccagtctttctcatgaaaatagatgagtaaaatattgataaataaaaatataacatataatatgcataatttatcacaaccttgtggaatttcttatgggaatagaatcatgctttaacattcaaaagaagcaatataattcattaaatttgcaggggaaaaaacaaaagtaataattatgtaattatttcaacagatattgctaaaaattaaacacagattgaagattctttaaaaatactttcggcaaaatagaaagaaaggtttttatacctttaacttgatttttaaaaaaatatttataacaacacatagaggtgaattatcaaaggttttacttatgagaatgggaagcaaataaagatatccactacctcttccattcaacattgtactgaagtcctagccagtgaaagaagataagagaagtaaataaaagtcagaattggaaataaaaaatattttcttattatttacagatgtgctatttcatgcctctgagggccttagtaaatgttgttactcttactaggatgccttgctaataaaacattaacttgcttcatctttccatattgagttgtccatttctttatttccgcattgttttctattatacatgtttccctaatgttttctattatagtaccaatcacaatgaatgataattgttaaagtttactcacaccactatggcttattcaacttatagcccataccaacctgatgtgtggtttgtctttaaaaaaatatgtattacaacaaactgaactataggtatttatgatctagaggaaagaatagaaagcagtgataaaataagcacatgaataaaataacacaaatgtagcaaatatagcattatattagtgttatgttaactcaaaaatgacagcaaattaaaaatatatagttttactttgttagaggcatatttagtagtacatacctaaacacaatggtggtgtagtccacattccatctaaacaataggcctccctagatccttctaggaaatggtgatcaaaacatctgtattctactgaagagccattttcataggtgtctactgttgaactaataatgactccatgtttaataagaggaggagatgtgcacattcctttagattctgcaaaaataagttttaaagtatacaatgaattgctataatgaacatccagtactttataagtgctacagagacagagtctccctctgtcacccaggctggagtatggtggcatgatcatgactcactgcaacctctgcctcccaggctcaagtgatcctcctgtcttagcctcccaactagttgggactacaggtgcatttttcttttgtagagacagggtctcactatgttgctcaggttggtcttgaattcctgggctcaagaaatctgcccaccttggcctcccaaagtgctgggattacaggcgtgagccactgcacctagccataaagccattttttaggcagttctcaaatatttttaaaatattgaagatgtttttgcaataatattataccatacaatgtatttttataattagaatcccacgttatagtgtttacatgcatatttaaaactatgagagtattaacaatcatgattttatttctccctaagtgtatatgggatttttctagaagccatgatttctgtatatattattttccttttcttccttattaaaagtaatagtccctatagccagtgagtactgagacaatgggtccccagaaagccctaagtagagcaatgctttacagtgtttgttgttgagtgctcacaagaaggtgatcaattctctgatagtctggcaacatttataaaacctcttgattttttcccttcataaaattgacttattggaattaaaagatgtcagcatggccatcctatataggtatatatgctgattgaagtttggaagttggatcactcctctcaactttatagattagaatatgatggtggtgaattggggtcataggtataaattttctctaaagatcagcgatgttgagctttttcctcatatgtttgttggccacataaatgtcttcttttgagaagtgactgtttatatcctttgcctactttttgatggtgttgttcgtttttttcttgtaaatttgtgttaagttccatgtagattctggatattagacctttgtcacatgggcagattgcaaaaattttctcccattctgtaagtttcctgttcactctgatgatagtttcttttgctgtgcagaagctctttaggttaattagatctcatttgtcagttttggctctcatcgcaattgcttttggcattttcgtcattaagtatttgcccatgcctatgtcctgaatggtattgcctaggttttcttctagagtttttatggtttggggtttttacatttaaatctttaatccatcttgagttaatttttgtataaggtgtaatcacaatgagacaccatttcacaccagtcagaatggcaattactaaaaagccaagaaacaatagatgctggtaaggctggggagaaataggaatgcttttacactgctgatgggaatgtaaattagttcaaccattgtggaagacagtgtggtgattcctcaaggacctagaaccagaaatgaaattcgacgcagcaattccattactggaattgcaaaccaccatggcacacgtatacccatgtaacaaacctgcacattctgcacttgtgtctcagaactcaaagtaaaataaaataaaataaaacaaaattaaaaagaataataataagaaaaatagcaacaaactataaataaattttcaaccgaggtagcagatattggtcaagtaaagatacttgcagagaacattattattttaccttttctagtacataaaggatatttcacttctcctctgttgcactgcacagataattcagacaatggggttaatggagataagtcatatccctgtttacatacaaaatctattaaatctccatgtaagactttcccttcatatttccacttcatttctatgttatttctgttcatgtaatccacattaacagtacatggttctgtaaaacaaaatgctcttttaaattctttacttgtctgacaaatataaaagtgatattttttaaaacaaaaattatgacaagtttcaaaagcaatattttataattgaaatcataattaaggcttctctcacacacatatatatataagaaaatatatactttattactatcaaatgaatctatacattattgtcataaactaaaaccacttaatttaaaacatcaaaaatactatttaagggcatcaatcagttagattaataataattttctttctataaaataaaaacctttaactaccatgtagaaaataatagaaaacctgctaatgaataaaaccaagactcctgctcccatggagcttaccttctaactgggagaaacacctacaatacataataaatataataaagacatgaattgtataatttgtggctgatatggtttggctgtgtgcctacccaaatctcatcttgaattgtagctcccataattcccatatgtcatgggaggaacctggttggaggtaattgaatcctggggtgggtctttcccatgctgttctcattacagtgaataagtctcatgagatctgatggttttataaaggggagtttccctgcacatgctctcttgcttgccaccttgtaagacgttccatgcttctcctttgtcttctaccatgattgtgaggcctccccagccatgtggaactgtgagtgcattaaatctctttcctttataaattacccagtctcaggtatgtctttattagcagcatgagaacagactaacacagtggccatctttaaactacagcataagataaattagatgaaaaaaagagtactggagcaggagggggtaacaaaagagctaggtgaagagaagttgcacttttcagtaaggtgattagggtaggcctaaataagaagtaaaaaagcttgaaggggactttgcacaaaagcttgaaggagactgagtgaaccatgtcattttcttatgaaagagtgtcccaagcaaagggaacaaccagtgcaaaggccctgaagtgagagcattcttggcttgtttgtggaagagtaaggagaccagaaagactggagtgattagagcagggaagagagtatggagaggttagagagactcttaatgtctggaataataattcctacagagaaaattctatgctttatcatactgttgtgaatttgtactgatagcctttccagtttcaatagttaccaagatatacaaagcccctttctcttgccctgataacaatgattaatcttcatttggtatttgctttgattcattaggaccaaacctaactctcttgaggcagttgttccagatatagaatgatgtatttccttaaatgttgttatttccttatgagcttgtttcattaccagctttgccataaatattttaatctagtctttgtccttagagattactatatctccactcaatgcaatatcaaccaaagcatcaaaaacttaatatcaaaaacatttataaaaatatgagaccaatagcaaaattctatgtgaatatgtatctgtatctgaatttgaatgggaatcgactcctaagaattacttgaaaggtggaaactactaacaaaaggttgaaagagctcaagacttaaaacatacacttatatatacttaaaaacactataaataaaaataaattaaaaataattgcaataaacatgattctcaattggataaaataatttatatatagatttataagtatgaaaaaatggctaaactatgaataattaattcatgtaaaaaaacctgtggctactagaaagttaaaaaattccaaattaattaattcttaaataaatcaaattaaaataattgtgcttgcctgcttaacaaaaaatgtcaagattaaaatattcaaagttaacaaagattaggatgattactactttaattcacttatggtagggttaacaaagcagaacaaactttctgatagacaatttgccaattaatagaaaaagaattaaaattcctgatctcatgataattatttttaacaaaaataaatatgtttaacatgtacaaagatttacttgaaagtgtactgtttggaatataaaaatgttgaacactaaacatccatcaataaactggttaaattacatatgtatatctgcattatggaatactatgcagccattaaagtatatattgtagaagtatgacaaaccatgtttacaatatattttgagtgaaaaaatctaagatatatacctctgcatcatatcatagcattttgtggagtgtgtgcttgtgtgtgtaaaacatttagaagaccatttattatctaagtcattagcaaacacttttatataatcaacaagatgtaacaaacgtgtccattcagatgaggatgcggtggtaaaatttagcaatatactctatataatatactctataatatattagcaatatactctaccaaggaaagaataggactaattattcttcttgaaatgacattctgagggcaatacaagcagagatattgagggctgtataccagggagggaatttcagctaggagaaagacaacccaaaagctaattggtcacaaaaatgttaatatacttaatgccactgaattgtacacttaaaaatagctacggtggtaaattttatgttatgtatattttaccacaatagaaaaaatacactaatattttagggactttctacttaaagaaatgagagagaaaacacttgtgaaaaaagatttgtacaaaatcatcattttcatgatataaaacactgtaagaaaatcacataaaagtacaaacgtagacattccatgtgttctctttcttacccaagcaaacaggtggggatgaccattttccttgttcgcaacgagatatttttgatcccctcagtaagtaatattcattgcatctatattccactgaggatcctgttgcatagcttgccaatatcccgtctgcaacagccccattcattacaacaggaggatgcttacaattctcattattttctaagaaaagaggttgttttaaaattaatatgagctcataacaatatactatagtaactcatactatagtgtctcgatatttgtattatataatttaggacaattgttttataaattcattacaaatatgaaaaattttttcagctcaaatatttttaaaatttgctaagcaagagttgacagcaaatatgttacctaaaaacaactatacgtatttttctcttttctcaattgtgaaggaattatgatatacacatttcttaaacctatagaatgagaaactgttcttcaacctaaagattatggtcaattctaaaattgctctttggcattaccccacttttattttcttctttttcattcctcttcatctcaggtctcaatagacccatgaaggaaatatcaatttttttcctctttttggtatctttctctcactttatctatttctttagcatccttcattgcttttgtcttatttaataaatatcctagataaacatgtgtgtggagatgttgctctgatctgattaagaaatgagatagatgacaggaagagtagtctccaggaatgatagtgtagcctggtggtgcctttcagtaaaatgaaagaccagggacatgtctcagaagggcataaggttcagaatggccagatgcaaaatatcagcaggacttacccaaggtcaagaacagaatgcactaccctaactttgcaggacatatggggagaagaagtagataatgctcatggcccgtcactcaatccaccatgcccttatttacttatctaatgaagcacatcgtcatttatgtgttgtcatttagaacttacaggtaatggcatgacacagatcagataaccgtgcttagcactagcgttcaaaaaaaacttttgtttaagaattctttacattgacttaaattctacagatagctacacatacaggcacacacacatgcacacatgcaaagcagaagagtaggtgctgtagcaatgtgtttctaatttgcctaagcagtggtcttttcctaggaatattcagattaaagtaacagaatggaaaattttacaccataagtttagctactgatggtaaatgtagcatacataccaacacactcaggaggaagtgtccattttccacgattacaagttatctcattcgatccatggagaaggtagccgcttttacatgcatatgtcactttatccccattgtaataaatcttagagtgtaaatttgctgcaccattttcaatgaagggtggttcctcacaggctaccttctcctgtccttctgaaaaggtacagttgaaagagaactgaccatttagctacacatgcagatttcattttagcaaagcttcttcaaggtgttactaaccaatgcattttggaggttctgtccattttccatcttcacaacgtatttctgctgacccatggatctcaaaattaagttcacattctatatgaactatttctccatgacgataagttgttgaatgtgtttgaattttggagtttatgggcagaggtggaggaggacatctgtttcttcttccttatggaaaaaattaatcagcacctttagtcatataattacaaaaaataataaagattaaattaaaatattcatcatgtcaagcatcatagagagaatggcagactgattctaggagcattcctttgatcctcacctcctgatgttaacttccttgtgtgatacccctttccatgagtaggacctgtgacttgcttctagcccacaaaatacagcaaaggtgatggattagtacgtgattatgcacacataattatgtaacatcagtttttaacgccattcttgccaagagactctctatccttgctggttttgaagaaacaagaggctacatcatgagcttccaaagcagaacggctgcaaggcaaggggcagagggctgccttcagttaacagccacaagaaacagaggctctcagttcagcagtctgcaaagcactgaatgctgccaataactacagtgagtttggaagaagtcttgcccagtcaagcctcagatgagactgcagtccagctaacatcttgattgcagctttgatagccatcgatgcaaggagtcggttaagccgcacccagacccccaacctacacccaatgggaaataatttctttgtgttgttttaacctgctgagtttgtggtgacattgttacgcaccaatagaatactaacacagcaggcattttacattcattacctcttttagtcctaaaataactttattaagtaggaactattatttctcccatgttatagacaaactaaaacttatgaagtaaataaattaatagcatgtagcagatctgttcttgaacccacgtctgtctaaattaaagtctcctgctctaaaatactgaccacactactttcctattgctgctttgatgaattacaatttagtggcttaaaacagcacagatttatcctcctacagtcctagaggccagaagtccagagtcagtttcactggactaaaatcgagatatcaggagagccacattcctgctggagactttggaggagaatcagctactttgccttttctagcttcttgaaatcacctgtattccttggctcacaaccccttcctcaaaacatttcaacctgtggcttccattgtcacatctcctgcttcctcttctgcagtcaatctccctctgcctcccttttataaaagcatttgtgattatatttagagtctggatagatagttccagataatattcctaccttaagattgttaacctcaaagtgtcttgtaccgtgtaaggtaacgtttaatggttctcagtattagaatgtggctatattttgggaggagtaagagagatataattcagcccacaactgaattatattgttgtgggctgaattatattagccattgtatgcctaatgactgtttaccggaaaaaacaggcatgttgtcatgctggctaatttggaagaggagaagggtataaaaggccttaagtaggtctgccatttatttttgaagtagcactttgagaggctgaggcaggctgatcacctgaggtcaggagttcaagaccagcctgaccaacgtggcaaaaccctgtctctactaaaaacacaaaaaaattagctgggcatggtggccgacacctgtagtcccagctactcaggaggctgaggcaggagaatcacttgaacctgggaggtggaggttgcagtgagctgagatcgtgccactgcactctagcttaggcgacacagcaggactccatctcaaaaaaataaaaaataaataaggaataatagactttaaaaaaatttgcttaaaaaatctacttctctactactataccaaggatgtcgagcacaaatgaaaaatcataaaatctttaaagttactgtacagtgcatttagggaattatgatagttctggcaatcccactgcatacccatggtcagagccctcatttgtttcccctagcacctgtttcaaatcttcaccactttcctccaagttctaccttcatgtctttcacctgcctgtcaatagaccttatatcccatattacagaaaataaaaaatgactatcaaaccctttgcctcaccctatcctcccaattctcaaactgctacttatctcttaagacccaacttaaatattgtccatcacttctgtgaatgctattccacagcataccaatcagaatctctaatgtttattcctgcactttgtacctgagttgattgtaccatttgtcacattatagcaattatttttttcatatctgcaattactgttttcatatcttctgctagtataggaccctcctcatattaaattgtaggtttgtttaaataactatggatgtcttctgacaggtaattgcattacctgtttggacacttccagtaatagaaatgtgaccatagatattacatttttgggcagcttttacaagatgacctcttttcccattttcacttctgggcattattcttctgcttttcctgctttctctgctttctacctcactattttggagattaatttttacatctggaaatatgtggcaaattaagagaaaatatccttgcaaagctgccagattggggtaattagtcctaataattcccaataagaaaagttattcgttataataagggatttaaaatgtataatagatattttaaaataataaatttaaaagatatagtcatttacaaactaagacaaaacaagatttattcaggtgggatatattaaagattgctgaaaatagcactgatttaaaagataatatttattttaaaaataggactcaggaaaaaaaatagatatgaccacaggaattttgtcagagctaatagagattaaagctgataaagacatggcattttgcgagtattaaatttaaaaatttaccttcgcatacaggagattctgggtaccaaccaaagttatagcattgaattaaatcagatccacttagataataattttcatgacagaaaaactgaacgacatctccttcttcataggtttgctttacaggatgaaaataaccattttcaattaatcttaaagaagagcactttaattctgcaaataaaagaatgaataaaattacaaacaaatgtttattttttctgctacaacaaaatgcactatttacatgacataactagaatagaaattaaatttgccaaaaagcttatgaattcattttatatatttgttaaatatcattaggcttattctaatttaattctgtgagctaaaatgaatttattctacttgagagctttaattatcaaagactgctatcaacataattaaaaataaaggcaaaaatgcatgaaaaggtgaaacataatgagcatgacaacttatatacacttctctatgagaaaaagctttcagagtgagagtagattttattccaaatgagaacctactggtacattttggtgtgagagaccatccgtatgtgagacattctacctcctctgtcttctttcctccagctgtgtagtagccagtagcacattcgtattgtactttgtccttcactttgaatgttttctgtgttgtggaataatttccattatataattcaggagccaaacatgtttctaaaattataaaaattatttattttataaacttttttaataacctagattataaaaaatctcaaaatatggttttacaaatcttaagaatacatggtaaaatcaactcttagcaaaattgaaaaatagccccaatttttctttgcctctattctcttcttcatacaccttgtgacctaactctaccagttttctgtttttaaaattctagtctacaagtgcttgaccaaaggccaaaattcaactaaaggcttgtgcagtagcaattgtgaaagtatgtgctgtctatgcatttttacaatttaaacaacttactaacaaagtatacatatatttaaattattgaactatttttaagtatatctgacattggttcacaatataaaataatgtacatgatcttaaattcttctgtaataaaggaaatagtgacatataaagaaaaagcttctttcattttattccattccaattccttttattgatgcaaagtaggaactattggcgtaggtgggttgtagggattgagaacatttggattaaggaatcacctagtacttgagaaaagcaatgtaatatcaacttcctgcattgtagacataatgaaaaataaattctattaaataatagatatcaatataagcttcaatatattcaatataagcttgataagcacttatcttcagttttaggaaatgattcttataccatgttctttcctacaggttggttgagaagaccatccatcagagagacattgaaccacttcttcatccttccctccagtggttttgtaccctgaagcgcaaccataacgcatgttctcttgaattttatacaataactttacatcagagatgtaaccattactcaggtcaggcttagtgcatttttctatgggaaaaaaaattatttaacttaatgatgaaactaagcttgtcttttactaaattgtaaaattaagccaaaagtataatgttattattggcgatttcattttggaaatatctgcataatttttttgaaaatggattcaatttaacactgactctctttgtatttactaattttagttcttatagtaatttctacccctaccacatctacttctagataggtttactagatatatcaaccacaatagccatattcaacatcctcttttaaacgaaactggctcaaccaaagccccttactctgggtcacctgccctagtggaagatcattgatagtttgatgatagtgtagcctgatataaaataatgaaatgagtcaattagattaccttctcacaactttgaactcaaactttcaattcaaaattgaaaaacacatttttcaatgggtatcatgagagaagttggcacatgaagagagatgagtcttacaaatgataaagcattagagtagcaatcttgcccttccagaggccagagtttcaagcatttttctggcatcttatgcttaattatcaaaataagtttcttgttacttaaagtaaattacctctctttgccttgcaatatgataatttcagttattaccctattcccttcaacagagtattattaaaaacagatacagaaaataacattttaatgtaaaagcattatttactggatttcaaattatgccttcattttgtagaaagacagattgctagtgattttgttcttatctactaaaaggtttaaccgctttccatttttattggacccctatttttatatacaaatttctttgagtattgaaacattgagtgacatatccagctgacttactgaagcaccttggctctggagaccagccttctgttgtacacgtggtttgctcttcttgtcttccactttcagtggtataaccagccaagcagaaaaatgacaattttttgtctatgctcattggaaagtaaaagcttttaaaagtatagtaatattgggcaattcttccattttccacatgaggaaaaccacagggtttctctgaaatgagtaaatgtcaagctgaaaatggaaaaacaaatctaaaaacataaatttgtaatcaggtgacaatacaaactaaaagtttttagagacacttcaactagtacttatttttcttacttaaatttttaaggtacttttgtgacaactcaagcagtccttttatcataattgatctgcaaatgactttaaacatccaacagtcatgataaaatttagcagaccactttttcagggaagctttgcataacttcgtagaacagtacttttttttttcttcctagacacagagtcttcctcagttatccaagcttcagtgcagtgctgaaatatagctcactgccaccaggagctcctgggcttaagcaagcctcctctcctgtagctaggactgcaggcacatgccaccacatctggctaatttttgttttattttttgtagagatgaggggtctcactctgttgctcacgctggtctcaaactcctggactcaaaggatccttctgctttggcctcccaaagcactaggattacaagacttgaaccactccaccctgcctgcacttcctaatagatatgtattgtaagtcacttatgtaatttaaaaatttctaatagtcacattcataaaaatactaaggaacaattgaagttagttttaataataggtttttatttaacccaatatattgaaaatattttacattctttttttttctaactctttaaaatccactacatatttatacttacagaatatctgatcttgaactagtgacattttaagtactgtctccaatagctatatgtggctgatggccactgtattggacagtacagttcaggaataggtaaagtttctccttaacatatgctaactcataaaaaattttgaaataaatagcattaaaagaaaaaacagacaaccaagtaaaacaaagcaatacttggcaagaacttggcaaaataggatatttaaatggttagagacctggtacttagcattactagtcatcagggaaatgaaaatttaaaccaccatgagatactactgcatatccaatagaactgctgaaatgaaaaagacaagctatctcaatgattgtgaagaagtgaagaaactggaactcgcatatttctacaactgaaagtataaatcagtccaaactctatgagagaacacctttgcaatatatattggggtaaaacatgtacaaaccatattacccaataaaaaaagcacatatttgtataccaaaagacatggaaaaaaatgcttatagtggcagtattcatatagtcccaaactgggaacaatctaaatgcccataaataatagaaaagataaacacattttagactatgcatacaatggaatattatccaacaacagaaatgaacaaatggtgaatctcataaacataatattgagtgaaagaagccaatcacatatgaattaatgtatacatttgcataactttttaaaagaaaacaaactaatccatgataatagaagtcagaatggttacctttggggtttagtgccttagaaggatcatatttctggggtactatcactgttctatatcttgatctggatggtgtaaaattttgtaaaaactatataagtgtatcctgtgatttttgcatttttctggatatgttatactccaaataaaacatatattttaaaaatatatctttatgttgaagatcttaaagtcataaaaacacttaaaagaaagaaatgctcgaacaatcctaggagctgtggtgggaagaaacatgggcagtcatggatggaagaaggcctagatccagtgtgattactacggcttcaatgccttggttgatcactgtataccttaatgctactatgagacataaaatactagtagtgctagcctaggtttgaaggaaatggatgtggaatgatgagcaacaaaacttccactatctgatggagcagacagaaaaacatgggctggatagtccccattccttgagaattattctcaccattttttcacacccaagcaccaaaggaatttacaataaaaagagtcttccaaaatagcagtgcaatggtgaatacacaagaaatttccctgaggggcacagttgcttgtcagggaggggcagcaaagtattctctgcacaacaatcctaggttgtggctttaaagactctctgtcctgggacatctccctccaccaccaggataggcacattatttgttaaggtagctggaatgccttggagaatatgaattcctgacaaaaaattaatgagaaatgtgaggaatatactaatcacatataaaccaggaaatcacagatgtctgaacatattaaaaaaagtacatgaagcgatggacacacttactactgatcagagaatggtaaataaataaaaatgggatatcactttatgaataaccatatagcaaccagtacaaaaatggacaatatgaggtgttggtgagaatgatgaggagcaacaatttacatcctctctcagagatgatatacttcaaaactgccattctgcaaaagtaatctctcattacagaaatcaagtacaagaatagactcaataatgctatctgtgagtgaatacagactgatgacattcttacagaaagataagttggttatattacaatattcattccagagctatttgtggttgagagagctagagtaacatgttaaaacattgtagtaggtcccaggggaaatggacttcaagattaggaataaggggataaaatgtgtaagtaaagcaagagtgagacctttcataggccaataatacttgcataccatgaaatgagaaacacaattaattcaattcttgtccctgaagtgcacaatgggagttgagagaagcatgcaaaaataaaatcattgtcttggtcttcaagcagcttacttttttttttgttgtgtaaaatagcattataaccttataataattagaaaattaactagaatattgcaatgtctttatggtatagataacagacaattatatctgctggtatttccctatttagacagaaaaataaaatcaaaagaaattcatgcaaaaatcatcctattatagaattaaaagtataaaataagattaattctgtgtctttcacttttataattttaattatagatgttttggtagaaaatttatagttaactattcaactaaaacacagttaaaacttatgtatttaatttcaacaaattcccaaaaatgtttattttagaaaagctgtattgctgtagcttccttctttgtatgttcactcttgctaatgctaagtgtcctccctggattcttcatcctatggcctgataatattgataatgttcctgaacaacatacccatgtacactgcctagcttccactcgcacactaatcttacacattgggcaatctgactataaagctttctaatagggagtccataggtattggtttgtttggaaagtcctgatttacatgtgttgtccaaacagttattaatagagcccctcttttactctctaagtgtccctgtttgtacaagcaattatatggttcacctactaatcactacttaatgtctccaacaaatgaataattcattgtgataaaaatcaaagtctcaaaagtaaaaaatatttatggctatttccttttcaaatttcccacattaaactctcaccttatgaacagaattaaaattgtacaagttttgtcagtattaggaatggattctagcataaatttagaattaaagttaacatgtgacttcgaaatggacatattgttaacctgaaaaccttttcgaagtatttagatcctggtctcctatgccccctagagatacaagggtttttgttttgttttgcttttctgacttatgctactgtaagaacactttactaattttgctcaaaggaaaaggtctaaatattataaaaagttatatttataaaatatgttataaaattgataatgaaaatagaagagtatattaaaacttgagttgtataaatattagaatctccatttgtatgttttagagaataaagaatattaagaattaattttaccttctgcatagagttctcctgagattatcaatatgatgataaaagtcaggtttttcaacctcatcttcagtggtgtgcttcacaaagattttaacaattctaagcactaggaacttgtcattaagtacacaatacttctcttgaggaaaaagttaataatttataacctctgtctaagtccttttgtaacgagtcttatatttcacttaaaatattttgaaataatgttaaaataacacaactatattaattgacattacttaccatgtcagagtccagtaagagcatgataactgattagggcaacaatagcagcagaataaataataaattatagcagcagaataaataatactaggtaaattttcaacctaagttcccaattgtaaattcatagagtaaagttcacttgaggccatagatctttactaatattgatcaggtaaaaagatgaacttaggaacatgagataacagatacctgatgttgaaatatgttgttgcctagactgcactccttaaagagatacagaaccatagttgtctcaatgatagaatagtattacttataatagtagtgtttgacatttagagagtttttactttgtggcaggtggtgagatcagcactgtgctatatcaacattcattcatgagaaatgtttagaacgtccatgataatggcagcacatgtaacagttttgaggtatttagcagtgaaaaaactggattaaaattattgccctcatggagtttacattctaatgagttttaatttaaaatacaaaataggaaaaaatggtggataggaggcaggactaacttgcagctcccacttggatggacagagcaggatgtggagactcgcattgtgaacttttgctccaagaactgctgcaaggatataacaggaaagccaagataatccacagaccctctgaagaaagtatattgctcctgcatgacccagaaaatagcccacatactgtgaatgcccaaactgtgaaaagtgtgaaaggggtattgtccacccctgaacacacacccttggggaacctgaaggtctagatcacaggagaaggatttgaccttacctggagctcagacaatttagagagctgagcgaaatacaggggtagaggaagcaaagggtaaagccccatcgtctctgtgggtccccagagaagccatttctgacttgtctcacaggggctgccggaggaactgggaaaagaccacagggagaaggaaacctccagctgaacttagtaacaattccaaccgaacacaaactttcctgtccagaactcaggaaagggcgtgaatctggtgtgcagacttaacaggtagggaggcacaaaagtctggcttgcattctcagctgggaggctagtagcctggggcaagttctcaatcctgctcccctactgcctggaaacaaattcggtgctttttgggggaacacagtagaagtgagatttgcttgttgggttgtgtgagagctgggtgaggtctgtaactgccagctttcccccacttccctgacaacctgcatgacacagaagaggcagccataatcctcctgggaaggtaactccattaacctgggaatcacacccccattccccacagagccacaacaagccccacccaagaagactctgagctcagacatgcctaaccctgcccccacctgatggtccttccctacccaccctggtagctgaagacaaaggtcatattctcttggaagttctagtgtcccacccaccacctgatcctcccctatataccacagctgatgctctcatgaaagcactacctcatggcagtgtgtctggaattggttccttccaatgggttcttggtcttgctgacttcaagaatgaagctgcggacgcttgcggtgagcattacagtttttaaagatggtgtgtccggagtttgttcctctgatgttcagatgtgtccagagtttcttccttctggtgggttcctggtcttgctgacttcaggagtgaagccgcagaccttcacagtgagtgttacagctctaaaagatggtgcgtccggagttgtttcttcctcctggtgggttcgaggtcttgctgacttcaggagtgaagccacagaccttcgcggtgagtgttacagctcataaaggtagtgcagacccaaaaagagagcagcagcaagatttattgcaaagagcgaaagaacaaagtttccacagcctggaaggggaccagaccaggttgctgcggctggctcgggtggccagcttttattcccttatttggctccgcccacatcccgctgattggcacattttacagagtgctggttggtctgtttttacaaagtgctgattggtgcatttacaaacctttagctagacacagagcgctgattggtgtgtttacaatcctttagctagacagaaaagttctccaagtccccattcgacccaggaagtccagctggcttcacctctcagcaggaggccaaccagcaccaaactagtgcatcaaacaactacaactaaggaccctcacagagttcctttcactcccctgccacctctactggaacaggtgctggtatccatgactgagagaactgaagacagtttacatcacaggactctatgcagacaacccccagtaccagcccagagcctggtagcccttctggtggctagatccagaaaagtaataataatcactacagtttggctctcaggaagtcacatccctaggaaaagggggagaatactacatcaagggagcaccccgtgggacaaaagaatctgaacagcagccttgagccccagatctcccctctgacatagcctacccaaaagagaaggaactagaaaaacaattttggtattatgacaaaacaaggttctttaacaccacccaaaaatcacactagctcatcagcaatggatccaaaccaagaagaaattcctgaactgccagaaaaagaattcagaagtttgattattaagctaatcaaggaggcaccagagagaggtgaaatccaacttaaggatatcaaaaaaatgacacaagatatgagcggagaaatcttcagtgaaatagatagcataaataaaaaacagtcacaacttcaagaaataaagaacacacttagagaaaagcaaaatgtactggaaagtctcagcaatataataaaacaagcagaagaaagaacttcagagcttgaagacaaggttttcgaagtaatccaatccaaaaaagacaaagaaaaaaatttaagtgaataaagcctccaagaagtttgggattatgttaaatgactaaacctaagaataattggtgttcctgaggaagaagaaaaatctgaaaatttggaaaacatatttagggaaataattgaaaaaaaaaaacttccctggccttgctagaaatctagccatccatacacaagaagctcaaagaacacttgggaaatcatcataaaaatatcattacggccgggcacagtggctcatgcctgtaatcccagcactttgggaggccgagggaggtggatcatgaggtcaggaaatcaagaccatcttggccaaaatggtgaaaccctgtctctactaaaatacaaaaaaaaaaaaaaaatttagctgggcatggtggcatatgcctgtaaccccaactacgtgggaggctgatgcacggcaattgcttgaacccaagaggtggaggttgcagtgagttgagatcgtgccactgcactccagcctggcgacagagcaagactccatctcaaaaaaaaaaaaaaaagattattgcagctaagtgtggtggcttatgcctgtaatctcaacactttgggaggatgaggtgggcagatcacgaggtcaagagatcaagaccgtcttggccaacatggtgaaaccccatctttactaaaaatacaaaaattagctgggcgtggtgccatgcctgtagtcctagctactcaggaggctgaggcaagagaatcacttgaagccaggaggcagaggttgcagtgagctgagatcgcgccactgcactccagcctggcagcagagcgagacaccatctcaaaataaataaataaataaatcttcacctaggcacatagtcatcagtttatctgaagtcaagacgaaagaatcttaagagctgtgaggcaaaagcaccaggtaacatacaaaagaaaacctatcagattcacagcagatttctaagcagaaatcctataagctagaagggattggggacctatcttcagcctccttaaaaaaaataattatcagctaagaattttgtatccagaaaagctaggcttcataaatgaaggaaagatacagtcttttttagacaaacaaatgctgagagaatttgccactaccaagccagcactacaagaactgctgaaaagagctctaaatcttgaaacaaatcctggaaacacaacaaaacagagcttcattaaagcatgaacctcacaggacccataaaacaaaaatacagtaaataaataaatacttaaataaataaaatcaaggtattcaggcaacaaatagcatgatgaatggaatggtacctcacatttcaatactaatgttgaatgtaaatggcctaaatgttccacttaaaagatacagaattgcagaatgggtaagaattcaccaaccaactatctgctgcctttaagagactcacctaacacatatggactcacataaacttaaggtaaaggggtgaaaaaagacaccccatgcaaatggacaccaaaagtgagcaggagtagctattcttatatcagacaaaacaaacttcaaagcaacagcagttaagaaagacaaagaaggacattatataatgataaaaggccttgtccaacaggaaaatatcacaatcttaattatacatgtacctaacactggaactcccaaatttataaaacaattactactagacctaagaaatgagacagacagcaacacaatactagtgggggacttcaatataccactgcactagatatgtcaccaagacagaaagtcaacaacaacaacaacaacaaaatggatttaaactataccctgggacaaatggacttagcagatatatacagaagattctacccaacaaccacagaatatacattctattcatcagcacatggaactttctacaagatagaccatatgataggccacaaaatgagcctcaataaattaaaaaaaaaaattatgtcaaacactctctcagaccacagtggaataaggtgaaaattaactccaaaaggaatcttcaaaaccatgcaaatacatggaaattaaataacctgctcctgaatgatcattgggccaacaatgaaagatggaaattaaaaaattatttgaactgaatgacaatagtgacataacctatcaaaacctctgggatacagcaaaaggtggtgctaagaggaaagttcattgtcctaaaggcctacatcaaaaagtctgaaagagcaccaacagataatttaaggtcacacctcaaggaactagagaaataagaacaaaccaaacctaagcccagcagaagaaaggaaataaccaagatcagagcagaactaaatgaaattgaaacaaaaaaaattgttttaaatatgaatgaaacaagaagctggttctttgaaaagataaataaaattgatagaccattatattaaccaagaataaccaagaaaagaaggaataaaatccaaataagttcaattagaaatgaaacgggagataatacaactgacaccacagaaaaagatcagtcaaatctactatgaacaccattacatgcataaactagaaaacctagaagagatgggccgggagcggtggcttacacctgtaatcccagcactttgggaggccgaggcgggaggatcacgaggtcaggagattgagaccatcctggctaacacagtgaaaccccgtctctactaaaaatacaaaaaaaaaaattagccgggcatggtggtgggcacctgtaacagctcccagctactagggaggctgaggaaggagaatggcgtgaacctgggaggcagagcttgcagtgagccaagatcccgccactgcactccagcctgggcaacagagcaagactccatctcaaaaaaaaaaaaagaaaaagtaaaagaaaaagaaaacctagaagagatgaataaattcctggaaaatacaaccctcctagcttaaatcaggaagaattagataccctgaacagaccaataacaagcagtgagattgaagtggtaacaaaaaaattaccaacaacaattccagggccagggattcacaacagaattataccagacactcaaagaaaaattggtgccactcctattgacaccatttcacaagacagagaaagagggaatcctccctaattcattctatgaagccagtatcaccctaacaccaaaaccaggaaaggacatgacaaaaaaaaagaaaactacaggccaatatccctggtgaacacagaaataaaaatccttaacaaaatactagctaactgaatccaataacatatcaaaaagataatccacaatgatcaagtgggtttcatactgcagggattgtttaacatacatacccaagtcagtaaatgcgatacaccacataaacagaattaaaaacaaaatcacatgatcatctcagtaaacacagtaaaatcatttgacaaaatccagcatccctttatgattaaaacgcttagtgaaattggcatacgagggacatacctcaatgtagtaaaagccatctatgacgaatccacaacaaacataatactgaatggggaaaagtcgaaagcattccctctgaaaactggaacaagataaggatgcccactctcaccagttctcttcaacatagtgctggaattcctagctagaaaaatcagacaagagaaagaaataaagggaaaccaaattggtaaagaggaagtcaaactttcactgtttactgatgatatgattgtatatctagaaaaccctaaggactcctccacaaagctcctggaactgatgaaagaattcagcaaagtttctgtacacaaaattaatgtacacaagtcagtagctctcctatacaccaacagcaaccaagctgaggatcaaatcaagaactcaactccttttacaatagctgcaagaaaaaaaaaatacaaaaaatacttaggaatatacctaaccaaaaaggtgaaaggcctctacaaagagaactacaaaacacagctgaaagaaatcatagatgacacaaatggaaacacatcccatgctcatcgatgagtggaatcaatattgtgaaaatgaccatactgccaaaagcagtttacaaattcaatgcaattcctatcaaaataccatcatcattcttcacagaactagaaaaaacaatactaaagtgtatatgaaaccaaaaagagagcccacacacccaaagcaagactaagcaaaaagaacaaatcatttggaggcatcatgttacctgacttcacactatactataaggccataggcaccaaaacatcatggtactggtataaaaataggcacatagaccaatggaacagaatggagaacccagaaataaacccaaatagttacagccaactgatcttcaacaagtcaaacaaaaacataaagtgggaaaggacaccctattcaacaaatggtgctgggataattgtcaagccatatgtaggagaatgaaattggatactcatctctcaccttacacaaaaaaaatcaactcaagatggatcaaggacttaaatctaagacatgaaactataaaaattctagaagataacattggaaaaacccttttagacattggcttaggcaaagacttcatgaccaagaacccaaaagcaaatgcaacaaaaacaaagattaatagatgggacttaattaaactaaagagcttctgcatggcaaaaggaacagtcagcagaataaacagggagaaagtcttcacaatctatgcatttgtcaaaggactaatgtctagaatctacaaagaacttaaacaaataagcaataaaaaaaaaaaacaatcccatccaaaagtagtctaaggacataaacagacaattctcaaaagaagatatacaaatggccaacaaatgtgtgaaaaaatgttcaacatcactcatgatcaggaaatccaaatctaaaccacaatgcaataccaccttactcctgcaatggccataataaaaaaataataataatagatgttggtgtggattcagtgaaaagggaacacttctatactgttggtgggaatgtaaactagtacaactactgtggaaaacagtgtggagattccttaaagaactaaaagtagaactaccatttgatccagcaatcccattactggttatctacccagaggaaaataagtcattatacaaaaaagatacttgcacaagcaggtgatgttaataacatcacaattcacaattgcaaaaatatggaaccagcccaaatgtccatcaacatcaatcaatgagtggataaaaaattgtgatatatatacaggatggaatactactcagccataaaaaggaatgagttaatggcattcacagcaacatgaatggaactggagacaattattctaagtgaagtaactcagaaatggaaagccaaatatcatatgttctcactcataattgggagctaagctatgaggatgcaaaggcataagaatgatacaatggattttggggattctggagaaaggtggaagggggctgagggataaaacactacaaatttggttcagcgtatactggttgggtgatgggtgcaccaaaatctcacagatcactgctaaagaacttactcatgtaaccaaatacagcctgttcccccaatagcctatggaaataaaaataaaataaaatagagtacaaaataattctgcaaggcagaagctattattatttcaattttgtattttttattaaatgtattaacagaaaagtgtacatatgttaagaattctcacaagtctaagacatccatgaatccacaacccagaacaaagaaggaatataccagcaccccaaaatccccctaccaagttactgcctacatctaccctagtgttaaacattatcttgacttctaataacatagatcaatcagtagttttatactatataaatggaatcatatgggaaatacatgtatatttttatgtctggttccttttgtttaacattttggttctgagatttatccatttgaggatacagtagatagcaccttttctaaatagtattgcattctgtaaatatgccataatttatccattcaactatttatgtaaatttgggttacttacaatttataaaaatcattgacatctgcttattttcaaatatttttttcacacaaaacctctacctagatgctatcattaacattttactatcgttttcttactaatttttaaatgcttcaattaacctaatttttcaacaataggtctccagaatgtattcattttgcataactgaaactttgttgcctttgaccaaaacctctttattttctcttccctgcaatcccctagcaaccaccaccattttactctctgtttccacttgtttgactgttttaaattccacacataaatgagaggatggagtatttgtctttctgtgtctagttatttcactccacataatgtcctccaggtccatccttgttgctgtcagtggcaggattttcttccttttttagactgtataatatgtcattgtatgcatataaagttgagccttaaaaaagtgggggttagggctgctgactctctgcacagtcaaaattctacatataacttgactctcccaagacttaactactaataccatgttgtgaactgaaagccttaccaataacacaaatagatgattaacacactttttttattatatgttatagaccatattcttacaatagagtaagctagaagaaagaaaatgtaactaataaaatcataaaaggaggaaata

SEQ ID NO: 429 - DNA, 40301 bp, Homo sapiens
actgcactccagcctcggtgacagtgaggagaaaaaaaaaatttccatcttaaaggtgtcagactcagactctcagttaatcttttctagatctggacaagggagggctcagagaaagcctggctgcatccatgcagtgtttttttgtttgtttgtttttggtttttttttttttgagatggagtctctctctgtcacccaggctggaatgcagtggtgcgatctcagctcactgcaagctctgcctcccaggttcgcgccattctcctgcctcagcctctcgagcagctgggactacaggcacccgccgccacgcccagctaattttttgcatttttagtagagacggtgtcaccatgttggccaggatgttcttcaactcctgatctcaagtgatccgccctcctcagcctcctaaagtgctgggattaccatgcctggctctcttcagttttctctgcagatgacaatctcccccacacaagacagtttttcagctattcttgtatttccagcccttctgaatagccatcttgaaatatatcaaagaagtatattttggggtgaaatattttagtttccctcaatacagagagcagggaggaagaccaaggccaggatggtcaagcgcttcaggttcagtgacaggaggtaggcttatcaagggacacaaaaaatcacccaacgaaagagaaaaacctacaaagtgcatgccattgaagctgatggaaaagtttcaacaagggggatgtggttagcaatgtccattgctattgggagagttgaagtttatggaagttactggcaagctgagggagagccggaggaagccagatgggattgccttgaggggcgggaggcaagagagatggaaaagatagacttgcttgttttatgcctctactgtcctgcaaaataggaattgtggtccctgtcttacagataaagaaactaaggcagaaggtcatggtggctcatgcctataatcccagcactttgggaggctgaggcaggcggatcacctgaggtcgggagttcaagaccagcctgaccaacatagagaaaccctgtctctactcaaaatacaaaaattagccgggcgtggtggcgcatgcctgaaatcccagctacttggaaggctgaggcaggagaatcgcttgaacccggggggcagaggttgcggcgaggcaagatcacgccactgcactccagcctgcgccaaaagagcaaaattctgtctcaaaaaaaaaaaaaaagaaactgaggctcagagaggatgacaagatcacaccatcagtaagaggcaaagccaggattcttcttttttttttgagacagaatctcactctgtcacccagcctgaactgcagtgttgcggtctctgctaactctactccgctaactttacctcctcttcccgggttcaagcgattctcctgcttcagcctcccaagtagctgggattaaaggtgtgtgccaacatgcccggctaatttttgtagttttagtagagatggagttttgccatattggccaggctggtctcaaacccctgacctcaagtgatccacctgcctcagcctcccaaagtgctgggattacaggcgtgagccaccgtgcccggccaaaagccaggattctaatgtgggtggttttctggcttcccagcacttgaccacgatgtcaccggcagccccgtgcctcctggtttgccactgacattaacccagttgcctgcccaatctgaaaaacttggcaaagcataaacctaaaattgtccaaggggcgggaggacagcaggaaatcgtggtgatctgtgaagagaaaggccacactgtccaaagcctgagaaacagctgctaagattagttttgagtcagcctaccctgtgacttggaacctgctcaatttcttttccagctcctgactcaggcaggcccacttcaactcaggggactgctcagcagtgtctgcctagcgttttaggcatcctggggacacgctccttgcttgacattgaactgtgcaggacgtggggatgctctgggctgtccgggaggcctgttgacaccccacagcatccccaggccaacagctgagatgcccacactccctttccacattccccacacagattggagaatttttcctccattaaagccgtccctggtacatggtacatggagcagggtcggagcagggtcaggacagagccaacggattggaaggcaggtgatttgggagtctctgctctggcaacacgcatggctcaagtgagaatgggtgttacacagcatctcccaagatcctcatgttacagttacccatgagaaaacagaggccacaacacaagtcacttgccagggtcagaagaccagtcagtagcagaaccaggacagaattccggccttctgattcctaatttagtgctcttccagctcaaataaaaggcagaccattcttggaaagactaatcactggaatattttttttcactgagaaaatattttcagaatttcaaggctacagtgagctgtgattttaccactgcattctagcctgggcagcacaacaagaccctgtctgaaaaatatatatatatatatatatatattttattttttttttcctctgatttcaatataattttcattttatttattttttgagatggattttttgtttgagatggagtcttgctctatcgcccaggctaaagtgcagtggcactgcctcagttcactgcgacctctgcctcctgggttcaagcaattctcctgcctcagcctcctgagtagctgagattacaggtacctgccaccacgcccggctaatttttgtatttttagtagagacgaggttttaccatgttgaccagcctggtctcgaactcctgacctcaggtgatccacccaccttggcctcccaaagtgctgggattacaggggtgagccaccatgcccagactgttttttgtgttcttagtagacacagggtttcaccatggttggccaggctggttttgaacttctgtcctcaagtgatccactcacctcagcctcccaaagtgttaggattacaggcatgagccaccatgcctagtctatttatttatttattattatttttgagaccgcctcactctgtcacccaggatggagtgcagtggcgtgatcttggctcactgcaacctctgcctcccgggttcaagggattcttgtgcctcagcctcccaagtaggtgtgactacaggcatgcaccaccatgcccagctaattttttgtattttagtagagacggggtttcaccatgttgcccaggatggtcttgaactcctgagctcaggtgatctgcccaccttggcctcccaaattgctgggattataggcgtgagccactgcgcctgaccacatataatttttattaattataatgttgaaagtccctttattccacacctctcctctcattcactcctgataggtcatttttaatgatttgatgtatatactgaatttggatgcttcttgctacagggcaaagacgctaataagattttgctggagccttttcacagatgcaagtcaatccaggcagtgtctatagctgctgaacccaaaatcagaaagcgagggctatcaaagctcttctgtcctgatttgcaactttagtagtgcaagaaaaaaaatcttagaataaaaaatgggtaccgttcagagacctttagagattgcaaggcatcacagatgataaaaagctccatctctagacgtgttcaggagtgggttggggctttgaccttgactagctgcatcaacttggacaagtcacttcgcttccctgtgcctcagtttcctcatccataaaatggggataagtatagtacctacctcataagtcctgcctacctggcacatggtgagcaattactaaattgtaggcctagtccctataatcccagcacttttggagaacaaggtaggggaatcgcttgaagccaggagttccagaccagcctggccaacatagtgagactgtgtttctataaaataaaaaaaaaaaatacccaagcttggtggtgcaggcctgtagtcccggctacttgggagtctgagtcaggaggattgcttgagcccaggagttcaaggttgtagtaagctatgattgcaccactgcactccagcctggcgacagagcatgaccctgtctctaaaaatataaaattaggccaggcacagtggttcatgcctgtaattccaacattttgggaggccaaggcaggtggatcactgtgagctcagcagttcgagaccagcctgggcaacaaggcaaaatcctgtctctactaaaattacaaaaattagccaggagaggtggtacacgcctgtaatcccagttactggggaagctgaagcaggagaattgcttgaacccgggaggcgaaggttgcagtgagccaagatcgtgccattgcactgcagcctaggagacagagcgagactcgatctcaataaataaataaattaattaattaataaaaaaataagttgggcatggtggcacctgcctgtagtccaagctactcaggaggctgaggtgggaggatcacttgagccaggagttctaggctgcagtgagctattatcacgccaccatactccagcctgctgtatgtactccagcctgggcaacagagtgacaccctgtctcaaagtaaagtaaaataaaaattaaaaaacaaattactaaattgtacttaacagtattgtcatcagtcttcctaaataggaggacaggcaaaattaagggacttaacatgtgccctcaggtatagtagtttggggcaggccagcatcacccgcacagtagttctgtactgtaggtgcgtgttctctgggtcaactttatggcccagtgaggccgtactctaccagaatgtcaggggacaagggttgggagaggcaaaagtgctggtctgaagcaggagtctgggtttccatcctagctctaccaccaattctgtatgaccgtgccccctccatttcctccatgaccacatagagacatggggcagttggatgaaatcaatgattcccagtcttggctctatcatggaaccatttgctaacttctttttttctcttatggatcccatatttttaaagatttttactaaatagaaattgacttatacttttccaagctggagtgtggtggcatgatttcagctcactgcaacctccgcctcccgggttcaagtgattctcctgcctcagcctcctgagtagctgggattataggtgctcaccaggcccggctaatttttttgtatttttagtagagacagaatttcaccatgttggccaggctgatttcaaactcctgacctcaagtgatctgctcacctcagcctcccaaagtgctgggattacaggcgtgagtcactatgcccagccgcttactcacattttctagtcaaaatagaaaactgcttaagtcactgtctgcagaagagcaaaaaaaaaaaaagaaataaaaaattgaaaactgctgatcagattgagaaaaacataagattattcaccacctaaagagaaaaaatttcagtcgaaagggaaaaaaattcatttttgtcttaataaggcaaattcacaatttttgaggttttaacaaaatatatgcagaaagacaaggccaccccgtagaacgtgcacacagccctaggcttggaaatggctggatttaataatatctggtctttctttgagccctgaaattctctaacactatgtcttggaacataattttactgttttcagtggttatagagatttgctttacaatttagcattggtctttacccatgattttgtttgacgccaacttgttgggcaggaatgcaccccctgccccccgctttgttatggccttgctcctatagggcaagaatatctgctttaaggccgggtgtggtggctcaggcctgtaatcccagcactttgaggggccaaggcgggcagatcacctgaggtcaggagtttgagaccagcctggccagtatggtgaaatcctgtctctactaaaaataacaaaaattagctgggtgtggtggcacacacctgtaatcccagctatttgggaggccgaaacaagagaaccacttgaacccaggaggcggaggttgcggtgagccgagattatgccactgcactccagcctgggaaacagagcaagattccgtctcacacacaaaaaatatatatatgtctgctttaagtatgcaggccgtgtttgtgctgaacggcaggaatgccaaacttggctgcatggtaccaactagggacctcagagttccaaggagaacaaacagttggttcctggaggctgggggcttgtatcagaccctgaagactaagcatgtgctgggtccattgttgtcctgcacccatggtagtgcactaaacacctaacctatatttaagtgtttttgtttgtccaaaaaatgtcttttttttttgggagtcaagagtcttgctctgttgcccaggctggagtgcagtgacacgatctcagctcactgcagcctccgcctcccgggttcaagctattctcctgtctcagcctcccaaatagctgagactataggcacgcacatccatgcccagctaatttttttatttttagtagagacgaggtgtctccatggtggccaggttggtcttgaactcctgtcctcaagtgatccacctgcctcggcctcccaaagtggtgggattgcaggcatgagacaccgcgcccggcctgccttgtcccttcttaaaatgagttgtccatttgtaagctgctgatttctttgggacattgtctccgtaaacttttcataaagcatcagtgatttcaccattcttccacccaagcttcaccgtaaatttgttgtttgttcttgcttcaatttcagcagaattcatttagctctgataagggctcgcttcaaactgatgtcttatccttcttagtgcctcaaactacatcctgttcactcatgttatagcaagttagtgtgagtttattttggtgcacaaaaatttttttaaatccatgcagtcttttttcataatacgcattttccatgaacttttcgaagaccccttgtagatgtctgttgtttaaaccacccagtttacagtaatttttttttttttttgagatgaagtcttgctctgtcgcccaggctggagtgcattggcacactctcggctcactgcaacctctgcctcctgggttcaagcaatttttctgtctcagtctcccgagtagctgggattacaggtgtgtgccaccatgcctagctaatttatgtgtttttagtagagacggggtttcactatgttggccaggctggtctcgaactcctcaccttgtgatcggcccgcctcggcctcccaaagtattgggattacaggcgtgagccactgcacctggcctacagtaattttatagcagcccaggctaagatagccatttctgggtataagaatgtcatatactgaacaggcctgcaactgtgagtaaaagtctgcaaagaggccgggcagtggctcatacctgtaatcccagcactttggggggccgaggcaggtggatcacctgaggtcagcagttcgagaccagcctgaccaacatggtgaaaccccatctctactaaaaatacaaaattagctgggcgtggtagtgcatgcttgtaatccctagcatgcacttgggagctacttgggaggctgaggcaggagaatcacttgtactcaggaggccgaggttgcagtgagctgagatcacgccactgcactcctttctgggtgacagagtgagactccatctcaaaaaaacaaaacaaaacaaaacaaaaacaaacaaaaaaacccaacaggtaggtagcagtggttcacgcctgtaatccccactttgggaggctaaagtgggcagatcacctgaggtcaggagttcacgtccagcctgggcaacatggtgaaactctgtctctacaaaaatacaaaaattagccaggcatgatggcgggtgcctgtagttccagctattcgggaggctgaggcaggagaatcgcttgaacctaggaggtagaggttgcagtgagccgagttcacgctattgcactccagcctccatctcaaaaacaaaacaacaaaaacccaaaatatatattataattttattttatttattcaattttattttattttattttatttttctaggaacaggtctcattcaggccaggcatggtggctcacgcctgtaatcccagcacttgggaggccgaggtggaggtgggcggatcacctgaggtcaggagttcgagaccatcctggtcaatgtggcgaaaccccatctctactaaaaatacaaaaattagccaggtgtggtggcacacgcctgtaattccagctacttgggatactgagtcaggagaatcacttgaacagggagatggaaattgcagtgagccgagattgttccactgcactccagcctgggtgacagggcgagactccgtctcaaaaaaaaaaaaaaaaaagaaagaaagaaagaaagaaagaaacaggatcttactctgttacccaggctggagtacagtggtgcaatcatagctcactgcagcctggaactcctgggctcaagtgatcctcctgcctcagcctcctcagtagctcagactgcaggcatgcaccaccattcccagctaatttttaatttttttttggtagagatgagggtcttgctatgttgcccaggctggtctcaaactcctggcctcaagcgatcctgccatgtcggcctcccaaagtgttgggattacaagtgtgagccactatgcctggcctaaaaatatatatatgaaaatatataagaaatgggcctcccaggaattaaggtgtttgcgggagtcctggtccccagtttttctgccaacactccctgttcccacacatgacctggtccagaccccaaacagccaggcccaaaggacaggtgaggcgaggcgagaacttgtgcctccccgtgttcctgctctttgtccctctgtcctacttagactaatatttgccttgggtactgcaaacaggaaatgggggagggacaggagtagggcggagggtagggtaggaccagaagcctctctaggcctgccatggggcaggcagccagggagaaggagggcccctcagtggagacccagggatttcagtagcccctgttccgggacaggcgcaggtcctgggaggtgacagaagatagactaaaggcccaagagtccctggacctgactcctcccaggcagctgccacacacaaacacacctccaggcaccctggacaggaaggaggagaaatgggcccctcctccagtggctgagaagctggggcaaatgttggctgttcctatccctggtgcatcccatggcgaggggcaacttccatcaggccacaccttttatctttgtctctatttttgatatctgtgtattatgattatacaaacccccacattggcctatatgtgcagatctgattaagaacttacgatattccatggacattccattcctaatctcctttagtcctcacaacaaagtattattcccattgtatagatgaggaaactgaggcacacagagatgacaagcaaccaccgctatatgttaggattcgaaggagctccaggaaagtctcatagccccactggccagaatgggctaaatctcagagggggagggtgggagatgggggtgacagtgaccttttttgtgactcctcctagaccatccatccctgctcccaggaggacctgtcctcccagatggtggagatggacaggaggactatctacccacccgtccccacggccctgaccctctgacctcaccctctccgctgatttcttcatgttagttcaacattaacccagaggggtcaggacagacaattcctcagtgacccaggagctgacacactatggcgcacgtccgaggcttgcagctgcctggctgcctggccctggctgccctgtgtagccttgtgcacagccagcatggtaagggagtgcttgcaggctggaacaggctggaggactggggtgtgggcccatgggctggggtctcctggctggacagagcacacagagctggcccctaagtaggtctcagccccaggcggccagcttagggaagaagtcaggagctcagggctggaaagagaatggctgcttctctcttccaatatagggagcaggctgggggcaaggggcagtgtaggaggggcacagggggccacatttagcagccttccaggcacttccaccagcccagacagcctctctcagaagccagcaggggagggtgggcttgcttcatgcccccagaatggccaagactgcctgttcctgaggccgctgtcccatgacccccccaccgccttacagtgttcctggctcctcagcaagcacggtcgctgctccagcgggtccggcgagccaacaccttcttggaggaggtgcgcaagggcaacctggagcgagagtgcgtggaggagacgtgcagctacgaggaggccttcgaggctctggagtcctccacggctacggtgagcctgggctgctcggacggtgccggggcctcagaccgggcccaactctagacacttccacagagaagcaagcgaggaacgccacagccccttcgctgctcacagcctcatttcaactctgagcccctcctcacagggctggcaagaggagcggcctcagcctttcctgggggtctctgtgcctggactgtgtccctgtgcagctccatgacatggggaggcctccacagtcttcagacatccacctgccctggagctctgtgtccacatggcctcctcagcggcagactcccacaccacccttgaggggtgggactctggggaggccaccacaagcccccgggctcaagactcagtgttcctggagctctgtgtcgcctttcctgtctgtagggctctgccagggtcccactgccccctctcctcccatctcccccagcctctttcagtctcggtgtgtgtgttggaggaactcccctatcctcaaatattcttctccttttggaaacaaaagtaggaaactctgccacaaacctccccagagcctgccccctgcgtgaccagggtaaaggaaagtgtgaggaggagacataacatttactaaaacaacacaaaacaggagctgccgtagcctcactcccagcccttgtttttcaggatgtgttctgggccaagtacacaggtgagcaccgggaaggatttgccccaggaagggaggcctggggaccccagtgagagaattctacccagagaatcttctgctgcacctagccatccacccatccaccccttccccactccttccttggtccctcccatctgttcatccatctttctgtttctcaccaacatcccatccaccctgactccagctcatcctggccataccccaatcccaaaggtaaacacctgggtcttttccagcttgtgagacagcgaggacgcctcgagataagcttgctgcatgtctggaaggtgagcaactgacacgggtttggggagcaggacatggaggggagcctgggagaagagctcaggggtgggtttggagtgtggctggtggaggccgaggcagtccccagcatctgacattgctcccattcctggggtcaagatgtctctttgtacctggctctgtgtctggcatgcgaacgaatgaatgaatgaatggactaatgaattaatgtttttttttttgagacagagtctcgctctgttgcccaggctggagtgcagtggcacgatcttggctcactgtaaactccgcctcccgggttcaagcaattctctgcctcaacctcccaagtagctgggattacaggtgctcgccaccacgcctggctaatttttgtatttttagtagagacggggtttcaccatgttggccaggctggtcttgaactcctgacctcgtgatccacccacctcggcctcaaagtgctgggattatagaagtgagccaccgcgcctggccatgaattcatgtttaaggcttcattctcctttgcctgacccgagtctctgcccccacctagtcagagctttgatgatgtcacattccccttctagctttaggtgtcactgaaccaaacaggaacccaaacccccagctgctctgacaccaaggacttccctaagcatgccaaggtgtttctagcacctggccttgcatatgttgtcaatttcctctggagcgaccatcacatctactgaacactttcctatccttcaaggactgcttcaaatgtcaccacttttgctgagacttcagggagcaccctccctcctgcactgtgttctgaaggcacctttagcacgacaaaaatggaactctttgtttatttataagagacagggtctcccttttttgcccaggctgatcttgaactcctgggctcaggcaattctcccatctcagtctcccaaaggagtaggattataagtgtgagccaccatgcctggctgccatactttcatttttttttttttttttttgaggtggagtctcactctgtcgcctaggctggagtgcagcagcgcgatctcggctcgctgcaacctccgcctagcggattcaagtgattctcctgccttagcctcctgagtagctgggattacaggcacacactaccatgcccagctaattttttgtattttttagtagagacggggtttcaccatgttggccaggctggtcacaaactcctgacctcaggtgatccaccagcctcagcctcccagagtgctgggattacaggtgtaatccactgcgcccagcctcatttgttaaattacgtactcaacagacattttacaaagttcctgctacgtgccaggcactatatcaggtgctggggattttaagagaatcaaatacagtctctgccttcaaggaattcaaaatctcaaaagagaacaaaaatacaaaatattaaaatgattgcggccgggtgtggtggctcaagcctgtaatcctagcactttgggagctgaggtgggcgcccaggccaggggtttgagaccatcctggccaacatagtgaaacccccaacctctactaaaaatacaaaaattagctggggtgtggtggcacgcgcctgtaatcctagctactagggaggctgatgggggagaatttcttgaatctgggaggcagaggttgcagtgagctgagatcatgccactgcacttcagtctcggcaacagaacaagactcatctcaaaatacataaataaaaataaataattcaataaagtgattgcaagaaaagttctgttcaaggcaccaagagaccacaggaaaatgagtgtctggtttgccagaaaaatgagagatggcttcccaggagaggcagagttctgcctggcctggtgggatgcatggatgaacaaacaagtgggcattccagtcagaagaaacaatccgtggaaagacccagaggcatgagaagctgagctagcagggacaggtagaccagggccagttgaaaaggaccttcatcactttttcatcctgctggccaagagaagccacagaatggaagctccatgagggcagggctgtgactgtcctattggttgatgtgtactgagcacccgacagtgcctgtcatatggtaggcacttagcgaatatttggaggccactgttgagtgaatgggagaactgctggttgcagaggaagaggggctgggtgaatgcaggttcaggattgtggacctgcatgagctgggaggtgggggatagacaactttgcagggagagaggaaataagtccccaggctccaaggctgaccggggtggggtctccgcaggtaactgtgctgagggtctgggtacgaactaccgagggcatgtgaacatcacccggtcaggcattgagtgccagctatggaggagtcgctacccacataagcctgagtgagtgaggggccggccttcccaccatgggctgagaacagggagcaagcgtacctcaagcccaacagcctcctgttgggcaatttcctgttccagaatcaactccactacccatcctggggccgacctacaggagaatttctgccgcaaccccgacagcagcaccacgggaccctggtgctacactacagaccccaccgtgaggaggcaggaatgcagcatccctgtctgtggtaagctgggggcagtggggcggcccatggccaaggcccgggggcttcatggggcctggcagcctgggatgggaaccaagaatactggctacccaggcacagtggctcatgcccgtaatcccagcactttgggaggctgaggcaggcagatcacctgaggtcaggggtttgagaccagctgggccaacatggcaaaaccccgtctctactaaaaatacaaaaattgccaggcgtggtggtgggcgcctgtaatcccaactactctggaggctgaggcacgagaatcgcttgaacccgggaggcggagtttgcagtgagctgagatcctgccactgtacttcagcctgggcgacaagagcaaaactctgtctcaaagaaaaaaaaaagatgctggccaccttcagagctggcgtcagtcattcagatcatatctgtgcctattgctcagtaaagtcagggaatcaggggatctgagtggggggatctgccagcctcctcctccccctccccactcttgacttccttatggtccaggctgtggctcattccaaacatgcctcctttctgatcaaggcactcctccctccgggaagccctccctagccatttcagtccacacaccctgttctgagtatcacagagcaagccttgtgcagtttggccctgcgggattctgtcattattatttccttggtgtgttaagtagctatagccaccccttccctgaggcagaccacaataagcatttctttttcccatgagggttggcaggtgtggctgcactcgctaatgcgtctgtagggtcaactgacggaggttggccctggctgggtggctctgattcaaataatgggtccagctgagtctggctcctcgttgagggttgggcctagatctgctccacgtgcgttcatgctggggctgaggctgaaagaaggtacctgggaaaactcttcttatgctgatgacagacacagaaaacaatgaacagaaaagcgtcttctgtcctgaaggcctggctcagaacaggcacagtcagccctgcccacgttccattggccagagcaagtatatgttcaaggccagggtcaagaggtaaactacacctcagcctgtaaaatcacagagcaagggatgtggatgcaggcaggggtaaagaatttgtgccgattaccagtccacaaacatgggttagtgtttgttctctaggcatccctgtcgggcccattgctcattcctggggttggtcttttttttttttctttctaagatggagtctcactcccttgcccaggctgttggagtgcagtggccctatctcagctcactgcaacctccgcctcctgggttcaagcgattcccctgcttcagcctcctgagtagctaggattacaggcgtgtgccaccactcctggctaatttttttttatgttagtagagacggggtttcaccatgttggccaggctgatctcaaactcctgaccttgtgatcctcccgcctcggcctcccaaactgctgagattacaggggtgaggcactgcgcccggccttttttttttttttttttgagatggagtctcactctgtcacccaggctggagtgcagtggcataatcttggctcactgcaacctccacctcctgggttcaggcgattctctgcctcagcctctcatatagctgggattacaggcacacgccaccacgcctggctaatttttgtatttttagtagagacggggtttcttcatgttggcctggctgatcttgaactcctgacctccggtgatctgcccagctcggcctcccaaagttctgggattacaggtgtaagccactgcgcctggcccctggaattggtcttatagcaagtttatcccaacaaaaacagctactatttactccccaacccccatacacacgcacacacattgatgataaataagttgcaggcttgcagaaattgacccatccaggtgaacagcctagtgatcccagcaagcgtcctgctgtgcagctataaaaacatgactcctccagcagctccaggcagccactaccagttaattacagatggcctaggaggccaaacctggttactatctctggtttattatgtgccagacacttatgctgtatattttgtttaatcctctcaacaaacctgcaaaagtggcattagtaacccctttaaaggcaaacggtcagaagcccagagaggttaagtaacctgaggtcacacaggcagaaagcagcaagaccggggttcacacccctgtctgttccggtccatgtgtggtctcactcactctgctgcctccttgcccctcacccaccaggccaggatcaagtcactgtagcgatgactccacgctccgaaggctccagtgtgaatctgtcacctccattggagcagtgtgtccctgatcgggggcagcagtaccaggggcgcctggcggtgaccacacatgggctcccctgcctggcctgggccagcgcacaggccaaggccctgagcaagcaccaggacttcaactcagctgtgcagctggtggagaacttctgccgcaacccagacggggatgaggagggcgtgtggtgctatgtggccgggaagcctggcgactttgggtactgcgacctcaactattgtggtgagctgcctgggtagggggcctgagttgcagggacaaatcctggtgggaataacaacagccgcttctgcttatcgaacgcttacctcattgagtgcgctcattacagccttacagtaaccaggtggggggtaaggtcctgtgcccatttcacagataagtacactgaggccccaggaggttattgcctagtagcccaactgtgcatgcacgcttaacctctgcaccaaatggcctccaaggcccgtaggggaattggggggatctaggggatgggtgaggaatggcccagcccagtcccagccggtgcctgggtcccaacagaggaggccgtggaggaggagacaggagatgggctggatgaggactcagacagggccatcgaagggcgtaccgccaccagtgagtaccagactttcttcaatccgaggacctttggctcgggagaggcaggtgaggtagtgggcatccgaggggatgcggggctgcggggctggtggccaggacttgcccctcactgcttggcttgctctgcagactgtgggctgcgacctctgttcgagaagaagtcgctggaggacaaaaccgaaagagagctcctggaatcctacatcgacgggcgcattgtggagggctcggatgcagagatcggcatgtcaccttggtgtgtcctggagccctgcgctaccattcactcctgggggcaggtgtgctgctggacccccaccctcaggccctgcctgcaggcctgggctttacagatgacaacagctgagcatccaggatcccaccaactccacacagcagccacatgagatgggttgtttacttctttttttttgtttcttagatggagtcttgctctgtcacctaggctggagtgcagtgctgcaatctcggctcactacctcgatctcagctcactgcaacttctgccttccgggttcaaacgattctcttgcctcagcctcctgagtagctgaatttacagacatgcgccaccacacccggctaatttttgtattttaagtagagacagggtttcaccatgttggccaggctggtcttgaactcctgacctcaagtgatccacctgcctcagcctcccaaagtgccgggattacaggcatgagccaccacacccggcccatgggtcctttacttctaagcagatggtaaagctgagactgacggagctggtggctcacctccgcgcacagctaatgggtttgaatccagttcttctgattccagagctgtgctacgctatgtgaactctggactggaaggacctagttagggggtgcaaaaagcaggaggcaggtcaggtgcagtggctcacccctgtaatcccagcactttgggaggccaagacaggaagatcacttgagggcaggagttcgaggccagcctgggcaaaatggtaaaaccccgtctctactaaaaatgcaaaaattagccaggtgtagcagcatgtccctgtagtcccagctactaaggaggctgaggcgggaggatcgcctgagcccaggaggctgaggcttcagtaagctgtgactgtaccattgcactccagcctgggtgacaagagtgagaccctgtctcaaaaataaataaataaataaataaaaaagtgtgaggcagcccctcagcatcacacggaggctccaggccccaaaggcggccagcccaagcttggatctgggccccggaggcagctctgcccagctgggttcttagacctgggattgttacttctagggctggtgtagaggcagccccctcatcctcagctcctaatgcttcctgctgcccctcccaggcaggtgatgcttttccggaagagtccccaggagctgctgtgtggggccagcctcatcagtgaccgctgggtcctcaccgccgcccactgcctcctgtacccgccctgggacaagaacttcaccgagaatgaccttctggtgcgcattggcaagcactcccgcaccaggtacagaactggtggcccgtgggtgtctggcaggggtctgagtcctccaaagcgatcatgaggggccctggtggctccgggacacataggatgttctgtataccccccagaatataacatcccagcagtctctgctggaaagcccatttggtcacgtcctgactgaggcttggagctgcggggagaaatccgtctgtctcctggtccctccaacactaggatatagcccatgtgggagtctctgaaaatagagtctgtctggactagggcgtgcagcctgtgcccctgtccccgtcctccaggctgtctgactccaaagccctgcacggctttaggcccaggaagaaacacccagggggctgccatggcaggaaccagccctatcccctccctggtggcctgcaggacacactgtctcccagaccccaagggcaggcagtttcctgctccttgctgggtgaacctgcagcttctccatttctttcttggggtctctgcaggtacgagcgaaacattgaaaagatatccatgttggaaaagatctacatccaccccaggtacaactggcgggagaacctggaccgggacattgccctgatgaagctgaagaagcctgttgccttcagtgactacattcaccctgtgtgtctgcccgacagggagacggcagccaggtgggccaccagatgcttgttagctgaggggcagaagccaagttctgggcctggctctgataccaagtagccttgcaagagcccctttcccttttccaggcctcggtttcttggagtgaacccaaaagttcttttcagtactggcgttttattttttatttatatttatttatttactgacggagttccactcttgtctcccaggctggagtgtagttgtgcgatcttggctcactgcaaccccacctcctgggttcaagcgactctcctgcctcagtctcctgagtagctgggattacaggctaatttttgtatttttagtagagactggtgggtttcaccgtgtcggccaggttggtctcgaacccctgacctcaagtgattcacccgcctcggcctcccaaagtgccgagaccacaggcgtgaacgtctgtgcccagccagctctggcgttttagattctggtctctaagaaatggcgttggggccaggcggctcctgtgggggttggctctcactaggcccttcttccttccccaaagcttgctccaggctggatacaaggggcgggtgacaggctggggcaacctgaaggagacgtggacagccaacgttggtaaggggcagcccagtgtcctgcaggtggtgaacctgcccattgtggagcggccggtctgcaaggactccacccggatccgcatcactgacaacatgttctgtgctggcaagtctgtgcagggcgggctgagggaacagtggggcccaagctgggagaactgagttgtgcctgggttcaagccatgtgactttgagcaagttgcctaacctcttggtggctcagtttcttcctctgtaaaatggaggtaaaagtctctatcccataaggttatgggagggttaaatgaagtagtatatattaatgtacttggcatagtatcagtcaccagtgagctcagatagcagcaagaggctgcgggtagggaaatgccattcattcagtcactcagcaaatatttattgagcgcctatcacgttccaggcagcgttctagggtatacagcagggacccagacggacaatgtctgtgccctcagagagcttccttcctaggagggcacatccataaacagatctaaaacagcaatccctgaccagtgctgtgaagaaaaatgaagcacagggagagagaacggctgatgaagtgggcttctaaatagggtggccagacaaggtgggcagatcacttgaggtcaggagttcaagaccagcctggccaacatggtgaaaccccgtctctactaaaaatacaaaaattagctggtcatggtgacgcatgcctgtagtcgcagctactcaggaggctgaggcaggagaattgcttgagccagggaggcggaggttgcagtgagctgagatcgggcatcattgcactccagctgggcaacacagcaagactccattgatcgatcgatcaatcaatcaatcaggtggccagagaaggttggagaaggcctccctgagaaggtgatgtctgggcagggactggaagaggggaaggaaggagtgagcaggcatatctaggggaggagcaccgcaggctgggggcatggcaggcactaaggccctgaggtgggagcactcttggcttgtctggggagcagtagggaggcctggggggctgaggaggggcagcagtgggtgaggggagagaggggggcaggcagaggacagccacttcctttagggcctggaaggactttattgagtgagatgggaagttattgaggggcttgaggcaggttaagaaatgatgtgactgactttaaaagtaaaaaataaaaaaatttagtgtaatttcagactcacagaaaagttgtaaaaataatacaaagatttcctgtatactgtcatccagattgtcctccattctgtggatgtgtgggaatttttatatatatatatgcatagtttgagagcaaatcatgaatatggtttctttttacccataaatacttgagtatttccaaaaaaaaaaaaaatacccaaggatgttctcttatgcaaccacaatacaaatattaaaacccggaaatttttttttgacatagcttcgctgtcacccaggcttgagtgcagtggcacaatctcggctcactgcaacctcctgctcccaggttcaagtgattctcctgcctcagcctcctgagtagctggaatcacaggcatgtactaccatgcctagctaatttttgtatttgtagtagagacagggtttcaccatgttggccaggctggtcttgaactcctgacctcaggtgatccacctgcctcggcctcccaaagtgctgggattacaggcgtgaaccactgtactcggccaaaaccaggaaatttttttttttttttgagatggaatcttgctctgttgcccaggctagagtgcagtggcatggtctcggcttacttggaattacaggtgcctgccaccacgcccggctaactttttgtatttttagtatttttagtagtgatggggtttcaccatgttggccaggctggtcttgaactcctgacctcgggtaatccacccacctcggcttcccaaagtgctgggattacaggcgtgagccacagcacctggcccaaaaccaggaaattaatgatgatacaatattattgtctaatctatagaccttattcaaatttttgttagtcttgctaatgtcttttatagggaaaaaaaaaaaaaaaagcgtgtttctcacccaggattcaatgaaggatctttctttgtcttctatgaccttgacatgtctgatgagtgcagtctggttattttgtacactggccctgaatccgggtttgtctaaggtttcctcacggtcaggttcgggctcagtggtgccatgtccttcttggtgcatcctgttaactggcacatgagaacaatttgtctcatatgtggtgagtctaactctgacctcttgaggaaggcaatgtctgccaagtttcttgctgtaacttctgtttttccctttgtaattaataagaatctggtaaagagacactttgatgttttttttttttttttttttttgtgatggagtctccctctatcacccgggctggagtgtgtggtgcgatctcggctcactgcaacctccatcccccaggttcaagtgattctcctgcctcagcctcccaagtagcagggattacaggcatgtgccaccacacccagctaatttttgtatttttagtagagatggggtttcaccatgttggccaggatggtctcgaactcctgaccttgtgatccgtctgcctcagcctcccaaagtgctgggattacaggtgtgagccaatacgcctggcctactttgatattttgtattctgtttgcatcaaaaccttctcccaactagggtgactaccaaatggcacttatctaattctgtcattccttctacatttgttagttactttattgctttccttcctttcattctatcagtgtggacttaaggatccttactttattctaagggttcacctttttttttctttttttttgagatggagtttcgcccatgttgcccaggctggatggagtgcaatggcgtgatctcggctcactgcaacgtcctcctcccaggttcaagcaattctcctgcctcagcctcctgagtagctgggattacaggcatgtgccaccacgcctggctaattttttgtatttttagtagagacagggtttcaccatgttggccaggctggtctcgaactcctgacctcaggtgatccgcccgcctcagccttccaaggttctgggattataggcgtgagctctaccgtgccaggccatactttgttactactgttattttttctgatgctcagatgatcccaagtttggcctgtggaagtcccttcaagctggcttctgtgacttggggagatgttctgtcattctttgagtactttctttctttctggcacagcaaaatgattcaggttaatcctactttccttactgtagtgttggaaccagccatttctccagggaacccttgtagtcaagagtggaatttagaactgagatctgggtgctggcgtgtgcacattgctagtgggatgtcattacttctaggctctcttagtggacagaaccagaaaaaaattatatgatgcatataccaatatctctatcatctatataaaaaaccatgagttcctactgaaacctccaattccattctaacaccacaggattaattttagcttttccttttccatatttgtaactctctctgttgacagtgagaaacctgaccctcattatctgtaatgcatttgcctatttgaacaatactagaatatagtttcaaaatcctccatccataacactattaaaaccaatcctatggctgggctcagcccactgcaacctctgcctcctggactcaagccagcctcccactttagcctcccgagtagccagggctacaggcacacaccaccatgcccagctaatttttgtattttttgtagagactgggtctcactgtgttgcccagacaggtcttgaactctgagctcaagtgatccatccaactcagcctcccaaagtgctaggattacaggtgtgagccaccatgcctggcctctcctagtaaatttttagaagtggtgttgttaggtcaaaaggcaaacatgtatgtcattttttagagatttttaaatttctttccataagggttgtaccagtttgcatttccatcacagtgtatgagaatgcctgtttccccacaaccttgccaaaagaatgtcacagttttaaatttttaccaatctgagaggtgagaaatagtatcttgaaattgttttaacggacatctttcaaattgaaaatgaggttgaacatcgtatcatatgattaaggaccttttttttttttttttttttttttgagatggagtctccctctgtcacctaggctggagtgcaatggcacgattttggctcactgcaacttccgccttctgggttcaagcgattctcctgcttcagcctcccaagcagctgggactccaggcgcgagtcaccatgcccgctaatttttgtatttttagtagagacagggttttaccagattggccaggctggtctcgaactccttaccttgtgatcctcccgcctcggcctcccaaagtgctgagattacaggcatgagccaccacgcctggcctaaggaccatttttatataattttttttttgagacagagtcttgctttgtcacccaggctggagtgcaatggtgcaatcttggctcactgcagcctccacttccctggttcaagtgattctcctgcctcagcctcccgagtagctggttccacaggtgcgtgcctggctagtatttgtattatataatttttttgtgaattgtctcttcatggttttttgcccattttttggtccctttcttatcaatttttgtgagttcttcgtatttatattaggcctttatttgtgatatacattgcaaatgttttctcctagtttgtcagtttttttaacctcatgtataatttttctggccatgcagtttaaaaaattactaggtagtcaaatttatcaatcatttattttattaaatctggattttgaatcagagataaacttttcctggccaggtgtggtgtcttacacctgtaatcccagcactctgagaggctgaggtgggggatcacctgaggtcagaagttcaagaccagcctggccaacatggtgaaaccctgtctctactaaaaatacaaaaattagctgggcgtggtggctgatgcctgtagtcccagctactcaggagactgaggctggagaattgcttgaacctgggaggcggaggttgcagtgagcagagatcgtgccgctgcactccagcctgggtgacagagcaagactctgtctcaaaaacaaaacgacaaaaaacaacaacagaaaagcctttcctgatagctaggtcattgaggaattcactcatgttttcttctagtacctgatttcatttttctgcacttagattcctgactcatatggagtttatttttgtatctgatgtgaggcatagatctaatttattattttccaaatggctaactagctgtctctaaaccctttattaaaaattattggccaagtgcggtagctcacacctgtaatcccagcagtttggaaggctgaggcaggattgcttgaggccaggaattcaaaaccagcccagacaacatagcaagaccctgtctctacaagaaaatattggtcaggtgtggtggctcacgcctataatcccagcactttgggaggctgaggcaggtggatcatgaggtcaggagatagagaccatcctggccaacatggtgaaaccctcgtctctactaaaatacaaaaaattagctgggtgtggtggcgcatgcctgtagtaccagctactcaggaggctgaggcaggggaatcatttgaacccaggaggtggaggttgcagtgagctgagatcacgccattgaactccagcctggcgacagagcaagactccatctcaaaaaaaaaaggaaaaagaaaatattttaaaaattagctgggcatggtggcatgtgccttgtagtctcagctacttgagaggctgagttaggaggattgcttgagcctaggagttcaatactgcagtgagctatgaccgcaccattgcactccagcctgggcaacagagtgagaccctgtttctattaaaaaaaaaaaatcggctgggcgcggtggctcacgcctgtaatcctagcactttgggaggccgaggcgagcggatcacctgaggtcaggagttcaagaccagcctgaccaacatggaaaaaccctgtctctgctaaaaatacaaaattagccagacatggaggcacatgtctgtaatcccagctactcgggaggctgaggcaggagaatcgcttgaacctgggagacggaggttgcagtgagctgagatccctccattgcactccagcctgggcaacaagagtaaaaactccgtttcgccaggtgcggtggctcacacctgtaatcccagcactttgggaggccgaggtgggtggatcacaaggtcaggagtttgagacaagcctggccgacatggtgaaaccccatctctactaaaatacaaaaaattagcctggcatggtggtgtgcgcctgtaatcccagctacttgggaggctgaggcaggggaatcacttgaacctgggaggaggaggttgcagtgagccgagatggtgccactgcactccagcctggcaacagagcgagactctatctcaaaatcaatcaatcaatcaatcaatctttgaactagtgatttgagatttcacctttatcacattctagattgtatcttattttcatttatttatttgaaatatagacaagtctccctgtgctgcccaggctgatttcaaactcctggctgggctcgagcaagtctcccgccttggcctcccaaactgctgggattacagacgtgagccaccatacctgacctaggttttattttttagttttattttttcctgcatccagctaatttgatttgatttgtagagacggggtcttgctatgttacctaggctggtctcgaactcctgggctcaagtgatcctcctgccttggcctcccaaagtgttgggattaccagcatgagccacggtgcccagccccacgttctagatttctatggatagagtatgcttaaggatgagtatgtttctggatgttcgactcggctttcctggtctgttgtctgtctgtgtacagcgtcacattgttttaatgatagaggctttagcgtacatagctgggaaggctaatgttctcttttagtttttctttccagtggtttcctggcaattcttgcatgtttgtttttccatatgaactttagtgtcaacatgcctaggtctataaaaaagcttggtggtaattttattgggattatgacacttcaacaaattaactgggagaatggacatatttttgatgttgagtcattttatccaaggataagaaacgttttcctatttgctcaagtctattattgtatctttcttgactgctgcaatgtattctcttataattttttctattggtatcttattttatgtatttgtaatatcttatttttcttgagtaaattagttaatggcttgccggttttctcaaaacaaatatctagggatttgatttatgaaattattaggcctattatttttcttttttttgagatggagtctcactctgtcgcccaggctggagtgcagtggcgtgatctcagctcactgcaacctccacctcctgggttcaagtgattctcctgcctcagcctccccagtagctggggttacaggtgcacgccaccatgcccggctaatttttttatatttttagtagagacggggtttcaccatgttagccaggctggtctcgaactcctgacctcatgatccgactgcctcagcctcccaaagtgctgggattacaggtgtgagccaccgtgcctggcctttttttttttttttttgagacagagtcttgctctgtcacccaggctggagtgcagtggtgcgatctcggctcactgaaagctccacctcccgggttcacgccatcctcctgcctcagcctcccgagtagctgggactacaggtgtacactgccacgcccagctaattttttgtatttagtagagacagggtttcaccgcgttcgccaggatggtctcgatctcctgaccttgtgatccgcctgcctcagcctcccaaagtgctggtattacgggcgtgagccactgcgcccggccaggcctattatttttctattgtggttcattaatttctgcttttttctcttaaaaagtttgcttacgtttttgtctggtttactttgctgttctcttgctagcttttttttttttcagatagggtcttgctctgttgcccaggctggagtgcagtggcacagtcatagctcactgcagccttgaactcctgggctcaagcaatcctcttcttgcttcagcctcccacgtagctaggatcagaggtacatgccaccatgtccggctaatttttttttttcgagacagagtcttgttctgtcgctcaggcggtagtgcagtggtgcaatcccggctcactgcaacctccacctccacctcccaggttcaagcaattctacctcagtctcctgagtagctgggattataggcgcacaccaacatgtctggctaatttttgtatttttagtagagacagggtttcaccacgttggccaggctggtcttaaactcctgacttcatgatccgcccgccttggcctcccaaagtgctgagattacaggtgtgagccacagcacctagtgaaggtgtggtttttttgtgtaggttttactgttgttagtgttgttctgtattgtttgtagaggatacgtggggagatttggataaaagcaactatcattattatcctcatcagacttgtaggtctaactttttaattttttaatttttaatttaaatttttttcttggtcttttatcattaattaattttttcgagacagggtctcactctgttgcccaggctggagtgtggtgacatgatcacggctcactgcagccttaacctcccaggcgcaagtgatcctcctctcttagcctcccgagtagctgggactccaggcatgtgccaccatgcccagctaattttttgtagagagagggttttgccatattgcccaggctggtcttgaactgctgagctcaagtgatccacccggcttgggcatgagccacctcccctggtctggtccaactttttaaaagcattattctgcctgttgggtggagaatagactgtaggtgggcaaagaatgaaggaaactagtgggttcaggagctcgagctagaagtggtgagaagggtttggatttggggtctatgctgaaggtagagccgacaagatttgctaggattggatgggtagggtgaggaagtggggacagcaagaatgactggaggggtaagtggactctcaccagctgtgtctcgtgaaggggcgtggctgggctatgagctatgctcctgagcacagacggctgttctctttcaaggttacaagcctgatgaagggaaacgaggggatgcctgtgaaggtgacagtgggggaccctttgtcatgaaggtaagcttctctaaagcccagggcctggtgaacacatcttctgggggtggggagaaactctagtatctagaaacagttgcctggcaggggaatactgatgtgaccttgaacttgactctattggaaacctcatctttcttcttcagagcccctttaacaaccgctggtatcaaatgggcatcgtctcatggggtgaaggctgtgaccgggatgggaaatatggcttctacacacatgtgttccgcctgaagaagtggatacagaaggtcattgatcagtttggagagtagggggccactcatattctgggctcctggaaccaatcccgtgaaagaattatttttgtgtttctaaaactatggttcccaataaaagtgactctcagcgagcctcaatgctcccagtgctattcatgggcagctctctgggctcaggaagagccagtaatactactggataaagaagacttaagaatccaccacctggtgcacgctggtagtccgagcactcgggaggctgaggtgggaggatcgcttgagcccaggaggtggaggctgcagtgagccactgcaccccagcctgggtgacagagtgagaccctgtcccaaaagaatccactatctatcttcagagcagggccaggtgagaggaaagatggcaggttgaatttacaggcattaaagatgttccaccctctgggttttaatggattatctcatttaatcctcacaagaggtaggtgagtaaactgagatttggagaagtaccttgtccaaagtcacatggctaagaaagctcaaagtaggacttcaaatatagaaaatattgagtgaggacggtgcttttttagttaactccctacatcttcccttgtatcattaaaatgatatcagatcaggtagggcatggtggctcacacctgtaatctcagcaatttaggagactaaggttgaggctaggaatgcgagatcagtctgggcaatgtggtgagaccccaaaaaataaaattagctaggcgtggtggcatgtgcctgtagtcaaggttacttgggaggatcacttgagcccaggaggttgaggctgcagtgagccatgatcatgtcactacacctgcactgcagcctgggtgacagtgaaaccctgtttataaaaatcagggctgggcacggtggctcaagcctgtaatcccagcactttgggaggctgaggtggatggatcacaaggtcaggagattgagaccatcctggtgaacacggtgaaaccctgtctctaccaaaaatacaaaaaattagccaggcgtggtggtggacgcctgtagtcccagctacgtgggaggctgaggcaggagaatggcatgaacctgggaggtggagcttgcagtgagacaagattgcaccactgcactccagcctgggcgacagagcgactctgtctcaaaaagaagaagaaccaaccatgcataccaaaatccacagatgctcaaatctcttatataaaatggcacagtttacatataacctatgcacatcctcccatatacttcatttttaaaatttatttttatctttttgagttggaattttgctcattgcccaggctggagtgcaatggtgcgatctcggctcactgcaatctccgcctcttaggttcaagtgattctcctgcctcagcctcccgagtagctgggattacaggtgcccgccaccacgcctggctagtttttgtatttttagtagagatggggtttcaccgtgttggtcaggctggtctcaaactcctgacctcaggttatccacccatcggggcctcccaaagtgttgggattacagacatgagccaccctgcccggccttcccatatacttcaaatcatctctagatgacttacacccaatagaacgtaaatactatgtaaatagttatactgtattattttaaaatttgtattatttttattgttttctttccccacaaatattttcaatctgcagttggttgaatctgcagatgcaaaacccacagatctggaaggccacctgtatattaaaaggtgtatataacgacattacttacctcatacggttatgaggattaaatgaaagaacttacatggtgccttagcacaatgcctagtgcctagtaagctgtgaatcactaccactcgtattctcactattgcctgggaactggaccgggcattgggcctgttgaaagttcctctgccgcttacctcgtccctctcttgggccctggaaatagcccatcagtggggtagttgcttcctggaatgtttcctcacacagcagttcccagctggaacaatttatttttccaagaaatgggacctctaagttataagagtcatgggctgggcatggtggctcacgcctgtaatcccatcactttgggaggctgaggctggtggatcacctgaggtcaggagttggagaccagcctggccaacatggtaaaatcccgtctctactaaaaatacaaaaactagccgggtgtggtggtgggcacctgtaatcccagcttctcagctgcttgggaggctgaggcaggagaattggctgaactcaggaggcagaggttgtagtgaggagagaggcatgccactgcatgccatccagcctgagcgacacagcaagagtcccttgcaaaaaaaagaatcatagaacttcaaagataccctttcagagcacattcttcacggttactgttggcagaggtcacaggtgtgggatggagcatggctccgtcttgagaagtctcatccatgagctcagggaaagaatgaagatcaacgtctgcctcaggcacaggatagtggagtggagcagggaaaccctgtggctacagtacctggcctaggatcttctaacgtggttttccacgggaagggacctgagatagggatctttagcaccctcctcataacgtttttttttttttttctcatttttcaacacatcagaaaacaaacaggacagagttccttggcctcattctttggttctggttgactgaaaggcagtgagcttgcaggatttggcagcccagggcatcaactcgatcaagggggaagggattcagaattacttgtgacatgcaggacctgctttttaaacaagaacacacattctcataagtctgttttcttccgacatagcggtcagtgttgtaagctctagggacttgggtttttccagtcagctgtgctaattccagacaggagtacagccactcttttttttcctcttcttttgtttccctcctcttttttgagacaaggtcttgctctgttgcccaggctggagtgtagtggagtgatcacggctcactgcagccttgacctcctgggctcaggtgatcctcccacctcagcctcccaagtagctgggactacaggcttgagccactatacccagctaatttttgtatttttttggtagagccatgttgcccatgttggtcttgaactcctgggctcaagtgattcacccaccttagcctcccaaaatgctacggttgtatgagtgagccaccaggcccagcctttgtagccattctttctaaatatgtctttccactatagcagcaaacgcctccatcatcccttcagtgaacaaatacccactcccatgttcccactataaaggagagacaagtttaatttcaggaggctccggggccacctgaaaacgatgactggaacctttacaggattaatcttccatcaatctttcatttcttggacatcaattgaattgaaggtgggctacaataggaaagttcctttgaactttataactgcccaaaatctcctcctgaatccagaaccttttcatcctgaagagtttttctgactgtggagggaggtcctgtggaatttattccagaggtgaatactcagctcactttctcatccttactctgactgaatgtgaagcaactgttagcctggaccaaaagagactcatacaaccaagcagcaaaccactaagatttcccaaactccattagtcaaatgaacacaaatctagttgtagtgtgagaaccactgaagcccagccaatctctgggcgcaatcttgtgtgcctttggtcagcaaagtggtaggatgcccaagagcttcttgaaacgactggtgataattggagggaaatcatgaccaaaatctcaaaacaaggaaggatgagatttttctgctccctaggagctgtttgtggagagcagggaaggagagttccttccattccaaaggaataaaagacagctccaagtctgtgagccaagaaaaagggaagctctgtaagcagtaattaacctttctctaactggctgaatacccagctggtaccaaaagttaaaaaattgctgcccaacactccatgatatggagcatcttgggagtcaggtatagttaatgcaaactttatttataaaagactcttaaattagttgtatcatgccatgcattcatacagaatacagtgacccttcagggcgacagagaagagctcacaaactgaaaggaaaactattaaagagtttctaatattaactattaaaaagctaggaaagattaggacaattttacaaatgagcaattaaaaagaaaagaaaaggatctgggaactagactgagcagagagggggcagctgtttacaagtctgtacactaaactcatccacggacagtcttctagagcagcaggacgctgacagagagaagcagagtatgtacaaatacttgtgccacaatgactcctccccctagctccacggcatgatacatacaaccagtttgtatacactaggcctgctgaggccattttaaactatgaggacttctagtttagtaaactaaagctgcagggtgccgggggagtggggcagcttcatttgcgactgctctttattctctccagtctttttttcaagtcgtctatgttagctgtggaggaggaggaggtcacagttcctgaagagtgagtctggttagaatccaggtctgaatgctggtgctgctcccgtgactcccggagctgagagagtttgctgtggagcatgtctgtggaagaggcgacagtaggaactgctggtttggagagcaaagaggtcaaaggaggtcggtcatcttgctattgagagaaggagagagattgtctaaggtcaggtcaagcaggtcaagatgcagctccagaactacagcaagactaagccacttctctgtgggccagcctgcctcggacctgcttgtgactaccctccctgaactgcacagaagaaaaggagcagtacctttgtgttgtccagaccacatcgctgtcggaggatctttagcctttccaagtagacagatggccccacttcttccccatttgtgttacctatggaggacactgtgcttgtgggcgtgggcacacatgtgacttccatctgaggggagatgcctagaggggaaaaagtagaaagaatattcagatatccacatatcccccttctaaagtgccttggttaatctcccaccaaaaagaacaattaagaatttcctatacttgaaaacgacaaattccacaagaatctacctggagttggtgataagggtgctctgaaatatacaatataagcttcttgagaatgcaaaaaactgatatagaaaggcagaatgtaaattgggtcatccatctgcatcctgggttatgcaggggattgtactccagtaatcccagggctgacttgggcaatccaaaaagctgaagctactcctaagcatactgtaattgcccaactgaaaaacccgaggaccttaaatgtttggaagaattagattaagtttggaccaatgtcacataggagaaactcatttgaacctgtgaaggaagcaaggtgtccaaggctatggtgtattcatggggaagagaaggtgtccaacaattatctaaagagggcatagaactggagtgtctgtaaccctaccactaagatcaatattctggcaggagagaggaaaaccaaaacaacaaaaaatccatcacacttcctaaatttctgagaatgaacaatgatacaatgcgggcctttaaaatatttcacttggtatcaatgcaaatgcattccacaggccccaaaggtaaggtactgggaggaaacactgccttatggtaaatagaaaagtagaaaggttactccagggaaaaaggactcctttaatgtaaagatgaggagaatcctctgagggggtgaaaaatgaatgaagaattatgtaaaagccagcaatatgagatgtctgaatactctaaggcacaaaatcaatttaataatcagtgggaatacatgcttgggttgcaaatgtgctgtttaggccaaaattatcacacgttgaacatccccaaaaagggctttggaaacaaggataggatgcctgccctgatcaaaccatggtatgtttacatgtggcatactgttggacattctgcacaccacactttaactcctaagaggtctttttcattaaagaccagcctgggcaacaaaaagagaccctggctgggcacagtggctcatgcctgtaatccaagcactttgggagaccaagacaggtggatcacttagaggtcaggggttcaagaccaacctggccaacatggtgaaaccctcttaaaaaaaattcaaaaattagctgggggtggtggcacacacctataatcccagctactcgggaggccaagacatgagaatcacttgaacccaggaggcagaagctgcagtgagccgagatcgcaccactgtactccagcctgggtgacagagtgagaacctatctcaaaaaaacctcaaaaaataaaaacacttgtaaagtcttggaaaggcgtaatttaaggtgtcaaaaacaaaaaagaactcctatttaagagaacaaaatttaactgaagcttcagcccagcaagatacaggctgagagtggatatgatcagggtctgaaaaacacaaagggacatgctttgacaggcaaacacattctcaaatgtaagagtaggtgaatgtcactaaactcggaaagaactaagcatagaactgatgagagggcacttttgcagttgggtctgtcttgtcttggtttaaggctcatgatagctattttctataactgaaacctcctaagtcttctgtttgtctctagatcctgtgagcagtaattctcgaatagggactttttcactgtgggggcagtaacatttcagcttaaacttagttactgcattcatttatatcatttaacaaatatcatcatgtgtggcttaagggcagggatacattctgagaaatgcatttgttagataatttcattgttatgtgaacacctagttggtataacctgccacacacctaggctacaagcctgtacagcatgttactgtactgaatactataggcaatgttaacacaaagtatttatgtatctaaacatagagaaggtacagtaagaatgttgtataaaagataaatggtacacctgtataggacatttaccaggaatggagcttgcaggactggaagttgctctgggtgagtggtgtgtgaaggtgaaagcctaggacactactgtcaactttataaacactgtacacttaggctacactaaacttatacaaaaataattgtgctatgacattatgacagctatggtatcatcaggtgatagcaatttttcagctccagctgggtatggtggctcacacctgtaatcctaggtctttgggaggctgaggtggggggatcacttgagaccaggaagaccaggagttcaagaccagctggggcaacatggtgaaaccctgtctctactaaaaatacacacaaaaaattagctgggtgtggtggcacgcaactgtccagctactcgggaggccaaggcaaaagaatcacttgaacctaggaggtggaggttgcagtgagccgagatcgtcactgcattccagcctggatgacagagtgagaccctgtctcaaaataaataatcttatgggaccaccatcatatatgcagtccatcactgggcaaaatgttgatatgcatgactagacacagatgctgaacaattaacctaataaatactacattatatagtatgttagaggtgtaagtgctatggtggggtgagggataggttgcaagttttaaacaataaggttttactggccaggcacagtggctcatgcctgggagtactttgggaggccaaggcaggtggatcaactgaggtcaggagttggagaccagcctggccaatacggtgaaaccccgcctctactaaaactacaaaacttagctgggcgtggaggtgcacgtctataatcccagctactcgggaagctgaggcaagagaatctcttaagcctgggaggcggagggtgcagtgagccaagatcgtgccatagcactccagcctgggcgagagagcaagacttcatctcaaaaaaaaaaaaaaaaaggtttcactaagatggtggtatttgaacaaagatgtgaaagaggaaagggagctaggcaacaaagccatctaaggaagagcatttatgtgtaagaaatagccagtgcaaaggccctaagaagacatatgcctggtgtgttccagaaacaaccagggggaggccaggcgtggtggctcacacctgaaatcccagaactttgggaggccgatgtgggtggatcacttgagcccaggagttagagaccagcctgggcaacaaggagaaaccctgtctctacaaaaaatacaaaaattagccaggcatggtggcatgcacctgtagtcccagctactcgggaggctgaggcaggaggactgcttgaacccagtgagccatgattgcgccactgcactccagcctgagtgagagagcgagaccctgactctaaaagaaacaagggggctggtggggctggagtgaaacaacaggaagaggactaggtgatgaggtactaggggcactggcgggtcctataaacacaggacctcagagacctttaaagggccttttgcttttgctgagtgaaagggagagcctctggaaaatgtttcattagagtcattctgatgctatgtgtagaaaagaacagaggaaggcagggtggaagcagggagatcaagcaggaagatagtacagtaatacagatgagagagaacacacacaccaaggtggtagcagtgaagagaagtgtggatgaattctgcatatggtttgcaggtagagccaaaataatttcctgacggaaaggaagagaagactcaaaagctttggatctgaacaaactcgaaggataaagttgccatcaaccaagatggagaagaatgtaaatggatcggctgggcatggtggctcacgcctgtaatcccggaactttgggaggccgaagtgggcggatcacgaggtcaggagatcaagaccagcctggccaacatggtgaaaccccgtctctactaaaaatacaaaaattagccatggtagcaggcatctgtaatcccagctactcgggaggctgaggcaggagaattgcttaaacccgggaggtggaggttgcagtgagccaagatcgcaccactgcactccagcccgagcaacagagcgagactgtctcaaaacaaaacaaaacaaaacaaaagtcaatggatcaggcttacgggatgatcaggactttagtttttttgtttgtttgtttttgagatggagtctcgctctgtcgcccaggctggagtgcagtgatgcgatctcggcccagtgcaacctccgcctcctgggttcaagtgattcttctatctcagcctcttgagtagctgggactacaggcgcacgccaccacacccaactaatttttgtatttttagtagagacggggtttcaccatattggccaggctagtcttgaactcctgacctcgtgatctgcccgcctcagcctcccaaagtcctggattacaggcgtgagccaccatgcctggccaggactttagtttttgacatgtagagtttacaatgtctatgtgaggctgggcatggtgactcaagcctgtaatcccagcactttgggaggccaaggtgggtggatcacctgaggtcaggagttcaagaccagcctggccaacatggagaaaccccatctccattaaaaatacaaacattagctgggtgtggtggcacccgcctgtggttccagctactcaagaggctgaggcaggagaatcacttgaacctgggaggcggaggttgcagtgagctgagattacaccactgcaccccagcctgggtgacagggtgagactccgtctcaagaaaaaaaaaaaaaaaaaaaaaatctatttgaaacccaggtggagatat

SEQ ID NO: 430 - DNA, 92313 bp, Homo sapiens
taatgataataaaaaagatatttgccttgactataaagcaaaattttaattgaatgtaggcttagatactaagaaaaaggataacaagccatgatttaaaaaaaaaagataatttcctctggggaaaaaagaaagaaaatgaaaaaaagaagaaaggaagaactaaagctgctgctgtttaattattaattaactattagctccttaatagttcaaaaactgagacaggtcaaaggtcagagacagaaaataaagaagtaggatatggatttaagaaatcactgggaggccttgtattctaagtacatattctaggaaaagccataatctaatttaacatctatccacattcgtgaaaatttaggttgtaaggaactgcagaatatcattagaaagggtgtttaaaaagcatggcattaggttaaataggccagtatgctaaagggagctaaacaggatgacaagatgtgttttagcaaaatagttcatgaaaatgattacttcaaaagaagttttcttatactataaacacctgtatgcaaataaactagaaaatctagaagaaatggataaattcctggacacatacatcttcccaaaactaaaccaggaagaagtcaagtccctgaataggccaataacaagttctgaaattgagggagtaattaatagcctaccaaccaaaaaaagcccaggaccagactgattcacagcagaattctactagagacaaaaaggggagctggtaccctgaaactattccaaacaatagaaaaagagggattcctccctaacacaatttatgaggccagcatcatcctgataccaaaacctggcagagacacaacaaaaaaagaaaatttcaggccagtatccaaaatcctcaataaaatgctgtcaaaccgagtccagcagcagcacatcaaaaagcttatctaccacaatcgagttgacttcatctctgggatggaaggctgggttcaacatgcgcaaatcaataaatgttatccatcacacaaacagaaccaatgacagaaaccacatgattacctcaatagatgcagaaaaggccttcaataatattcaacagcccttcatgttaaaaactctcaataaactaggtattgatggaaaatatctcaaaataataagagctatttatgacaaatccatagccaatatcatactgaatgggcaaaagctagaagcattccttttgaaatctggcacaagacaaggatgacctctctcaccactcctattcaacatagttttggaagtgctggccagggcaatcaagcaaaagaaagaaataaagggtatttaaataggaagagaggaagtcaaattgtctctgtttgcagatgacatgactgaatatttagaaaaccccatagtctcagccccaaaatctccttatgctgataagcaatttcagcgaagtctcaggatacaaaatcgatgtgcaaaaataacaagcattcctatacgccaataatagacaagcagagagccaaattatgaatgcactcccattcaaaattgctataaagagaataaaatacctcggaatacaacttagaagggacgtaaaggacctcttcaagaactacaaaccactgctcaaggaaataagaaaggacacaaacaaatggaaaaacattccatgctcatggataggaagaatcaatatcgtgaaaatggccatactgcccaaggtaatgtatagattcaatgttattcccatcaagctaccattgactttcttctcagaattagaaaaaactactttaaattgcatatggaacaaaaagcctgtatagccaagagacttctaagcaaaaagaacagaactggaggcatcacgctacctgactccaaactataccacaagcctacagtaaccaaaacagcatggtactggtaccaaaacagatatatagaccaatggaacagaacagagacctcagaaataacaccacacatctacaaccatctgatcttcgacaaacctgccaaaaacaagaaatggggaaaggattccctatttaataaatggtgctgggaaaactagctagccgtatgtggaaagcagaaactggaccccttccttacatcttatacaaaaattaactcaagatggattaaatacttaaatgttaaacccaaaaccataaaaaccctagaagaaaacctaggtaatactattcaggacataggcatgagcaaagaattcatgactaaaacaacaaaagcaactgcaacaaaaggcaaaattgacaaatgggatcgaattaaactaaagagcttctgcacagcaaaagaaactatcagggtaaacaggcaacctcagaatgggagaaaatttttgcaatctacccatctgacaaaggtctaatatccagaatctacaagcaacttaaatttacaagaaaaaaacaacaccatcaaaacatgggcgagggaaatggacagatacttctcaaaagaagacatatatgcagccaacaaacatatggaaaaaaagctcatcatcactggttattagagaaatgcaaatcaaaaccacaatgagataccatctcataccagttagaactgtgattattaaaaagtcaggaaacagatgctggcaaggccgtgaagaaataggaatgcttttacactgtgggtaggggtgtaaattaattccaccattgtggaagacagtgtggtgattcctcaaggatatagaatcagaaataccattggccccagcaatcccattactgggtatatatccaaaggaatataaatcattctactataaagacacatgcacatatatgtttattgcatcactatttacaatagcaaagacttggaaccaacacaaatgcccatcaatgatagactggataaagaaaatgtggcacatgtgcaccatggaatactatgtagacataaaaaagaatgagttcatgtcctttgcagggacacagatgaagctggaagccatcattctcagcaaactaacataagaacagaataccaaacaacccatgttctcactcataagggggagttgaataatgagaacacatagacacagggaggggaacatcacacaccaagtcctgttagggattggggggcaaagggaggcagagcattaggacaaatacctaatgcatgcagagcttaaaacctggatgacaggttgataggtgcagcaaaccaccatggcacatttatgcctttgtaacaaacctgcacatgtatcccagaacttaaagtaaaataaaataaaaaagaagttatcttagtataaaaaaggagaaaaggttgtgtttttttgtgagtgttgaaaaagcataatgagtaaagtattagggaaatgagtgcattgaggaggaggatggggaaggtagttaaatataaacctggttttatttgcaaagctttaatcttgataaacgggaccttcttaaagcaaatatcttatatagggagctcatatttgggtttcaaaatctaggttatagtccaaacgatttcaaatctgagagaaactttttttagagtccattgtacttagtgttaatatgacaacaaaccacaaaatattaagaagccagtaattatgaagaaaaaataggtaattattcaaaccaagacttaataactgaaaatgtataaataagtttgttagatctttgagggctctgccagggactattctttgcagtagctaaaacttccttttctataaatgattaacaagaaatatttgtttaattgacttgaaaaactccaaacatgctatgttcacttttaagaaagatgattattagaaagttaatttatgctaaatgaagtataaataagaactagattgcacatatgtttgaatcttgatatctttgccatctattctgtgaattggattaaggtgttctacccccagaacagaaagatgctgttttccaaaatagcaggaaagaaattagattaataaaaataattttctctatttacgtttttttgcattaattgttctgaaacatttgccttctattgccatttgcttatgatagaatcttgtgcaagaacataacaattttgtaaaaatgcagttgttacaccttgcagaatacacaatcttgagctcattgtcacagagtagataacaaaatcatgccttagagaaacagtatttatgatatgagcctttgcctgaaggaaaatgatttttagaggctgtaaaatctacctttggcttaagccagaccagcaaagagcccctgcacatggaccacacagcagtggcctctgaagacttgtttttactgaactgtgctttggtgggaagtcctcagcaccttctgcacagaaagcagcctatataatgtgctcttgttagaggcattctgctcattacatagtgacctctttctgcggacctttgggagaagtttatttttaacttcagtctcaataaaagtgtgctccttttgtacattttttggggacaccatatggtataactgataaggtttttttgtgcattggctgtttaaaaagttcacttaaacccaagttcacccatagcaaggtcgatagctttatgatatgcattttcctgttagcttttttctgcttcctgtttatgtttctacctccggttttgctttcttccctacttctaacatatgtcatctagtagtattttttattttttttaagcagccttaagtcttggggggacaagatgagagagaaatatattcattcacacatgcctaaaaatatgttgtatttagtcatttgggttttattttctgccaagaacattgtgtttcacaattattttgccacctgaagaaatatgataactttttatttaaaattctagctgctaggagtgcagagaagattattcataatgctggcaaatatgaaaccacactatcatcaccagccaataatttttaataacctactttgtgtattgcagagaagtacagttttcacaatatctactataacctagcatgctgactgttctttctagtttattttctggcacaatttatttacctctcccatttaaactccttcattggcaactaattgattttttttttggagagaaaatttttacttgattttatttaaatcttcaaatttgtggatagtttgataatttctgaatcctatactaggcctgtgggctcaggatgtaaactaatgccaatagtccctacccctgagaaaaacataattaggtcagttaaacccactgaaaaaagtccatgcaagctgttcaattatttgtttagcctgaataattaaagcttgacctctatgtgaatgtcttcagaactctggctaagtacagttgaaccagacatgccacctactgggaagagcatcaagtatgggtagaaaatagagctgcaataaaaagtaatgagcagtggatggtggtgatggctgcacaacaatgagaatgtacttaatgccgctgaattgtacacttaaagagtaacttttatgtgtattttactacaatttctaaagaggtaatgagcagtattaaaaagcattagagaatagtagaaattaatattagtaattaataccattatattcatagtatatcatattttcattataatgctaataataaatactgatagaatgcttactatgtaccaatactattgcaatcatagaattatagcctttgtcactatttctcccagtctattcataaaagaaaagctttttaaacatttttacttgtcacatctgtaaacaaggttgccacattccagactttcagaaagtctttttaatcagcaggaaggaacttcaatacaaggtggagataactaagacggtaaagccattaccaaatttcctgtcaataaaaagcaggtggggtatgaaattaactgcacaccattcctaagacattgagaagcttcttctaagtgtaaaacatgaaagtacagatgaggtagaagtggtttagatgtggaccagtggtaaaaataaaaccatcgcataagaactttgaactcttgtcattgtccaaacatcctcaatgattgtctcatctctccattagtcaatttctcacatacaacatacttttacccgtcttctccccactccagtgtcattctcctatcaccctaagcaagtcagaatcctgttcctcatgggcgtcttctataatatttccaaaggtgacccacttttaatctggtcactaccatctgtaattcacgatttggagattagggatatgtattgtatctgtttttgtgtctttccccaccctcacatcatcagttctacccaggtaattcttatttgttttgaccttgcacatacactggatttatgggcatggtacaggagatggagggaggtggataagtcattattagactatatagagagggtagggaaaatgagtaggtatgtcagagaaagcttaactgggccctgaatttgagcataaagctcttatttatcctggtttttattgatccttatcccagtcctctcttctctggagttctgcacaggttgccttcatacacatctaatatcagatgacctaggttaaatcatctccaaaagttttcacagtctgattccatcccacaaggctactcatctaattgtctttttctttactactcagggtgtaatctgttaggcttaataggctcatagtgtctatttgcttcttatgtttgtcttctctatgcaactagatgatgtatttgaataagccagagaagtgtcttttatttcctttatatactctcccctacaatgcctgtcatagtggtttgctgtgtcgatagaatgagcttaatactttttaaaaaattaaaatgatggtacatgtagagaggttaatatcaagttttctttacatgtaccaaatgcaaaatacatgtatatgttttggtggggacagttcatacaagccagagataataaaatcttaaagctctgtagtctctcccaacaatttaagtacttggatatgaaaaaccttgttatctgggcattgaccatgtaaatattattccacacataatcattttgtctttgtctacagctttccctatctctaggctatgagaatatatgaacttgggagaattaggcattcagaattttccataaaatacttctccattaggaaatataaaacaagaaaaatgctaacatggagctatcagatatttttaagtatgtgttaggcccactgcattggggcatgtgccaatatttcgtaaaaccaaaattcactgcctagtaaattgttccttcctggtctgtccagagaagtaaatggtgaaatattcatggctcttgggaacatccaagctatttggcaagagcttttccctgggtttgccaaaatggccctgaactcaaaatatggtgtttattcaaaatgattataaaaatggcatgaagtttgttatttcttttaataacttgaaagaattctggagaaataatttcatgtttcttctagtcctttcatatttttgatacattcacagctattcttttccaaattgcaattagaatgactaataatgtttagaattttatctgttggtttctcttaagtcatgattctaccgtgagtcatttaacttctttccaaagcacccagttgtaacaaacagtggtttatgtcactggagacgtactatgtagtcaaacttgtaatttcatctaagtgagatcagagagagaaataaaaagtgggtatcttttttatttcaaaataacaggggttttaatatttctacacagcattagataatagcccaaacatattattgatccccaaacaagtattttccagatcaattaatagtcattatcaattaatattcatgtctacctgtctgagcaatggattagaaacattataagtttcattttatggaagagaaagcagactaaaagtctagggatatgatcatttggtttctggtttcagttctgacactaacaagcaatatccttgggcaagttgtttaatctttggggccttatttttctcaagtagagaataacgaagctggatctcatgctccattcccatctcttccctaccccccattatttcataagattttcttgcccctattatgccttagtaaattctagatcaagagagatcctgcccaatttcagagtagagaagcccaggactagctgcgtaatttgtggggctcattgaaaaatggaaatgtcgaattccttcttaaaaaataaaggatttcaagagggtaactgcaaagcattaaatttagcatgcggtccttctgagcatgtgaccctttgcaactgaacagatcacacacatccaagaagctggccctgtagaaaacaaagaaatgttttcccccaccttccaacattctcttttgctcttaacggaatggaaatcttagaaatgttgatgggacaatgacatgaatcatgaaaagaaaggaatagtgggaatacgaatattagaaagccaatgttttgtggatgtttgaaactctcatatacattcatagggcttaccccactggtatgggcaacaggtaactctggtagtttctaaagatgctcccagtgaattatgcctcctggtatgtggtccttatgcagttcccttctacactgaatcgagactggcctgtaatttgtgttcacaacgaatagaatgcagcaaaagcaaagccctgtctcctagagattctggtatgttgtctctttgttctcattggttttaaggaacttatttatttctgccttaatttcattatttacccagtagtcattcaggagcaggttgttcagtttccatgtagttgtgtggtttcgagtgagtttcttagtcctcagttctaatttgatttctctgtggtctgagagattgttatgaatttcgttgataaaattttatatatttatggtatacataacattttgatatatgtacacgttacaggatgattaaatcaagctaagtaacaaatccataatctcacataaattttttttggttgctcttttaacactaagttttggggtggtttatttcagacaccccaaatgactgtctatctcatgtgattttaaggatgtctaaaggttccccagttgtgcaatatctacaggatcactgaatgccaagtccccagggaaaggaatgatgaaaggggaagttgctggaagaagagagaggaggaagttgaggccatagagaggaaggccctgaaagaaaactttaactgcttgccagtttggccagaggtctctttgagcaggaacaactgcatttagaccagcagttcccatgctctgttttacaggtctgagctttccagtaggtgaaattatgttttgaaactgtgtgccatgtagtaccagctagaataaagccaacattacacattcagttctaccatggttatttcagttctgttccatatctaatgaccaccaaccttgaatatcaatgtgtgcagtccttagggagaccaggacggattcacaatttcaatggggctactggaaagatgcttggctgtttttttactcatggaaagtcagaaaaatcattgttatatgggaaagacaggatattttaagtacttatttcatttgataatattgtttttctcttcactcaagaaaaaccattaaaaaatcatgtgtttgtgaaagttatccaggtctatcaattattatttaaagtaatatctgttttactagtgtgtaaaggatttaaaagagttataatgaagcattttaactacataaatattacttcatagcattttcaatcattaagaaagataagcccttttcttgttggttcttgatattttcctacctgtattcaaattaatgcagaagtaatagccattatcttacttactggtagcaaggagttacattataaaagcttcttgtataaaattttattcactaatagaaaagaaagagaaatagtggaaaactgttaacatttaacacagcgtaaaatacattgcccattctaaatggtttgaggtcttaaagagtctcttccaggggtttttgaatgttcaattctagtaaatatcacagccaaagagttccaggcgaagtgcaatactttgattccatgttttaggaatgacacggataaacctggaaatgattggggggttgaaaaagttcttcacatgtcctttggtattagtatttccttcaaaaatctgaaagccaaataagagaaaatctttaatgacaacataaatggctaaggttttttgtttttgtttttttttagacagggtcttattctgttgcccaggcttgagtccagtggcacagtcatggctcactgcagccttaaactcctctcaagtaatcctcttgcctcagccttccaaagtgctggcattgcagacatgagccatcatgcccaacccagaaaattttttatcctattagctcaaaatgagcatatcaaagaacacatagaacactctcacagagatgatcctctatcagttatgaaatcacatgccagatagatttcatctcaccagtgatctgacttaaattagtgaaaaataaacaagtctcacatggtgctgtggagcagctgcaaaaccatttctgccttcagcccgtctgtattagctgtatgactgaacaagttacttattctctgattcttcatttcctcattggcaaaataaggataataacattttacctcacagaagtcattgtaaatatttaaaaatgtatgtcaacgtaagtgcatagtaagtgccaggaagtggccaccaataaatgtttgactattgctaacatttaaaatgtgaccatgcattttaatttatttattcttgttggcatgtaccttatatcctcaactaaagtgtataactttcccccttccatcatcagcaagttccccaaggtttacacacaccagaaataaaatcactctttttttttatgacaatgatatttatcctcctatgagggcaacctggtgtagtgagaaataaaacaaaccaaaacagacaaccaggagtttgtctgagaccaggcaccttaagaactaagatttagaagacttaaagaggtggtacatgtcactgcatatttgtcaaatgcaaaatactgttattctcattatagcacagtcttcagattgctttctctttgcccagatgccactctaccttgtccaccatggaggatttcagcctgtatggtttccattccactccctgctcactgtagtggatggtatagctctttacatacatttcagaggacagagacttgcagccctgtgttataattgccgttatcttcttgatcttgagtagatcaatttctagccactgcttattgttgtttgcctatgaaaatgacaaaaacacatagataaggaagatgttaaaacctttgctttttttttagaccaagttatgcaaaaaagcacagagctcaaaaggattttgttctatcttatcccttaggattcacagtctcctagaagctttccctctttcttcttcattgccacaatatgtgtgtaaatttttattgaagtatttcacacattgtactataattgtttccttcttagcattccttactgcttaagggtagaggcttatttcattttgtttcctggtactcaccacaatgttaagacactcagttggtgttcaataaatagttgttgaataaatgaatgaataaatgagctttatttggaaaaataattaaactgctaaattatctgtgaatattattttcttaagcaaatttctttaaatactctggtaatattgctgcagggttatctgggaaataattggatagcattctctctctatttcacctgttttacaaaacacaacttctctttccccctgttaatgtcaaagagcagaaatagttcaatttcttctaatatttcaaataaatgtaacatttgagagacctgataaaaccataagtagagcttgatacacagtacagttattgtcctgtctctggcctaacaaaatgcctaatcacatggttggtgatatgtgtttggagaaagatcagaaggtctaaactgagttttagagtcatctaagataaatttttacctttgggagatttatcgtctaccataacctcattcaattctaaaggaaataatattgatatgtttcttcaacatcacccacacatacataagtgtatgtgtatatataggtgtatgtgtatatatgtgtatacacaaaaattcacatgctatatgtattttaaaagcaaattaactgaattagaatgattatatgagaaaacttttaagtctataacatcctctagtgacatctgggtggtatcttagtgtgtcttcatatcaaggttgtaccagtgatgcagagtataaccagctagaggttttcacaggcataaaagaggtagagacattttagttatggagagaacagcatctatgtgcatcactgcatatgtccagctttgattttcaacctctctaaagagaccatataaagacatttcatgtgaatggaagggggttaagtaaaacacatatttctgatcccgaattctaactttgaaatgacaccattaaaaattagcattttatctttgaggcccttgttatatcacaaagactaagagcaaattatagagagtgcaaatttttttaaaagattgtaaaatgaagtatggagtgacaaggttataccatgaacaagtctaaagagtcatctgaaaaagaattggataacatctctttaattattatttatattgctatgtaaattatataaatgtaatataacactatttttattattttaacttctctgggtgtcagctttgccctctgcaaaattgcaaaatgaggtatttgggctgcttcaaatggtggaaggagcatggcctgtttactgggagaatgggattctagtcctgattctgctaccaaactaagctaaaattatttaatctcctgtgtatttagaattaaaaggaaaaatctagaccagatgctttgctccttgctactgtaacattctgtgattccatattgggccagaatgagtttcaagacacagatatcagttcccaagactgtgtggaatccaatcttttctatttacgccaccagcaccacaattcttttttcctttctagtggcctaatttaaggataggccctggaattctatagaaagccaggaaattggagtgtaggtatcttaagggagggagatatgaggatagaaattagggaatttggatttagttggctgaagggatcatcaagttattcatgccattctgatatctcaggtcatttaaagaattaataaaaatgagtcaaatattaagagttacccccaaattaaatcacctgaattactcagtgggctaatatcagggacagtataactctctggaaggtgtttgtttaacttagatcactgattttataactctggttttgcaacattttactatgcttctagttgcctcaaggaatatcacaaagctcttaaaataaggagggcggggaagagaacaaaaaagtttagatgacatttcatttaggaaaatgaaaaaatattgctaaattgtaaagaaaaaataagagatgatgttgcaaatctaaatcatttttttatcactaatgtaagctgtctaaatgaggagttggcaaactatgatccatgggccaaatttggcccgctgcctgttttttgtaaacaaagttttattagaacacagccagctcattcatttacatattgtttatggctactttactgctacaatggcagagttgagtagttatggcagagaatgtatggcccacaaagactaaaatatttaccatctatccctttgcagaaaaattaatttgcttattattggtttaaatcaagactagaccaaaaaccacagagatgataaatgacttctctctgagacaaagttatagtcaaagctatcaagtccacagacatcctggactcttggacctaggattttaatctgcagaaacagattaaaatactcctgcttcccagatcctccatgtttgtggtagtgagggcctttgctttcttctggagccctaagagaacaccatgcatagagtatacttgaccttggcttgccaggcattcacacgtccctgggcattcagacgggcacggaagggttcccagtaatctccccaccaagatttcttaaacgaagaagctgtgatttgcttgttttctatctttccattttccatacccaggggtgtggaacatcctatcaaaagaaaagtaacgtgattaattacacaccaatattccctgcatggcttcatgcactgcagaggagataagaaataatattactaccaacaaatgacaaaaacaataaccacaacaatgaagatttattgaatccaagtgccaaatactgttctcaggctttacatgtattatataatgctcataaatatctccattttagtacagccaaaacacagtaacttgtctaaggtaacacagccacaagaatcagaaactgaattgagttcagacaatctgataccaaataccatgttctaaacatttaaactcacttcctccttctgagagtcttggaaactttggtctttgctttcaggtgacaataatcctaaattatctatatataaaaatactctgtttcttctaacaaaagctaccaagaagatacaatggaccctcagtcactatttaatattttctgtttcaacccttagagggtaattcgagttatgtaccctttggaatttttccaaggtgtaatttgaatatcataggcagcaaggcagacctgtgactgtaagaaacacagctagtgagtgaacctggctgaccacccatcatctctgtgacactttgttcttgttggtaaatcatgcagaaattttcttgaagtgatgccttactttctccatgaaaaaaacaaagggtcctaaaaataatacccactgctaataattacctaagtatcaagaaaatgaataagaagaaaataatgcttcttgtataaaaaatagatgttttaaataagttagcagaattgaatgtcacattttagggtagtttattaggatctgaacaaatctatttataccatatggaaagaaaaaaacgcaatgacttatggaactgtttcaaggagtggtcctgccgatacaagatctgtgttttatttgggagatgttttagactactgctatctggacattggcaaaatacccatatccatccaagggtatactgtgccattatctgcttcaacaggaaactgattccaggtttcagctactttctccattgtgaatcatggtggcttctctccacccaaagggaagtactgcaactcctgacaggtgtgccacggcaggtttctagtgcacctatttattgatccctcttcccacctccagcccttcagcagccaagtggggcctggatcagccaagccttagatttattgcttcattcttttacctcagaatgccaggcagatattattttctttgtgtgctttgaagtaaaaaatattggaaagcactgctttaagagtccaagaagaacagttaagactcttaaacatccttgctatatatagtagaattttattatgaccatttatgattacctggatttatttataccacaggtcacattacagcccctgagaaatagcagctaacatagaaaagacttgagtacctacacagggtatgaaagaaaatataaagaagaattgtggtttcaggaagttgggaagccaattcagatttcaaaaacactcattgaacaccatatatatggcagtgatgttgccagatactgtcatgacattgaagtttgagtgacctgaggactttggaagagtcaggcctagtttgaatctcaggtaggtcttattgaaaatgggctgatggaggtaattccaaattagagcccttccttggagagttgtgatgtgtctatataatccaggcactttcttcacagagatgctgtcggcactctgattggcagaaccattcttggtctagatcacactgagagtttacctgagtagaacctctgtttcacaaaggttttcctaggagcctaagtcactgaaaagaactaaaaattctactcattctcctatacctcccaaatcttgattctttgagtggcagtgagaaaataatgcatctttgtaccttaccatttacctcacaaccttgcagttccaatcgaagggtaggtctgttataggctcgagttggagagatcctaatatatctagccacaataggtgggtcaaactgattctcttttattgtagaggcatctgaattgccattaaaatactagaagaaaagaggaaagtttagttatgtaacaatgatctataaagtgactttatattaaaattttgatctaatttaatattgtaatactacattttcatggggtccaaactaaatcaatttggttataaaatatacttggggataattccagttccaggaagattgtatatatgtactttgccctattcctcctgctaagtacaactaaaaactttggacattatagctcagagaaacataagaccctgaaaagagctcagaagacagactggctagggttctcggaaggaacaaaatggtgatcagtgtcttgaattttctttttgcctcataaatcccagacttagagatgaagaagccggcaacctggaaacaccaatgagtacagactgaaaaagcccaaataaaatctgctttctctaaccaaagtaccagtaaagggcagcatagcgagatatgatagaaaactggtggacactgacttctgtcctttagtcaaacaccacagaaaaacctgaggcccctccccaacccacaacagcaaaggctgaatggggagcctagacttctatgctcctgaggctaaagaggcaccctacaccctcactggggttgtgtcagaaaaggccatgtagggatttagggctttcatctccagcccctaatgaagctcctgcccctgcagtatcagtggaggccaaatggggaacttcccttcccacccagccaccaaggaacaatcccttcttaggtggcaatggagtggggaacctggactttgacccccacttggcagtaaacaggctgtgccctaccccttttcctgacagagcaatgtcagaaaaagccaactttttaaaacagaagattggagcaggtatcggtaatactgaaaacagaaaaacaatagagaaaaatcaataaaacaaggctggttctgtgaaaagattttttttttttttttttttttttgagacggagtctcactccgtcaccaggctggagtgcagtggcgtgatctcggctcactgcaacctctgccttccggattcaagcgatactcctgcctcagcctcccaagtagctgggattacaagtgcacgccaccctgcctaattttttttaatatttttagtagagagggggtttcaccatgttggtcaggatggtcttgatctcttgacctcgtgatctgcccacctcggcctcccaaagtgctgggattacagacgtgagccactgcgcccggccaagaagatttttttaaaatcgacaaatctctagcaagattcacacaaaaaagaaaggaggggcagatgacaatatcagagatgaaacaggcaaaatcactacaaacatgaaaaaggataagggaatatacaaacaactctacacatataaacttaacaacgtagagggaattgaccagttaattgaaatatacaaagtatttcaattcacccaatatgacatagataattttaatagccctgtaactatttagaacataggatctgtaatttaaaaactgcccaaaaagaaatctgcaggcccagatggtttcactagtgattcctaccaaatatttaaagaattattaccaattgcagacattttctcctagaatgtagaaaagagcatgcttaccagttttatgaaagctagtataactgtggtatcaaaaacagaaaaagacaattaaaaaaataaaactatataccaatatcctctcatgaacatagacgacaaaatctttatgctatggactcaactgcaatctgtgttttctctcataatactgattagtaagaaccataatttaggatttcaatggttctgagacatagtataaataattattaaaaataggtaactaataaacagtaaataattttatataaaatataagcagaaacagactcaaggttattggtataataatggcaggcagactccttgcattcagacttctttggggaagggaatagagaggaggagaagagttagggcttatggctgagcccctggaagaaccagaaggagaatgtcattcctcaggcatggccccccaaaaagtctgagaatcacactgcctcagaggcttactagcattaacactactatttacttcaggtacactgaaataaagaacaaaacaaactacaatagtaaaatcaaaagtcttggtagccaatttttagcatgagctccttgaggcgcaagaccagatgttctactctgccgtataccattggccagtctgagaaatctgggtattttgtttgatgataaaatgattttttaaagttttgtggggttttgaagtttcagtaaccctgcttctctctttaatttgtaagacacagacctatcatattactgcttttctccatatgacccttagaaagccattcacatttctaatacccagaaaggtattttttaaaatacataatcattaggtatagtcataataattctaggccaagtctagagtctagagattcagatagaaatatgcacacaaaccatcacattccttgtgctgttccctttgaagatctgccagttgatctggttggaactgtaagctacatagaactctgtggtatagcaggacttcaggtagtgtttggcaccttgggtctggatccctgtgattatgacttccttttgcatgtccacctgcaatataggaaagccagtaaacagaactgtccttgtcaacaagtcacacactgcctaaattcattatacaatcagctttcttcagaactaaagagctagcacataagatcttagcaaactgatacaatgactacatgcaattcatatttgggcacagagtacctaaatttgaatcccaactcaatgactaattagctgtgtgttactttgggaaggtaggtagtatctctgtgccttttgttttttaatctataaaacaagatattattagaaccaacctcagagggttgattttaaggatataaagtacttagaacagtgcctcacacttagtacttgctatttcccctaacaacattgcaagaacaataacaaggaattactaaatcactttcatttttattattacgatagcagtaaatattatcagtctattaagacaaacctggatccaaggtttagaggcaaattctgctgcaagtttttctacactccaagcattataagatccaccattgtttaatcttgctaatctgggctcccagtaacctaaactcaagggaagaaaaagatttattctgaattttttaaaaacccagcaatttctcaagtgagtttaatccagtggaaaaccagatccttggaggacctgtgttgtagtcaggagtctaggcatgggcctcagctactaggccagtccttgatgatgaaatctgggcttcaggtctgtgtttggtcaactgccaaccacctcctatcccctttcttgcacacaggtcatgtttgattttttctgttgtgtttatattcctaatgctgaatgtgcctgcctaacaggaagacatggaagggtatatgggagcctcatcatcctcttgatcatgacctcttgatcttgggaagggctttgaggcagtgtgggaaaactttggaggagttcctcacatatagtggaggttcaacaaagttttctgaatagatgaatggttgccacaggcaaagggccatattaatggggactataatgcctggctgataagaccctgtgaatctggctgaaatactacatgtgtggtcaaacccagaaaagatgactgaggagagttttggaaatgggcgcgtggtcataagagtaaggtatctgatccttgccaaatccctgcagagaggctgggctttttatgtagagaaatcaatgacccccagctatcggtttttcctggaaaagactctttgggatcattatacaccagaagaggtggcagtgttaagagcacactaacaggcctttagctcctaccatagtgttccttcctttaccatatatgtaccccaaatggagctgcttcactacattgtagtagagaaaagcataaagagaaaaactgattcatagataggattgtcatgtatggtttcataggctgcatgctgcacaactgtagggggtaccattcacagaccatggtgctacaacttacccagaaactctgaagccttgatctgtgaatcagatatgataccagtgcttagtcccattggcatcctacagtctatgaaaaacagaaaaaaaatgaataatttttgcttagaaaatatatacaataaagtaaaactccatggttagggattatgtttctgactcaataattagatatttttacctaccttgtgtggccctgacttaaatatatctgattataaaatggtaaatgcactaacaagactggtgctttaatagatatagtggcatcctagaagaaagcaactgaaatcctgaaatgtaatcattttttaaactgattttcttctgcttttatcttaaattatgctattttacaacattaggtaccatccatggccaggtgcagtggctcatgcctgtaatcctagcactctgggaggccgaggggggaggattacttgaggccaggagtttgatcttgggcaacctcttctctacaaaaaaaataaaaatacaaaatataaaaatatgaaaaaaagttctagtcctgatgagactatgttctcaaaagttgacctcaaagttacaaggttatttatatcttgatcaaggaagggataccagccactgtgctacctggatgttggcacagtgcttcatactcaacagtgcttagtaatggcttaaagaatggatgaacagatggacagatgaaaactgtgtttcctaaatgctgaaatgtcaagtttagtgactcagtcattgttaaattcctgtgaccttttccctcctcaactcttggaagctggaaaatttcttatatgcacttgtccatggatcacaagtcatgaagaaggatgctttacacaggtttcccaattgacaggaatgcttttgatctgactgatgtgttttcaatgcaatcagaccatgggccggaataaaagcaattatggctacaaattatgcctttgtcacatcagagttcttagagttgaatatttccaatctaaaagttggtaatattctagtaataggcactctcctgccaaaccaaatatcacatggctcttgtgatacctctgtccatgataagaaatggcgtttgcatccctgctctctggttttctccaacctctgtgtttaggagccaccagccaggttttgatgccttcatttcaagagttttaaatgaacctaaaataaaaagaacaacattacatttgcaaaaattaacaagtaaatattgtggttgatagttctctaagaatcctaaaattcctgcttcacaagaggctttcaaatagaatttaaccatttttctttaggtaggactgaaagtataacagataaaaacaaaacaataacaacacatacacagagataactaaaaaaaattttaaatcaccaccacacctcactagaagaaactttcacttatctaaatataatgttacaaattaactcacatacaatacagcttcacagtcctaattatcaaagtgacctcgaatgacatcattgggcttcaaaaatatcatacatgtttcctttccctcttttcatttttgcttttttctcttttttatataagaaaataaaaataaaaccttcttcctccatgttttcaagttttccataaagcttacatatttgaatagagatttacataaattgctcagaaaaaacactgaaagaatgagatttctaaaacctctggctatccattctggtatttaacattaccccctggcagttaatatttaaattctgttgactataatttatgactgtttcccagattgtgggtgaaaatgaatagatatgattatcttcctcaaacacactgaaaaatgtctccagttttcctctctccaatgcaggtatttaggtttgcagatttagagacaccagccaatcctagcttctcagtctgtctgcaggctgataggaaggatgactgatcttctaatacttgatgaaaagatgagtaaatttgactgaatctcttctgtctctgattttaatacaataaattatctattaattattatattaattaattaatatgatattaatataatacaattaatactctctagatgtattagtgagttactggcatgtgaaaaaccaataagaaccctctttttttccctgctcttaatcaaaccagtccatttggacttctgtgcctgcatctgaggcagattcacacaacgtcacccaaagtgctgtcgaggggctgccttcactaactcctcaggcagcatgtgttaggttggtgcaaactataattgcggtttttgccattacttttaatagaaggcaaaatagaaggaaggctgcttgttaaaaatacagactccttggaattctgcccaaaatctactttaaagtctctgagaacaaaatccctctgccttcacatctgcattttaactgacttcctaggtttttatactgctgcacaagtagatacacttacaaacaactcattggcacagaaacatcccttctgtataattgtagactgtttaaatctacatttatctttattttgcacatgaaaagttctaaatacctttgttattctttaacttttattattattttttaaaaatgttttcctcttcaaacagtctataagtcagtttaagaatgtgattcctggagtcacttgcccaaagatattagggtgatagggcctagaagaggagcagaactgaagaatctggaaaccctcccagcagagatagctgtagctgcctgagccctgtgggattcattttttcatctgcttaagacctcatctgtatgacacacagtggcttgggagaaactgcatgttatgttgcaactgagttgggtcacacatttagcctgtgtggtgctgcaaatagttcataaattaggtgacatttttgtactccgtatatactttgggtctatgggtttgcctaggctctatgccagaaccctgtgttctgaccccttaggaagtatatgcacaaggaagaaatgagaaggagttacagattgccttttccctgtatttcttagcagggacctcttcccattacccaatctttaccaggcagaaggggccagacccctaactggtgctgtttattgccattttccagcaaggtctggccgtgaaagtgaaccacgtgaatgtcttgggagccgcctatgttcagcaggtgtaacctcacccactcttgctcatacattttcaggccaggcaagctgtagatcatcccattaatggctgaaaggacaaagagttgaaatcaattaaaaatctgttgacacagagagggcgagtggtaaggaaatatggggcaacccactcaacacccatgttcctcatgattctgcattcccaggcctacctagccatggaaagggccctcttgtatgtcacattagtgagaggctaaagcagaaccactagtccttctcatatcattcacaccagcctacagcagaaggcagggggaactccctttccaagcagtttatcactcttttcctcagcttttacagttccgtgctttacccgtgtatactttccattaacagtcttaattttccttaactacaaaagataaatacaaatatgggcagacaaagtaaactccagggattagagtcagcaaggagatatgcagcatgtcaccttaaggccttctaaattcagagaaagtttcaggcaaattaggaagtctaggagtttataaaattaggagtttatcgttggtgtatccagcaaccatagcaagtcatgtttattctcttattggtatgacaactcctctgcccacttctcagattagataactagggttctcaggctttatctactctccccacagtaaaatacgcggattttttaaaaagttcctgagaaacttgatcaccttaaaaatgtaacacaaaactgtaaagataaagtttagtgttaccaaacgtttaactgaaaccaaagtgaaggaagtgctttgtttcctccttcttaagttagaggaactgctgtgaaatttcagaaaccaggcaggtgaatttttggagagggacgggttgagatcatttgggcatccttcaaattatatcaggcgtgagaacacctatctacatattcataacacaagctcgtacctttctcttctcagtttctgtttcagttactagcttacagggcaaattttccttgtgaatttccaaataggcacacttttcccagtgtgaccacccaaatgctctcttgccactattctcctattacctgggtacctagtttcttatctcattttgttctcatatgctttgggtgccacctggtagctgctgagagctaaaactgttagcgtcattcttattttagaaaagacacacaggtgatcatttcttttatataaacacttgtgcctttagagatccagaaacaagcttattaactttaaattgcagaacaatgttaattccttttcaatgtatgttaccagctgaagcacactggctttttgttgttgtggttttctgttggtttgttttgcagcagcttctctgtgctatctttcagactttctctttttgcctcacccacagtgtcacctgccagattacatcagccctctggaatgttaaggaaccggttttagttgtagctctgggtgtctcagaagcatctcatgtctaatcttgtgaatatctaagggcagaaatcactgtgacccagtgtgatttaattaggagattagatcaaagtctgaggaaaataccgtgaaactcatgggattttttcatttctgaggatgtgagtctccaagaacttcgggacttcttttcatagtaccagctcttcttttcatcaaaggtcataaatagtaagacaaattctctcatgtccataggcatgttgctgtccttatgtagtattcctttttggcagattaggaggggacctatcaagcctgagtgaatatctttttcctggaaaaacagagtaaattgtattgcctctttctcaggaatttccttgctcttctgataatcactcatcatatagaaaaggaaactttctgataggctctgaatttgaagatgaagattataaatgaatggcataataagcctggatatttatcacctaattctgttgtattcataatcctccttcctctgattgatctttatcccagtaacaatgatgataataataaattgataatataagggatactatttattgagaatctattactatattaaatgatttgcctgcaatctcccatttaatcctgacaactatcttatatggtaaatataaattcattcattgaacaaatatttaccaagtgcttaccatgcactatgtactgttatctcatttttaacttctgataccaggctaagagaggtcaaggaatttcctaggattatgcattgacagggtaaaaatttaaatctgagtctgtgctctttccactatgcctgaaatggaggagttgtttctctttttaattgacagataaaattgtatgcatatactgtgtatgacatattgttttgaagtatatatacattgcagaatgtcagataaaggagtcttgactttgcagttcttttcataaagaaagagcagaacatagctaatacttgttcaagaaaatttcaaataaatgccatcttctgtaaatgtaggcattctaattcatggccaatcattcaagtaatctttcctcctctccactgaataaatgtttctctctctgtcatctgaagagctgcatggagagtccctggttatgataaatgcagactgttaaccacacccttatgcattcctcatgaaaagcaagacagacatttgacaagaaataaccccgactcttccatttggtggacttcagattacgaggttaggggaatgagaaaaactttcaatgaaagtacctactgggttcacagctgagtagtaggcccaagcccgacaggcagagccaggactttctggccctgatcgctcagtggcatgccatacgtaggtataactgctatttggctgaacagcattatcttccttaaaccattcaggagagtcatcttcataagtctttccctctgatgatttttcataggaaagtccatgggcatgtagagaatacggtctggatgctaaatttttaaaacgaacctaggaaaaggaatgatccacaaatgtacttaagcttaacaaaaatctaaaccacaaaaatgtcagcattataagtcaaaatggctggttataaaatcggagctaagatataaggtacaaaataacttatgtatattatttcatttaattttcataaccatcctgtgagatatggcccaagtagttttctccagaaataccaaaagatatttgttcttaggctcaaggctaaagtactgacattatctactaatgaaatgagagtgataggtagtggagatgtgaagatgaaagaagcttgattcttgttcataagaagcttttaagctcctgctgaaacagacatgcacatgggcatccacactacaaatctggagacaacaggtgctatatacaaagtctaagtgggttcagatgacaatgccctggaggaacaatttggttgaatatttaggagtggttggaagaattaaggtaagtttcttagaggaaatggaattggccatcatagaatgaacaggagctagaaagacatttcagactctcagaagggcagaaggatgcctgtgagcaggggagtaaaggaagagtttggggaatagcaaggatctcggtggaactgggctgtgaaatgcacagggacaggtggaacctggtgagaaatgaggctagaaaaggagcaggttggggccagatggtaaaggacttaaatgccatatgagaagtcttcacaccccagcagtcagacccatgaagctcctcccagcccttctataacttctagtgattaaagactccctaattgtctgttccttattttattctacaaagccagcatcaccctaataacaaaacctggcaaagacacaatgaataatgaaaactaccggccaatatctctgatgtacatagacacaaaaatcttcaacaaaatattggcaaaccaaatccagcagcaaattaaaaattaattcatcacaatcacataggcttcattcctaggatgcaaagtggctccacatatgcaaatcaataaatgtgattcaccacataaaccgcattaaaaacaaaaacagtatcatcatctcaataaatgtggaaaaagcttttgataaaacctaacatcccttcatgataaaaaccctcaacaaactaggcattgaaggaacatacttcaaactaataggagccatctatgacaaacctacagccaacatcatactgaatgagcaaaagctgaaagccttccccgtgagaactggaacaagacatggatgcccaatctcatcactcttattcaacatagtactggaaattctagtcacagcaatcaagcaagagaaagaaataaaaggcaaccaaagaagaaaagaagttaaagtatctctcttcattggcaatatgattctgtacctagaaaaccctaaagactccatgaaaaggctccaggaactgataaatgacttcagtaaagtttcaggatgcaagattaatgtacaaaatcaattatacaaaataaaatgtacaaatgtacaaaatagcatttctatacatcagtaatgttcaaactgagagcgaaatcaagaacgaaatcccattaaacatagccacacacacatacaaaatacctaggaaaacatctaaccaaagaggtgaaagatctctataagaagaattacaaaacactgatgaaagaaatcatagatgacacaaacaaatggaaaaacattctatgcttatgtattggaagaatcagtattgttaaaatagccattgtgcccaaagcaatctacagattcaacactattttttaacaactactggaatcattttcctcaggattagacaaagctattctaaaattcatatggaatcaaaaaagagcctgaatagccaaagcaatcctaagcaaaaagaacaaatctggaggtatcacagtacctgacttgaaactatactataaagttacaataaccaaaatagcatggtactgatacaaaaacagacacataggccaatgaaacagaataaagaacccagaaataaagccacacacttacaaccacctgaactttgacaaagtcaacaacaacagcaacaacaacaacaaaaaacaaggggaaaaggactcatatttaataaatggtgctggaatagccggctacccatatgtggaagaatgaaactgaaccccaatgaatccaatgaaactggattcatcatatacaaaaattaactcaaaatggattaaagatttaaatgtcagacctcaaactataagaatcctagaagaaaaacctaggaaacaccattctggatatcagccttgggaaagaatttatgactaattcctcaaaagcatttcaacaaaagcaaaaattgacaaattaaactaaagagcttctgctcagcaaaagaagctatctacagagtgaacagacacagaatagaaaaaatattcacaaagtatgtatctgacaaaggtctaatatccagaaactataagatagttaaacaattgaacaagcgaaatacaaataaccccattaaaaagtgggcaaaagacatgaacagatacttatcaaaagaagacatacaaatagccaacaaatgtgaaaaaaatgctcaacatcactaatcatcagagaaatgcaaatcaataccacagtgaaataccatctcacaccagtcagaatggctattagtacaaagtcaaaaaatagatgctggtgaggctgtgaagaaaagggaatgcttatacactgctgcttagaatgtaaattagccactgtggaaagaagtttgggggtttctcaaagaatttgaaacagaactactattttaagggaggagaccacccctcatattgtcttatgcccaatttctgcctccaaagaaagaagaagtaaaaactaaaaggcagaaatgaaatccacaagcagacagcccggcgccacaccctggacctggtagttaaagatcgacccgtgacctaatcggttatgttatctatagattacagacattgtatagaaaagcactgtgaaaatccctgtcctgttctgttctgttctaattactggtgcatgcagcccccagtcacgtaccccctccttgctcaatcaatcacgacccactcacgtggaccctcttagagttgtgagcccttaaaagggacaggaattgctcactcggggagctcggttgttggagacatgagtcttgccaaagctcccggctgaataaagcccttccttctttaacttggtgtctgaggggtttttgtctgtggcttgtcctgctacaatttgacctagcaattctattactgggtatatagccaaaaaagaaaataaattgttcagccgggcgcaatggctcatgcctgtaatcccagcactttgggaagctgaggcaggcagattgcccgaggtcaggagtttgagaccagcctggccaacatggtaaaaccctgtctctactaaaaatacaaaaattagctgggcatggtggtgggtgcctgtaatcccagctactcgggaggctgaggcaggagaattgcttgaacctgggaggcagaggttgcagtgagttgagatcatacctctgtactccagcctgggcgacagagtgagactccatctcaaaaaaaaaaaaaagaaagaaagacagaaaatacattgttctactgaaaagacacatgtactaggatgttcatcacagcattattcacagtagcaaagacatggaatcaatctaggtgcccatcagtggtggactacataaagaaaatatggtacatatgcaccatggaatactacgcagccataacaaagactgaaatcacgtcctttgcaacaacatggatgccagctggaggctattatgctaagtgaattaatgcagaaacagaaagccaaataccacatgttctcacttataagtgggagctaaacattgggtactcatgaacataaagatggcaataaacactggggacttctagaagggggaaggaaggagatgagcaagggatgaaaaactattgggtactatgcacgctacttggatgatgggatcaatcataccctaaacaacagcatcacataatatacccagataacaaaactgcacatatgccccctgaatctaaaataaaagttaaaattattttaaaaatacacaaatgaagtcatttttatctagtgaaatccagggctaaaacaaagattcagtatttgatttttttccttttgcctaaggctccagtatgtctcaatgcaacattgttacttatcctgtctttattcacaattgtgaggttttgtttattgtggctttcgtgcattaattttgatttttaaattttttaaaaaacttcagttgctttaggaatgcaagtggtttttggttacatggatgaattgtatagtggtgaagtctaggattttagtgtacctgtcacctgagtagtgtaccctgtacccaataggtagcttttcatccatcccccgttcccttttgagtctccaatgtccattataccaatctgtctgccttcgcatacccgcagtttatctcccatttgtaagtgagaacatacagtgtctggtttttgattcctgagttacttagaataagttttttaaatattgtgttaaattatcgttcatcttgaaaaaggatcccctaatcataaaagagaatattgcctcccatagcttcatggaaaatttagaataattaagattcttatatccctatgtacttgtttacgtttttaaaaagagcaaatggtcactgaaaatgtagtgaatgcttacacaggtatagtagattatattttaaaatctagaatagcttactttagaatcagggttctttctgggtttttgaatgtgagcggttagcaaaaatggcggaagtaaactttgttataaaagcaagttataatcgtgggtctggacacaagattttgaaagaaattaccagaactaggaagacactgaagaaacttgctcacttttggagggcatggagacatctttactttccttactcattttatttaacttcattttatttaatttttaggaaaacacctgaagatatttctaaattactattactactagcactgctactgccaccaccaccaccactgctatgaaacccaattcaattgctcttgaatatattaattttctgtgttaactttagataggttagctttagatagaaattacagaaagattttccacagattatatagttttcagcatttaaaaaatgagatcttttttttttttagttcgaagattgccaaattgcttggcaaggagtctttgaaaagaaatgtaattattcattaatcctggaaaacaaacaaatcacctatagctctcttgccacctgcacctttacaaccctctggtgcttgtggaaattcctccgaagatcttagcagtgctcaaaagacttacttggataacatcatccacttcagctctgataataggaccaagaattccgagatgctcttcatactcccctcgaggatcacgtttggtaaaagtgctgtcgaggtactttcgaaaaactactttcttatatgtggtatcttctggaatatcatcagagtcttcaatatctgtttccctgaaataataatactatttgtgtaaaagaagaaattaaagactgttcccagaatttaggaaattgtctctttctaaatatagcatctagcatagagaaggtctttaataaatacttggtggataaatgagtaaatatataagtggataaaaacaaaagccagtaaatatctttcaattcctaactcaaatattattttataggtaagtcttcctatgaccttttagactaggtcaagtctctatatcaatttctcatatttctatagtattattatagtatatatagtaaattcctgtagtattcttataatatctctagaatatatattgtagattatatataatttatttgtgagattatctattaatatctgtctctcactgggtataagtgccatgaggtcagccattgtgcctagtttgctcatagtactctctccagtggtaagcacattatctgacacacagcaggaacttaataaatttttgtcaaacatataaatgaatgtataaatataatcgtatgttaacacaccaaattttaagatcaaaggcagacaaagccatgtaatgggacagtgccagagcttggggctatcaggtgacaatggtcagattaattagaaggtcacacttatgaaagtcactggatgggtgaatgttttgtaccctaaaagtagccactcttctcacatttgttttttgctaatgtccattattcttaagcttcttgacattggtgtggacaaagattttttggatttgacctcgaaagtacaggcaacaaaagcagaaatagacaaatgggattgccatcaaactcaaaagtttatgcacagcaaaggaaataacagagtgaagagacaacctttggaatgggagaatattcttgaaaaccagatatctgataagaatattaatattaaaaatataaggaactcaattcagcaaaaaacccaaatagcctgattaaaaaatgagcaaaagacttgaatagacatttcgtaaaagaagacatacaaatgaccaacaaatatatgaaaagatgctcaacattactaataatcagagaaatgcaatttaaaatcacaatgagggctcacctcacaccgttaggatggctattataaaaatgacaagagataaatgttggcatggatgtgaagaaaagggaactcttgtatactcttggtgagagtgtaaattagtacagccattatggaaaacagtatgggaggttcctttaaaaattaaaaatagaattaccacatgatccatcaatcccacttttgggtatatacccaaagaaaatgaaatcagtatgttgaagagatatctgctgtcccacgttcactgcagcattagccacattagccaagatagggaagcaacccaaatgtctataaacaaatgaatggatttcttaaatgtgatctacataaacaatgaaatactatttagcatttaaaaaaaagaaaacgaagaaatgccatttgtgacaacatgactgaaccaggaggtcgttatgttacataaaataagccaggcacagaaagacaagtactgcaggatctcacttataatgtggaaactaaaaacattgagctcatagaagcagaaggtagaacagtggttaacaaagggatacagaggtggagcattgagaaaatggtcaaaagataaaattcagttagaagaaataaatttagaagatctgttgtataagatggtgactgtagttaataacaacacactgaatttttaacattgctgagtacattttaagtgttctaaccacaaaaaagtatgtgaggtaatgcataggttaattagcttgatttagccaattcacaatttataaatatattaaaacatcatgtttacaccataaatgtgtataaaacaacaacaacaaaaaaactggggtacacccatataatggaatacatgcaataaccagatgaatctccagagaattatactgagtgaaaaaataccagtccccaaaggttacatgttgcctgattccatttatgtaatattcttgaaatgacaaaattatagaaatggagatcagactactggttgccagggaataaggaagggctatggtgggaggaaggcagatgtgactataaaggggtaatgagagggatttttatggtgatggtgaacattctgtgtcttgacagtatcaacatcagtgtgctggttgtgatatagtattatagatttgcaaaatgttacccctgggagaaactgggtaaagaatactcaggatacccaaaggatctctccgtattatttctcttgactgtatgtgaatctattttatttttgttccaaaataaaaagtttaattacaaattataaataaataaataaagcacattatttccatctagttcattggctcagtctaggactgaagcatgtcgaattctcccactgactctcacatttcccaagcctgtggaaacaagccaaacactcacccatcaaacccataatatttgctatatactgtgagtcatcaacagagaatctccttctgcctttcttctggtctacctcccctactaatcccatctttccagactctgagcataacatgcaaactcacagaacacaagggagtgggtaaagcaactccgaatgccataaaagtgggttgtgagccttgaatggaatacaagattttgaaggtggttccatccctattcactctggacaggccctgcatctcactccctcggggccttgcttagaaatactcaggtagctagttgttctcatgtggtattgagtgcaacatttaaataggaagtcataggaaaaggtgttttaaacagagttctaatgtggagatgtcaggcatcagattaatgaactcatatgcataagtcacaccatacattgtgtttgcctactgtaattacactttggttttttaagtgattagtgtaacagctttagtaaaagctgtgggcatatctagacagctgatgcacagtcatcatgctatatccctgagaatttgtagttgactaagccttgctcctttcctcctctctcttctctttctgtatcttcatcccagaacaaagagcccagttcaacatggctttctacccctaagcaaaactgaattgtaaatattcttttaaaaaagggatttggatctcttagaaattctgatctaaacaagtaaatgcaaaaaggagatttctacatcatatttgagtttggatttgaggctaacttcaattaaatcatattgattagcatatagctatggataggttgggctctgcctggagcaataagagtcagtagaaacatgggtagtaagaggagaggacacagaaaaatgcttaattacagaatattatagagttctcacagtgattgttcttatattgtccaggggtcatctaaggtaaagaagcaatcttggaattgacaaaggaaaaagaacaggccaacttgcaataggggaaccacactgttcttagtataatttgcccacaattatccccctgaattgtagtagctacttttttcagcagtaatggaaaaatgagaataaaaaaggagaaaactggccaaacctttgtacaaattctgaataatcccaggatatttcttcagcagcaatgtaataatttcttctgtttccattgttgctgcggaggtaccatgctgcaatgttgtcaggatctctggaggagttgatgtttgtcctaacatcagttttgtaggggtcatcatagggcacataatcaatttcagcatagtcatcttcactgctctggacctcttcctttggaatgatctcaatgtaatctgtaccatctttactgaggcccactataaccagtggattaaattcctttgatagaaaagtatcattgagagtaggagatgaaggagatggcatctgaccaaggtctggataaggaaaagactcattaaattcttgaagaagcaatgactgactagattcagaagggtagaatatctgatcaaggtctggaggaggtgatatctggctgagatccgggagaagggtggtgtcactgatgtctggagagagagtcacctggctgaggtctggggaaagggacatctgaccaaagtttggggaaagatctgtctcaccaaggtctggagaaagtgtcatctggtcgaggtctggggtaaggggaatttgactgagatctgcaaagaggggcatctcactgaggtctggggaaaggtttgtctgactgagttctggagagaggtttgtctggctgaggtctagagaaagggttgtatggctggggtctggagaaaggggcatctgaccgagggctggggaaaggtttgtttgactgagttctggagagaggtttgtctggctgaagtctagagaaagggttgtatggctgaggtctggagaaatgggcatctgaccgagggctggggaaaggtttgtctgactgagttctggagagagagtcatatggctgagttctggagagaggtttgtctggctgaagtctagagaaagggttgtatggctgaggtctggagaaaggggcatctgaccgagggctggagaaaggtttgtctgactgagttctggagagaggtttgtctggctgaggtctaaagaaagggttgtatggctgaggtctggagaaagggttgtatggctgaggtctggagaaatgggcatctgaccgagggctggggaaaggtttctctgaatgagttctggagagagagtcgtgtggctgaggtctggagagaggtttgtctggctgagttctggagagagggtcacctggctgaggtctggagagatgactgtctgccagacttcatgttctgaggaaggggacatttgacttatatctgtggggaaggacttgtgacttcggtcatactcaagcatttcactgagctctggagaagaggatctgtgactggggtctgaagtagagtgcatttgatcagggtcttgaatggggaatgtttgatagtgttcctctgggggcactgtctgataaagacctggaggacagcttgcctgaccagtgtcatttgaggaattctgattatggtcaggaagtgaggctatccagccaaaatccatagagggcaatgtctgattgaggtctgtgggaagagatgtttcattggatttatgaagcaccaacgaatgcttaagtcttctttctgaaaatgtgttgtaggcttcacttcttagagggtgaaaggtcctcggagataaaggagcatggtgtgtgtgcttctcttttttcttttttcgtgtcttaatgagaaactggcttttcttcagtctactctttcctccatcctgtcttacttgtagagatttatgtctaactctaggaaactttgggtggccactctgctttccaggcttgttggcaagaggggtgctttctccccaagcacgtgaggcattctgggggctgatcagccaattgttaacagctgtgtcttcatcagtatcttggattatttcatagctacctttctcagaagccaaatgccatctcccaaccaaaatcttagatgagttactttgttttaagagtaacagatcactaggagggtccttccagggcctcattctggaaggagaaccagtgtcttggctaggaaggtcctcccagggcctcattccggaaggagaaccagtgtcttggcttaggtgtctcccaactttatgtgctagtaatttcatccaggagaacctgtgctttgctgcttgatctctttctaccttgggtcccttatgcttagcatgttcttgacttttgaattctccagcaccaagtgaaagtagacgtatccctgtgacatctggctgtagaggatcctctatagggtcttcagaatatgggctggaatgctctgctgtggaagaattgagaactgagttcttgccaatgaggtgtctcagtggggaaccagctgtggtggcttgttggtgagaaggggctttctgaggttctgcaaggttattgacagtgaacttactaatattacttggggaagaataatttgaaccaacaattatatctgtgtttgaagaaacgaattcagtgccattctccagagctagggcagtaagattgaactcttcttcttcctgattcaatgatgagtttcggaatgacctgattcctaatgctgcagccagtctgttctggtaatcatagtcagcatcactctcttcatcttcaggttctaaacgatcatgcattttccgtgtagccatgactgtagattctggaggttcaaaaatctcatatgagtcttcatcatcatctgggatacatttaacatccctgaatttcagcctcagctttttgcttcttggactagaattcatggaagttaacatccaagttcctacagaagagagacagacagaagagagatctggaagtctgggaaaagacatgaaaacacaataatccattgtggcaggtaatttctaataaactttcgtcaggaatattcaagtatgggctgtggaccactgcttgtctgtgacctattgattactgggtcaaaataacacaaggagagaaaaatgagaatgaaatatttagtaaacttttgtttttctaaagcaatttgacattgctgtgactctaagcacatgaccagtgcgttcatctcgcttaacagaataaaaaacaaaagtgttgcttagtggagattagaggggaaaaaaggtctttcagcacagatagttgctcactattttaaaatatattaagaaagggatgaatcaagaataaaatggacttttaatatcataaatatcctaacagcacatcttgtcttagaattaaagggatggtgatgagctctatccccacaaataagagacatttagatgtttctaagtaataattcacgaggacaattttgaatctctgaaatggcatgcattgctggaacatcaaagatttcttggtgagtctccaatagttaccattgttggtgtctactgagtgctaggcacttggcgcatattactattttaatggtcaaagtaactctgtgagatgtgattacactgttttccagataaatgacttgtggctcagtgtggccaagtaacttgtgtaaggttacacagcaatcgattggcagatcaggacttgcattccagtctgacaaactccaaagctgttgctgaagcagcctttaaggcactgtacctgatgattgaagatgactgttgcaaaaaaccgaatagggcattttgataaaagaaatgctcttttgtggccaaaatatttatgcttcttcctcagagttatgccttatttttctgctgttgtatatttttacttcctactttgcccagagaaggaaaaatataacccacactaaagaactggatccatttaagtcattaatttctcaaagagaaatcatgagaaacattgaaagaaaagcctgcagggggtcagggagatacatagaggagcactggtagcctggagagttgcagcagacctttatagaccagaaattcaaagcaagcttcctctgtgagtgtccagactcttactcaccaacattatccattgtgaccgtcacagattctccacgcatggggaagagggtcaaggtgtcctcatgcctctttccatagatgaatgagtgcccagtgaagtggatggtcaaaatttcattctgggtccccacactacagaagtgccactggacagtgtcatcaaagcagaatccaagagtagttatgctctcaggcacatagccattgatagctgaaagtgtaaaatctgttaaaattccaagtctatgccaacaaaagggcatgtgtctaattatacctaagataaatgtctccatgttaatttggttgtgtcaaagcagtgattatccaagataagctttatctagtctaacatgtgactagaagatcaaactcagaattttcaaatgagagattattctcctaaattagccaaaggagaaatctcaggaaaaagataaagccttccatttacattgatttagtcattcatcaaatgtatagtaaatattttgtgctccattctctgcctttaaagatattctaataattccacttggaggaaaagcataatataagaaattcatctttttgatatattagtcattgggtaagaagtaatgtccctaaaaataaagcccatttagcatattttatagtttttattgctgtcttataatctacatagtattcacagtttccatttgagtatccagttcatacatttcattattgttaaaagggacactgctgtaggcaatatttttatttacttatgtactaagcatagtaaaaaaccaaaggtatgatttctacaagggcagggctcatgtctacctcgattaccactcttagccttagtaccagtataatgactggcattaacaaatatttaaatacctacttaaatcacttaagtgactttaataatttacatgatgtattattagtttatacctcattctagatgtttttctaaatggtctataactgcattgttcaatatggtagccactggctacaagtggttatcgagcacttgaaatatgggtagactggactgagatatgctgtgagtataaaatatacattgaatttcaaagacttagtaataaagtaagtctcattaatttttatattggttacatgttgaaatgataatattcaggatatactgagttaagtaaaacatattactaaaattaatgtcacctatttctctttactttttaatgttgctatcagaaaattttaaattacgcatgtagctcatacgtagtttctattggacagcactggtctagaactatgatagattcactgccaaaaggaagttatgcaaagaaagctgagagtaattttctgtttgaattatttgacctggcacctgtcagctctgataatccctagctgtcagtcatctgaagctatatgaacagaacatgcagaaatcatcctcacatgtgtgattacctactagagaaggtgattaccatgactctagactctgaggatcagtagggggaccctggctgttgtggagaagtttgcttccagctggctcagtgacatttctctcagactgccatggcagtgcttttggccactgaactttagaactgcagcaaatgccggaaccctcattcagggaattccttttgttctgaaaatcttactgatcacttgaaatgtcttcatgcatgcctttccaagactcttgggtccctatactcattttgctctactttgatgtgtcaatccatctttggattacttgccttctttctgtcctagccatatattcaccctgaactcagtctaggatactattgacatggactataacaccttccattagtcctactctctcacccttttcctcaccacgcagagtatgtctgtgtacacacacacacacacacacacacacacgcttggaatagaagatcaaacgcatttctaaggatgtgagcctttgacctcttgcttaaaaatgttgctatgatgtcacccacggatttcatcaccaagtctttggactggaagtgaggattggaggtgccccttagcgagtagattttaatccatgtctctgactctaggcacagtcatatttcaaccacaggaatgaaaaactgatgaacaaaaatagtactctgacttactgctcatgatgtttgattcataaaacttggggtcatcacgtttcacctcatcaggattttcacaaaacttgttgatgttgtcctcaaggtaccagcttttgttctcatcaaacacagcaaacacagcctgctgttcgatgtctgctgccctctggaggacaaaacagtatagtactggtacaagaacagacgcatagaccaatggaacagaatagagaactcagaaataaggctgcgcacctacaactatctgatctgtgacaaaagcaagcaatagggaaaggattctctattccataaatggttctgggaaaactggctagccgtaggcagaaaattgaaactggacccctttcttacatcatatacaaaaattaactcaagatggattaaagacttaaatgtaggcctggcgcggtggctcacgcctgtaataccagcactttgggaggccaaggcgggtggatcacctgaggtcaggagttgaagaccagtctggtcaacatggcaaaacccgtctctactaaaaaaaaaaaaaaaaagaaaagaaaagaaaagaaaagaaaattagccaggcatcgtggcttatgcctgtaatcccagctactcgggaggccgaggggccgaggcaggagaatcacctgaacatgggaggcagaggttgcagtgagctgagatcgtaccactgcactccagcctgggcaacagaacgagactccatctcaaaaataacagaaacaaacaaacaaaaaacaacaacaacacacttaaacgtaaaaccccaaactacaaaaaccctggaagacaacctaggcaatattatttgggacatagggatgggcaaagctttcatgacgaacatgccaaaagcaatagcaacaaaagcaaaaattgtcaaatgggatttaattgaaataaagagctcctgcacagcaaaagaaactatcaagagagtaaacagacaacattcagaatgggagaaaatttttgcaaactatgcatctggcaaaggtctaatatggagcatttataaggaacttaaatttacaagaaaaaaacaaacagccccattaaaaagtaggccaaggacaggaacagacacttttcaaaagaagacacacatgtggccaaagagcatatgaaaaaaacgctcaacatcactgatcattagagaaatgcaaatcaaaaccacaatgagataccatctcgcaccaataagaatggctattattaaaaagtcaaaaactaacagatgttggcaaggttgtggagaaaaaggaacacttatacactcttggtgggagtgtaaattagttcaaccattgtggaagataccatggtgagtcctcaaagacctaaagtcagaaatacctttgaacccagcaattccattacttggtatgtacccaaaggaatataaatcattctgttataaagacacatgcatgcgtatgttcattttcgcactcttcacaatagcaaagacatgaaatcaacccaaatgcccatcaatgacagactggatgaagaaaatatggtacatatacaccatagaatactatgtgaccatcaaaaagaacaagattatgtcctttgcagggacatggatggagctggaggccattattctaagcaagttaacgcaagaacagaaaaccacatactgcatgttttcacttacaagtgaaagctaaattatgagaacacatggacacatagaagggaacaatacatactggggcctatcagaggatggagggtggaaagagggagaggatcagaaaaaataactaatggatactaggcttaatacctgggtgatgaagtagtaagtacaacagacctccatgacacatgtttacctatgtaacaaacctgcacatcctgcacataagtacccctgaacttaagagtaaaaaaaaaagaaaaaaaagtgctgtattcagtcattaacattgcagcaaattatctacaccactgagttctcagaaaccaaagtgacatagttcttggaactactgaagccatataattcaggcatttatgagagtccattgtgtacacagcacttgttagagctaaaggtaatatgcaaaagcaaacagaacagataagaaaattcagagattaaaatatcccaaaagagccgggcacagtggctcacacctgtaataccagcactttgggaggctgaggcaggtggaacaccttaggtcaggagttcgagaccagcctagccaacatggtgaaaccctgtctctactaaaaaatacaaaaattacatgggggtggtggcgggcgcctgtaatcccagctactcaagagactgaggcaggagaatcacttgaacccaggaggcagaggttgcagtgatctaaaatggtgccactgctctccagcctgggtgacagagtgagactctgtctcaaaagaaaaaaaaaaaaaaaacaaatcccaaaagaaaaatctcatttcgctatggcagctgaaagtctgtctatctctgtaattgcacacctttcaacatgaatgattgactgaatatgctctgaataagtgcaaaggatgaaagagaaggttgcaatagaaaagccttatgcttctactacctgtttcctttcctagctcaataaatcaggatcttccatatgtccagaaattcatttctgctttttctaggcatatgtttattttgtatgccttgagataagacctctttggttacagtttagcataattgggaattttagtttaataatatgagactacaattcttcaatgaagacaaactcagaaattcagtatctttgttcacattcttctgtatactttagtctcaacagagatgggccataatctgggtccaatttcactaggaactatgtctctaaatttggttgctttcagagaatctctcctctgtctccctattgcaggtctctaaaaatagcaaagactggtaaagagctttatacttttaccagatggtatctcactgaacccccaaacagacctgtaacatttttaggagggttattacccatttgataaaaggaagaaattaggaaaggctaatcaacttgctcaacacatccaataccaacagacctggaatttgaaactaagacaaaatatgttatcacactctagacttgccttcggcagtgatggtactgataaaaatagacaagacaaaaaaaaaaaaagaataaatgttatcacactggtgctaaaaaggactacttgacaattactgttctcttgaaggaaatgccccattatttagccaggagacctaacatgttctagccagaagaaattctcagaatttctgaaaggttacttcaaggacaaaatacctgtattccttgcctgtccagggatctgctcttacagattagaagtagtcctattagcccagaggcgatgtctctcatgatgtccacgtcactgtagtatggtcttgttaagcactgggcatcattttctgtgggttcatcaaactctaagatgttccacttataagtataggtttcccctggttgaactgctctgatcatggtgttgttcctgcctgaaagaaaatatattcaaaattgttttcatttgcaaagttatttcatgataataaataaataaataagctttcgctggaaccaattaatattgcaaaaggaattcttttatttttattttttttaaattatactttaagttctagggtacatgtgcacaacgtgcaggtttgttacatatgtatacatgtgtcatgttggtgtgctgcacccattaacttgtcattaacattaggtatatctcctaatgctatccctccccccgccccccaccccccccccccgacaggccccggtgtgtgatgttccccatcctgtgtctaaatgttctcattgttcaattgaattctttaaatattctacttggaacctggataacatgtagccattagataatgctccactagaggccactatgacactaataaaagacaccatattttgttaccactaagagacaaaactcctgaagtgagaagggtttggctgtgatttttaggatactcctacatgtatactacctgactgcagtagtgacaccaccgggcaaggagaatagcagaaaaatgtggcagcctctcagaagttactagttggattcagtagaagtgaaagattcaaacctgaggtgaaagaagagttgacttcatcttcataaggcgagaaggtcactccatgagggtaaatgctataggggcggctggccatatttttgaacacgatctacaaagttaaatcaaatttattctaggatttaaggttgatcatgacaaataatataagatactagctttgcatattcaccttttggatggtgtgtgtgtatacatgtgtacacacagtaggaaaattagatctgtttatctgagcagtaacctcccctcatcacttggcaggagcattggagagagtgtttcactcacacattaaggtggaaaatggaaagagaagtctgactttagaggataggttaggagaagtgacgttttcctcacagtatcactctctccaagcaagtcctccttcccctgcccttctcttttcagcttgggccacatctcattttgaatctgcttctcatctctagaccatgatccccttcccctgcccggtagattttttaggacactgtctttgaagtcatcttctcagctaggttcagtggctcaaacctgtaaccccagcactttgggaggctgaagcaggtggatcacttgagctcaggagttcaagaccagcctgggcaacatggtgaaacctcatctctacaaaaaaatacaaaaattagccaggcgttggggcgtgtgcctgtagtcccagctacttgagaggctgaggtgcgagaatcgcctgagcccaggaagtggaggttgcagtgagccatgatcacaccactgcactccagcctgggtgacagagtaagacccttggtgggggggaaaagctacttgcttgagaggcacagacaaatagccagatcctgaacttttaataaggtatgtctacacttgctgagagcacataaaagggatcagaaatggaagaagggaaagaggcatggagaaaaaaaactgcttttgtcctttggctattttaaatgaacagaatagaccttgtcaggtgcataaaacacacaggagtcctagttaggctctttaatctgcaaaagagaaccttaatcctatcttctatttggttgattgtcaaagcctttggatcatcctttgtctgtagattaactacactctaggattttgtcaaagattgcaacctttaattctctgctgtccaattcttatctatcttggtgaagtgacatgacatttaaggagaattgtctgaggaaaactccgtgctcttgatacatggagtttaccttcatcagagtccaaccattagagagctgcatacctagactacattaaaaaatgagtaaaaattgtttctattcaattgtgtttactgttatatcttagctataatgagaaatattttaatgcaacttttaatctattattttatgcaacttttaatctattatgctggttataagaattttatcaaggatgccatctactgtatcactcagcactctcttttgtagaactcattaaagaagttcctcttagatcttaacatcaggataaatggtgctttctttttgtagatgatgtaaacttcaccctgacatatttccttttttacactgactgccataaagcttaggacaaaatttgaagacagccttacagggtcacatggtatctacttatctgtggctttattttctttgtccccgtattctatcccaattacatagactccttgttttatgcctttataacttgagaaactgtctcagatcctttgtattactgagtaagctgtaaataaatacaaatactaaataaaaactaaaagttgcatttgaatttaaaattatatgagcatctttttcttttaaaattaaaaaataaccaggtactccataatattttactatgtaatttctcccatgattctgtatttgtgttacttactttgagtgtgtctctgacctgggctctgataataggacccaaaatcccatcttctttcatattgggattcactgtatgtttggtgaaggactcatcttcgtactgtgtgtacataactttcttataatgttttccaatttggtttgagaaattatccaaatgctgagacctgtattttcttaaagtgaagtaaaaaaaaattaaaccactttctcaaatagagatctcggtaggatggggaaacccttgtgcttaaacattctgctcttagattagctaacatactagttctctaaaaatttcttagtgtagtttgcaaagtccttatgttttctgtctagttggaaaactggaaacttctgatttgtctcctgcatcactgataaaagtcataggtaactggttagaagcagctacttagatcttcctgtcattcttattgctacagcagacatttgatatctctgggaaaaggcctatactggctgaaaagatactaggaatttttctaaagtctgtcctatcacttattctatgatagcctttttggttttaaaggtatttcttaatccctaaaagcaacttccaaccccaggaaacatttactagcattgttaatcatagttctgtgctattgggctatctcttccaccatctagccaattctctgagctgactgaaaagcaacctccttcacccatcttttgtagctactgggataaatactttgggagcagaaacatgaaccacttttcccctgccctctttattaccttagtttgcaaaagcaactacatgcggccaaaaagcacattttaaaaagctcaacatcagtgttcatgagagaaatgcaaatcaaaaccacaatgaggccgggcgcggtggctcacgcctgtactctcagcactttgggaggccgaggcgggcaaatcacgaggtcaggagatcgagaccatcctggctaacacggtgaaaccccatctctactaaaaatacaaaaaattatattttttgtattttgtatttgtgttggcgggcccctgtagtctcagctactcgggaggctgaggcaggagaatggcgtgagcctgggaggcggagcttgcagtgagcagagattgcgccactgcactccagcctgggcgacagagcgagactccgtctcaaaaaaagaaagaaaaacgcaatgagatgccctctcatgccagtcagaatggcgatgattgaaaagtcaagaaagaagagatgctggcaaggtcatggagagaaaggaacacttatacactcttggtggaatgtaaattaattcagccattgtggaagacagtatggcagttcctccaagacctaaagtcagaaatatcatttaacccagcaatcttttaagatggaatatcattttatgaatttatttttcccagtggaaagcactgactgttgccaaacactcctggattcctatctcagttctgtcaacaattctataatcttggccaaattttttttgttctttttcctagtttaattgtttttaatagaaaatacattcacataatttttattacagtgaaaactctcacttttctctgatgactctcaaaatgacctccctaccctccctgaattttctaggtagccatatattaatttcatgcgtgtaattccagaatacctttatgtcttacaaataagaaaatataaatattcttatccctttcactcctttaacaaaaggcagctatgtatacacgctatactacatcccagctttttaatttaataacatatcttggagaactttttgtattagtacatacagagtgtttgcatcctctttttttgatgcttagtattccattgtatgaatgtatcctaatttattaaactagttttctactgatggacattttgggttgtttccagtcttactactactaacgttgcaacagtgaatatgttgtacatacatcatttcacctgtgaacaagtgtatctgtatagttagatttccagagtgagatagctgagtcaaagggtatatgcatttagaattttgatacatattgccaagttattcttcagaatccttttaccaatttaatcttccacgaacaatatatgatagttcttttttctcacagccttgtcaacagatgatgtcatctggacttgtgaatgtgatagataaaagtagtattcccatgaagtttaatttgcatttctgttattatgagtgaatttgagtaacttttcaagggtttaagagctatttgaatttccaaatctcttaatctctcagacccatttcctcatctataaaaagaaataagagcagtatctagtttgtagagttgaagcgaagctctcagaaagggacaatacagtgcttggcaatggcaaacattcaacaaaaggtagctgctgttgtcatttttattattattaggctgaatttctttggtgatttgggggtaattcaagattaatttttacaaaaagacttgaatagaaaccaatacatgtgtccccttgagagctgtgaacttacatttcaccccaaacatctaggaccctatggaatgtgtcttgaacctttgcccagtggtatgaaccccaacaactcacttgtccatattcgctggtattacaggtgcatagtcccaaatgacttcctctgcagcaatgaagtattcccacctcttcatgtgccgcctctgctcacgagttattttcttaagattcctggttttctttgggcagtttttaatgtcaatgtaagcctgcatcccagctgagttaggacagaaagacaatgaaataactcaagagaagaaattatggttgattgaaatgcatatcctttaaatcaacttgtggaaggtttatattaatataataagagtgaaagtaatgctcaggcaatttttgaacattttagtttggaactctttaagtggcatccagaaaaggcaagaattttaaaagggggaaaaggaggaggggttagggaaaaaatttggaaagattccctttatttcttcttgagcaggcaaatttctaataatttttaacttcttaagaccttatgaattaagtcttgttaaattctcatttttctgtcatctgtcccttaatctataaaatgaagtagcaccagtacctaataaaattgttgttaaaaattaaatattaataacaatacataatgcacttatcctcaacaaagaaacaaaagttacattgttgttttaatattattgggaactctatcttccacggatatcatgatggttttattacttcaaatataattttgactactcgtgtgaaaagaaacagaaatgatctcatgaagtatctcttccttatatgtgttgcttatacattattttggtaacaaaatgatttcctattgtgatatcatttccttagattttagtctccatttatatgaactctaatctcaacagttttaaagcaaaaatgtgtagtagaacaatcagttattttgtttacacgataccacataacgtgggttgatttattttcccacctgaattccccagtgttctttggagctcacccctcagtatatgccatgtatgatccattcaacacacattcattgagttcctctctgtgctagactttgtgttcatcccactgtaaaggttaatgttttcatgctaaacttttacactttctacaacttagtgcttctgtaaatttgcagtttgtcttgtgctagcatctaggtcttttttgcatatgaagtaacccgaagaaagaatatctctatgtatgcatttgttttcttcctcttttcttctttcgaggaagttagagatctctttagcttttgcttaattaaaaaaaaaaaaaaaacctttgccaattccttcgctttctccatccccaaagagcaagttataaatctaagagcaaaatatctaagtttggttgttaggaactgaggaaagtttgtctgcggtgcaggtggcttgaaagggcaagggagaaagagggagttagtgcatgggaagaaaggattctgcattgagaagcaagactgtcaggagagtttcttgccttgcaaatgttttggggtgagagaagatatgatccactttccctctgggcccacagtcatatttgcggtagtggatgtagcactgacaagggtgatggctgagaccttatgatggttctgctccaggacctggccgttgaaatgaatggagaataattctggccccgagctcattcccagcagatgccagctgatgtggtcatgggcacaaactgttatatctgagaaagagggagagacacaggccaaaataagcattcagtcaagtactctgtgatcaaacattcactcaccaagtgtattgagcacctgctgtgtgtcaggcattgtataaagctttgagggaacagacactccagttgtagtttgtgccctgcaaaagcagacatctgagtgaccagcaaacaagcagtgacaactcattgtgataaatggcattatacaggtaacaacagagcttagagatggtggatgtgaactcaaaaacacagggattgctaaaggattaggccaagaagggaaccaagaaggtaaccgactgttctggtctgaggggtttcccaagattcaggactttaactattagaactggtaaaaagtccacggcaaaatggaatgtttggtcaccccagtctgatctcagctggagggagtcaaatcaccagaaccgccaatagggctgagttcaagcacttaatcctctcagctctctagctgtagtggtcgaagctctgcctaagggaagaagatgtgaagatgatatgaggattttcaattgttatttttacttactttttgattgttttaatgacaagtcaacgaaatcactttggggttacacactctccttaaaatgcagtgtacaagtcctcattatgctgagccattgggagcttttcatggaaggagtagtgataactgaatataaaaacttagttttgctccttctttgctcctacagtcactgggaaaatgctcatttgctctgtggggagactccatccttggcttttaggtttctgttttacatctcagatacataatcactagatactagataatgggcctgagaatcagttccttacccacacaaaggcttgttttttttaggagaccattgcaacaaagccaggattccttgcatcactaggaggctttggtggaagcgtttatccatgccaaagaaatgcttatattgagttcagcaattaacatatctgtgttagcatttatcatatgtattcaatttattctgctttataaggcagagggtttttacaaatgtttactattcttagtttctactgatggtctttccctaccttgtcccatttacccccaattattcttttgggaactataaattcgtaaactctaagctcagatcaatttatttttatttttgtgcatatggttttgcttttcttggcatccatatacttatacagattgttcactctgccaggaaatagatgttaggataaatggttagtccacttttgtaagtaagcacattgagacaactaatttatccagggccacagaaggtagtctgataatctgaagtctgaactcagattatctaaggtcgaggtcagttaactaagccccagtttttacaagctcctagtattggaacttgggatcaacattgagagtcatatgagtatattttcagaaaaccaagtggaaaatgtagtcaaatgaaatagaatacaatttaaaaacactacccagatctcaactcttaacaatatttgtgttttagtaagtgaagctatttgtgattttcagatggcattagagaataacctctaagaagtttagtgttttgaaatatggtttatttagtaaagtggcattttaattttttaatgtttttccctcaggctagtatcatataccctggatctttagttgtaggtcagttctaccagagagaaatagaagagatgtggtctaagtgggaattagttattttttctcttaacgattgctatgattttgccttctcataagtgcccaaatgcaaatggaaagagaaaatattctagatgccactgaatattactcttctgtcaccttttgaaatgctggttttttttgtgtgttgaggattactcctaatctgttcatctttactgcaatcttcctgctgatccttcctgctagggcttgtccttgaagaagccatggtcatcatatagaggaactgcagaactcggagagagtggctgagctgataccttaaggtcttattcaaagtacaggccaaggtgaaacctactcaggtcactatacctaacaaggctgcacatttcttctctagcttctaatttgtctcttctatttcctgtttaaaaaaaaaaagagaaaatatttccttcttgatagggagttgcaaaacagtgagtatggtcaacttctctagtgctttgaagaaaacaggaccgaaaaattactaatgattttactgttgtttaatggtacacagccctcgtgttacctggcattgtcccattcacatatccattgactgtgtacattagggatgatgactggctccagctcttgctttcatcaaacacagcaaatagtagcacgatttgcttgtcaaacgtcttctgtgtcccaccctcagttagggtccctatgaaaggaaagacatgttttcagtagcactgcagatagaagacgctcattagctttcctggatagcaaagagtttagggcaagcaatcaaccataatgatttcaacttgaagaaattcttattttttaaaatagcatatttatcaagtaataatggttctagggttatttaaaatctggtgccacactgtcttctttgataccttcttgctttggggaacaggctttatttcatccagcttgggaagaaaacatttggtgactctcaagactctgtacaagtatccatttcccccagtctcaatagaagagtatatagatacgttagctcagttggtaaaagcatcatgccccaagtttaatgctgtcatcttatttgtatatgaaagggggcattagataattgggtggaagtatcagcattaatccattctcactatgagaaaaacatgctgctgatggtaaaatgcaagaagagtcttttgtaagttttaaggtttttttcagtaccatcacagtatcttatatataccaggaaatggaaaaaaagtctttgtataatgagtaaatacattgggcatgtatgtaggtatggcctgagcgtgtatgtataggcagatggtgagtccatcacgttatttcccatgctgtggctcactgtggttgtttgttttaatgaaagatgggctggattctcatgggataaaatgaaaatccaagcttgctcctaagaagcccagccaataaaagttcttgtaaagtcacttgagtgtgtttgaaacctaccacccaaagttttcaacttgtttgtaagaaaggaagctggcatttcacgtgtttatagagcaaattaccagcccaaacctcagatatgtcaaacatgttagccaaagttctttccaagagctctttcagcagagtataggctactgtatactttctaaaagactttggccttgaggtaaatgttacagatcatacaagcatgacatcagaacatactctcaaacaggaatttgcctgggagaaccttaaggactgagatgaaggaggaatgagaagaaacagaggtggatccacaccctgaaatagcaggtgtttttttctcttgtcaaacaatgatctggtctccgtgccgtcttcctctgcttgatgtacaagaagttaccaagatgctcccaagctttgtcccatgacagaactcctgaccattccaacatttagttgttgaatcttttggtgggggtgttcttaccttttttacagataagcaggggcccaatcagccccgagttgaaatcctcgatcagattttcatgggagtaatagatgtgtgtgaggcatggagggtcatcatgggtgggtccactgtcctcactgatactccattcataggtgtattctcggcctggagccacagcgtcgtccatcttctccgcagggaatgtgtggtcaaggtaagaagcacctggaggagtaacagccatcaagacatgtgggcagtttctgaggattgcgttttcaccactctcaaatctggggatagctaagatgagttctctggagatgcatatgtccttcaatagtgaacttttattatttggaaagattcacatatgcccatttctatgctcatgtacttacaaaggctttgataacatggtgatcttaagaataacaaatgttatttgtaaattaaagtttagcaagttaattttccagggtacctgaacaattattatttaaatataatcagagaattgaatcgcctttgattagtaaaccatctcagaatataagaatgggtgatatcttctttgtggtgtttaataagacatacttagcctattaacatgagatgggaggatagtcagagctgtttatgtattattttgttttgctatttcagatcttctttccaactgctgtgatcctcagctttgttttatctctttatttcatcttagccatctgattatctcaattttttcccccgagccacagcgtctaactcccctatgcaggctggttgtctgtatgaatatgaaatgtgtccatcccctgaaacttagatgtcttactttgtactttgtgcacccaaagacacatcattaacacctccatgtatattggactttccctactgataggagagggagaggatgaagaaattggtcttctttattgaagagaaggaactgagatactcaatattaaaagaagtgtagagggttgggtgaggttttcaataataaaatggagcaagtgaggtcaggaaggggagaggtgagtgccatagagagccaagtggaatgaacagtttcctctgcctgaggaattcctcatttaattaggtgaaagattccctatcatcagctggtgacagaatttctctttgggatgcagttatttttgtttggtacaataacttgataaattctttacgagaagaaggtgagaacatcagtgtggatgtaggcagacaacaaggatctggggaaaaaagcctgaaatgttttacatgatggggtaaaaggccaataaaactcctcttactgaagcaactacactttttgaaaactgaaatgattaatcctttccctccccttcctttctcttccctttcttttctttttcctttcctagtttcttttcttttctcctttcttcctttctttgtcttcttccttccctattccccaccctccttccctctctttcttcctttcattatcctcattgaggtataatttgcatataataacatttaccacttttaagtataatatttgctgagctttgattaaaacaattacccagtcttatagctatagttccaatcaagatagagaagagttccatcattccaaaacatttcttcatgccatttgtagccaatgccctctgggcccagacaaccactaatctgctttatttcactataatttggcttttctgtaatgtcatatcaatggaatcatcattacacacccttttgtgttggattagtgttagctggtatggtatataattttctatcctttattttttacctatctttgtctctctcattaaagtggatttcttaaattctgcatacagtttagcattgcttttttattcaatcttatttgtttcttaattgtagtgttctttccatttacttttaatgtaattgatgatatggttgaatttaaaactgccatctttatatttattttctatttgtctatctggtctttattccttttccccttcctttctgttttcttttggattgagtatagttagtgatgtttaatctccattgttgccttcttagctttgttttcttagtggtgcccttccgtttacaatatatagtacatttttaacttgtcacaaacttccttcaaataatattatactatttcacttgtaagaaccttgcaataatatatttccatttcttccctcccagcctttgtgctattgtcatacattttatttatatatacataatataccccacaataaattgttactattttgctttaacatttagataatcaattgcctttttaatagattaaaacgaggaaaaaatttctctatatttatcaacttctggaacttttcattccttcttatgaatctaaatgtctctctgacataatatttcttctatctaaaggagttcctttaacatttttttctgctctgttagtgagaaattctttctgcatttgtatgtctaaaacactctttattttgccttcatttaaaaaagactttttgacttggtatagaatactaaacagacagattcccctatcttctaccctcccaacactttaaagatgtccctaattgtcttctggtgtgcatagtttctaacgataagtctgctatcatttcttggttttgttcccctgtatgtggtgtgtgtttttatctctcactgcttccaatattttctctttatcactggtttccagcaacttgatagtgatgtggcttggtgtggttttcttcatgttccttcttcttagttttgtcaaacatcttgaatctgttggtttgtagtttacattacatttgggaatttttcagtcattatttcttcaaatactttttctgttcctgctacttctgggatccaattacacatatgttagatcacttgatatggtcccacagttcactgatgctctgttcactttcttcagcctttttaatctctgtatttcactttgcagtttctattgcaatgtattaatattttctactatttcctttcacagtgtctaatgtgctattaatttcatccagtgtttgttgtattagtggtatccttcagtttataatatatttttttatcctttattttttacctttcttttctatgctttattttttacttttcatgtcaacaattgtattcatctacagaagttctgtgtatgcatatttatattctctatcttcatcatgctcatgcttttctctgctttctggaacatattgagaagatttatgatagctgtcttactgtctctgcctgctgcttctattctctctttcacttctcaatctgttgagttttttcttggttatgagtcatctctttctgcttcttctaatgcttgtttatttttattaacattgtgaatttacattgttgtttgttgcattcttgttaactagtattgagttttattcacagttaagatacttgaaatcaaatcttgttttttattctgttgcctcctcagcagcctgtagtctaattttatccacccactgtttctaaatccttctgacaattctatccagtgctcatttattaggaggtctttctatgtttgatggtaggaacataaacgattaccggccctgagtaaggtccagggactgttccacctgttcctttcaagtgacatttttcttaccctcagtactttcctcacatgtatgtgcagatcagtattcaacttgacaaaacctctctgtagattctctagagctctttctctgtgattatactgtcctctgcaggactctgccctaaaatcacaaattctagccatttgagcttctccgaagtccaaactctatttcctcaacccatagagactctgtctgggttctccctgcttgtgctgttccctggaaacactcttcaagcagtaagcttaggtgctcatagggcacatctggtttgttactcttcttttactgtcttgagttgtctgtcattcgatgtctgaaaacttctgttttatatgttttgtctgcctgtctagttgttgagaaaaagggtaaatctggttccttatgttctgaagccaaagtctgagatgctaaatttccatataaaatatttttttacattacagcaatgtcagcttcccttctttaattgtacctttccccatcccaactgtggaaaatctattccactcaaaacgctttgcatgagtttgcatggcatcagcatatgtttggattctccaggtgggagtggaaaataaggcacatccattcaatagcaatgaaggattcaggtactacagtaacgtgcaatgtatctcatgaggttctgagcatggaaaccataagttgagtaggtatatctagatttacttcttgcataaagtccttaacgtggaccacaagtccatgtatgatttacctctacttctctcttcagtcttatcatacgtcttttctcttgtttactatgggctccttgtcccttgggtcccctgtcagttccccagacatccaagttctgtcctacctcagggtctttgcagatgccattccctctgcctagagtgctcttcctcccgtcttccttttgataaatatgtgctcatcattcagacatcaccttgaatatctgttcacttctacctttatctccaattctgatacacatttttttcttttacagcacccatcacaatttgtaattaaatgcctgtgagattatgtgactaattcattttcttctactagatcataagtatttgtgtcctgcacattttggtcacccaagtgtgagttcctcaaggaaaagtgctggattgtatttgtcttagtgtctctggtgccttccataggtacctagagaagcatggaacatgaacatgaagaagatgctcagtgaatatttattaaactcctaaaatttaaggtcctatgggctacagcctaggtcaacaagtcaaagctcatggctgtgtgttgttatgattgcgtaatgttaaaatagattaaatgccaacattaaacatccggagaaattatataagaatttggattactggtttctctttaaaaaacaaaaacctggagatctggttaacaacaggaccaaactcctgcacagaattttgttggatctggatcttagctgcccttttctgctttctgatgatcagttcttactggaccaattttgttcactgaactacttatctggctactataggcatctgagtttgtgaactttgcgctagcataaagtggactttgttgtgtcttcccccaacacaccccaaaggatagcttgacactaataactaatatttactctaggctgtactttcactttgataataaaactgtcaagagctgagaaatgataaaagcttaagtcacttcctgtaagttataacataattctagtctataaaagaaaaaaagtttatggagaaagtctccactaataagcaggaagcattatctgtgaaagattacaaaagagctttggtaacaaagcacaaacaggactgataaggagagttgccctctcaggtcagaacttgtctattaactgaaattagcatggctagttgatgagctgcaccatctaccttgaatcaagcatgacagcccttcttcaatgcttcttgctacatggcctcataaagttgaaaaatgatgtttctggacaggcagcttccactgtttcaactgttaaaacatcacatggggtttctatagtagaaaatgatattctttccactgccttcacaagctcccctaagggcaaaacattatattctttgcagggtaggagataacttttgaagttcttcctccctttatttttctgggtaaatgtgtgctcattcttcagatgtcagatcaaatatcatcttacacccttcttgatctctgattgtgatacctgtttgtttgttgttggttttttgacagcactcatcgccatttgtaattcagtatttgtgagactatatggttaacgatacttttttctgctagatagtgggagaaagcacttgaacttcagggtcagagttgaaaatatcttggtggttgtatcatttgctaactgtgggaacttgggaaggtttcttgaagtccctttaacctcagttttttcatttataatttaagataatataatcctttttctagagataactttatcctttttgatgggttatgaagactggaaaatatttgtaaaatttctggctcctaacaaatgctctgatagcctgtgggaatacatgttcacattttggttaagtattttctttcccagtcatgttgcaattaatacagcctctttcctttatgttctactttagataagatagatcttaagtgtgcttgagttctggtaacacatgtgagtaagatagaaattggtgattttcttagtttgggttgctgttaacaaagtaccctggattgagtggcttataaacaacggacacttcttcctcacagttctggaggctggaagtttaaaatcagggtgccagcatggttgggttctggtgcagggtctcttccaggttgtagactgccatcttctccttgtatcctcacatggtagaaagagggtgagtgagagggtcccttttataagggcactaatctcatcatgagggctccatcctcattacctaaaaatctcccaaaggaggggggagggatagcattgggagatatacctaatgctagatgacgagttagtgggtgcagcgcaccagcatggcacatgtatacatatgtaactaacctgcacaatgtgcacatgtaccctaaaacttaaagtataataaaaaaaaatctcccaaaggccccacctgctaatgccatcacactggaggttagatttcagtatgtgaatttttggaggacacaaacttccaatccattgtagtgatgtatctattccaaaggcgatgaaagtaaataagacttttttggtaaaagtactttttttttttttttttggtaataagtaagacaaagtacctgctcaaaattatcagcaaaatcaataattttaaagcaagggaaaaataatgcatagtccttactttctaatcagtcctcggcccctcagtttagttcagtaatgattaatatcatcatgatcatgaccatcatcatccactaggttccaggctctgtgctaaatgccagagtacaaatgtaaagaagacagggcctgggcccctgaggggctctgcctagttaactctagggtacatgttggtgccctaattgtgataggtttgacctctagatttcttctagggctacaattagaacacactgtcaatctggaatgagaaccaaccaatgtaagtatctaaaaattgcccaagatgctataacacttgtgctaggtatagcagggtgactgattttctaacaatattgaacctatctgtaaacaatcaatgtttcacacctagatttattttaacacatactgggcttaaaaaattattgtatatacttgtgtacatgatattttgagatagataatgaaaggttactctagtcacacaaattaatgtctgtctaattgatcaaactaaattactcagaatttcacattcgcctgtcagttacatataagatgaatttcaaataattaaatgaatgatgttaattaagtttagtatactactaaaagttgaattatgagcatcttgaaacagtgaatgatatagacttgtacataggatatattctataattacactgagtgagatggctaatgagacaattggggtgtaattttatcaatgcttttattcttttcacttcaaattattttacctttagtctagaataaaacaggtttgttgtatctttgattttacaacatacattaatataaagtataaaatacaaacagctattaagaggaagcatttgtgagatgcagttttggtgaatgtgattttgactttgtaatcaaaataaaaaaaattaagctctaaactgaaaagaagagaaatggacagggacaactattgtgctagagcacaagaagtccttgttcagctgcttgctggaataaaatctttacacaagggtagctcttcatttatatttactcagttctgttcatttcctgctcagtcgatagtcagctttgtattgtatttattcttgtcatgatgtactaattacttgccaaaggctctcagtattttttaaaaatgaaaaatggtgcatacaagctttgggaaagtgaagttacataaagagcctttttggttactcattagggtgctcactcagtaactcttcccttgttacttatttttgtgaacaactcttttcctctcctaagttaataaacttagtgaatgcttcactacattcaaagattcagaatattcttttagaagctataatgtaggcaatgggcgaatcaatgctgacgttttataaagagctgatttcattgcacaggacttgcaagtctctttggaaaagggatccacatttttgtgatttattaaatatacaaactatagccgttatagtttgtttcaggtgtttatcatatactcaaggaagtctctacataaggccaaaatattcagatgagaagtgaaaaaatgtaatcacctacattaagtcaagcattggaatgttttggaaaaatctagaagagcaaatttttgtatagagaatttggcaacacttagatacaacgaacaatgtctggcagaaaacgtgttttatttggagagctggcttaccagcagatggctatatattatagaactaattttgtgacatcacattcatatgcaactcatatatttaaaatatgagaatataactaaaagaaaagaataatattaaattctccatgaaacaagctttttaaaggtaattgaccaaaacgactttgaaaattttactgaacaacaaactttgctcaaaggtgcagcattgaagtcaatttgatgcatgctagttacagagtttctgaaaatttaacctcaaattgaaaccctttagtgacagcttttaagtgattagttacagttgcagatactttattccctgatctaagacagtcttattaaatacattattaaaggaaatgtccttacaagcatttttacaaatcaccgtttgtccattctgtcaaaaagggttatccagagttctcttatgttctgttgtggtttctcaagccagtgtaatactatcttaaccccctaccacctatctctcaaatatctacctctgagatagaggaatctggattctcatgtaactggctcagcatgcagttagtttatccccactcccaaaaaaatagctcaaaccacagagggaggctataggtgagggtgagtgtcagacatggaggaggagatgttttattttaatgcagagggcataataaaatcaacttataaggcttgtcttttaccataaaagatactatctgcttactaggtttgcatctcatttccaaggtaaaattttactttccctaccaatatgtatttacctttcttagattcataggaccagaggcaatattatatgccaataatcatgtctccagtgaaagctgtgggagcattttaagcaattgctcataaataattgctggctgtagggaatgtagggacaaataaacagtaaaggaagagggatagtgttgcaaggttcattcactgtgcaaacagcccaggtagggtccaaagtctacaattcttacctcctcccttatttgaaatgaaacctgcatgtgacattttgatattttgaggtttctcccccttcttctttacattgctgaacttctgatgcagtcgtctagaagcctcataagtaggtgaagtggttgttcactatgtcactgtatgattttaagaacataggagaaactcctgttcccactacctcacccagagtcttgccaaattcactttggaagaaatctcagtgccacagttaatgcttcattgtttttcctcaagccaaagattaagtgctaatgcaagtactcctaaggaaggtagttcattgacctattatcagtcacttataccttagtgggtatgagtttgacaacagtttatatagaaaacaataaatttaaaaattactttctgattttttctgaaactaacaagttttaagataaatactaaattatttgaacacattttaattgaagaattatctttactatcatggctaatatttattatctgttatatgccagtcattattctaagatttcacgacaacaaacctgtatgacagagacatgattattattaccattttacagatgagaaagatgaggcacacagaggttaaataacttcataaaagtcactgagccaggatttgcacttattagtctagttctaaaacctgcacataaaccactctcctactcaattattctctcaaaggtatgatggctggaacatgtagaaggaaagatatttaaatgtgaaccatgaaaagtctgaaattattttaaaatgttctcataccaacaactattataatatggatacaattttttataccagtgcctgatggaactctactatgcttacaatgatctgaacatcagcataatgggataattagaaccatattaacatcaggtacttactattcagcggctgatacaataacttgcatgactattatctttatgattattgccatcattgtcatcattatttatagagagcttatccgatcccaggaaccatgtttagtactctacctaagtgacttcatttaaatttcaggcaatcttatgggtggttataatcatttccattttatagatgagaaaactgaggctcagagatgctaaagtcgtagaatcagaaatgataaagctagaattttaacttgtctgcctttaaagcttactttcttaaccacttcactatgtccaaaagtctaatactattaatgcttctagtctcaccaccaccaaataccacttattgagtgtcatctatgtgccaggaagcctatatcaggctagttctatgtcactatgtcagtggctcatgggccaaacccaaccaatttcctgtttttgtaaataaaattgtattgtcagaggcggtcttactctggtgtatgacttgagggaaagaatacggtaacaaagttaattagttctggcatctgtaaccaaagccaaaaaaataggtatcgtctatggctgcttttgtactaaaaggcagagttgagtacttgcaacagagatcttatggcctgcaaagccaaacaaacttactatctggccctttacggaaaaatttactgacccccgccttaaaccatctttcaatgtatgtattattattcccattttaagatgaacatatgagaattcagagaaattagataacttgccctcccaaacattaaagagtaagaacccagtgaaaaatgcaggtctagaggactccaaaaccttttccttttcttctctcaaaacttacaacagcaacaatttttataattaccagttgcaagagatttccctaacaacacgtggttaacagtatagttttaaatgttgatgctggtattaaagacttagacattttcccttttcagaaaaatattagatttatcttaccttctgataatttactgtacctaattccttgaggatggatgctcaagggcttatctgccttatttttaaagtgaacttttatgatgtctccgacttcagcatataaagtaggcccaagaagtcctgtgaaaacaaatatttaaactatgtctgtattcagggtcatcaaaggcagagttgctaagcaagaaaaacaaacagatgataccaagagtgattgctaccattcctcctggtcctgaggctgactcacttattttcaatctagaaggttttagcagctcattaactcaacattacatgtacacagatcacaatagaatggtagaaacacttgtcctggacccaaaagaagtcaacagagtaggagaaatagttctggccaagtcttgcccactttgacccactgtcattccttagcaataactttctttgcttaagaaagatgttcatttcaattacagagggtgatgcgagagggtagttactttagatttctctgacatgggtgtgctcagagacctagatgaattgaggaaccaaatcacacagctctctggctctgaggcaggagtagtcttgatgtatctaaggaacagtaagaaaaacagtacgggaagaaagaagagatgaggtggatggtaggtgtgtagaacaagggaggccctatgggctacggtaagaacttgaattttcttctaagtgaaatgggacatcactggagcatttttctttttttttttgagatggagtctcgctctgtctcctaggctggagtgcagtgatgcaatctcaggacccactgcaacctccgcctcctgggttcaagcaattctcctacctcaacctcccaagtagctgggattgcaggcatgcaccaccacacccagctaatttttgtatttttagtagagatgacttttcaccatgttggccaggctggtctcaaactcctgacctcaggtgatacacccgcctcagcctcccaaagtgctgggattacaggtgtgagccaccacgcctcgtctaagtgaaatggagcatttctaagtaaaatgaaaaaccactttgtacagcagagacatagtataacgtgtattaaaagttcatcctaaaacaaaaagttcatcatagctgctgtgtagagaatagtctgtgtagggacaagaatggaagcagagagattaggcagtataggaaagagactgcagtgtactgggccagcacatgtagcagaacgtgatgagtagtggttggagtctggacatttttgtaggtaaggcaaacaagacttgctgatggattgcatgtggcttgtgagagacagaagtcaaggatgacctcaaggtgttttatcagaacaactgggtaaatgatgttattagttactgcaatgggagaacacagcagagacaggaggttatgggtgcagaaatcaagaatgaggttttactttctacatgccaggcactgtgttagaaagtttctggctacctggatcaaatacagtccctgtactgaaggaactcacaagctagtttggagatagatgtatgataggagcgactgctgagatatgggcaaaatattacagaagaagagaggatgaagcacaaattctgtctggggagttagggaaaaagttgatggctgagtcagaatttgaggaattgtatatagtcagccctccatgaccatggttcatattcatggttacacatccatggagtcaaccaattttggatcaaaaatattcaaaaaacaacaataaaaaataaacaataaaaacaatacaaataaaactctaacataatagcaatttacatagtatttacattgcattcagtattataactaatttaaagatgatttaaagtatatgagaggatgtgcataggttattgcaaatactatgaaattttatataagggacttgagcatctgcaaattttggtatctgtgagtagtcctggaaccaataccctgtggataccaagggatgactgtactagaatttccaaagtgtagtccttggagtctctgcatcagaatcacctagggtcttaataagaggcagatttccaaatatcacctcagcctcaatgaatctgagttctggaggtgaaacttgggaatctggactttaacgtgtgctccttggtgatcttgatgtctttgaaatcttgagaatctatgaccaaaagccccattccagacaagtgacagaaatcaactactgtcatttctgagccatccacaagtgtcatgggattggcttctcgccattaggcgtcctagaagcaggagaaggaagtcacggcactcatggagttcagccagcatttgtttgcagtggtgatgataatcataataaggctttcctgtactgtttcccttaatacattcaagcactgtaagtccctacattaatcctcacaagtttttaaggtagatattaagatcctcattttataggtgaggacactgagcctcagagagtttaaatatcttgcctaatatcacacagcatcatgatttaaagtttaatatgtctgtctctagatcgtgacttttaagccacttctttatactacacctccaccttgtattcattcctttattcattcctttatttattcaatgaatatcaagtgcctatattatcctaggcatcagaattgcaatggtgcgtaaaagagtaaaatagatacacccactccctgccttcatagagtttataaaagtcaaacatttttatagttctataactttatacgtttttatagtaggaaagacagattttaaacaaatgatcacaaaaacattcaatttaaacctatggtaaatattatgacagaaaaggagggaatactctgaagagtatttgacagtggaatctagtccaattggaggtgagttggggaatcccttcccgaggaattaatcctttaactgaggtccaaaggcagagaggaaaagggatggccaaagacattctaaaaagttagagtagcgtgcgcaaaggccctgaggtgccagaaaatgtggcctttttagagaactgacagttatccagtggggaggtggagcttagtatgtgaaaggaaggggcagaaggtgaagccgaaggcatcctcagagtcccatcatgcagggctttgtaagcctcatagagttttccctttagcctaagagtatctggaagccattaaagagttttcatcaggggtgcaacatggaccagattttggttttaaaatctctggctgtatttgtggaggatgatctcggaggagactgagcagagaacaattgagagaacagatagaagactccaggagagatggtggtgactgagattatgatgagatgatgaggagagaatatattagtgatgtatttatgagataaaatagttggaacttgaagatggattggatgtggggtagagaataaaggacatcagttgctgtggatggctgatgaggttctgatttggggagctgggtggaggagggtgccattctctgagatggaggacaccgtgggagggctttgtttggtgggtgtagtaggcagaataatgtgcccctgctgagatgtccacgtcctaatctctgggacctggaaatatgctactttatatggcaaaagggactgtgtatctatgattaagaatcttgagatgagattcttctgggctgtccaggtggatcccatgtaataacaaaggtccttatcagagggatgcaggagaatctgagttaggaagagcttggaagatgctactcagctggttttgaagatggaggaaggggccatgagcccgtgagtgtaggcagcttccagtaactggaaaagacaaggaaacaattctcccccagagcctccagaaggaatgcagctctgccaacaccttgattttagcccaataaaacccattttggacttctcatctgcagatatataatcataaaagaataaatttgtgttgttttagccactaagtttgcagtaactggttacagaagcaatggtaaactctgatttctgggacagaggtcctatctttccctacccctgtcttgccacccacggttgtcctattcctttccttgaactcctactcctggagtttattctgatcttgtgcctgaagctttttgtttgtttttatgttagctttacacaggactgtggaggtcacaaagttcagtccttattttagttaacaaagcctgggaggtaggaatcgggggacaaaggtgacttgcccaaggtcagtcagtgatctggtagcattgctgggatcagaactcagatctctggactcctgagccaaagctctccctattccttccacggggcaggctcaggcccccatctttatagaatagtccagatgtctacacctcttttgactcctgacatgtcggactccactgactgacccccctcttccagctgctaccctctgtcttggctcctgatggaagtttccactgactattcccacctaccccagctgccaatgagcccaacagggtgctgactatgctgccaattgtgtgccgcatttagttgccatggttctcttgcttggttgatttgtttgttggcatcacatgcctgcaaataccagatgcccagagaaagtctcctaagttatttaacctaataagacctattacttcagtggacagtttggagtatttattcaacctcccctcctgcttcttcagatttaaggcaaaacaaaaggatgttttcataaatgcataccaaatactttcacgcatgtaggaaaacacatggctaaatggttttcaagctgctctttagctcctccaacagccagatggcctaaaacccttctaaccctctcctcagtgcccaaagctggattggggaaaggagtggcctacttcagggcttggggaagccagcacagcatgtacccaatttagtgcagttgtggaactggaaaggactgcagaaggtcaactaatccaatcccctgctcttaggtgaacaatgcattacataacacaaggtagtgattgttgcagctatttcaaaactccttcagggacaaacattttataatttgtccctgaaaaatatgcagactcaaaactagccaatttaattaattatttatttatttagagatgaggtcttattttgtcacccaggctggagtgcagtggtgtgatcataactcactgcagcctccaactcctgggctcaagtgatgctcttgtcctaaatgaccctcttgccttagcctccccagtagctgaaatgacaggtatgtaccaccatgtctggctaatttaaatatatatatatatatatatatatatatatatatatatatatatgtatgtatttttttaaatagaaacagagtctcactacattgcccaggctggtctaaaactcctggcctcaagcaatcctcccaccttggcctcccaaagtgctgggattacagtcatgagccactatgcccagccaagactagccattttaaagcccaagacagaattcctaaaaatgaccccagctgtactccctcacctgcccaaatgtccacaaaccttattggatgggcatcttcatacctccaatcctacagcccagccccctacaattacaagaactaacaacaacaatagttcatgctgcaggagtgaggctcatgactttttcagggctcagctagaatcacacccagcagatgagtggagcaggacataggggaaaggtacaaataacacaggactagtctggggaatgggagaggccacatagttaatggcagtgttcaaatccagatcttctcagtcaaaataaaaggcttttccttcacgccagatttgcctccttgtatcaactactatagagttacaaaggtgaataagataccactcctgcacttcataagttcatagttaagcaactttggacattcaggaagagattacattaaaatggacgtcgaaacacctttgtccacatgaaacaaatatattctgagatacacaggggttgacagaaaggtgcaaaggccttacacataaattggagactgttctcaccaactgtcagagtctacctctaacaaggttaaatcaggaaatcactaaaaaatttaatcatctgaaaggactttgatcacagaacccttttcttcaaaagctatccatgcctttttattgtttaaaagtcttcagcctggaattagtcctttccgtctcttatggcatttagcacaatgtctcacacagcaaagggattaaaatttgcttagcttggcaaaagccacaaaaggtacaccttcaaataccggccccaatcctcttttcctggccctaatgagtatgtttcccaccttatattcccttcatctacctacaatttaatttaattaaatagttcttaagtatctattgtacatgctaagcttggagctggagctatgaaaatgaatagactctgtgatataggacaggacatccttcaacttcctactcataactacaaacttaattttatttgcaacgttatcctctgctttcctggccccccatgaaggtggtagccattctacctaaggccaagccagcccaaggtttgaatcccaatgcttcctgcttcttctaagtctccattaatcattctctctcagatgttttatccccacattttctattggaaaggacttcatggcatttctatagagtcttcccttaaatatttaagtctctgtattcctttttataaaattctcaaatgtccttaagctcctcagtacccacccccacccccgaaactaccctgtctctcctcccatctggaaccaagtttcagggaagagttatctataagacccttgtgcttcagtttcctcgccttccattcactcctcaacaccctgccatctggtcttgtcccactattccataacaaagggaccatattttgacccttatattaatagcatttgaccctttgcctccaggataacacattctctagatttcttctcccctccctgaacaggctttctcaagctccttggtaaacttttctttcttggctcatcccttggactttgctgctactttgagctctgtctgcagccttctcttctcatcacatcctccctgggtgagttcacaccctctaaattcttcatttgccatctttgttctgatgtctcccaaatgttgacagctagctcagatctctcttttgagggccaaacttctacacccgtctgctcacttaacatctctaggtagatattctatacacacctcagactccaaatctatacttatcaccttctctcacaaactatctccttttcttacattttctttctcactgaatggcaccctatccattctgctgttcaaaccagacaccttgaagtccataacaattcccttttcttcctcattatctgcatctaatgagtcaccaagtttaatcaactttagctcctaaatatctttggactccatctcagcttctctgctatctggattgatacaacagtcccatgactactttctctggctctggactggtctttctccaatctattctctataattggacaacataatctttctaaaggacaaatatttctcctgctgaaatccttttagggactccctattcctctcaatataaagcctagcatggatccctgatccccatctagttgcatctcttgttaattccttccctgaagtttgtggtccaactgtgctgatccagttatggttccacaaatataccatactctcacctccaaacttttaaacattctgtgccttggtttaaaatgcatctatcacccaaccccttgcctccccacttggctttccaagatcctactcttttttcagctatcaatctagaaatagaaatactttcctgaccaccagactggagataggtctcctatgtcctactacagaatcctcatcatagttcttccttattactctactgtcattgcttgtctatccataggttatccccaatagctgattggctcctggaaatcaaggtccatgtcttattcactttatcccagagcctagaatgtagtaggttctcaatatacttttttgttgttgttgttgttgtttttttttttttgagatagagtttcgctctgtcacccaggttggagtgaagtgatgcgatgtcagctcactgcagcctccacctcctgggttcaagtgattctcatgtctcagcctcctgagtagctgggactacaggcatgtaccatcatgcacaactaatttttgtattttcagtagaggcggggtttcaccatgtgggccaggctggtctggaactcctgacctcaagtgatccatctgccttggcctcccaaagtgcatgagccaccacgcctggcctcaatacacaattatttaaaaataaaagaatatttaaatgcagatctgtttaaaattaaataaatatataaatgaacacatgtgaagactatataaatgagtggagaaatatagatatatagatatccataatactatgatatatatgatctaagttatgattagtaatagcagcaacaataacaataatgtagctaacttctactgagtgcctattatgtgtcagcatcattataaatactttgtacttattaactcaattgatcctcttaatatctttagaaggtagggattaattcaaggtactggggatgtatagaagagggaagatttaattctgctggtattgagggggtgtcaatgtagcttcagagggaaagtggcttctgggtaggtagtagtgaaagccttggttttgggtgagattcgaaccctggggaagaatatctggtggggatactgagcaggagtggtaagagaagtctgagaaaaccaaggggaagtggcactagaaaaaacaggtaaagcgagagcttcagaaaggaagagtgttaaatgtcctagtaatgtctagtagtaaaagaacataggctctggcacctcaagtcctaggtgcccttttgtgagagtaattttagtagacttattcatactaaagcagattagggaaggaatataggcgaagaaatgtagagaatgatacagagttctcatacagaaaactggtagtgaaggaaaggagagaaaaggaaaaggcaggcagggtcaaggggagatttttttttttctttttctagataggagttaactggacatggtttgatttggttttggtttagtcgttgatttttaactgaaaggaagactcccattgactaaatattgaagattaaaggagatcagaagaggcaggacagactaggatgattctgggaaagacagcaggtcttcatctgattggggaaagggacaggtgaattactgacaaggggattcaactggaggaagttctcccttgatggtctctatcatccctgcggaatatggtatcatagttaagatattagaaccctattcaacccagtcttcttgataaaggaagagatgaggaaaaaataagagattttctttaaaaattatggctattgtatatatcacactaaataaacagaagaatagacgggaaagagatgcaaaagagtcagccatacatagttcctttgaatgaatctagggagccaaatggaagcaaaatatcattttgcgaaggcacatctatgctcattaaactagaccataatctccatgaacccaggatatgagactgtcttgtccactattgcatccacaatgcctatttcaatgcccagcccataccaggtactcaataacagttttttagatgaatgaataaaaattcaaacacttataagttttatttagttattttaatcaaggttaaaaacagagccagcttcatgggtatgtgacctgggcagtttcacagggccccatgccccaaagggcccctggcttggtttaatgctttgcagtcactgtgaaattttcaataatatgaacaaggggactcacattttcattttgcactgggccccacatattatgtagccagtacttcttaaaaaaaaaaccacacgtttctataaattttcagtaaatggatattttagatgcatgtgaatgccaaattacccatagaaatttatctttaaaattaaaaaagtatatttcaggcttacctgaaatggtagattgtggtttttctttcttaaaatatggttcatactctctgtagacaattttcttaaaggaagttacagaaagattcaaactggaaataaaatacaaaaactaatttgaaaggcatattcaatatctatttctcacattacaaaaaaagtagatctctcatatcttcagacttctagtagaataccagtatctttattgtatttcagaagtccacagttttataaatatgatcaataagtaaagttaatgaaataattattggtctcttcaaaaatatcctgttgtgataactatttgttcacaagttaatctaccctaatatcattcctcagaatcaattttctaaaaagaacccaatatcacagtagaaacccaaactgtaggtttagattttatatgattaaaatatgaccaaatcctttatgaataaatatatgagctgtttttcaactgatcaatcaaatatagttttaatctactggggaacattgtgaaaaagtattgatttggtggaatttatttctagttgagaggtgagagatggctaatggggtaaaagccctgggattcatattggaaacaaacaaatgaaaaaactgttttggaaagagtcagtaacttgtccaagagatacagttgataagtggcagaaccaagattaaaaaatgtgaaaccactgcattcatgattttaaataaaattagagagaggacagacaacagggagagttgtgagtggtgggttactttcctgtttttgctgttgttgttattgttctgtacctctaaaggcaaatcagtcttatccttgtcttaaactcaaagatgagggtaaaaggaaagagaatttggagaaaataccttgcaaatgtctaaatcagttgatcagagtggctttgttttgcttcctaatgtggggacagtggcccagccataatcaagacataacagcacccacatatgccatgacttctatacagcgcggtggctagggtgcaggctgtgaattcagtatctctggacttgaagcctatatctacctcttattgttttactttgaaaagtttacttcatccatttgtgcctcagtttctacaactatgaaatgagattaatactgaaatctccttcacagaattgttgtataattttaaataagttgatatgtgcaaaaggcatagagctggcacactagaaatactcaatccatgttagctagtaatattattttgtaaatgtaataagagttagtctttacccttcaggttttctcagaaagcaaaaacaaatctgtagttacagtaatgctcacaaattgtaatatgtggaatacagaaactgtgttaatatgtgggggcagaattaaaggaggcacgtaagtacttttagaatagctagatagagaaggtagtggattctccatcactggaagcattcaagtagaaattagacaactacttggtaaggtcattggtgctgagggaaaggggaaaagtagaaggttaaagcgtggaagttgaatatgaattaaatgaactcttagcattcttctaacttaagaattccaggattctatatactaatgtccctaatgtggaagtccatttttatttatttatttttagtacaattgaaaagttattgtcctcccctgccccagatctttaatacagaaatgtagatgatggtgtaaaatctttactaaaaaatatcagtctcttacgtggagtaatttcaacagagagatgtttcctaacatgtttttactatgtatgctgtgtattcatactgaggtatgtctattttgatctgaacaatttctattggaaaataatctatctgattaaaaagttacagatcatatgaattcaaacaatgtgtacgacgagtttttcatttataaggattgtttaaagatgatttgttcataatcacaaaatcatataaagctagaaccctagaaggaaaatgtatgtatatcttttcttcaatatctctttgtatacatgtgagtgactaaacaagttttctaaggaaatttttgaaagtgttcaccttagacttggagcaagaataatagatacattttacctttaaaaggcattgtcctgctaatattatatgaaataagtagatagatgtctgctttgtgctaaaatacactttgccaaaagatggagttggctatgttgatattcacctagtgagtatcatagctctaggggcaggacaagttagaacaagttcttagtttaagcagccagatatatggattagatttttcataagaaaatgctagagagaaatgatatgatttagggttaaacaatatgacagtttgtctgggttgtgtttctatggttttgactcaacaattcctaccagaggaacgaatctccagaactttggaaacttacccacaggatgaggggacagaatgaccagtcatggttccctgtgtactcaccatgtgaatcagacctttgccctatctggttctgcctccggtattttgcttgttattttcaacgctaactacagacaagagaaaaaactcccaagcatgaacccagcatgctacaagaaagccaacaaccaagtctgcattctactcatgagcaggcaagattagtgttagaaggactgttattttccttggggttttagcttacggcagttcccaaagggtgtgggtgtgacctagattatcactttgaagtacgatatttaaaatgattatttttgagaaggagggatctcttcttattataagaccaagatggtatgtaataccctccaaaataacccagttacaatgagagttttaaaaaggttaatattatacactaaaagatctcaaaatattacattattttttggcagattactttggttttgtaattgtaaaagaggaacacatctttcataatgaagtgtgatgtaaggaaaaaaagtgagtcacactagcaggtttaccatttaaaaaataactaactggaaatattgaatagactgtatgatttagttaatttctgagaagtcttatttttaacatttcaattagaaaaaatagtttgcaactcaaggatagtattttatctgaattaaacctcctctcagttacatatgcctttaagtagccaaggtaaaccatatcccaggacatgatgaacagagagaaaaaaaaatgaagagtcacattcaataggataaataagtcaaatatgaagcagaaaaaaggtgaaagtacaaaaacatacaagaactgatgatattttgaaagtcatttataaggcagcaataaaattatatgacaaaaagcacaaggtgttcatttttagttttagaagatgaagctatgtagacaatggaataaataatatgtaactaggagtctcataaaaatactatacaactaaaaatctggaacaggagtttgcaggaagggctaatgagggagcaagtgcctggtgcctttgaattaaccaatatataagccaacacaaacatactaacaaaactgtattgaaaataaacttgaaaagaaggtagcatctaaccaatcaaatagggtgctttctaaaccctcagaatgataaactacattgttggatgcaaaattagcatttgcccagtttatttaattcagtatactctcctattagttatatttacttacctgaagttaaaaaaaaaaaaagccatgacattgcaaagggaatgttctctaaaagaaatagattttcctctctagagaagcccacccggactccacacctgagttaccttgagtttgtgggctcaggtcggtagctccaactgatgccctgagcagccacgtagaactgccttagctgtgccgcttctgtcccttggctcccccagcctacccagctggtgcccaagaccaccaggacccagaggcgtgggcagcctgggaacatgcttcctttcctgctcccgctggctgccaccaccccaggacctgggcagcgcttgccgagctgctaaccacactccgggctgtcccagctgcaatgagctctagaggctgtgggtggcagcgtcctcctcccctgcagttcttgcaaacggcagcagcagcctctggctctcactccctccgctttttctggggcttttcctggcaggggtttggtgagatcacagctcccagtgaccagaggtattagggagagcaaccaaactagtgactgttttactgcaggtgaagaaggggcagagatcagaggctctagcaggcgggacaatgcccagggattcatgagccggacaaagctgtatccctccatttccacctgccaacaccacggaagcagtcgtccgttaccactgacctgaggcctgcctgggtccaagctcacacttggagaaccttctgtgcagtgcagtggcacccaaccaccttaagcagatggctccccttttaatctgaggaaaagagtattgtgccctgttactgggcactgaaacactattttcaagtggtgaagaagcagggaacaaacacatggacaaggcctactgctctgaatcgccttcctggcctctatcaaggcacagttctgccttgataagggcctgtcgccagctaagctgcagcatagcagcgggcttgaagagcttggctgaaaaaaatcagttgtccagatttcagtttcacttactagctgtgttgtcttgggcaagttactgtacctctctgttcagttttgacatctgtgaaataaggatgacaataataatttttcctgatagggtatgttgggaggataaaatgctactgtaaactatagttccagcacttaacacacagaggctaggcgcagtggctcacgcctgtaatcccagtactttgggaggccaaggcgggtgaatcacctgaggtcaggagttcaagaccagcctggccaacatggtgaaacccttctctactaaaaatataaaaaattagccgggcgttgtggtggacacctgtaatcccacctactcgagagattgaggcaagagaattgcttgaacctggaaggtggagtttgcagtgagctgatatcatgccattttactccagcctgggcaacgagagcaaaactccatcaaaaaaaaaaaagaaagaaagaaaaagaaagaaagagaaaaagagagaaagaaggaatcacaaatttattattatgatcatattttcctgtctccaggaccccttgtattcttgtttttcttgaaggatctgactgtttcacagcaccttaaatcttactttgctattgatagagaatctgcgaattatattgtctgaggcatcataatgacttgtcctgggttccctgtatctgcatggctccaggtttctgtcttatgctttatgcattcagtacattcaataaattgtaatctggcacctcacatgaggtctctgttaatgatatcaggctcatcaacagcctcttcctccctccccactccccccaatattctgtcttttctcctgtgctgatattattgcaccaacttagaatgcccattttcttcctctttgctgggccattctttacagtccagagttctgcctatctcccagattctgggctcaaattggcttttccattttatgaactattacaacactattcaaattatataatcatgttaattaccttttgttattccatgcaggtatctattgtctccctaactgaacagttgcttacacttctttatctacaatattatcagtgtctcccaaagttggcagaccatcagaattcccaggggaacttttacaaaatgtagattctgactcaggaaacagggttgagaccaaagtcctagaacacctagcctactgattgacatttaaataagcagtcagagatgctactggcagtgtatcagagaaacgttttgaaagcactgtgtccctaaatcccaaggttactaccagaattgttgcaacattattgtaacctttgagtaggctgcttttttatttgcatgtttgcttatgtatatacagtgtacatgacatatttatttaattacattttacagagacaagatgactactataatttttggctctctattttttttaacatcagttccagataaatactatataactttcaatgacctatttattaaacatgggatttaaagaacatgtaaaacacatttgttcttccctgtaaaatattaaggtgatgaagaatttttccatttctctgattttctcttgcagtgtagggtgtgcgatacatatttgctgactgaatgaatggttgaggtgtaaataggacaaccataattgtgtgttattacactgatggtaaacaatgtgatgtatacagaccttactgaacaaaccataaaatagaggaacacggcatttggggaaaattcttttaattacgcatttgaatattggtctttgggtcatttgagggacagtgactggtggcaggaaggtccacggtgacatgtggccttctagcttgattcttggccttctgcagcctctggtgccatccagaggactctctggaagcctcagagcagaggtccaagaggcctcatcaacagcaaccactggagactccagaagatgctacaggaatttcttccaattagagatgccacctgctttccaacaaagtggagaaaaccttccttcaatcaaaaaataaagaggtatttttatttctccacagtctggtcttcttgtgagtcagatgctccagtctctttggttcactggtatttcaagtaacaggtgagtcaaagcacagagactactgcagaaacatttgctcctggcttctgtggcttgtgttacaggaagagaagaggtgggacaggaaggggtggtaggttgagaatttgagattgtaccacaatcccaaactcaggaaacagggttggtccagagcgggtccaacaggctggtccagagctaatctaaggtaattccatgtctttgattcatgggtgtttatggaaacctgcagcaaatgcattatagttaagtccagtgtagcaggaaacttgatgttcacaacaggatcatatggaggctgaatgaggagaccaggaaaaggacaggtctctggaaatgagaccaaagaaatttaaataattatcatttccttaaaaaaataaaagaaagaaaaaaattgctcatcatatctacaccctgaggcgcagcataatcttttctttctagatttcgaatattctgccattcaggctttttgtaggacactcaactacccactttttgggagagggatagcatcagattatttttgtttttccagcaggtagcatagggaattgactccataacagttcgtaaacatttttcagcagtcctgacttctgctttgcaggcaaggccacatcatcaccacctagcagttaataatggaaatgttacacatcctgaaataagttatgtcttgttaggacatttctgtcctggaggaaatgaaaatccttttgtgaactcttttgtaactccattgtcatacctgtgtcctactgccaacacaatttccttcatgcctgaaaatttaatacatacttaaaatttaatatatgattatgtaaagaaaagttaagctttatagtcttccatttttccctagtgttctatttccttcaaaaatatctttatagggatcttaccttaaggactcgggtcaaatgcagcgtttgtaaaaactccatatgttcctaggtggctaaagaacagaaacacaaggatggcaacaatatactgcttagttctcgacaacacagtccaacacatagtatttccagaaaccacaaattaccatccacccttggaattctgctttagaaaggaaagaaaaataaatgccaaagaaatattcgatatcccacttaccagctctgggtaatttgcattgcattttgcacccacactaagttattgttcatgctttatgtactgaatacctgttataccctctaagttgctgcaacctcttctaggtgacaagaggtagttacaaaattcttggcattaacacttgataatctaacgatagttttcaaagggtgcaatatgacccctaggggtgttttttgatttttataaccaagagttcttccgatattgagtgggtatggggcaagggtgctggatgtctacgacaatagagttcatataaggatttccatgtcctccaggacggaaatgtctttaaaagatatccagcacccctgcctcctgcccactcaatgtcagtagaactcttgttcattacaaaaataaaaaaatacccttgggggcatactgtccctttttgaaaactattgctagattataaatagcaaggggtacaggacacaaaagaattgtccaacatcccacataactttggaatatctgctcgatattcatacaggttaaaaatctctgagcctggaactcaagcactttacatgtaaatattaagcatttttttgcatctttaaaatgcaattgccatatgaatcaaaggacaattatcacaggttttcagactctttaccggagttgttcaccatgttgaaaaattaggctggtgttggccacagttctaatgctctttgagtcactaatacaacattcccccatcagtccacctgcgtgggcgttgctttcctagtgattctgtggaaggtgcacgcttctgatgacctcattgcatctactggcacagcgcctaagtttttgcatcttgtttttattataaattacttttcattttattcctactttatattttaattagaatatttgttatctgtgtattttacttcagagtagaaaagaagacattgcaaaagacattgtaaaaaggaggcaggcattgcatgtaatcattctgacatattacagtgaattataaagttaaggtagcaaaatttactcaatcataaaacatttctaccttacctgtgaggattcaaggggcatttcccatcatctaaaatcagcaagaagacaagaatgaatgattaaaaaaaaaaaacaagatgaaagagagggtcattaaggatagaaattactggggaaaaccagtagactgattttcaggagggctcattataaggggaatattgggaacagtttctccctgaaaggtagaaagtgttttaggctaaattaaacattcgacaatatttaactccagagtcctgtcactttcttcctccttcctttcagtaaatacataaatcaatttcttttgagggcatcttgtgtcacttgccctcagcccttagctgagcaagctaatcacatacatgaatccaaaccaacagaacagtggatgtttttcctccctggtagcatatttttatccaaataacagactctcatagttgaattttcagctatggctgcagcattttcctcttatttggccatagaaaacttcaaagcctaaaatcaaattgggagaagctgaggaaaaaagctcccatccccaacaaatgaatgtatttattattaaaaatattggggcatgagtggccatttgtccttctccactgttagagggtcctctggaaatgtctcaaagtcaaagaaaggacttgggggaaacatcaagattagagtgattcctacatgatcatagagattaaggtctaggagctcttgcctctgccttctgggtttggttgagcaagcacacattttgcatggagggattcactgtagctctcagtacatctctttggtattgaagcagagtattgacctttgtctattgtcttagccactcacaggagagtatatgaaggaaatttggaaaaacagcctcaatgttttggtagcattgtaaatggagaaagaataagagtaaggaacacgtggttttgcctctgagcagttaagaataggtgttgagacctatgtcaacaatagagaaattcaatgagatctctttcagatattttaacatagccactttccattaccttgatttgagcaattaatggtctctctgatgcccccagttactttctatgaggagtgatgaagaagagccccattaggttataaacaaaactttatgaacttataggcaggctaagtgtctggagaagattgagaaaggatgttttaaaccttaagagatgggatgttcccatctttaattcctagactaaagttctttttctgatgaacagtctgatgaacacagtttcccttacagagagttttcatctatttggtcttctctgtttaaatcctgcatcaactttacaaattttcaggagaaaaagcaaatctcttagcttatcacaccaggtcaccaatacaggggcagcttcttctgcccctaacttcatctcctgcctcctccataatccccttttgattcagatgcactgaactgcgaaacataccatcttctcattgattttacactttcatgtctttctacatgccattttctctgatggaactctatttccattttccccttggctaaatgcctctcattcttcaaagctaagcttgaaaaaggctttctgacctgccagtctggtttaggcatccctagtctatgttctaataatacctaggttgtatttgtgtcctaacacacttactacacttcactaccggcactgatttcacctgtctcccctactggatttttccttccttaatatcagaaaccatcattatgagtctcacactctaacagagttgatgaataaatgactgctacatgaagaaatgagtgaagtcaggaagcataacacctttctaattagctttagtgatagcctagggtacttagaccagaggccccaaatgcaaaactgcaaagtagcctcatttgaattttgggagagagcttttgaaaaattcagatttccacacccactaccaagtctccccatagaaggatctatatttttaggaagttccctaggtgattctaatggacaatcagttctcaagatcacttatcttggctttattttcttttaatgcaaatgttttccaacatgaactactgaagttgtggtttttgcctccccaccctaaattacataaatcaatttcttttgatttatgtaaccaagatgcaaagagaagactctttcctatttacctttttgtctgaaacgctttcttagcaaagccaggagcgtcccacccattatcagacctatcgtagaagccaccgctccaccaaagtaagtcagggcttcctggatagtcaatggtcctgctacaaaacaaacacacacacatgcaagacataagaagtgtattatgcaaaagactagtctttctctcccagaaagttttcaagaactctaagatgtgcgatcaagtaggatcaccaaaggtcctgggaatgctgacaagctaacatgaaagaagatctggaattcataaatccactgcaacagaatgggaagtggggccttattttattcctaaggcttaaatatagactgtaatttccaaaggaatcagggtgaggacccaataaaagaaattaaattgtagacacaagaagcctatacatgtaagtatgggcaaataaaataaaagtggggccttaatttattcctaagacttaaatataaactgtaatttccaaaagaattagggtaaggtcccaataaaagaaattaaattgtagacataagaagcctatacatgtaagtttaggcaaataaaataaactgtgcataattttttggcaaagattcagttatgtaacaaaaggcagtcaggacaagctatgaggggaaaaaatagggggctgaaatataccttgcaaacagatggaatttaattaaggaagatctgctaggaggtttttagagttaggtggtaagcaaaggtcttctgagataataaattagaaatctgcatgaaataactcccagtttaaaacattttgaaacttcaaggtctgttaaacagagattataacgaagcaaaaggtttcatttcacaaactgaacactgaagaggaggggtgattacctacacagtcactgggtttaatttccactactttataaggcaaggagattctgcctgattcattgtgaaacacttattaagcagggggaaacccggggatggaaagcaagaccactatgagaaagacacagggaagaaacactgattttgttattttccacatcaaagtgacttcttaacccacatgaaaattgtaccttggcaggttggcacggtagttgaccagtggccattctcttggcatgctgtttgtgcagagccattaagtaactggccctctagacaatggaaagagcagattgatccataactgaagtttccccagaggttggagcagttcatcgctattggcttattaacatgtagttctgagcatttcacagctgcagaaaagaaataatgcaagagaaacaacatgtggattggaggtgaaagagattatagtttcttttgtaacctaacattgccaataaatgaggcagaatgtaaaaggtcagaaaggatatgagccacttccaatattcacagtagctcttctaacagcacatatatgaaaatattctctcgaagggtgatatccaaagaaccaagatgcaaagatggacacatagtagcatccgacaaatacctgctaatgcattgataaatcttgcctccaaatatactatttacaaaattttggttcttaaaatactgttagtctaaatgttattactacatttgtgatcaactggcatgtcagtatgtgtttattgaaatacttaataagtgttcagcatatctggacactggaagtttgaaagaagtagactgtcatcctccttaaactacattttcagggaacttcagggttattctttctaatttatggataggaaattaaaggtcaagaaattagatttaattcaaataaatgttatttatcagtagtgacatttgcaaagcactgtgctatgttttgtgggggatacaaaaatgaaagaaacataggtctcaatgctttatgtgtagggcgatagctcttcaggaaatatcatgtatggcttaactttttatttaggttcaaattattatgaaaatatggaatgtttatactgtcacataatatgcaacttctagtttaccaatttctatagcaggttttacatttaatatgtctatttttctaacacatcttggacatctgcaaatgtttcttcctttaagtctctgagtacttgtgtattagctttagcttgtgacatgaggaaggacagaagtgaaatgcctgtgacacattacttctaatgggattggtgtggatttcataagggagatgacacttggagtagtggttgtggttgggtgagacttcaacatacaggcacaatggctagcttgagtacttgcaggaaggcaggttcagaactgcctgctccttttcaccttacctctgcatgctggagttactgctgtccattgtcctgaaggtctgcagctgagagtgctgtctcctatgagtgtgaatccagcgttgcagccaaagtaacaagtggtattaaaaccaaaggttcccggatgatgcctacagtacatggttccctgcccaggagtggtgagggctggacattgcacccctggagtaggaagtgatgctatgcctgttgtgagaaaatgtttccattcagagacctcccaattaaaagaagcgttaacagagttaaggctaatctggaataactgcttttcactcccttcataacaagggaggctcctgcaagagctatttaaggaagttaagaaaaactatcagtgtcagagatagaaaaccagatgaggaaaattattaaaaatcatccttgaggagatgattctcctggccaagagaagaaatcagaggagtcattgttgttgctattttaaaaagaagcaagaaatggtacagaaatataagaaattcagcagaaagccaaatatacatgggccaactgcctgcccaaccctgcctta

SEQ ID NO: 431 - DNA, 120655 bp, Homo sapiens
gctacaacaacaaaaaggaaataaaacacaagttaaaatagaatataataaaaccagagaatgaaaagagagatgatggagctaagaaaatgaagtgatatgttcttaatacaggctgtaatatataaattggaaacaggaggaaaatagagtcaatctaataaaggaaatttttttaaatgaatgcaaatgtacagaaaaaaggtattaaacaactaggtgaaagataaggaagacagataaaggtgatcctatgattgggtccctgaaataaggaacatttccatgaaggaagaattggatcgtctaatcaaaagggcacaccatatattaaggaacactcacacaatgcaaacatcatcaaaacatattctggttattaaaactggagtatgaataacaattatttaagtagtcaggcagaaaaagcaagttatgtgcaatgggggaaattctccctagcctcagactcttctgtagaagctttccatgctagaagatagagcaaagtcataagggaaagtaaatgtgactccaaaatactttacccagacaagttgttcaagtgtaaaagcaacaggtagatattctcagatatgaataaattaaaatttcaggaaatatagccctaatgagctcctctttaaaaaatactacttgaggccaggcacggtggctcacgcttgtaatcccagcactttgggaggccgaggagggtggttcacaaggtcaggagattgagaccatcctggccaacatggtgaaaccccgtctctactaaaaatacaaaaattagctgggcttggtggtatgcgcctgtagtcccagctatttgggaggctgaggcaggagaatcgcttgaacccgggaggcagaggttgcagtgagccaagatcatgccactgcactccagcctgggcgacagagcaagactgtgtctcaaaaaaaaaaaaaaaattactacttgataatgaaatccagccaaccaagagggaagtccaataaggaactcagaacaagataaaataaaataatgggacagtaagtattgaatccaattaaatatagaacttcaacaactgaaagaactgtgattgcagaacagcttgtaaatagtataagccctgatgaaataaaaccaaaacaagccaaaaaaataaaaaatgaaagctagaggggagggaaacggaacaagtggcaagataactaagtagctgattttataaggtcgtgagctcagtcatgttgtttaaaattgagatatggaaaaaagtaattcactaaaataaataaataaaataaaattgagatatggagccctacaagaaagcattacttcagtctcctagtgcatctttatactgtgtctgcttgccttaaagggatattttaggaaccaatatctcttatggcaaatacaggaaaaaaaatttaataggttttattattaaaataacatgcttctgtatcatctttttcttttttaaattttttattttactttaagttctgggatacatgtgcagaacgtgcaggtttgttacataggtatacatgtgccatggtggtttgctgcacctatcaacccatcatctaggtgatccttttcttttaaatttgtttctatctctgcacacctacacatccattcatccttctatctgtatatagatcactatctataattatgtccacaatgtatgctatcatcactcacctctaaacattgtgatttgatatttttaaaaatatattctttgtactgttttatattgcttgcttgtgtcatttttaaaaattcctgcctattaaaacgaattagagggtcactgatggtcgagaggaaaaggagaaagacagttggcaaactatttatttttgactctaacatgagactttataagtttcccatgtcagaactctttacaaggtcatcactttggtcaatttcaaattgatttgttattaaacatgtgctgcctatactgttccaacatgtaattctttctccttctgcttgtagtaaaacaaacccttgccaagagaacactgacagaagacataaattatcctgtgagttaaaggggcaaccaaggtttctattgtttgcagcagtggttaaggagctgttcagaggtagaaaacaaaaggatcctggtgacatgataatagctctgtgatactctgttgcaggctgctggatggtaactgtcctggccttctaccattcaacatacatgatcataccacgtgtcatcatccatagtccaaagtagaggctgagagagataatgcctatttttgaagtatatataaaacagcacaattctgaggctgtaggtcaagtgactcaggatcattttttacagacttataaatctgtagattactagcccactgtagatataactaataaaggcatgtgcctatggaaatgttcactagactgggaactaagtccctccctttgcaaaccggttggatcttgcccttagagataagaccaaagatctgcagaagggaagtttcccagcagacaaattgcaaaaatagtagagagttcacatatacccatcactgtttcccttaatattaatgttaatcttacataaccatagcacaataatcaaaaccaggaaattaggattggtaaaatactattaactacatatcttattcaaatttccccagtctccccactaatgtccttttcctgttccggagtctcaccttgcattcagttgttacttctctttagtcctctctgatatgcaacaattcctcagtctctatttgtctttcatgacctgaagacctttaaagactactgagcagttattttgcagaatgagcttcaatttggatttttctgatgtttcctcatgaccagattgaggttatgtagtttgagcatgaataataagaaggcacgttgtacccttctcagtgtatcatatcaggaggtacatcatgcccatatgtctgattaccattggtattaatcctgattacatgattaaggtggtattttgtttctccactataaagtcaacattttttccctttgtaactggtaaatatttttgacactatgccaatgtcttgcttctcctcaaatgatcacctactggctttgttatccattggtggatcttacctgtaaataattattaccgtggtattttcctaatggtgattttgtattttactccttccttctacgtgaattggaatccttcagtaaggaaaactaccttcttatattctatttatttattcatttaattgatatcagtatggacaaataaatatttattttatcctatgggttaaaatccattaatattgttatttattttgttgctcaacttgccccagatttggccactgggagctctggcagcttggatcctgtctccttttgacatgctcctatctatttgtgtaagtattttcttattttctggcaccacaagatgttccaggttcattttatattttccgtgccccaactctggaatcagtcacttctctaagaagccctttgagttccttttattggagaattgtgtttagagaacaaagtctgaatactaattatattcactgttagtgagctgtcattagttctagtcttttcaaaggatcaagctgggaaatacaggtatgtatgttaacctacatggtagacaaacatcaacgtctatttccatgtctatatatctctatactaaacactatgagttcatactagtacatctgagtctaatccaacacctcaaagttcatttcagccttccttcttctcttacttgtaaattatttctccaccaataagaaaactagcttttatctacaatagattcatttatttgttcaatcttgatcacataaatttgtcacagaattgctaaacaatacccctgtgaataatggtgttacaaataagtatagtgttagtgtattttttgtcattaaccttaaaatatccagttagaatactgttttccaatgttactatattagttatttattgctaaataacaaaattcccctagaacttagcaattgaacacaacaaaaagttttttcacaatttctgtgggtcaggaatctgggcatggctatgctgcatgcctttagctcctggtctctcacaaggctccaatcaaggtgtcagccaaggcagcatttatctcaaggctcaattgggagaagaccatcctaagctcattcatatggctctgggcaggcatcagttcgtcatgtcttttacctggaaacatcactgccttgtcccatacacctctccaaaaggcagctcacaacatagaagccagattctgtgtaagtgggcataccagcaggaaaggatacccaagacagaaggcacagtcttttcataatctaatttcagaagtaacatgccaccattcctgccacattcttttcactaaaagaaataatcaaatccatctcaaatttaaggagaagggattgcacaagggcatgaaagccaggaggtaaggatcattaaggaccatcttacagggtacctaccatagttatttaggtccattttcttccccagtacccttcagggtgactatgttgttcatttgaaatacaattaggttcatttgttactgcttatttcccaattaggttctccttcacctcatcttgcttgattttaattattgattcatttttggctggttgtgtgaaacattaccatggttctaagagtcagcactatatacaaagataaactctgagaagtgtcactgcctccttatccctattacctcattcccattcttccctttttcccatacatttatcacttagacctcgtaggcaaccagtctcttcagtttctgctttccttcctatatcttttgtacaaatgagcagatacatggttattttcttatatccctttctttcttacatgaagagtagcatattacagatagtctcttatactttgtttattcactcaacagtatatcctggaaattattccaaatgcattcattagagatctcccttatttttgacaggttcataacaccctattgtgtgtatataccatggttaattcaaccattcaggagagaaatttttgactacgcttttttgaccaagaaatactcctgcaaatatttaaagacaatttttcaagtgacaactggggaaaaagagtgcatcttctaagcatctctgcagattagaaaagcaatgtattaattctcattacttggtaggtataattagaatcttcacactccactggtagtcttgtgaattgaaacatcattttgaaagcagcacagcaatatctaagggtctcctcctttgactcactaattcaactcatgagaatttattcaaagaaaataatttaacaggggaaaatcttgacacagaaagatgttcatagaaaaaatgtatcatcctcaaaaccagaaaataatctaaatgtccaaaaaatggcctaataaatatttatcaatacaataaaatatcatgtgatgactaaaaactattatgcaaactatgcagataggaaaggttttgatacaatattaagtgaacaagcaggacataagatgatatattatgattgcaaagatgccaaatagaaaacagtagctgtgtgtagcctcaccaaagtgagatgatgctagtgaaagtggctgccttgccacatagtacatttccaagttcttcttacatacttgtggagccatgtgattgtgttctggccaatagaactgtgttaaatttatgtgagcaactttccttcctggtccataaacatcttctttgtggtttctttctttgtctgctaattggatgtcaacaccaggaaaccctgttttgaagatggcagaatctctgttagtttgagtctctgagtcccagaacctcacacataccattgctgatttggctttaataagcaagacgtaactatccactgcaataagccactgagatatcatggtctatctgttgtagcagcaagcattactttaacaccctatactatagtgatagaattagcaaataattttactttcagacttttctttaatgccaatattctaccatttgttgataatgaaaaataatgtaacacttcgatctgtaggaaatcattaaaaataagcaagtgagtcattagtactccttcatcaggaagatggttaatggaagcctgatgtctactgtacagcaaattattctaagcagagtttcagaatactcctgaataagggctagaaatattccttcgaatctcaaaatgctgtattcacaggactaccatggctagcaggaatacaataatctaggaaaccaagagcatcagagatttggggccgtaaaaatgactagcaatatatcaaagcatcaccttaatttaattgttgacgcaaagatatattagactgaacagctgctttgtgcctgtcagaaattggctgacctaaccctctagaccctgacaaaaggaggcaatgggactgtacatcattggccttaatatttgcagctacatctacaaacagcattgcttcttgttagaactcctgctaccagtttgccacctgtggctttgtgctgacagcgctggtggcttactacatcattcagaagtcagaacttggacaagctaaatgaacagctaaaggggctcacgccttttaaaaacccagatgaaagcccacgctctccagaaagccacccttacctctcttccacaactacagcaagaaaaaacctctgactcctataagctcttagaatttattcactatgtgttatgctcattgtagctatttaaatatacatctcatcttccctcttgcaatcttcttcagaataggaaccatgtcttttttatttacgatccaccccctccaccgtctcattttagggcctagaaaaggatcagacaagtcctccctaatcatttattgaatttgaaatatatttgtgaacatttaaatagtgtttcaactagaaaatgttttcacattagtaagccattgatctaaataggctggtgtgttgatgaacccaatatattatttatttgttttaatttaggaaaattttccatgcaaatgtctttcctgattaaactgattatactggccaattcagcctttccgataaataggacacttctttttttatattcagtaccaaatagttggtttgaatgcttttctttccccttgaggaaatcaattgtgcaaataattaattgttcaggctcattccctgccttatacaataagagttttcttttattgaatctataatagctctgacaacccattaagtgttgctaaactttcaagttacatagtctttgcaaaactctgatatatagatatcatatccatttgacagatagaaaacccccagagacattaactgattttccctatcccatgcagtacataaataacagtgccacgatctaaactcaattctgtctgattccaaaacccactaggccaacacttgtccagaaggagaaaaataaaacctgtgtctgagtagattctctgggtgaagcaggttctctcctttaaatgtagcaactggagcatcagagaacataatctggcaggcttaaattagcacagcgaattacgtttaatggaggagttgttgagcagatggggaagaaatctgatcaggtcctaggagaagctgaaaatggtgtgtgttgggagaattctagttgtggcaaactgaaccacacagggttatatgtttccttcccaaacaccataaagtgagagtaaaggaataaaaatagaaaaagtctacaagaatgaaacactattaaggaaaggaacattcagaaagcaaaatacactcttctagattgagaatttagcagcatattggccaggcctggtggctcatgcctataatcactgcactttagaaacctgaaacaggaggatcacttgagcccaggagttcaagaccagcctgggcaacatagtgagacctcgtctctactttaaaaaatcaaaaaattagccaggtattacggtttggctctgtgtccctatccaaatatcttaaattgtactctcataattcccacatgttgtgggagggacccagtgggaaataattgaatcatgggggcagtttccctcctactgttctcgtggtagtgaataagactcacgagatctgatggttttaaaacaggtttccacttttgcttctgtctcattctctcttgtcatggacatgtaagaagtgccttttgccttcaaccacaattgtgagtgatatggcttgggtatgtgttcccacccaaatgtcatcttgaattgtacccccataattcccacatgttgtgggagggacccggtgggagataatttgcatcatgggggtggttcccccatactgttctcatggtagtgaataagtctcacaagatctgatgattttatcaagggtttctgctcttgcatcttccttagtttctcttgccaccatcatgtaagaagtggctttcacctcctgccatgatcctgaggcctccccagccatgtggaagtataagtccaattaaacctctttttcttcccagtcttgggtatgtctttatcagcagcatgaaaatgaactaatacagtaaattagtaccagtagagtggcgtgttgctgaaaaaatacctgaaaatgtggaactgactttggaactgggtagcagagaacagtttggagggatcagaagaagacaggaaaatgtaggaaagtttggaatcttctagagacttgttgcatggctttgaccaaaatgttggtaatgatatggacaataaaatccaggctgaggtggtctcagatggagatgaggaacttgttgggaactggagcaaaggtgactcttgttatgttttagcaaagagactggcggcattttgcccctgctccagagatttgtggaactttgaacttgagagagatgatacagggtatctggcagaagaaatttctaagcagcaaagcattcaggaggtgacttgggctctgttaaaggcattcagttttaaaagggaaacagagcataaaagattggaaatttttcagactgacaatgcagtaaaagaaatgcccattttccgaggagaaagtcaagctggctgcagaaatttgcataagtaacaaggagcccaatgttaatcaccaagacaatagggaaaatgtctccagggcatgtcagagacctttgtggcagccccctcccatcacaggcccagaggcctaggaggaaaaaatggtttcataggccaggcccagtgtccctctgccatgtgcagtttagggacttggcatcctgtttcccagctgctccagctgtgactaaaaggagtcaaggtacagctcaggccatgccatcagatggtgcaagccccaagccttggcagcttccatgtggtgttgagtctgtgggtgcaaggaagtcaagaattgaggcttgggaacctccatctagatttcagaggatgtatggaaacgcctgaatacccaagcaaaagtttgctgcaggggtagggccctcatggagaacctctgctagggcagtgcagaagggaaatgtggggttggagcccccacacagagtcccaactggggcactgcctagtggagctgtgagaagagggccactgctgtcctccagaccccagaatggtagatccaccaacagcttggattgtatgcctggaaaagtggcagacactcaatgccagcccatgaaagtgaccagaaaggagggtataccctgcaaagccacagaggcagagctgcccaaggccataggagcccatcttttgcatcagcatgacctggatgtgagatgtggcatcaaaggagatcattttggaactttaagatttgactgccctgctggattttgaacttgcatggggcctgtatcccttttgttttggccaatttctcccatttggaatggctgtatttacccaattactgtacccccattgtatctaggaagtaactagcttgcttttgattttacaggctcataggtggaggggacttgccttgtctcagatgagactttggactgtggacttttgagttaatgctgaaatgagttaagactttgggggactgttgggaagacatgatttgttttgaaatataaagacatgagatttggcaggggccaggggcagaatgatacggtttgactctgtgtccccacccaaatctcatcttgaattgtactctcataattcccatgtgttgtgggagggacctggtgggagataattgaatcacaggggcagtttccccatactgttctcatggtagtgaataactctcacaagatctgatagttttatcaagggtttccccttttgcttctttctcattctcacttgccacagccatgtgagaagtgcttttcaccttccaccatgagtgtgaggcctccccagtcaggtggaaccataagtccattaaacctatttttcgtcccagtctcaagtatgtctttatcagcagtgtgaaaacacactaatacaccgggtgctgtggcacatgcctgtagtcccagctactcaggagtttgaggctgcagggaagtatgatagcaccattgcactccagcctgactgacagagtgagaccctatctcaaaaaataaaaaaaagaacttaatagcatatggaagctaaatttgagacaatctgatctccttagttgcagattggcaggctaggtaaactgaggaggagatgtaaaatcgtccccctttaaaaataaaagaattcaggtagctgtccaaacaaataactacagtcatagacctttccaggctgcaagcacaatagactctagagaccaatactacactaactctatatctacagtgtcgaatactgctttgttaactccccacacactcaactccccaacttcagatgttccaaaaaatgatatctcttctcccagctcaatatctggtttcaccttgaccagctcagtctaaccactgcctaaatgccttgattttggtgaagaacttcttaaggcatggaccagcagtctttggtatctgatatggtttggctatgtccccacccaaatctcaacttgaattgtatcttccagaatttccatgtattgtgggagggacctatggggggggtaattgaatcatgggggctggtctttcctgtgctattctcatggtagtgaataagtctcatgagatctgatgggtttatcagggatttctgctttttcttcctcctcattttcctcttgccaccaccatgtaagaagtgcttttcacctccctccatgattctgaggcctccccagccatgtggaactgtaagaccaattagacctctttttgtttccagtttcaggtatgtctttatcagcagtgtgaaaacaaactaatacagcatcactaactttctaggcaaggcaaaatacaaatccatcacctacaaaaaacacatccttccaaaatggacatttaaaatccctgcataatgctagccttgcaggacagaactggtgccagtttcaatggcttatcgtatataaagttgttctatttggggtgcatggtttggcctgcaatataactgaacatatgttatagtagagttgggtgtcatagagttctactacatttattcctgcagaggcaaggaaatctggtcctttactgtccctctagggttgagactagaagataaatttatagtccagatattttaattttaagggcttgggttaggcaaaaattatttttggagaatattccacattatgtcacacatagatcaattcaaggaagatttatgtctctcctttttgttacaattataactaagcaactaagctttcaaattgaaatgcataggaacttggatgatattccaagaactgagtgcttcagaatgttagatcatttcactgatcttgctttgcaatgtcgtaatggtagcagaccatgtgcatgcacatacacagaggctttgtgtagagtttatttgtgtagaattccttcagtctgtggttttattcctaaaattccacccagggaattagtaaagaaggttgtggaaagtgttatgtgtttgtttttagctttttgtttctttgttttggtgagatacattttgcatctcttagaaatgaaaatgaaaacgagaaattccccctgttagtgttcatgatgtcctcctccacaaagatgctttccaaggatcacagcaggtgcactcatcaacactgtcctgaacacacagctgtcccaggaatggatttgcaaagtgtaaagaggaataagaagcattttatcatcaacttaacatttactgcaaatattctctcacttttcaaggcttcaatgttagtactcagttggctatcatgatatttttttcttcagcagtataggagatatatgacctctcttggtctttatttgactagaaccaggtataaaattcaaagtatttaacaatcaatacccatacgtactgaacaatcagagaagatgcaggcctgagggctggaggtagttgctgaagatcccttctttaccataatttaaccccccttaattgctagctgggcagagggcggtagaaaaggtctgtcctgtccatgcaaagcagctgaatatagccctgactggaactgaaaattaggctaaagcaataaaactgacccaccaacgtcagtatagctagatagtacagtggtaccattgccactggtaaaggggaagctcatgatcatagcagtggtaatggtaataattatagtaccagcaggagaagcagcagcagcaatcaagctattgtcaattgaggatttggcagtgagctagcaatgaaagagatatcattctctggaacatctgaggttggagagttgagtgtctggggagttgacagagaagtattagaaactttggacatttattatttctaattgtcaaagaaacttgccaggcaggaaatacctacaacctgtagatacagacacaaagtttcagaaactttaagtaactggctccaagtcacatagctagtacaccacagagccaagactggaaccaaggacactccaaagcctgtgctatttctcttatgcaataccagccttctcccatgcaaaagtaaaccaaggactactgccatctacctggaggctacaatttcatgacttaattcttacacgttcttataaacttataattctacaataaacttttagaaatgtttactacaaggactaataaatttcagcagtaaaatttaagaatgaccaaaaaagtgatataaccagtgttttcaatgttaggtcactctacatgtttcttatttaaagatagaggtttcaaccatttaagacagccaaacttccccctttcttccaacctttagtaattttcatgagaatgtttagatgctgaacttgattgacagtgtagtgactgatattcttctcataagtaattcatgctcatatttaaactttggaaaacacagagaaatataaagaatataaaagtcacccacaatcccattgcccggagataacaacagttaaaattttgatctctttttttccaatcattttactatgcctatatcagcacatatacacatatagacacatgcaaattgagatcatataaatattgtcaaatgaaatgtcatattatgagcattttctaatggccattaaaattctgagaaacacaatttaaagctttcttaatattctaacatatagatgtagcataatttatttaaccattcccctatctttggagaacagcaggccttggtcagtaaataaatggttgtataaataacaggatctgaattaaatgcagaagattaagaaccccaggttattccttggtctctgcaagttaatggaatccagagaggcaggacaatcaaatgcaatatttttagccttttgaaggatccatccatatacatatatatttagcctttgttgccgacgtgttatgctgaaagcttccccagagcaaggtgtttaatgcagaggcttattgccagaatggtaagagtcactctcacatctgtatgggtccaaaaccagcactagagaacacaagggggggaactccattggtcccatcaaaatccagctctatgaaaagtacatcatggtttttaaataattcccttcaaatccatgatatgtaacaaacctggaaatttgagctaaaattgtcaatgatttcatttgttttttctatgctctaagtaatgggccatttttttgttttgcttccagctttattgaagtataattgacaaatcaaaattgcatgtatttaagatatactatgtaatgttttgatatacatatacattgtgaaatgattaccacaatcaagctaattaacacatccatcacctcacatagttactgttgtgtgtgtgtgtgtgtgtgttgagaatacttaaaatctactctcttagcaaatttcaagtatgtaatagattttttcttttttttttttttgagacagagtcttgctctgtcactcaggctggatgcagtgacacgatctcggctcactgcaacctctgccccctgggttcaagcaattctcctgcctcagcctccctagtagctgggattacaggcatgcactgcccacctgatctttgtatttttagtagaaacggggtatcgccacgttggctaggctggtctcgaactcctgacctcaagtgatctgcctgcctcggcctcccaaagtgctgagattacaggcgtgagccaccatgctcagccgaattattattaactatagacaccatgctgtacataactgcaactttgtaccctttgaccaacatctccccatttcccccacccgtgccccggtaacagccattccactcatgtttctatgaacttgacatttttagatttcacatataagtgagatcatgcaatatttgactttctgtagtaatggtctggttttaatggggggatttctggctccagaaagcataaacagtaatttcttgcagctattgacatacagaggtgactcactcttctccagatacattattaaaattaagaaaggattatatttcttactggtggctttgaattgaggaggattttgtgatcaaacacagttcaggtagaatagacatgggatcagaatcacctaggactcagaaaacagctgagacactcttatggaacaatgttttcaaaggatggtgagccagaaacagctagaagtacaccaaagcatagtgatgtcattgagaaatgacagcctagccagtggctacatttcacagttctttttgcatctatgtggggccatgtgactagttctggccagtagaatgaaagcagaagtgaagtacgtaccacttcaaaaccaagtgtcaagtattctgttcttgcactttcccatctgaaatgaccatgaagactcattattgaagatgatggcattgtaagatggaaggaagcagcatccttgagtcagcatttagaagatagccacccaagacaaatgcctgaccaagaacatcaacactggattttgtgcaactgagaaataaatgtttattgtgtcaagtcattgacattggagggttgtttgtgaaagtagtctgcatagcttgacagggactcattaaaaaggcctctgccatctgagcacctgatttggaagagatagagcatgggaaaaagataagtgtggagcacttcttcaagatgaagaacacaaatcatgcaaacacagggcaaagagaagacaaagcaccaagggtaatagtaacaggaaatcaaaggctaatcaaaggttaagtccaccaaaaaataaaggtggtggaaggaagtctaaaatcaaaaagggttgttatatgacttgggcttttgattttttccatggcctacatgaccaattaaacaatagttacaaatgtatatttctgtcaacaagtggcttttttactttggtatctgaatcatttccgttcccctaaataatctcttttttttttggttgatgactcttcactgttgattttaggtcacactgtaattcattgtgttctcctgaaattttggttactggtacaagcaacaataaagacatgaaaaataatttgagattttgttacatagattaaagatgttaatgaaagcttttttgatcctaagcaagagcactcaggatttttcagttagctatagactttttagacatctgctatcgttcaccatgacacaaagctgcaccattctgtttactgatatctcgagtgttaaatgctccttatattactctctgaggataaaagaatgttgaactgaaataaagtgttagcccttgccttctgctgaattactgagcctcatttccgcctatctatctgtctatctgtctgtctgattgtctgtctctcagttttaagccctaataatgacctgggcagggaatatactagacactaaaataaatcctgattaggacacagtcttatgggagccccagtcatgccaaaaggtgggatctagagtgtatcttgctgccctcatatggtcctgggtctgcttgatgtttactatatccagtgctctctcagttctttacagcctgggggcattttttcctcaacatctgggtcaaaacctggtacacagtaaatagtcaacaaacgtacattgagtagaactaagctctggaatgctcagtcatgattgtcatggaacactttatgaattattaaagtctgtttgtgtgggcatctgcctcactttctgcctagggctaaatatcagccctgcaaaccagccatacccaaccccagcactgatcaggcccctcttatgggaagttggaccctgttttcagtacctactttttaattttttaattattttatttatttatttatttatttatttatttatttatttatttatttatttattttgagacagagtctcactcagttgcccaggttggagtacaatggcgcaatctcagctcactgcaacctccgcctcctggattctagtgattttcctgccttagcctcctgagtagctgggattacaggcgcccacaactacgcctggctaatttttgtattttcagtagagacagggtttcaccatgttagtcaggctggtctcgaactcctgacctcaggtgatctacctgcctcggcctcccaaagtgctgggattacaggcatgagccaccacgcccggccatcagtaactacatttatcgctttagcaccttctccaaagaaccaaaagaaattatctacttgatttaaaagcatcactcacttctgccacatgaccctctctcgcccacccacacacatacagactggaaccttgaaggtttccacgcaggctttactcaaggaaaagtttacccgactccattaagtcttccattttccattattggatagccatgcctctagaacatggtctataactctgcttttcctgttaacttttcccactatttccacagcttttccttcaatacctgctcactgcaaaggctctagtaagtcccttatagagtcccctctcctctgctccccaactccaaggaatgacctaaggctagctggagaaacttttcaaatgatctcggctacctatcagacctgaggtttgcactatgcaaataactacacacataattagaaacccatagaatatggttgttttctaccgaaaactcatttgatccaggatttactgaaggtagaacaactgcaaggaattaaggtaacacatacctgtgaatataaataaaatgaacgagagagggaggtggacatggttataaaacaacaacatgagagatccttataaggacataactgttctgtatgttaacagtatcagtgtcaatttcctaatcatgatattgtactacagttctttcaagatgtcaacactggggaaagtgggtacaatctctattatttcttacaactgtatgtgaatctataattttgtcaaaataaaaagttttcttaaaattaatgaatgggagtaaaagaaattagccacttttagaatttgctcttaaaggttctgtgtagatatgcaaaaaagcaaaaaactttagctgaaaatgactgaattgatttgctggtaaggaaaatttctataagattcaggttaggcaattctgagtaaagaaaatgaagaatgagtagaaaaaaacatagtggcagaaccttctggaactcaccaggatttgaaccatgcaacttctgataataatacaaataaaactctccaaagcaaaacatttaatcatgtcagttcctacattgtgcatgtcataatgatagctacaagtgtaaaagaatagcctttccattctaccttattccatttaaaagtctagcatatgaaatagtaaaatgaacctcacattctctgttataagttaggtgagataaaccacaattaaaaattgagatgcctgataaccagagaaagaagtgttaggctgcaacccaagagtcaactaaataaatccctggcattaacttggaactgtctctaacagttgcaatataattcaaattattaatgacatgatagctgatgtgttgcaatcctctcagtagtgatgctaagttatactcgccacatgtacattcactagaaaatcatcataattaattttagtacagccccgagctatcattagtgataaatcatgataatgattacattcaagtttaatgttattgactacatgaattataatgttattaacaaattagattgaacgtcttatctaaaactaatgttctaatggggagaagtaaacccctttccatctgaagcccagagtaacttactggttgccagtcctgtctccctattaactctggtggtgtaaggtggataaaataagaagtaataagtctccaattcaacagataatcaggcccttcttcatagtaaaaatgaaggataaccttgcatttcccacttgcagagtcattagccaaggcttccagcttcctggagagagatccagagagctgacattatgggcacctaataaactgaaatatccaggtctccaagtcgatattacaagagtagagatattgccagaaattaaaagtttcagggtaagtcagaacaggaagaacatgtgctcacccagctgcaatcagccatcactgccagggagggcctggtaaagaatccataccccggttcacaggatagaaccagggacagtcatgtgcacatttccccttcttcatctctggccccaaggctttcacttattttttatcttggactatctgtttcattgcaagtcacctcaagtcattttttgaatgaagtacagatgaaaggataaaaataaatgtcaacagtacactagccttgcttgctgaccttgtttgctgttcttgaaggcctatatctgccttttttcattgtggcatgttggcagcttaagttgtgaggttgtgaatcgccattgatcaattgctgatttggacatgggcatttatgaagaactgtcctgatcagaaaataacccatctagtcctttctgatcccttcagttcaccttttttgatccagttattatggttcttgatatactcataaacaataatagttaacaaatatcctctgagtagatactatatgccaccaggcattattcaagtgctttacgtgaattatctcatttaatccttacaataagcctccataataggtactgttattattccaattttacagttaagagaaccatggtacatacacacaaaattaattgacttacctagtggagctgtattcaaacccagttctgtctatgtgactccatccctaaagctcataggtacttcctgggtagggttgcccagctaaatttgaatttcagataaactgttttttttaatcattctcaatacttcatcatctttgccttgttttcttttttaattacaaaagaagcagatcaccactaaggagagtaaggactgaaaatacaaaagggttcatgagcaatagagacacatctatggagggtgtgaaaattgaaaggtgggctttcagatggaatgacacacacaaagacacagaggagataaaaatgagctaagttttctcactgctcttaggagttcttctccttactctccagcttctattttccccaccaaaaaatgactgagcagcctatgttttgaataatttttccttttcattaaatcaattcagtcatggtagtctttaggcaaatgagccttaaaagcattatcgctaaaaactcttcttccactgattgctgacagaccaacttctacaacatatcaaatacaaagtgtccaaggcaaatacaacattttctctagaagctatagctcctcaagacaactttatgtccaaatctaacattttttgcaactataccctataccaacacagaatatcaatccgtacacatactcttcattgtgtacctccacacttttttgattttttttctttttcattatttttttttgagacaggatctcgctctgtcacccaggctggagtgcagtggtgtgatctcagctcactgcaacctccgcctcctgggttcaagcaattctcctgcctcagcctcctgagtagctgagattacagttgcatgccaccacgcctggctaatttttgtatttttggtagagatggggtttcaccatgttggccaggctggtcttgaactcctgacctcaggtgatccacccatcttggcctcccaaagtgctgggattacaggtgtgagccaccacagccagctgcttctttgatttttgttactccttcacattcacatttttgagcctggcatcaggtgtcatccacataccctgtaccatttcatctaatccttataacaaacctgtcaaatgatcagtattatcatccctattttatacgtgatggtaagtcactggagtgacttaccaaaaaaacacacactagtgagtggcaaagcttggttggatttgaactcaaatcttctggctcaaagccccatattctttcaactatacacagcttctcttggatgccaagtgcctccatttgtaccctactccaaattttcacctaagaaaaacactttgtaaggttcatttcaaacagtatctgctccataaactcttcactgatcatccaataaaaaatgaactctccttactttgatttctttaccatgttctttgtccactcagtcattcaataaacaactgagcacctactgtgtgccagcttctatggcaggtgctaaaggaacagcagtgaatgacacaataaggatgctgatctcattgcatcatatattttatggtataagtcagagaatcatagtttccaatttcatgtcatctatagcccttattttacagatgagtaaactcacatacatgaagttcaggttcatgccattataggcaggccccagaatagaggccttcacctatccttcccattaacgttgtttatctccatggcttcttttccctactaggctgccaataacttgagggcaggaactgtgttttaatcatctctgtacattcctcagcattagcacagacattcaaaaaaatgggtgcaatgtgtgataatggtggcaaacaggaaagacagattatctacactcttagagctccaatggacaaaagagctagatatttaacatttaaaagtatgttacaatttcaagtattccctcacatcacttttcagcaaaagagctttcataaattacagatatacactgctgagttaaacttgtggaaagtatcacatatttccaaaatggaaaatgttgttttctgctataatagcctttaatccctcattgttttctcccttaattcaaatcccaataattataaatagcacattaatacataacttatctggaggctacatagctatcaacttcgaccatgaggaagtcatctaaaacacaaaaagacgcagagaatccctctgagcagccaaaatacattttaaaaaatacaggcattaaagaaatgtattgcttctttagtcaatatattagatctttactgtttttattcaatgcatacttaccgagtgttcatgctttctctgtgtctgaaaatcaccctgggactcttaactcttatttggggcacaattctaatagacatatacatctaattttcatgactcacagccaatgaaaagcagcaagcagaaggtggataaggttggccagaagcaggctactgtatcccattttcctacttcattgtaattcctaccaccacaggcatatgtcaacaataccaaagaatgaacacaaggcagcgtcagcctatggattactatatttcacatttaggaaataagttatatataaatacactgtggaagataacttgggttccttcttcactgcagccaggtaatgatcaggcagtaatggctaatgaaagaaatatttatttttctttctgtatttaaaagacaaaatcatcaactatgcataagtgaaggattttgtttccatgagactcaaattccctctccttaaattgttctgcttttgagcagaatatacgtggattactttttaccagcagagggaggtgaaaaacaaggaagctctgaacatttctctcttcaccacagaggttaagtctttttgtaatgtgactgattggctccctttagcagcatggtctaatttagaaaggtcaggaaattgtgtttaacgtctactgagtcaacaaacttaggaaaaacacaagtggcaaaaagaaaacactctcagcaggattggcccttatgcaatggctccaaggagaagagccgagggagaagcttagcaatgtctgcaccactgcacactgacaagaaatcctttttgccatgaaatcacacttcgcatatttttacagtgtgaagacatatacacttcagctcagagagagtttactctttgttgcaatgaaactgatgaaataaaggcttttgttgttgtttttacatgaatatcatcagggctaaacccaacttcttggcaggactagggggaatgggcagagggaggccatctcctaccactgctactacccctgaggtccagcaaatatgggcatgagggcctggggaaaaaaggcatatcatagagaaaagaactttcatctgaagaatgcaaggctttttaagttatgaggcccagagagacattaaaatgagaccacaatcccatcctatcccccacgtgagctatgaattcatctcaaaactacgtgtttttgccacaagtagctataaattaatctaataatgccacactggacactataacccacaccctatagcctaccaacatataccaatcactaatcaatgttacttctataaaccagcgagaattcctgacaaacaactttgtatcaatccactccttgttccccctttttgcctttaaaaatccacttgcgaatgctgccaattggactgtatattcagggcaatttgcatctatgctcctggttgcaatcctcaagcctggcccaaataaactctaattatattaattttgcttcagcttcttccttttaggttaacaccacttaggattctcccagggaggcttattcagcttattcaggtgtataaatctaattttcctgccccacagccagtgaaaagctgcaagtagaaggtggaaaaggttggccagaagcaggctattccatcctactacttcattgtaattccaatagccacaggcatatgtcatcaacgctaaaaaacgaacagaaagtaacaaactgggaagcacagtatgatggttaattttaggtgtcagcttgactgcattaaagaacatctagagaactgtaaaacatcacttctgaatctgtctgtgagggtgtttccagaggagattggcatgtgagttcgtggactgagtggggaagatctgccctcaatgtgacaggcaccatccaatcagctggggacccaggtagaacaaaaaaggcagggagaagactatttccccctctttctcctgaagctaggacactcttcttctcttccccttggacagcagaacttcaggctctttggcctttggactccaggatttataccagcaccctcagttcctgctatgggttctcaggccttgggctgagagttacaccatcggcttccctggttctgaagcctatagacttgggctgaactatgctaccagcattccgggatctccagcttgcagatggcctgttgtggaactttacagcctctatattcatatgagccaattcccctaataaatatcctctcgtatgtctgtatttctattatatatcctattggttctatctctctggagaaccctgactaatgcacacagtacaaaataactatcagacaaaaccacaaccaaggaaaaagagaatcatgctttaaaaaatgcaaattttgtcaaattatttgcatcccctgagaaacaaggacagggatagcaaatctagaggaattccaagttctaacataaatttgctgtgtgaccttgaacaagtcacagtccctctctttgcttcaatttctccatctgcaaattgagaaaatagtatggactagagaatctttcaaatagcctctcagcctaacactctgagctcagtgattcaattgccagattgaaaatatgtaagtagcattatcttcccaaacaaaggttatcacatgaatttgtttgttcatcataacaaagacaggtcaatgattataattataattataataggtcaactgtcccacatgaaccctgctcaatttccagctacataattatattgaggaacaggaacacttgctactttgagctgatagcaaaattcctctcctctctgggagagaactgtttctatttaggacaaagaccatacttagttatgaagatgagtcccctgggcagaacctgcatggtctgggctgagaccaacttaacagctaaactgctctaaacaagaaatgaaaataatttgggtggttggaaggaaatgtgctggaaagggaaagagaagaggtggaaggccggaacaagaggccctgcagcacaatggacagctaaatcacaagtttaagggaaatctggtactagtgttgctggatcaaattttactgggcatcttgtattttcacttcaggtgaacaaagaataatttttagtataacttttccaaatattgcttgagacatactaaaaaattcatttatcagaagttcagattttactgggtgtcctgtatatttatttgctaaatctggcaagtctaccagtggcagaaatgacaaacattttaggaacttcaatctgagattgtttagctatactagggtataacctcccttagggctaccactaatccataaagcatgattacattaattagaaaaaggtgattcttcttcccagtacctacctaaggcacaggcttaatgagtgtggttcacgggttagatttcagcctcgattctcctctaaatcctgcctctcttccatgtcttcaaacctttagcaaagtcttctgtacatggccctaggttaagggtatggaagacagtgaatgaaggtctcctggccccagagtacaagatttgcatagagaaatgcaggaaaagagaagcaagcttatttcaggatatatgcctcagaggaaaggtcaaggattcagtggccacaggcaatagcatccagagtgactgagtaagagtcctcagaccttgccaaaaatcctgagatattagagaggttgtaggctgcccattgtatattgggtgagaattagagtcaataatcagggaaagggtaaaacctgaagatggaacaatttggaatataaatgtggttatataactaaagagggaagtaggcagttcatgaagatttagagatcatggagaaagaggaactcctacttatactcaagacccaggtcaactgttacctgctctgtaaagctgatggttctaggcagaatttattcatttttctttgtgctccaattctcctagcacctgtatctgttagaagccacgtggaaaaaaacaatcagaatataaggtacaagtctctctgtccctctcctctctccctttctccattctcgctttctgtagaagcagattatgagttatttgaaaacaaggactaggccgggcgcggtggctcacgcctgtaatcccagcactttgggaggccgaggcgggtggatcacgaggtcaggagatcgagaccatcctagcgaacattgtgaaaccctgtctctactaaaaatacaaaaaattagctgggcgtggtggtgggcccctgtagtcccagctacttgggaggctgaggcaggcaggagaatggcatgaacccgggaggcagagcttacagtgagccgagatcacgccactgcactccagcctgggcaacagagcgagactccatctcaaaaaaaaaaaaaagaaaaaagaaaacaaggactgatatatcaattttataattgatattatataattattatataaatttattaattttatataatattaatatttattaattttataaattaataaattattatatagaatttattaattttataaattaataaattattatatagaatttattaattttatagccccagtgattggcatatactagccaacagatacatttgtgaaaaaataaaatatattttgagtttaaaattaagactgtagaaaaacataataatagttttaagtatatggcagtgtttatagttgttttctatgtttttagagggcaacataagaggatagacatctcaaatgcaacatgaaggaagtagaataggcataagaaagaaaagaataataatttcagccactgggtgatcagcctctaatgtaggcttttttaaaaattcatttttaattcactttagtcagttcaatacggtcctacctcagggacccttgcagatctaaaatcctgtttctcatggctctaaactccaagtacagcaagaacagtagctaccatttccctaacccagtagggtagttcacttttgcaatgctatgcaaatgaccaggagagctgacactttgggaagatttgcccgaaaaggaaaacaaactgctagtccagagaaaactcacagttacctacttttattccactctgaacttttcctttaaggaggaagagttgcaattgactcctgaaagccctgctgattcagtcctgttgactaatcggtttgggttaattttggaaatgctagaactgtctgaactcttgtataaaagaattgtaaatagaaatctggaaaggagaaaggaaggacaggtcaagtcttagaataatattgctaatagtgatgagaatttttctgccctacaaaatctcgtggcttcattctccctcttttgttcacatttgacttaaaagaaaaaaaaaatgcatccctcctttccaatgttaagtccacttgacttggtgctttatgtgcccatccctcttatattaattctcattgtttccaccctcctcctttctgtttgtttttccccaattcctcttactctgatacctttctcttggcttacacacatgcttggttctcgccaaagcctcacttttctgcatctctgctgccttccaagcaaacatgactcgttctcaccaatatccagttgtcctctcctcccaggcataaaaagtaagcactgtccactctcctgcagttacataggcttatgtgactcgttttcaccaatgaactatgagtgaggtaacatgtcacttagggcagaagcttggaagagcaggtgtgaaatgtccatgcactctttttcactgaagcggcaactgaggagacttcgtgttccagaaggcacagcaacagatgattcaagtctctgttagcctgggtcaaacagagacctctcctctggattatgatgattatacagtatgagtgagaaatcaagtatttttgtgtgttaaagcattgagatttgaaggttatttgttaatgttatattgcttagacagtcctgattaatacagtcctctttctctcccactttactagcagatatcttgaaataatagtctaaacagtggttgtcaaatgtacctgtgcataagtgacacctggagtgctttctttttctttttctttctttttttttttttctatactttacgttctgggatacatgtgcagaatgtgtaggtttgctgcataggtatacatgtgtcatggtggtttgctgcacctatcaacacatcatctaggttttaagccctgcacgcattagatatttgtcctaatgctctccctcccctttcccccaaccccgtgacaggccatggtgtgtgatgttcccctccctgtgtccatgtgttctcattgttcaactcccatttatgagtgagaacatgcagtgcttggttttctgtctggagtgcttttttaaaagccagatttttaggccccaccccagacttgatgaatctgaatacagttctgaggcttggcaatctgtatttttacaggctccgcaagtgactctgaagcagccaaactgcaccaatcctcagacatggacacccagagttttactttctcacctcccgtttacacataaacattctgtaacctggtttctccattccttacccttgctactaaccctcagaagtcatgtaagacttccaggacctcctaattgcaaaatcattcagtccctgttgtattcaaattccctgtagcaagtggcaaagttacctgccactccctttcgtgaaattctcttttcctttagttttcatgatatgatgctactattattggctttcagttctgtgaccaatgtgtttttctttttcttctttcttgtttcatccttagtaaaagtgaccctatactttttaacaacatttttattcattttgacaaatttcagttctgattgtgctcttgtgcttttttaatggttgatttttaagccattttagtttttaattttaaaattttaaaaaaatgttgtgggtacatagtagctgtatatatttatggggcacatgagatgctttgatacaggcatgcaatgtgaaataagcatatcatggaaaatgggatatccatcccctcaagcatttattctctgtgttacaaacaatccaattatacactttaagtaattttaaaatgtacaattaagttattattgactatagtcaccctattgtgctatcaaatagtaggtcttattcattatttatatttttgtgcccattaaccatcctcacctcctccccagacccccaatagcattcccagcccctggtaaccatccttctactctcttatctccatgagttcagttgttttgatttttagatcccacaaataagtgagaacatgcaatgttagtcttcctgtgcctggcttatttcccttaacataatgatcacctcttgccagcatttgaggtagggagagtgtaggcacttatgggaacctattgcagtaggatctaccctagttttattttacatttccaactgccttttggcagtatctccattcaaatgtttaaccaccattgtaaacccaacatgttcaaaaccaagcaaatcttcttatctttcaaatcaatgactttaactgatttctctagttctgtgagtgatcctatgtatctagtcacccaggcttacaaatttgctgtcacgtttgtttcctctctaccttatttccaacattcagtgagttacctagtatgatggttaattttaggtgtcatctggattaaggaatacccagataactggtaaagtgtgtctgtgagggtgtttccaaaggagactgactcatgagtcagtggactgagtggggaagatccaccttcaatgtgggcaagcactatccagataggaaccccaatagaacaaaaaaaggtggaggaatggtatttttttctctgtctttccaggagctgggacattcttctcgtgcacttggacattagaactccagactctctggcatttggactgcaggacctgaagctttcagacttgaactgaaccatgcctgttaggggacttctcagtctccataatcatgtgagccaattcccttaaaaaatcccccgctcatctacatctatatctgatctatatcatctatatctacatcctatctgttctatcttcatgaaaaaccctgacaccaagtcagaaccaatttagctctccaatatgtcactcagtcctgtcgcctctgttctctttccactgccaccagagtaagtcaggctcacatcatctctacctagaccagtgcagtggcctaactacctttcgcactttcaagatattccacagagtgctatgcaattcatgttcaaagtaagagctgctctagctgacattggagtttaccccaatatttctttccagccatttttcttatcactccactactttacctggtactgtaccttgaccacgacctatgttttccaatccctctccatgccttaattagctgagataaaacactctatatttaccgagagcatagaatttaataatcacctctctaccatccttaatgtaatttgagtgccttgcactcaggaaatacagctcagtacatatttgtggaagtatgtggtgttctatggttcacagaggatatattatacatcttcaaatttgcttgttaacataggttctgcatttggcaggactctactaatcccactcccaccccaaaatatacaattcttcgtggttgatgtttgtcagctttgggctaacctaactgggccacaaaatgaggaaagacagccatctggagctttaagagcatgccctttgcccagggaaacatgccaggtcatgcagaggaaggctgtattcgtgaaattacttttggcatcaagttcaaccctttgcatcttgctttcctctctgcttgctcccttatgcttatctggcttccagcaaacactgcccttcaagcatgatgacctgtttgatcaatctcctggctcttgaccttcctgctttccttcctaggtataaattacattcttcctccagactcagaattttctcagactcagttccaagacagcatttggcttggcctcaggacctcatgactaggaagagcagagttctatcccattccgggagaaaccatacaactatggggctgctttcaaattttgtgctcaagtctgatggcagtaactaaaaaccatctgttgtcgtgttttagcatgagtggtatagcttgcaaatgccttggtgcactaccttccatcagttattcttgaaattctaggttctgttgtggagggatgtcagaatcaaagttgattggcctcttagcaaaatctctggtgccagaaagggactgtgcattgattttccccattgtgtgtggcatccttatcacctcccagcatactgctccttgttggtactttttctagactaaaaagaaaaagcactatctgttttttcccattcttacctactgaaaatcctgtcacacttttatgcttctgagatgggcgataggaaggtcttgactaaagggcttcaggacactaatccacataaatggcagatctgatatcagcatgattgctctgcttctctcttcacagttctggaacaaaaagtatagggctgtaaggaaaatatttactcattctgtaaacatctggggagcaccaactctatgccaaatggaaggaatccaaattttccttctctcaagtagttcacaataaagtaggaaagacccaaacacatcgtttccttttcttattataatcacttaaaagaagcattttctcacattcaagaggcctctgttccacttttgcttgcccacttctgtctttttatttcttgcaaaagaaaatgagttttgcttagggaattgagtatatagatccagtggacagaagataaaagatttccatggtagtgacttacttatagcattttccttgcagagattattccaccatagaaaatattccattagcacgagaggttgcttcatttcatcttccttttgtcttatggaacccctattgtaagaaacacggaacttaaaaatgtccaaccttaacaaagagatcacttcccagtattgtgaatacatggagggtagaggtgaagccatgctactagagaaacacaaaaggttgggcctagtgcctggcccaggctgggaagtgggagtcagcaaatggttcttgaaggtaatacttgagccaagactgaaggataaggggagagggaggagaacaagtcaggctaagagggtctcattcctggtagagcagaatgggagcaatggcctcaggatgaggagtggcaatgacacacagcacctaaagatcactggtccatcaacaaaaggaaggaaatgaggctggcatggtaggcagtgtcaggttaccaacaagcctcttccactaagcaaatagaaacaacaaaatatctgcaaattctctacctgtgatgtttgggaaatatcttcagtgacctgggaatgaattttccccatgttgctttaaaaaagttccctttctcccttaactggatagtaatatatcccaggtatcctgggtgccaatgtcatttgggaacttctttaagtcacagcagatattttaaagggtggtgaaggtcactaggtctcctttgaaaatacagaggccctaggcagccattaaggtccttttgtgaatgtcacaagtaacaaatgttcaattgccagagaaaactggaagaccaaatgataggtgcaacctgtagtgatcaaaaggaacatctcacaaatgagaacaaagagaagatgggcaggaagaaggaaagaggaagcacacaatttgaaatggacattgaactggcaacagagctcagcatggtactttgaagatggcaaacatagtgacttgggactaagaagagggagaggcaaaagcccagtcagatgctcacatagaataaataaccaattggcagcatgggccattgcagcacatattagttttctgtgaccactgaaacaaattgccacaaattttaaacagcaatttattttcttgcagttctggtggccaaaaagcaagatatcaacaaagctacactccttctggaagcactagaagtgaatcattctttgtctcttctggcttctggtggctgtcaatactccttagcctgtgtccatatcactccaatctctgcctccatcttcacagggctttctcgtgtgtgtctgtgccttctcctcttctgtctcttataaagaaacttatcattggatttaggaccacatggataatccagaatgactcatgagatccttaacttaggtatagctgcaaacactctttttccaaataaggtcacattcataggttctgggggttaggatgtaaacatatattttgggggccaccattcaacccattacatagtgtttatgtgggggagagatatcctccctttttgtcttcctgattgtaatgttaatatacgttcatcataaaaatatagtgaatatagaaaatcacaaagaaacttaaaactcatctttaatttcacaacccagagtcagccactggtaaaaatttcagaaatcatattccagacttctatgactatatgtactgatttgttaggctcctatggtacttactattgtgaaatctgcttctttcccaattatagacatattgtgaacatcatcccatgcctttaaatctctttccacaacaaaatttttatcagctgcctaatatgccatcacatgtctgtatcatagtttaatgaattggttttgaactgtttgacatttaggctgtccccagtttttcagtgttatcagtaacactgagatgaggacatgcatgccagggtatttaaaagaaaacttgggttgcatgatacaatgggacattgactgtggataccctaaattctctgagttttatagtaaagtgtgcattggactatactgaatcaggcccaagttaggaaaaagatttggcctggaacagagaatcactttataacttctctttctcagaaaaaaaaatacatttattcagcttcctctcttgccactctctgtgttatgctttttattttcttaaaagggtgggagtgacacacctatttcctctttttaaaatgttattaatattttattaatgcctaccatcttgtctggccaagcaaaccatcttactcagtgaagtattaatatagcttttcattttaagtcccatgataaagccagaaaagactagcactagaaaaaaatctacttttattttttattatttctatacctgcactgagaaatatttgtatctagactagaataaatggacaggaggataagggtcatgggtaaactgagtaaatacagcattttagaaaaagctatttagacccctaaataactagaaaagatattcctcagattggggtgaaagggaagcttatgtttgaattataaaaagtcagtacaaacccatctggaaggatcatataatgaggaacacaaacagcctccagaatgttcatcaaagaaaattaatattcgctgagcgtataaggccaacattgcattgccataaggaaatacccaaaaatgggtaatttgtaaagaaaagaggtttaatcagttcacagttctgcaggctgtacaggaagcataacactagcgtatgcctctagggaggcctctggaagtttacaatcatggcagaaggtgaagtaggaacttgaacctcacatggcaaaagtaggaacaagagagagagcaggaaggggccacacacatttaaatgaccagatctcacaagaactcactggttatcacaaggacagcaccaacgggatggtgctaagccattcgtgagaaattcaagcccatgatccgatcacctcccaccagaccccatctccaacattgagatttacatttcaatattagatttgggtggggacacacatccaaactatatcactgaggaagcccattcttgtgaacgtccagcttacgttttgaaactacaagagaagtagaccgttccaatgtacttatatttgtgatttccaggtttactgccacataattttggcccataaagtgaatactctttctgatttgggattgtgcattcataaagttagcaactactaaaaaaaaaaaagtcaatattatagttatttctgtgcctgagtagcacaagtggacaaatctgatgaaatcacagaagtggtgatagcaacacacaacactagtatatagagtttcaagaaacatattggaagtgcatattcattgctcactcagcttgactgactccagtaaatccaccccagtagtgatttaccaaaaaaaaaaaaaaattgatccaatcctggcagaggaggattgttgagaactttgaaagaacacattttagtccaagcaataaatttgttaatagcagattcttcttcttcttctttttttttttgagatggagtctcactttgtcacccaggctggagtacagtggtgtgaacttgactcactgcaacatccgcctcctgggttcaagcggttctcctgcctcagcctcctgagtagccttgatacacagcatgatcccttacccctcagactggccaagaatgagcttctagatttgtcccatttacccatttcgtcattcatcggttattctctatgtccactatcaatgatcttgaaatcaaataggagaggaaacacacaaataaaactaagtaaataaataacactgctaagtatactaagaaaggtaagagcatggacgaggagcaaacacttaccctaaaccatcatcatatttttacttccaaggcactactatttgacttagcatctcagctgaccactcaatgtctaggttcttcccaagctgactacagtgcttaattttttttattttgtgcttactatatgccacatattttacatacattatctcatgtaatgctcacaatcaccatataaggtagatacaaattctatttcatgggcttagaaaagatgagtaaaattacccaagaatttgaacatagtttgtcctaattccaaagctctggtttattctacctcactatgctgactctcaaattttcaaagagatttatagaattaaagtgtacagagtgattgaccagagtgagtgtgctagtccattctcaccttgctataaagaaatatttgacactgggtaatttataaagaaaggaggtttatttcttatttctgagggctctgttctgttccattggtctatatctctgttttggtaccagtaccatgctgttttggttactgtagccttgtagtatagtctgaagtcaggtagcgtgatgcctccagctttgttctattgcacatctacaactatctgatctttgacaaatctgacagaaacaagaaatggggaaaggattccctatttaacaattggtgctgggaaaaccggctagccatatgtagaaagctgaaactggatcccttccttacaccttatacaaaaattaattcaagatggattgaagacttaaatgttagacctaaaaccataaaaaccctagaagaaaacctaggcaatagcattcaggacataggcatgggcaaggacttcatgtcaaaaacaccaaaagcaatggcaacaaaagccaaaattgacaaatgggatctaattcaactaaagagcttctgcacagcaaaagaaactaccatcagagtgaacaggcaatctacagaatgggagaaaatttttgcaatctactcatctgacaaagggctaatatccagaatctacaaagaactcaaacaaatttacaagaaaaaaacaaacaaccccatcaaaaagtgggcgaaggatatgaacagacacttcgcaaaagaagacatttatgcagccaaaagacacatgaaaaaatgctcaccatcactggccatcagagaaatgcagatcaaaaccacaatgagatatcatctcacaccagttagaatggcaatcattaaaaactcaggaaacaacaggtgctggagaggatgtggagaaataggaacactttgacactgttggtgggattgtaaactagttcaaccattgtggaagacagtgtggcaattcctcaggaatctagaactagaaataccatttgacccagccatcccattactgggtatatacccaaaggaatataaatcattgctgctataaagacacgtgcacatatatgtttattgcagcactactcacaatagcaaagacttggaaccaagccaaatgtccaacaatgatagactggattaagaaaatgtggcacatatacaccatggaatactatgcagtcataaaaaatgatgagttcatgtcctttgtagggacatggatgaagctggaaaccatcattctcagcaaactactgcaaggacaaaaatccatgttctcactcataggtgggaattgaacaatgagaacacatggacacaggaaggggaacatcacacactggggcctgttgtggggtgtggggaggggggagggatagcattaagagatatacctaatgtaaatgatgagttaaggggtacaacacaccaacatggcacatgtatacatatgtaacaaaactacacattgtgcacatgtaccctagaacttaaagtattatatatatatatatatatatatatatatatatatatagagagagagagagagagagagagagagagagagagagagaggtttaattggctcatggttcttcacgccatacaggaagcatggtgctgacatctgcttagcttctggggagtcctcaggaagactacaatcacggtggaaggtgaaggaggaagaagaatgtcacatggccagagcagaagtaagagggagggagggaggtgctatacacttttaaacaaccagatcttgtgagaacttactgtcacaaggacagcactaaggcgatggtgttaaaccattcataagacatccaccccatgatccagtcacctcccaccaggccccaccttcaacattagggattacatttcaacatgagatttgggtggggacacacaggcaaactatatcattctgcctcagtccctcccaaatctcatgtccttctcacattttaaaatacaatcaggccttcccgataatcccccaaaatcttaactaattccagcattaactcaaatgtccaaagtccaaagttccatctgagacaaggcaagtcccatgagtcaattaaacctcttttctttataaattacccagtaacaggtatttctttatggtaatgggaaaatggactaacgcagtgggtaagaaggagcccttggattcaatcattaggaaatcatatttgtgtccactgtattagtttgctaggcctgcataacaaagtaccaaaaactgggtggcttaaacagcagaaatttattgtgtcacggttttgaaggctagtaacgagtgatcaaagtgtcagcagggttggttcctcctaagggctgtgaggaaggctctgttccagccctttctcctagtttccaatagcctcaggcattctttggcttgtagattatattctccctgtgtcttcatatcatctattctgtacacatctgtctctatgtccaaatttcccctttttataaagaaaccagtcatattgtattagggcctacctcaatgatatcattttaacttgattatctctgtaaagaccctatttctaaatgaggtcacattctgtagtaccagaggctaggacttcaacacttctattttgagaggacacaattcatctcaaaatacccactgaatgagcactttcagctcagtagtatacatagaaggaagaccaaaaagggataaaggttgagatatgataaggtcatggaaattggctgggagtagggtgctagaagaggctggagaatgttttacaggtgaaaggcaccaggaaaaaaggagaacttcaagatctacagggagaggataattgacagagcacagtcctgaggggaatgagagcagtgaattatcagaaagaaggtaggatgccacttctttggaaacaaaagagaagggaaaagaagctttaaccaacttctatttgtgggaatttctggagctatcttcatcacctcagcccaagtctcattccagattctcgtgaggcctgcctcatatttcttcagtaacttgcagcgttagctttataactttattacagcttcatttgcagctttaaaattctcaggtactgtttaccacttgatacaaagtattacaggatctttctcatagttatttcgagaaaaatgtcagtgggctcaagaatatagcacaacacagaagacaagcaattgaacaaatgaacacacacatataaagagaaggagacaatgtcacacagaacaatcaggtcttgtcactacttaaaccagaccgtagctcattgctctgtgcagctgaggttaagcatgcctgaggcaaaggcctgcaggcacagacagagagaaagcactgaacaagggtgtcaacaaagcatatgcctgagccaagacatgtgacagagaggagccctccatttgcagctgttcacactccaataatgggacactcagaaaacaactacaaaatccctcatcctcatttcctgctagggtaagcaacatttaagtgtggacctaaaaaccttatcatagaatgaacagtttgaataaaaagcatgccatattgcctagagtttcaatatttcaacccagttgtcaaaatctggagcttcttggcaagaggcaagtcctacagacagatgtgaaatagacacttttggaaatggacattttggatatgatgaccctattagccaccagagctccagtgattctggcagggctttttggagttggccctggtgctgctgatctggggagttcatatagcatacctcctgctatcacatcatattcattttggcaaattaaaagagcccattagagaaagttgaaatgctttcctcaggagcttttatcaaattagtgcaaggatacagaatatgaccctaaaacccactgagtgcccagcttgacttctaaccatgaacaacagtaggctcaagaatatagcacaacacaaaatacaagcatgatagcatcatcagtatttctctctcccatcacaatttctcttggactcatacacgtagtatacatttatggaaatagcttatatatagcttacctaaaagcatgcttcattctatataaaatgtgatatcttataagtgagcattcactccacacactttattctttcacaaatttgacagttctcttttgaaatgaaaagctctcataaaccagcaccctttgtgtatcttgtctgtgtgtgtgtgtgtgtgtgtgaatgtgtataacataaccaagagaatattttagtatataaagcaataaaggcctagatttcataaaccacatcccaaaaataaaatgaaaacttcaaaaaccctgacaggttcaaccattaagccctttctgtttaaggcattattcatagaaaatggtttttgaaattttatatcaaattataaatattattatgtagtccaactgttatactacctgttcataactcaaatattttgttttcaaagcagagtttacatgaagaaacaaagcccagaaacaaatcccatggactactaattcaatcagaccattcatggctttgctttctttcttccctcccttcatctccatttgggagctatgaggcaattaatgttgtctctatgcgctctggttaaccacagaagaactcaattcagaaagtccaactgttgctcactcatgtcaattaaaggactctatgcttaaatctgctccaggccatcttttagaaatgaacctttgtggccaaaattatcagatggggaaaggcactgaaaattaattagtgctgttcctaggtatcagcaaggatgttgcagtgccattgtgctttaggaaactcatctgggacttgaagctacactcagaatttgcactatctcacctattttctaaattgattcttacaaatgacagatactggcaggtcacttcatagagggtaaaagtcaaagagcagagaaccaaaaattgggctaaatcttcaattcacaatacacatggccttaaacttctgcttcagaagagatttgtacatcaaggttggctcttcacactagcagagatacggaatcagcctccaaattgtcactgctgacatgacatttaatggtggggaaaaacccaagtgtcctcttttgtgtgacttgttgaatgtcagaataaacgacgttaaatgttccaatgtttattctttcttgcttcacgctaacctttccatctttatcctaccacaccctgctcctcccccctcaaaatcagcaaagaactcaattggcctgtcatgatgatggaatgtaccaatgtcttaattataacacattgtcttggctagaacaaaaagtgtttccattacaatatttgctttgacacactgtcactgcccaatatctcttttccatgttgtagtcaacaaaattgtgaggggattatctctcaccaaattttaaaaataagtgaggaatctcctgacatacagtctactctgagatcccgccaacccagggatggggcaaagcctcatagagtgaacagactcttaagaaacaaaagttgttctcatttactctcaccgccaggcacacacttaagggttcttcaattacctcactggtctctcttttaagtgacctctgctagctcttccttatctccttgaactttaagtgttagagggcaccagggccttgtttttggacattttcccttctctatgctcactcccttggtgatctcatctgtgtcattgctttaatttccatctacatagacacaacttctaaatgtttgtgcgtgtgtggaaagggggatgtgatcttttgaggcccagatatatgcatcaaactgcctcctcaatatctccttttggatatcaataggtgcctcaaatttaacatatccaaaaccaaaaccctgactttacccccaaaacctgctcctcctcaatcttcctcatctaagttaatgataatctcatcctttttgctgttcaggtcaaatccttaagatgatcctaactcctgtctttctctcccactccacaccccatctgtaagaaaattctcttgacaatactttcagaatatatctagaacccggtcatttttcactccctctattgttgccaccctggtttaaccaccatcatctctcccctagattgctgcaaacagcctcctcactggtcagcctcggcccttgcccccttcagtctgttttcaaaacagcagcccgagtgatccccttaacacatctcagatcatatgacgtctctgtacaaatccttctaccggctccccatctctcccagaatataaactctactccttgtactggcctacaaggacctccatgatctggatttccatgtgctctctgaggttgtctcctaccacactctgcctctctcactcagctccaggcacccggcatttcaccaacctggctacatgtaggcccatatcagggtctttgcaattgctattctgcctctcccgaatgatctctccccagatagctgcatgcatcattcattcaactccttcaggtcttcgctcaaatggcaccttcccagtgagtccttccattgccacccaattcaaaatgctacactctcctatataccacatgtgtattacttgtcctactaccatcctttattttactcaatagcacttatcaccaacacactatgtgttgcatttcttgtttaattctgtctcccctgatacttgaatgtacagtctatgaggtcagggatttatgcctgtattgttctctgctctatccctagcccctacaatatacctagcacatggtgagtgctcaataaacatcattacaataaatgaattaaaatcccaaggcaactagtcaattcagaataaaactaaggaaaatctatcaaagtagttatgtattcaattaaatattcattccagccaattattcaattatttgagatatatattcaattatatacattatatatatatatgtgacacagagtgagagaaagaacttaaaccagttagcaattaagcaatagaagcagaaatgaaggtggaggggctgagcagaggtaactccagcccctggggcaccaccaaggcagccaaggtcaattttgtaggcctgaatgctttaaacagtaacttgcaaagtttatgacaaactattattgacaactcaactagccatccaaaaaaggcagattcatccagcctctaactaaaagctttttattttgttgcataaaatggctataatcaattatagatgtaaacaaaattactaagtataattattttttatctgatatttcatcatcaatagaaaaacagacaagtttcttcaggaaaaagataggtcctgtaacagggaaatgtggtttactaatgaattaatgatcacatttgtcctttctactttaaagcctggactttctcatcactcatttccttcacttgagtgaaaaagctatcttcgcaataatcttttttaagttgggaacttcaacttaacttgcatttttaatttttaccttttgatatttttttccaagacatattttaccatgataggatttctcagatgaaagcagagttcaaggtaggttactacacacaagtctaattaaatatttgagaaaatgggtcttttgaaccagcaagagttgaaaattttatttattcattttctttctaatatactaaaattgaaatgtgggggtttgagatgactgaataaatgctagcccaaacatcaactcagcttctaagatggcaaagctggataataacaaaagcactggctagaattcagagtcttggtttctgtacctgtaagactgatagtagctctcttccctgcctctctcaatggattgctgtgaaactcaaatacgaaaacaatgggaatgggctctgtcaatgataaaatgctgtccatgtataagccaaactacggggaagtagggggaacttgcttctacttatttcccaagctgggtgaacaaacagaattgttaaaatgtcaaaacatttggcccccatagaaaataaaatgttttaaaaagcaaaagaacattattgtgttgaatcaataaaaaattccttttatgtttcatctgctatgatgtgttatctttggagacaatatatgatgtttctcttttaaaaatgtcacagcattgaggataataatttctcttagaagatcctttttgaaaaatggccaaacataaatcttttaccctcaatttatgtcatagcaatcgataaccagggtggctggctgacttgtaattggctgtattctacccaaaatgtctcttgattctagaatgcagggttacagcaactacttttacaagaccctgagatacatattgaaaaccagctacctatataacactagtttctaatatgtcaaaaactttatcatctaacttgggtggaacagtgtcctctctcttcccttttatccacatagtcacattatgctgtacaattgtacatcattttttcccagtctcctttgctaatttgaagattcttacatgtggaggctactgagtgattattatcatactctccagttttaattcataaatggattaagaacaacttaacacatttctacagctgaaatgagtgtggttacttcacaagtcatccactgatgccaacttaaaccacaaaaccataaaatgaggagcctaagctttgtgctgttagttacaagacagagcttcagtaaacctatgtaaatagttcagtcagttgtgcctcagcctcccaactctgcagccttccctgatactttctcttgatccctgtattcagaggcaggcaaaaatgattggtaataggtgcaaattttagtctccaccctaatgtgacatgtaattaacagagataagatatttaaaaggttaggtaatatttattttattgagtacctaccaaatgaaaaggacttatagatactgtgtcacttattcattcattcatttattcataaataacttattaaatgttagacaacccaaaataagcaaagcagaaaacgttcctacattcgcgtagcttaaaattgagtgtgagagacagctatttaaacattatcatactacttctgcttccaagtagaatgtaataagtcacagtaaatagacacttctgctgtaataattacttaaatatgaataaattataaaaatggtatttagatgcctgagagagctttgataacaattaggactagatgaattaaatttccatagagtagacaaccattccaagccctgcaccacaaaaaaatataaaaggaatccttgagacagaaaaaaaaagataccagacaggaaaatggaaatgcaggaaggaatgaagaatagaggaatgaactaatatgtgggttaatatcaataaatattaacttcacaaagtaataaaaatactatcatatagaattcatattcaatgacaacaataacaaaaaagcaagataaaggtaaaaggagttttgaggttctaaggttttatattggttatggagatatggctaaataataattttcagtacagtgaaataattcacaaatgcatgctataatctctagagtagcccctaaatgtatagcacaaatatgtataactaacaaattattagaagaaaacacagaacagaacaatgtattttgtaatttatccaaaagacagtaagatgacagaagaaatataaaacagatgagccaagaaggaaatgaaagacaacgtggtacatataaactcagctatatcagtaattacaatgtatttaaaagaactaattactccaaataaaagactaagattacaaaaccagacaaaaaacaaccaaaaccaaaacacaactatgtacaatgataccaaaacaagacacaggtatcacaaaaaataagatgacagaccaacatattttatgaatttagatgccaaaattctcaatgaaataccactaaaacaaattcagcaacacataaaaagaactatgtaccatagccatagggaatctatcttaggaattctagctgatttggcatatgaaaatcaatcaatgtaatataccatataaatacaataaaggacaaaaatcacatgatcatctcaatagatgcagaaaagcatttgacacaatccaacactcattcatgatgaaaacactcaacacagtaggaatactaggaagttttctcaacctgaaaaatagcaatctatgaaaaacctacagccaacatcttactcattagtgaaaaaaaaaataatgttttctccctaacatcagaaggtagataaggatgtccactctcatcacttttactcaacattgtcctggagattctagcagggcaattacacaagaaaatgaaataaaattcatcaagttgtagaggaagaaataaaactgtctctcttcagagatgacacaatcttatacatatagaggaaatcacaagaaatctcctcaaaaatctattagaactaataagagagttcagcaaagttctagagtataagatcaatatacaacaatccatagtatttctatacattaccaatgcacattatgaaaatgaaattaagaaaattccatttacaatagcatgaaaaagaataaagcacttagaaactttttaaaggaatgcaatatttatatattgaaaactacaaaatattgttgaaagaaattattaaagaagacctaaataaatggaaagacatcttatatttatgggtttgaaaaattactattgttgagatggcgatactccccatattgatctacaaattcaatgcaatacctttcaaattcccacctggattttgtgcagaaattgacaaactaatcataaaatttatacagaaatgcaagagactcagaaaaaccaaaacaatctcaaaaaaagaagactcattctttcaaatttcaaaatttattacaaagctatggtaattaagacattgtgagtgacataaggatagacatacacctcaatggaatagaaataagagccaaatagcttggcagttcctcaaggtattaaatataaatttatcatataaccccagcaatcctactcctagatatatactcaaagacattgaaaacatatgttgacatgaaacctttacataagtgttcatggcagtattattcataatgaccaaaaagtggaaacaacccaaatgtccatcagttaatgaatggataagccacatatgttacagccatacatgggatggttttcaacataaaaaaatgaaggactgatatatactacaagatggatgaaccttacaaacattatgctaattaaagaagctaaacacaaaagaccacatttgtataattctatttatgtgaaatatccagaataggcaaatctctagtgacagaaagtaaattaatattttctggggtcttgggatgagggggaaattggatgagaataatggatatctttgggtgataatgaaaatgttctaaaattagatagtggttacaactttgagaataggccaaaaactattgaactgtccacttaaaagtatggaaattatatcttggctgagcatggtggctcacacctctaatcctagcactttgggagactgaggtgggcaaatcacctgaggttgggagtttgagaccacctggccaacatggtgaaacctgtctctactaaaaatacaaaaattagccagatgtggtggtgcacgcctgtaatcccagctactcgggaggccaaggcatgagaatcacttgaacccagaaggcggaggttgcagttggctgagatcgagccactgaactccagccttggtgacagagcaagactcttatctcaaacaacaaaaaataaaaataaaataaaatatagttaactttattattcttacaagagttaattttttaaaaaatatataagggcacagaaaagtccaaagtaaaaggataaaaaaattaagtaattcaaacattaaccaaaagaagcctgtcataactatactgatatcaggcaaagtaaattttaaggcaataagcattattatagataatagaacaacattttataataagtggtaaaaacttttcagtatcctcaaaatgataaggaagtcattatcttcaacaagaagatattattatcctaaaactatatacacagaataatatggcctcaaagtatataaagcaaaaaaccaacaaaactaaaagcagaaattgacaactctccaatcataaaggaatattaacacacttatcttcatagctgatagaacaggcagaaaaaaatcagtatacatataaaatttctgaagaacataattaacaaacttgatgtaatattcatttatagagcactgcatacaaacaagccacaatccacatttttcatgtcacagagagtatttatcaaaatcaattatatgaagaaaacctcaacaaattttaaaatattgaaatcattcagagtgtttttttaaccaaaatagaattaaaacaggaattaacaacagaaagataactaggaaaaacaactcaactgaatgaaagttatacagtacacacaaaacaactatcaccaatgggtcatgttagtttaagtataagttcaagtctttaagtctttgctattctcctttgagtctgttttgtaacaatgtggttcaggggtcagcctgagactttcacgatgtttacacacaggattaggagatctccttctacagcactctaccctctgggaattatccttcactctccagacatgcttacctgggtttcgttccctaattctcctagccaggaaggcagcaccatttctacttgagttttagctgcctttactgtcctgcctcactgaacaactgatgcctgctcttggatcaaagccacaaaaaacaaaaataccacaaaatgcccacgtccattatttcaagtttcagttctccttcacagtttgcccatctgtactttctcctcagtatcctcaggtagttatctttgtattttgcccagagtgaagagttaccagtgggagagttgatctattggggagttgatctattgatctataacaggagctagagggcctgctttgtgattttaatttacatttatctgatgacaatgaagcaagatgactatggctttctcattagaaaatataaaaatataagatagtggaatcgcatacctaaagtgatgaaagaaaaaaagttcatccagaattctatatctaataaaaatatccttcaggaatgacagtgaaatgcattttcagaaaaagaaaaactaagaaaacacattatggtattcttcagactaaagggaaataataatagagagaggctttgaatttttaatgaaaataatttaaaatgatttagttcttaaattctttaaaacaaacattgtttgaagaaaaagcatagcatttttttgtgaggttttcaatgtaggtagatgtaatacatatgataattataacataaaagatgacagtgggggttaaagggacctataggatttaaaagttcttacattttccatgaaatgatacaatattcattctaaacaaaccggtaaagtttagggagatatatatatatatatatatatccatatatatgtatatatccatatatatatatccatatatatgtatatatccatatatatccatatatatatccatatatatatcatatatatccatatatatatccatatatatatcatatatatccatatatatccatatatatccataaatatatacatatatatccatatatatccatatatacatccatatatatccatatatatacatatatatccatatatatccatatacaaccatatatatccatatatatccatatatatccatacatatagccgtgtatatatatccatatatatagccgtgtatatatatccatatatatagccgtgtatatatatccatatatatatccgtgtatgtatatccgtatatatatatccgtgtatgtatatccgtatatatatatccgtgtatgtatatccgtatatatatatccgtgtatgtatatccgtatatatatatccgtgtatgtatatccgtatatatatatccgtgtatgtatatccgtatatatatatccgtgtatgtatatccgtatatatatatccgtatatgtatatccatatatatccatatatatatccatatatatccatatatatatcgatatatatatatccatatatatatcgatatatatatatccatatatatatcatatatatatccatatatatatcatatatatatccatatatatatcatatatatatatccatatatatatcatatatatatccatatatatatcatatatatatatccatatatatccatatatatatatccatatatatatccaactagcaactagcaaatgcaactatatatatatatatatatatatatatatataatttgctagtacaaccactaaaaatagtgtgagggtagtgttaataggataaaacaaagattcaaagagactgatcaatttgcccaaggtcatgtcacagctaagtggctgagctaagatttgaacccagattatctaattctaaagcccatgctctgttcgtgactacaggctgcctcttcaaactttgagtgtaatcaaacccataatctttgagtttctatgcactaagtcgccgaaccataccttaatccaagaactgaaactccactatttgtctcataaatatcaaccagctgctgggcagactattggtcagcagatgtcctcttgatgccctgatacatgactttacatgtgagaaacagctcctaacattctagtcataaaatataaaatatcatatatatatacatgtatatatgtgtatatatgtgtacgtatatacgtatatatgtatacatatatacacatatatatgtatgtacacatatatatgtatatatgtgtacatatatacgtatatgtgtatatatgtgtacatatatacgtatatatgtacacatatatacatatatgtgtatgtatatgtatatatgtacacatatatacatatatgtgtatgtatatgtatatatacgtatatatgtatatatgtgtgtatatatatatatgctttcattagcatttcagaattgaaaactatgagcagctgagattaggagagctggctccaggctttaaggaaagtgtgggtaaaggaggctgtagactggtagaagagggtttagaggaaaattgatgggcaggtggaagaaaataaggcaaaattctaatcatatggcctaattggggcagttcacctcagccataatgaatacaggccctgggaataaaaggagatccaagccttccctgatggtagggatgagacgtcctaatatcctctctgcctcagagctggttggggtaagtacacaggttggatcctggagaaggcagagactgacagtcagagctttccctgaacagagagaatgttcagtagtttattgcacagaggaaaataatatggtctccctgcagagtttgatgtataggaatggaacaattctacgacctactattttgctcctataacataaactcatctctaaaaatcatctcaatcatttctaagacacccctccatcacttcttgtgcctgcttctcttggagaaatgcagaatgttttagagaatatcaacagagagaacgctgaagtctttctgtccccaggctagccaagtcccagagaaaagtagaagggatgagattaaattctgccagcaaatcccctagacatcattcttggcatgagcttctcttgcccagccctgcacaggctggttctttgggctttcatcttctgagtatactggcttgtcttgctaaccaggaggccatttgacagccataattatttcccaggtatattgcagcatgacggtttatttattttgtggatggctgagccaaatctgggaggataagtctaacaccatttcttcgtaatagctcagttgttccaataccattttcttctcaacctccaaaatacaggttactttatttatttcagtattctttgtgcatttaaccaccattctcattccacaggctttggtgaattaaagtaactacagttaccaactctttttattgaaaaactctttatgagttgattgtaactgcttctccaattataattgcttcctctccacaggcctcgctattcaagactctgagttaccttgatcatgaaacttcaatgtggaaatttcccaagaccatattctgaagtagcctttttaaccctgagagtgcttttgagagctgtgtccacattaaattctgaaccgtccttttatcccatattgcagccacagagatcagactggtggttgacagagatttaatcagagcatttaatactctcaaattcctgccagttgattgtgtcactttatttaaaaatgaacaaagcagttagaaaaaaaagttattatagtccttggaaattttcagtcacaaatcaaaactctctgtagtgggaactatggatggattcacataaatgatggtttagtgtatgggggatattatatctatggtgcaacatatgcgggaggcacaaaagaacctcagtaatctggtcatacaattacagaaaggaagcaggctggagttttaaaagcataggtttcggactcagacaaacctggatcacagttctgccatttcctagttgttactttgagcaagttacctcatgtctttgaggcttaatcagttcatctataatgtgggaaaagcaaaaataccaaatttacaatgttgtaaggatgaagacagtaaggacgcaaataacttgagaataggctctggcagatgaccaaagaagctctgctgatcagaaatattttgattattcccagactctgctgtcagttaatcacacatcctctattccagtcaacctctgctacttgaaaggcaggatattggtggtggtggtggtgacagtgacagcagttaccctttgttgatctctttctatatactgctctgctaagtaccttacatgcactgttttacttaatttcacttaatcctgacaaccactctatgtggtaagtgccaacatagtagctaaccacaagggttttgcaatcagaaagatctgggtttgaagtgtggctcccctactcagtagctgggtgactttggacaagccatagaacctatttcagtaaacagagtatcaatttccccatctgtagcaaaaatatacttcttatttcataggctgttgtgagaatttaaggggatagtataaataaaattcctggcacgtaagaggtgttcaatgttagactacttccttctctccctgtaagttagtacaaaaagggcaaatgaatgagtttatatgttaccttatcatgctttaaatctaaacatttcaccaaaattcataggaagaaatatagtaaagaaataaactgaaaaatcaagccatcttggaagaaagctgaaaggatatttttatcttagctttttccaatattactcctaaaaacagtgctatttttatttgaatgtagtgttatttctcagttttatttacttgacagctgcttcgatagttcttcactggggtcatgtttactgaaagaaagcatattgtgatatttgaataagccattttagaggctccattttgaccaaatataaacaatatagatgtcaggcaagcagagtcagaaatcaatctagcagcaaactccatcttaatggcaacacacatcaattgtcaattcccagaaacactctaactgccctcttaccagcaagagacagggctccactctgtgcagaactttcacaagctgcccctactacaacacgcaacgtgctcagtgttcataacttcccaccctcactcactctgtacctttttcctcactctgatttctttcatccactgaccatcaaccatttcatctctaaatcactcccttagctggacagataatctagtccatccagacatattactttggcttcctcctgctcaaatggttctatcatctccccacctagcccatgctggtaacacagattaaactcttcttaaattgacctggctccatagaagacttcggcccacacactgtcactgccagcagcttcctaaacctgttctaccacagccttgtatacagccctgcattgacaggtgtgagtaagagggatcagcaacccaacagtcatccctgacaaaagcctgaacttgaaggcaaatgggattttcatggaacaaacctttcttctagggtccctctggtacgggagggtggcagggaaatgctgggaaaagaaaggtggggtccttgctagggctccacctctgggcctgtgcccatgggcctaggtgaggacaggcatttctgtttttgtgcccaaatgttgcatttcccaagaccaccctggcctgccacgcccccatcctgtgcctataaaaatcctgagaccctagtgggcagagacacaagcagatggacattgagaggaacacaccggcagaagaacacaccagcagacaacagcaggccaccaaccagctggggcggtaggaggagagcttccaccattcaataaaaccttgcactcattctccaagcccacgtgtgatccgatttttccagtacaccaaggcaagaacccggtatacagaaagtcctctgtcattgcgataaggcagagggtctaattgagctgataaacacaagctacctataaacggcaaaactgaaagagcatactgtaacacacgcccactggggcttcaggagctgtgaacattcacccctagacactgccgtgaggtcacagtctcacaacctgccggtctgcatgcttcccctaaaggcttgagtagcagggcactaaagaagcaagccactccccctgtcaaccaccctgcgagagggacaagggagctttttccttttcacctctctctgtttttcatcccacttcttgcattatcccagtggtagtttcttttaagatcaatctccactattgccctaaattaatgttccctccataagtcttctttatcagtacctagctattcggattggcactcccattagccaaggcaagtgactgcaacaaaggaaacatctttctgagttgctaccgagcacaccagtattttcatcagattcagctgaatggcacaacatccacctttccacttaggaaacatgtgttggaggctatgggcacaattacagtgtacactttgagacttttgtagcaatcaaacaagttatttatactcctccttgttaccaaaaaaaaatgtaaggtagcttactgtaaataatgtgtacacatgaacatacagtgtggaatgagagacaatggagactccatctaatgggttgggagcgggaagggaagtgatgatgagaaattacctaatgggtacaatgtgcattatttgggtgatggatacgataaaagccctgactacactactatgcaatatatctatgtaacaaaattattcttgtaccccataaatttatacaaattttttaaaattgtaaaagaaaaaacaatatgtcaggaaatcaggggaaggtgaaaataatggtagaaaggttcaaacagggacaggagaaaggttagtacttaaaatgtctactggaagtccaaaacattggctaattggtgagctacaaatctggccagtgtgaagaaggaaaagcagttacatgatttacaacgcctataggaaataagccaaacaagagaagcatgggtattcgtgggtaccaagacaagacatcacattacattatctacaacaacatagttcatagggctatttcctctatgatccctcctataggccattggcttcgaggcaaagcacagtccagcttctacagtgagccagagttacgggatttagataagcagctctccaaaggtctggcttaatttagagagaggttttagaatttttgtaggaatggatggataacaacatttgggtgatcctccctaaatatggtgcccacaactgagttttggattttagcatcaggaggtccttgaaaatgttgcttgacaagtcactaaaatggagctcctttagactaccagtgaagaacagaatcatgtcatttagcagtgagtctagctgtagtgaatcaaatactcatgtcagtcatttaaaaaatacaaaataatcataaaatgtctaacataaaacaacataatttcctggtacacatttttaaataaatcacaagtgtaatttataaaataaatcctaaggtcgcctccatgatgccctctttctggtatccacactcttatataacgccttccctctgaatgtgggtaggacctgtgacttgcttctgactgacacatatggcaaaagtgatcttactctggtgatcaggttacattgtataccacttcattttgttagcagtctgtttttacagacgccttgctggttcgataaagttaagtgaccatattggggaagtccacatggtaagaaactatggatgatttctaaaaactgtgggcagcctcttggaactgaagacagcctccagccaacagtcagcacaaacctagggcccactgtactcttaaccccaagagaatgaattctgacaaccacctaattgagctgggaaggagattcttcttcatttgagtattcaaattattatacaccctgactggtaccatgagtgtagccttataagaccccaagcagaggacccagttaagccacgcctatattactgatcacaaaaactgtgaagtaataaatatgtgttgttttaagccactatgtttgtaataatttgttgtacagaaataagtacccaatatggccaggcactgtggctcatgcctgtaatcccagcattttgggaggccgaagcaggtggatcacttcaggtcaagagtttgagaccagcctggccaacatagcaaaaccccgtctctactaaaactacaaaaattagctggacttggtggcatgcacctgtaatcccagctactcaggaggctgaggtgggagaatcgctttaacctgggaggcagatgttgcagtgagccgagattgtaccactgcactccagcctaggagacagagtaagactccatctcaaaaaaaaaaaaaaaaaaagaaaaagaaaagaaagaagtacccaatacaagatagatttgttctaaaatgtgtgccaaaatagagatatagaccaatggaacagaacagagccctcagaaataatgccacacatctacaactatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaaaacttaaatgttagacctaaaaccataaaaaccctagaagaaaacctaggcaatagcattcaggacataggcatgggcaaggacttcatgtcaaaaacaccaaaagcaatggcaacaaaagccaaaattgacaaatgggatctaattaaactaaagagtttctgcacagcaaaagaaactaccatcagagtgaacaggcaacctaaagaatgagagaaaatttttgcaatctacccatctgacaaagggctaatatctagaatctacaaagaactcaaagaaatttacaagaaaaaaacaaacaaccccatcaacaagttggcgaaggatatgaacagactcttctcaaaagaagacatttatgcagccaaaaaacacatgaaaaaatgctcatcatcactggccatcagagaaatgcaaatcaaaaccacaatgagataccatctcacacaagttagaatggcgatcattaaaaagtcaggaaacaacaggtgctggagaggatgtggagaaataggaacacttttacactgttggtgggactgtaaactggttcaaccattgtggaagacagtgtggcaattcctgagggatctagaactagaaataccatttgatccagccatcccattactgggtatatacccaaaggattataaatcatgctgctataaagacacatgcacacgtatgtttattgcggcactattcacaatagcgaagacttggaaccaagccaaatgtccaccaatgataggctgaattaagaaaatgtggcacatatacaccatggaatactatgcagccataaaaaatgatgagtccatgtcctttgtagggacatggatgaagctggaaaccatcattctcagcacactatcgcaaggacaaaaaaccaaacaccgcatgttctcactcataggtgggaattgagcaatgagaacacttggacacaggaaggggaacatcacacactggggcctgttgtggggtggggggagaggggagggatagcatcaggagatatacctaatgtaaatgacgagttaatgggtgcagcacaccaacatggcacatgtgtacatatgtaacaaacctgcacgttgtgcacatgtaccctaaaacttaaagtataataaaaaataaaataaaataaatttacaactgtagacatatttgtctacagtaaatataagactaaacaatcagatactaaatcattaaatgattatcagttagtatctttaattttcttatacttctatattttctatagatcatctttgtaacaaaaagaaaataaaccaaatgaaaatgaaatgaattctctcaaaaagaattaagacaggaagaagtctcacaaagtaatgtaaaatgtatcttatggtttatgtaaaattcttaataaaagtaccttcttttctccaaaaaaaatagtccattggttaactataagccaattaaatggtatggcccacttaccaaaaaataaatctttggtttgagaatagaacacagaaaatctctccagatacaaacagatagcagggctagttgattattaaaatctcttctggtttctgccaatacaaccatttcatctactttggctgtgtccttggctgtgtgcaaagcaccattactgggcttcaagagagcaagaactggaattaaagcctagatcacatgacctcaaaaagcttacaagctgctcagggacaccaaacatatatatgtgaaacaacttacaacaaacaccaaataacctatcaattttattcacacaaactaacgaagatgcagggaatccaattagacatatgataggcatttttaaatgcatttacattcagctttaggtgtataggtgttttgggtgcttatatttgatcgtggatatgcctgctgttctgagattttacctcaaaataaacagaaacgttgtgcgcattatcccccattcttccattgaaaaggagcaggctggttctttcatatcaattgatgcaaggtttgtcttttctctcccctgccctgaaccaaaggagatacgttgagggggaaacagaggttcagtgaacttttctacttcctcagtgccactactatatctgagtacattagctctagctgttttattcttaatttttaaaagttaaatactcactacaaaaaaaaaattataaacaggaaaaaaagaaatgctaaaaacctgtaacccagcctcagaggaaaaaaaacactgaaaattttgggttaacttactataagtgtacatgtatgtattaaaattaacccatacacacacacacacacacacggtgaatataattatattaacatgctgattttttccctcacttagcaattgtgagcatcttttcgtatcaaatattctttcctattactgcaatttaaatccaatttaaattgcatattttaagcttccttgaaaataaagcagatgttccagtttagaatcattgtaaaccatattatttttcaggtctagttcatttatttgtatacattgattgaaaccataattcgcatgccatgctattcaccaatttaaagtgtacaatttaatgatttttagcacattcacaaaactgtggaaacattactacaatattttaaatattttgatcaccaccaaaagaaactctatatccattagcagtaacccctcatttcccccaaccttcccacaaagccctcaataaccactagtccactattttgtctctatagatttgcctcttctgacacttcacatgaatgggatcatacactatgagcctcttgtgactggcttctgtgagttagcataatgttgtcaaggttcattcatgttgtagcacgtataaatccttcattcctgtttatggctgaataatattccattgtatggatataccaaattctgcttatctatgcatttgttgacagacacttgaattgtttacactttttggctattagcaataatgctgttatgaacattcatgtacaggtttttgtgtagacctgttttttgtttttttttgtttttttttttttgagacggagtcttgctctgtcacccaggctggagtgcagtggcgcaatcttggctcactgcaagctctgcctcccgggttcacgccattctcctgcctcagcctcccaagtagctgggactacaggcgtctgccacagcacccggctaattttttgtatttttagtagagacggggtttcaccatggtctcaatctcctgacctcgtgatccgcctgcctcggcctcccaaagtgctgggattacaggtgtgagccaccgcgtccagccctgtgtagatatgttttcatttcttctgagtatatacctaagagtgtaattcctgggtcacaaggtaactctgtgtttaacattttaatgaatcatcaaaatgttttccacagtaactataccgttttactttgccaagagcagtgtagaagggttccactttctccacatccttgcctaatatttttcatcttgttgattatagtcatcctagtaatccattttgcatatagtatgagttagggattcaacttcattcttttgcatgtagaaatctgattgtcccagtactgaaggctattattttccccctttgaattatcttgatacccttgtcaaaatcaatgaccataaatgtgagagtttatttatagactccattttgttacactgatccatatgataggctgaatattggcccctcaattatgtctacttccaagttcccagaaattatgaatatgttaccttatatggcaaaagagactttgcaaatgtgggtaagaatcttaagatggggagatattccataattatccaataggcccaatgaaattataagaattcctataacagagaggcaataagatcatactcagtaggagatttaacgatggaagtaagagtttggagtaatgcaaggaaggggccatgagttggaaatactggcagtcgctagaaaccaaaaaatgtgaggaaatggaatgtctactctgttctttcagaagaaactagccctggcaacaccttgactttagtccactgaaattgattttgaacttctgacctccagaagaagaaaataataaatgtgttattttaagccaccaaatttgtggtgctttgttaccacagcaacaggaaactaatataatctacatgtctagccttataccaatactatactctcttgattatactagcattgctgtaagttttgatgtcggaaaacataagtcctccaacttcattcttcttaagtattgttttggctattctggcaaaccatagcatgttaatggatttatattctattgtttgttaccataatttatttgaataattcttattgttggatatttgggttgttttgaaatattttgctattataatgactgcaataaatatcctccaagatattttctgtacttttataattattgccttgatgtttatgtcaaaaggagtatatttttgaagcttttggtatggcctcaatgatctccagaactgtatactccaaccaacagtatatgagagtgctcattttcctacactctcatcaaccctgttatcaaattatagacaaattttacattaaattatacatttagatgtgaaagataaagctataaagttagtataaaattttaagagaatatctttatgacctagaagcagtgaagtacttcttaaataaaactttaaagacacagactataaaagcaaaaactaatgaatttaataaattccaattgagagtttctattcaacaaagtataagaaaaacacagacaaagttaattgacatgtgacagattaggaaacattatttgtaatgtctaaaactgacaatgaattaacatctggaaaactcaagaaaagccttcaaattaacagccctggtagaaaattaggcaaagcctgtgagctgacaatttacaaaaagagaaacccaaaattctgaaaagcctatcaagatgtattctaaaatgcaataaggggatatcatttaaaacagattgcactttacttatgttaaactagcaaaacttataaaggaggataatgcaaataattgacaagaattacagtacagaaatctatatgcactactggtgggagtgtagattggtgcagccaatctggagacaaattggtggtgtctagacaaatcagagatatgaataccccaacatcatggtattatgttcctgtacataaatcccaagtaagttatcacaccactccataagggtactgataagaaggcattatttgtggaaacaaggtgttttaggcaacctggatgtcatttactggcaaagtagttaggaaaaaaatgtggtatctgcacaccaggcagcagttaggagcactagactggatatgtctaaggcaataaaaatatatcttaaaattatggcactgattttaaaacttaagaaaaacaatgagatatataataccatcccattcttataaattaaaatatatgccagctaaacagagtggagagttcagaaagaaatccacatgtacagagccaattgatttttgagaaaagtggcaaggtaatactaggatcaaaagacagacttatcaattaataattctgggaaaattccaaatccatataaaattaaaaacctcaactattacctcatttcatatacaaaaattatccaagatatatgatagtctaaaacataaatgctaaaactataaagcttttataaacttgattaatgttctaaaagtggtatgtgttggccctctcagaggcatggacaattcaaaaacatttcagaaagaaagctatgcttagcacaacttaaacactaatgatggagtaatagttttctattgctgtgttctgtaagttagaagtataagctggctcaagtgagagctcagcttaagatctcacaaggttgaagtcaagatgtaagcctactgggctcctgcctggaggccctagaaaataatccacttttaggctcattaagattgttggccgaattaaatttcctgctagctgttagccaggggtagctctgagctcccagagaccaatcttcagtcctttcacgtggccccctccatcttcaaagtcacaaatgctttaccaaatccttcaggtactttgcgtgtctctgacttctctttctgctatcagctgtagaaagctctctgcatctaaagaacacacctgattgtgtcggcccacatagatattctctatatcataacatcaactaacttggaactttaattatcaaactaacaccaaaaggatctgataattaaattggaattatggcccagaaaattaggccaggacctgtgtgttaaccctaaaaagggttactgcccgctaaataggatccagagtctgctaacacactttacaaaatgtccagaatacacataacaaccacctttcatatcaagacgcaggaaaatcacaattgtaataaacagagatagtcaaggagagtcaactttgaaatatcagatgtccaaatgatctgcaaggatattaaagcagccatcataaaaatgtttcaataatcaattacaaattatctcaaaaattaaaaagctggaaacctcagcaaaatgtagaagttgtttttttaaaggaagaaaatggaaattataaaactgtaaaaacaatagccaaatttggaaaaaatctctggatgggctcaatattatagtgtagctaagcaaggatacaatcaacgaacttaaagagagttctgtacaaatctgcttaagtgttgggggaaaggcttatggggtgcctgtataaactggccataaaaatatgggacaataagttgtggaaagccacaagaggcctctgaggaggaaagcctcctaattgccatcatgtttccatggtcagagtgagacccactctcttatctgtaaacactgtgttcaaggagaaagacactcctttaaagcattggaatgtggacaaatatgcaggctcctagttaagcccgctcccaccagctactctctgataagttaaagatatactgtttgaacacaaagaagattcacttaaaccaccactgctataaattacgcatatgacacactgcctccctttcactgttttgccctgaacatctgcttcttaaatctaagtaattgtactgaataaataatgtggagaccagagctctgagccttttgcagactccattttacaattggccccctggcccccactcttaacctgtctcttctcattccttcatcgccactggactttgggtaccctatgggtggtgttgaggctggtcccaacacttaagaacagagaaaaagataataaagactaataaaagtgaaagagactaaagaacccgtaagacaataaaatagatgcaacatttatatcatcagtgtcccagagggagaagaaaaagaaactagtggcaaagaaattatgctgaaatttttcagttttggcaaaagacacaaacttaaagattcaaaaagtttaataaaccccaagtagtataaacacaaataaatgcataccaaaacacataataagtatgcttctgaaaagtcaaaaaaaaaatcttgaaagcactcagtggaaaatgacacattacctatttgaatttgaatgagtatcaatttctgatctgaaatcatggaggtctgagggaagtggcacatttttcaagtactgaagaagaaagaaggaactatcgaccacaaattatatgttcggtgaaaccaatctttaggagtgaaagggaaatgaaacattttcagacaaagaataatgaaaataatttgttgccaacagacttatctttaatgagtggctttaaaaattcttcaaaaagagggaaataataaaagaaaaaatcttggagcattggataggaagatggaacgagcagaggtataaatataaatggtctaaatgtaccaatcaaaagacagaaattgacagagacattaaaaaaatatgactcagccatatgggtggcacatgtctacagttccagctactcaggaggctgaggcagagtggtcacttgagcccaggagtttgagactagcctgggcaacaaagcaagtctctacctccaaaataaataaataaataaataattttaaatgaacataagtgggatgaaagcaaaaggatagaaagagaaaaatatatatcatgcaatcattgatagtaaaacaagcaaaacacagaagtagctatattaatatcaaataaagtcaacataagagcaaagaaaattactaaaaacaaagagggacataacaaacataaaaggatcaatctaccagggaattataatgaccctaaatgggtacacactaaataacagcgtttcaaaatacatgaagctaaatctgatagcgctgaaagaataaataggcaaatccaaaattataggtgggaacttcaacactgccctgtcagcaactgatagaaatactagatataatattagcaatacagaagatatgaataacacaatcaacctacaggatagaatcggtatatatacaatgctcccccacccgccccccaacagcagaatacacttttttttcaagagccacataagattcacaaatacagaccatatcctgggccataaaagaaacttcaacataagaaaagaactgaaattatagtgtgttctctgacaataatggaatcaaactagaaatcaatattggaaggatgaaatgaaaatatctaaacacatgaaacttaaactaacttttaaataagccatgggtttaaaaggaagcctcaaaggaaattaaagaaaacattgaactgaataaaaatgagaatagaacatgtcaattttgtgaaatgaagctaaagcaatactgagaaagaaatttagagcagttaatgctcacattagaatgacagaagggagggagggagaaaagggttgaaaaactattgagtactatgttcactaattgggtgatgagctcaatagaagcccaaaccccagcattacataatataccaatgtaacaaacctgcacatgtacccccgaacctaaaatttttttaatgctcattgtatttttaaatacctcattaattacttgtgaaggacattggcaaaacacactatgaaaatggagagttataggacaatcaggaaatcacaaccaaatgaacattgattggatatttgatggtattttggaatcattttcaatttttttacaatttcaacttttatttcagattcagggggtacatatgcagatttgttacacaggtatattatgtgatactgaggtttggaatgcaaatgatcccaccacccaggtagtgagcatagtacccaacaggtggtttttcaacccttacccccttactcaccctctagtagttctcattacccattattgccatctttgtccatgagtacccaatgtttagctcccacttataagtgagaacatgtggtgtttggttttctttttctgcgtttgttcacttagaataatggccttcagctatatccatgttgttgcaaagaacatgatttcattctttttatggctgcgtagtattccatggtgtatatgtactacattttctttattcgatccactgttgatagacacttaggttgatttcatatctttgctactgtaaataatgctgcaatgaacatgcaagtgcatgtgtctttttggtagaaagatttatttcttttggatatatatccagtatcaggattgctgggtcaaatggtagttctgagttccttgagaaatctccacactgctttccacagtggctgaaccaactcacattcccaccaacagtatataagtgtctccttttctctgtagcctcgccagtatgtgttggtttttgactttttaataatggtcactctgactggtgtgagatggtatctcattgtgggtttgatttgcatttctttgatgattaatgatgttgagcattttttcatacgtttgtcagctgctaatatgtcttcttttgagaagtgtctgtccatgccttttgcccactttttaatagggttatttggtttttgcttgttgagttgtttaagtttcttatagattctggataaaccttacttggatgcatagtctgtgaatattttctcccattctgtagattgtctgtttactctgttgatagtttccttttgctgtgaagaagtggattgctcctgcaggaccttgggagacagcattaaacaaccaaaactaaggaccctcatagagaccatttcactctcctgcctcctccacgagagcaggtgctggtatccatggctgagagacctgaagacaattcacatcaaaggactctgtgcagacaatccccagacccagaccaaagtctggtagccctgctgggtagctagatccagaagagaaataacaatcgctacagttcagctatcaggaagccacatcccaggcaaaagggggagagtactacatcaagggaacagtccatgggacaaaagaatctgaacagcagccttgagccccagatcttccctctgacatagcctacccaaatgagaagaaaccagaaaaacaattctggaaatatgacaaaatgaagttctttaacaaccccaagtaatcacactagctcaccaacagatccaatggatccaaaccaagaagaaatccctgatttacctgaaaaagaattcagaatgttgattattaagctaataaagaaggcaccagagaaatgagaaaaaggcacaaacaatttaaggaaattaataaatgatacaaggtatgaggggagaaatcgtcagtgaaatagatagcataaataaaaaacaatcacaacttcaggaaataaagaacacacttagacaaatgcaaaatgtactacaaaatctcagcaatagaattgaacaagcagaagaaagaacttcagagttcaaagacaaggttttcaaattaacttaatccaacaaagacaaagaaaaaagaccaaaaaaactgaacaaagcctccaagaagtttgggattatgttaaacaaccaaacctaagaataattggtattcctaaagaaaataagagaagtctaaagtttggaaaacatatttgggagaataatcaaagagaaacttccctggccttgctagagacctagacatccaaatacaagaagctcaaaaaacacctgggaaattcattgctgaaaggtcattgcttaggcacactgtcatcaggttatctaacgtcaagatgaaggaaagaatcttaagacctgtgaggcaaaagcaccaggtaacttataaaggaaaatctatcaggttaacaacagatttctcagcagaaaccctacaagctagaagggattatggccctatcttcagcctccttaaacaaaacaataatcagtgaagagttttgtatccagcaaaactaagcttcattaatgaaggaaagatttagtctatttcagacaaacaaatgctaagagaatttgccactacaaagtcagcactacaagacctgctaaaaggagctctcaatcttgaaacaaatcctggaaacataaagaaaaccagaacctctttaaagcataaatcttacaggacctacaaagcaaaaatacagaaaaaaaacaaggtacacaggcaacaaatagcacaatgaatagaatagtatctcatatctcaatacaagccttgaatataaatggcctaaatgctccacttaaaagatacagaatttcagaatggatgagaattcaccaaccatatatatcctgccttcaagagactcgcctaacacataaggactcacataaacttaaggtaaaggggtgaaaaaagacattccaggcaaatggacaccagaaacgagcaggagtagctattcttatattagacaaaacaaactttaaaggaacagcaataaaaaaagaaaaagagaggcattatataatgataaaacgccttgtccaacatgaaaatatcgcaattctaggccaggcacggtggctcacgcctgtaatcccaacattttgggaggctgaggcaggcagatcatgaggtcaggagatggagaccatcctggctaacatggtgaaaccccatctctactaaaaatacaaaaaattagctgggcttggtggtgggtgcctgtagtcccagctaattgggaggctgaggcaggagaatggcgtgaacctgggaggcggagcttgcagtgagctaagatcgtgtcactgcactccagcctgggtgacagtgtgagactccatctcaaaaaaaaaaaaaaaaaatatatatatatatatatatatatatatatatatatatatatatatatcacaattctaaatatatatgcacctaacactggagctcccaaatttataaaacaattactactagacctaagaaatgagataaatagcaacacaataatagtgaggtacttcaatactccactgagagcactagacaggtcatcaagacagaaagtcaacaaagaaacaatggatttaaagtacaccctggagggggtggagccaagatggctgaataggaacagctccagtctacagctcccagcgtgagtgacgcagaagatgggtgatgtctgcatttccaactgaggtaccgggatcatctcaatggggagtgttggacagtgggtgcagaagagtgggtgcagcacaccgagcatgagtcgaagcagggcgagacatcacctcacccaggaagcgcaagggataagggaattccctttcctagtgaaagaaaggggtgacagacggcacctggaaaatcgggtcactcccaccctaatactgcgcttttccaatggtcttagcaaatggcacaccaggaaattatatcccacgcctggctcagagggccctacacccacggagcctcgctcattgctagcacagcagtctgagatcaaactgcaaggtggcagtgaggctgggggaggggcttccaccattgctgaggcttgaggaggtaaacaaagcagccaggaagctcaatctgggtggaacccagatcaaggaggcctgcctgcctctgtagactccacctctgggggcagggcgtagccaaacaaaagtcagcagaaacctctgaagacttaaatgtccctgtctgacagctttgaagagagtagtggttctcccagcatgcagcttgagatctgagaatggacagactgcctcctcaagtgggtcactgacccccgagtagcctaactgggaggcaccccccagtaggggcagactgacacctcacacgaccgggtactcctctgagacaaaacttccagaggaatgatcaggcagcaacatttgctgttcacaaatatccgctgttctgcagcctctgctgctgacacccaggcaaacagagtctggagtggacctccagcaaactccaacaaacctgcagctgagtgtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagcacctctcctcctccaaaggaatgcagctcctcaccagcaatgaaacaaagctggacggagaatgactttgacgagttgagagaacaaggcttcagatgatcaaactactccgagctaaaggaggaagttcgaacccatggcaaagaagttaaaaacattgaaaaaaaattagatgaatggctacctagaataaccaatgcagagaagtccttaaaagacctgatggagctgaaaaccatggcacgagaactatgtgatgaatgcataagcctcaataaccgattcgatcaactggaagaaagggtatcagtgatggaagatcaaatgaatgaaatgaagtgagaagagaagtttagagaaaaaagaataaaaagaaaggaacaaagcctccaagaaatatgggactacgtgaaaagaccaaatctacgtctgattggtgtacctgaaagtgacggggagaatggaaccaagatagaaaacactctgcaggatattatccaggagaacttccccaatctagcaaggcaggccaacattcaaattcaggaaatacagagaacaccacaaagatactcctcgaaaagagcaactccaagacacataattgtcagattcaccaaagttgaaatgaagggaaaaaatgttaagggcagacagagagaaaggttgggttacccacaaagggaagcacatcagaataacagctgatctctcggcagaaactctacaagccagaagagagtggaggccaatattcaacattcttaaagaaaagaattttcaacccagaatttcatatccagccaaactaagcttcataagtgaaggagaaataaaatactttatagacaagcaaatgctgagagattttgtcaaaaccaggcctgtcctaaaagagctcctgaaggaagcactaaacatggaaaggaacaactggtaccagccactgcaaaaacatgccaaattgtaaagaccatcgaggctgggaagaaactgcatcaactaatgagcaaaataaccagctaacatcataatgacaggatcaaattcacacataacaatattaaccttaaatgtaaatgggctaaatgctccaattaaaagacacagactggcaaattggataaagagtcaagacccatcagtgtgctgtattcaggaaactcatctcacatgcagagacacacataggctcaaaataaagggatggaggaagatctaccaagcaaatggaaaacaaaaaggcagggtttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagacttagactcccacacaataataatgggagactttaacaccatactgtcaacattagacagatcaacgagacagaaagttaacaaggatatccaggaattgaactcagttctgcaccaagcggacctaatagacatctacagaactctccaccccaaatcaacagaatatacattcttctcagcactacaccacacctattccaaaattgatcacatagttgaaagtaaagcactcctcagcaaatgtaaaagaacagaaattataacaaactatctctcagaccacagtgcaatcaaactagaactcaggattaagaaactcactcaaaaccactcgactacatggaaactgaacaacctgctcctgaatgactactgggtacataacgaaatgaaggcagaaataaagatgttctttgaaaccaacaagaacaaagacgcaacataccagaatctctgggacacattcaaagcagtgtgtagagggaaatttatagcactaaatgcccacaagagaaagcaggacggatctaaaatggataccctaacatcacaattaaaagaactagagaagcaagagcaaacacattcaaaagctagcagaaggcaagaaataactaagatcagagcagaactgaaggaaatagagacacaaaaaacctttcaaaaaatcaatgaacccaggagctggttttttgaaaagatcaacaaaaccgatagaccactagcaagactaataaagaagaaaagagagaagaatcaaatagatgcaataaaaaatgataaaggggatatcaccaccgatcccgcagaaatacaaactaccatcagagaatactataaacacctctatacaaataaactagaaaacctagaagaaatggataaattcctcgacacatacaccctcccaagactaaaccaggaagaagttgaatctctgaatagaccaataacaggagctgaaattgaggcaataattaatagcttactgaccaaaaaaagtccaggaccagatggattcacagccaaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaattttagaccaatatccctgatgaacatcaatgcaaaaatcctcaataaaatactggcaaaccaaatccagcagcacatcaaaaagcttgtccaccataatcaagtgggcttcatccctgggatgcaaggctggttcaacatatgcaaatcaataaatgtaatccagcatatatacagaaccaaagacaaaaaccacatgattacctcaatagatgcagaaaaggcctttgacaaaattcaacaaccttcatgctaaaaactctcaataaattaggtattgatgggatgtatctcaaaatcataagagctatctatgacaaacccacagccaatatcatactgaatgggcaagaactggaagcattccctttgaaaactggcacaagacagggatgccctctctcaccactcctattcaacatagtgttggaagttctggtcagggcaatcgggaaggaaaaggaaataaagggtattcaattaggaaaagaggaagtcaaattgtccctgtttgcagatgacatgattgtatatctagaaaaccccattgtctcattccaaaatctccttaagctgataggcaacttcagcaaagtctcaggatacaaaatcaatgtgcaaaaatcacaggcattcttatacaccaatagcagacaaacagacagccaaatcatgagtgaactcccattcacaattgcttcaaagagaataaaatacctaggaatcctacttacaagggatgtgaaggacctcttcaaggagaactacaaaccactgctcaatgaaataaaagaggatacaaacaaatggaagaacattacatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatacagaccaatggaacagaacagagccctcagaaataatgccacatatctacaactatctgatctttgaaaaacctgacaaaaacaagaaatggggaaaggattccctatttaataaatggtgctgggaaaactggctagccatatgtagaaagctgaaactggatcccttccttataccttatacaaaaattaattcaagatggattaaagacttcaatgttagacctaaaaccataaaaaccctagaagaaaacctaggcaataccattcaggacataggcatgggcaaggacttcatgtctaaaacaccaaaagcaatggcaacaaaagccaaaattgacaaatgggatcaaatgaaactaaagagcttctgcacagcaaaagaaactaccatcagagtgaacaggcaacctaaagaatgggagaaaaattttgcaatctactcatctgtccaagggctaatacctagaatctaaaatgaactcaaacaaatttacagaaaaaaacaaacaaccccatcaacaagtgggtgaaggatatgaacagacacttctcaaaagaagacatttatgcagccaacagacacatgaaaaaatgctcagcatcaccggccatcagagaaatgcaaatcaaaaccacaatgagataccatctcacacaagttagaatggcgatcatcaaaaactcaggaagcaacaggtgctggagaggatgtggagaaataggaacactttgacactgttggtgggactgtaaactagttcaaccattgtggaagtcagtgtggcgattcctcagggatctagacctagaaataccatctgacccagccatcccattattgggtatatacccaaagtattataaatcatgctgctataaagacacatgcacacgtatgtttattgcggcacttttcacaatagcaatgacttggaaccaacccaaatgtccaacaatgatagactggattaagaaaatgtggcacatatacaccatggaatactaggcagccataaaaagaaaatgagttcatgtcctttgtagggacatggatgaagctagaaaccatcattctcagcaaactatcgcaaggacaaaaaaccaaacaccgcatgttctcactcataggtgggaactgaacaatgagaacacttggacacaggaaggggaacatcacacaccggggcctgttgtggggtggggggtgaggggagggatagcattaggggatatacctaatgctaaatgacgagttaatgggtacagcacaccaacatggcacatgtatacatatgtaacaaacctgctcgttgtgcacatgtaccctaaaacttaaagtataataataaaaaaaagatcattctaaaatttatacaagcccttagaacagttaaaaatatcttaccaaaagaagaataaagttggaggaatcactctacctaatataaagtcttactacatagctacagtaattatgacagtgttatattggcagagggataaatacatcaatggcacaaagaatagatagagaaactggaagtagacccaaaacaatatggttaactgacttacgaaaaaatttcagaagccattcaatcgaggaaggatagggtggtattgttgttttttgttttaacaaattgtgctggataaattggacatacctatggaaaaaaaaatgaagtttgacttaaacatcatactttacacaaatattaactcaaaatggagcatgggcataaatctaaaacttcaaactgtaaaacatttagaaaaaaataggaaaaaaatcatcaggatctagtgttagtggaagagttctaaatgtgatccataaaacaaaaacaaataaactggactacatcaaaactaaaaaattctactctgtgaaagacctaattaagaggacaaaagacaagctacaggctggagacaatatatttaatccacgtatctatgaaaggactcatatctagaatatataaacaaccttaagaatctgacagtaaaaaaaaaaaatcagactaactggaccactcatacattgctgatggaaatgtaaagtggtacagccattttggtaaacatcattgctctctgacaaagatacggtgggtcccactgatgaactgtgctgccacagtaaatgtagccactatgcctatctccattctgaagatgtgtcacttcctgtttcagactcaaatcagccacagtggcagaagcccacgaaatcagaggtgaaatttaataatgaccactgcccattctcttcacttgtcccaagaggccattggaaatagtccaaagacccattgagggagatggacattatttcccagaagtaaatacagctcagcttgtactttggtacaactaatcgaccttaccactttcacaatctgctagcaaaggttatgcagcgcgtgaacatgatcatggcagaatcaccaggcctcatcaccatctgccttttaggatatctactcagtgctgaatgtacaggtttgtttccttttttaaaatacattgagtatgcttgccttttagatatagaaatatctgatgctgtcttcttcactaaattttgattacatgatttgacagcaatattgaagagtctaacagccagcacgcaggttggtaagtactggttctttgttagctaggttttcttcttcttcatttttaaaactaaatagatcgacaatgcttatgatgcatttatgtttaataaacactgttcagttcatgatttggtcatgtaattcctgttagaaaacattcatctccttggtttaaaaaaattaaaagtgggaaaacaaagaaatagcagaatatagtgaaaaaaaataaccacattatttttgtttggacttaccactttgaaatcaaaatgggaaacaaaagcacaaacaatggccttatttacacaaaaagtctgattttaagatatatgacatttcaaggtttcagaagtatgtaatgaggtgtgtctctaattttttaaattatatatcttcaatttaaagttttagttaaaacataaagattaacctttcattagcaagctgttagttatcaccaaagcttttcatggattaggaaaaaatcattttgtctctatgtcaaacatcttggagttgatatttggggaaacacaatactcagttgagttccctaggggagaaaagcaagcttaagaattgacataaagagtaggaagttagctaatgcaacatatatcactttgttttttcacaactacagtgactttatgtatttcccagaggaaggcatacagggaagaaattatcccatttggacaaacagcatgttctcacaggaagcatttatcacacttacttgtcaactttctagaatcaaatctagtagctgacagtaccaggatcaggggtgccaaccctaagcacccccagaaagctgactggccctgtggttcccactccagacatgatgtcagctgtgaaatcagactgaaatgctgaaataacgataaaaaaaaatacagaggttaaactagcaaagtgagtaaagtcaagggataaagaaaatttgttggaaaactcacaaagcaggacataaagcaaggccattagatatatctcattagtgtgacatctgggaggacaaagcatccaaaccctttcttctatataagtggtgagatgatgaaggttgtaagagggcttctgcccccttgaagacttcagatgctggggaaaggatagataagaataaggatgaaccaggcttttggagcctgggaaataatgactagcgataaacctgaagggaagttaagtatacgatccccagataatactaaggagaaaggcaatgtgattctgcagccattgtagccagagataataagcccttgaggaaggggccaggggaatttttctaaggatagacagtattaatgcagcactctcttctgctattaaactctcattggcttctaaaaggagtttcggtgagtgatttgctgagatgttgcattttcatggctgctgcctttaggtattattgcaacagtttggaattttgaaattaaaacagttctgtaaaaccagtttagttttgtaaagtgtatgcatcaaagatgtccttcattcagacattactgagttacaactatggtgccaggtactgtgtcagggtactaggggtatggggataaaccagactccctctttgatctaaagcagcatgaggccaggtgagaggtttcaatataatgtgataaaatgtgcactaggtactaagggatcatagagaaaggaacacattaaatggggaaacaattgatagagagagaatattttcatctgggtcttaaaagatgagtaggcgttctctctctttaaatgtctgatataagggcattttatgcaaagaggatcactcgtgcaaagactcagatttgcaagaacgtgaggtatttcaggagttttgtatggttccatatggactatgacaagtgagacaggtaaactaggcagagctggtcatcagataatgaagtcattaacctaaggagattggacaataaaatgcaatatggaggtatcgaagtataaacataaggagtaccactgatggctgatttaggatgcccagtctggcaacacgctaatgaaatgatagtgggggagggggccgtaccaagactaggagagagcagtcctgagactattgcaattatctgcgggagacataaaggctagaacctgaacagtagcagtacaaaaaaagaggggagttcaaatgatattaaggaagtagaagtggtatgacttaaccatctgggtatggaaggggaaatggctagagtcttggggactttgtgtttgatgtgattatggaccacagaataatgtctaagagaactggctctttagtctgactgccagagtctgaatcctgaatgttttagtatgttaccttgggcaaagcccttagcctctatgaatctatcttcctcattcataaaaataagatgacagtgcctatctcgtgggacttttgtgaggatgaagtgagataatggatgcaaagttactgagcacagtgtccaacacagcagaagcattacatatacattagctattactggctacattatgatatacagttagggagttggaaagataatctgaaattcaggagacgtatctgactataggtgagtatttggaactcattgttctgtaaacagtagttacagccacgtgtgtgggcatctggagagtgagcatggatattgtgatacctagtacagtgcctggcagtagtggttgtatgctcagtaaattttgttgacagggtcagggccggactagactgtggtaagcaaggcctgtagggcataaatatacttgtatgccccgagaagtgaggacctcttaaatattgtgccctacatgccttgtttggttcactcttgtcccagccctagcaagtatatataaggtgaaaaaggaaaaagctgaggctggagcctgggagaaccctggacatttaagggccatggagaggaacaggagttaatcaattcaagtgctggatggataacaggagttagagcaaagcggggaaccagaatagagtgattattataaaaagagtttcctaaaaagggagagatcaacaattagaaattatttagagcagccagtaaatacataaactcaaaattattctttaggtcattcctgattgtgacaatagtcatttcattatataaatgtgattaaggaaggaaaagagctacacagaagttattaaagagctaaagagaattgagaaatttaaaacagaagaaagtagggccaacatgaaaggagtagggagaaaaagagataaccagcatattgtctcactgatcctgccaacacctgtgagatagatattcttattatactactgttaaacctaatttacatttgacaaagttaaggttcagagcttgtgtgacttgtccaaggtcacaggtctagaggaggcagatacttgattcaaacctatttctgtctgatctgattctaaagtctgttttttcactcaaccacactgtacagtcagctctccttgtgagttccacagccacagattcaattaactgcagatcaaaaatattcaagaaaaaaatggatggttgcatctctactgaacatgtacagactcttttatctttcattattccctaaacaatacagcataacaactatttacatagcatttacattgtattagctattaagagaaacctagagatgatttaaagtacaaaggaggatgtgtttaggttatatgcaaatagtaagccatttttatatcggagacttgagcatccacagatcttgatatttgcagggggtcttgccaccaattttccatggatactgaggaacgactgtaaatggatgcaggcatggatgctatttaggagtgtccagggccaagtaaatgagttgctgagcagagaggtgggtggaggctgtgaggcatcaatatgtggtggcatccatctgcattttggtgatttttttccttcacagtcctcggctgtctgggaagagaaggatgaaggcagatggctgctccaatttaggggctaggattgcagggtgggcacagcattgcaaacgagtgaaggaaattgagaaatatggccaatgaagagttgaagagaggcctggcatggtggctcacacctataatcccagcactttcagaggcccaggcaggcagatcacttgaggtcaggagttcgacaccagcctggccaacaaggtgaaatggtgaaaccccggctttactaaaaatacaaaaattagctgggcatggtggcgggtgcctgtaatcccagctacttgggaggctgaggcaggagaatagcttgaacctgggagatggaggttgcagtgagctgagatcgcaccactgcactccagcctgggcgacagagcaagactctgtcaaaaaaaaaagagttgaagagaaaaagtctaggctaaattcaaagaaaaaaagtgagcccaaaaggaacttgcagagcaagggaaaagcagggatgtcaagggactagaacactccataaagtgaacagctgcaatgaaaataagggaagaaagtttagttcatctccgtttctttcctttcctttttactttcctttctcttcctttttggagttaatcaggaagtagtcccaaataccccagaaagttcatcttataagcccttggtcctcttgagatggtatcagatatattgctagacccttgaagaaaggaacaactccaggcaacttcttgagtccctgttattaattttatacatacacacacatatatgtatatacatgaaaacacacaaacacatgtgtgtgtatacagccatgcattccttaacaatggggatatattctgagaaatgtgtcattaagcaatttcatcattgtgcgaacataatagagtgtacttacctaaacctaaatggtatagcttactacatacctaggttgtattgatgtggcctattgctcctaggctcctgggctgcaaacctgtacagcatgtgactgtactgaacactgtaggcaatggtaacagtggtatttgtgtatctaaacatagaaaaggtacagtgaaaatacagtattataaccttatgggaccactgtcgtataatgtggtccatcattgaccaaaatgtcattgtgcagcaaatgattatctcatatatatatatatatgatatgatatatatgatatatatgtgtgtgtatatatgtatacatatatatgtgtacatatatgtatacatatatacacacacatatatatgtacacacatatatgtatatatatgtacacacatatatgtatatatatatgtacacacacacacatagagagagagagagaggagaggagaggaaggagggagggaaggagaaatatgattcagatagagacatctatcctccagagttcaggagtgtctcttcagactaggtagatgtagcttaaaaaaaacatatcctgaattctagagagatgcttaaatcactgcaattcctataacacttgccaaccaaaggtgctgttgatctgaaattgcttttttaaattaatgcagtgatttttctttaacatctagtgacagacactggggtcacatttgcagctggaccataattaggcttctgttcttcaggagacatttgttcaaagtcatttgggcaaccatattctgaaaacagcccagccagggtgatggatcactttgcaaagatcctcaatgagctattttcaagtgatgacaaagtgtgaagttaaccgctcatttgagaactttctttttcatccaaagtaaattcaaatatgattagaaatctgaccttttattactggaattctcttgactaaaagtaaaattgaattttaattcctaaatctccatgtgtatacagtactgtgggaacatcacagattttggctccatgccctaaagagaaattggctttcagattatttggattaaaaacaaagactttcttaagagatgtaaaattttcatgatgttttcttttttgctaaaactaaagaattattcttttacatttcagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacagtgagtatttccacataatacccttcagatgcagagcatagaatagaaaatctttaaaaagacacttctctttaaaattttaaagcatccatatatatttatgtatgttaaatgttataaaagataggaaatcaataccaaaacactttagatattaccgttaatttgtcttcttttattctttatagactgaattttggaagcagtatgttggtaagcaattcattttatcctctagctaatatatgaaacatatgagaattatgtgggttttttctctgcataaatagataatatattaaactttgtcaaaaggactcagaaagatcagtccaaccctctaacccatattgaatggtgatatactacagggttatgccagtgtgggaactatcgctggtaaataagtttaatcctccctagggcttcacaaagaacattgttccaccccaggagggtggaaggaagaaactgaaatgattgtgtcttagaacctaatgaaagtttgcattcctcagtaaaatcagagactgctgattgacttaaatgtttatagcttcaaagtcctcctcattatcatggcccacaagcccttccatgattgtccttccccaccctccccattacccttcttgcctcctctgctacttctctcctcgcacactgggctccagccaccctggccttcctgtcacttcttgcacactctaggaatgctcccactttggaggctttatctggctgtttctcttatttggctgttcccaacttcctgtgggctgactccctcacctccttcgggtctttgcccaaatgttaccatcttaatgaggcctaccttcaccatctattaatacttcaacctgccccagtagccttaccactctagacacctgtacagaactccactctactttttaacagagcttttcaccatctaatgtatcatataatttcttactcatactatttatcatttattttctcctactccactaaaatgcaagtttcatgttggcagggatattcaattgttttgtttattgatatattcctagcacctagaacagtatctggaaaagaggtactcagtaaatatttatcaaatgaattgaccaaaagaaggaaaactcaaaactttaatgacaactaactttaaagctacaataacttaaaattcagcagtaggattttgagggagggtaagtttcaaagattgacttacctaagactatctgcataaataaaaagaaattaatccagacaacaaattcaccaacttccatcaattggaaatccaattctattttctacagtttatgttctggagacactactggacactcttttactctcataactcataactcctccacttttgtttttaaatcatgagagaaaaagagttgactctgttatattgttttatctacctttccttgatcttagaaacgaatactaccataccagcttctactgaggtgccccctaaagttagtccaaataggtctttgcaatctccattcccgcagaatttagaactttgaatcacatgatttatttctaaaagtaaatccatgccgattttccccaccaaaaaattcctgactattaaactcctacaatcccttcattgctcactccccacccccaggatcatattttaaagttgggcccttgccttttgggtcacataggtacactgtttgctataccacaggtatagctatctggaaaacatggagggtattattctgttactactgcttcgtcaaccaaaaaataaaacaaaacaagaacaaaaaagaaacaaactccctgcctcttttcacttgcagtcaaggttcctaaccactacaaaattagcctatgtttcttcttgcacatagtagaaacccaagcttctcactgctgtgctattctgtaccatcaactcatcacataaagagcctggttgaagaatgattgtccaaccacattactagcatctgtcaagactttccagtttacaaaaggcctatcacatttaaccctcacaccatccttgtgaccaaagcattattaactccattttacaggagagtaaactgaagcttagggaagttaaaagaactgccaaaggtctcccagttggggagtcatgaagcccagaagagaagccaaattctctgctgctcaaccccttgctttcactattacacctcagggccttcaaatctaaatgcagttattcattaaacaggaacctggtagtcttaaacaggaatctctcacttggtaagatcttgtctcttgttgtatttgaccccaactgtctatggctttgcctgaacccaaagtacacacagcctagaaaccaaaggagaaccaaatgtgggataaaatgacactcattttaacgacatgtctcagcaaatgagttcctgtgtagctggctgaaagcccagaccctttcagtaaaacatcctgaataattcacatttgttggtctataatataaagggcaaatgtagctcatttttagaccagttctgaacatcaatagtaacaaaccagagataaccgattttgttttcatagaattggaacaaattagagtatctgtgcaaaagcatatcagatctaggagcagaggggacaaggtctaatttttaaataagcaaattttccagggagggactacttatgataaagggatattagtctcttagtcaacggaacctggatacacgcttctgacagagaagagggagaataggcaggaatctacacaccagatgtcaaggagatttgctttaaaatacgactgataattagaaatttctcagtttcccccttttccctcattctttgattcttattgttatctttatctcttactcctttgtttctcatatattgagtcttacagatcaagctcctatttttttcttcaggggtatttttctagttcaaagtgcctaccatctcccttctggttctattcatccttctctcccaaagctcctttagaagtgtggattaaggcagagcactaagaaaccagacttaaagattcccttctcattctgacttttctcctttcacctattccttcctcctgttttcttaccatcagtgtcttcaaaggctttcaagtacacggtaaatgcagaaacttcaagaaaggcagaatggaaacataaccaatgcatacataaataaagcacactgtagaatctttttaaattctgtatgatatatcgaatgctgtctctcacattacctagaccatttgaaaccgaatttgtaaaacatagactatctttaagtagtaacagatgcttctgacatgttttctattgtcttgaaccattactgcatatgatacatcaaagttaagtgacaatacaagaaagcagattcatttgctccctgcctaggccgtcagttcctaaagtggaaacgccatatattatctagctcagtttgctctacaagacctgcaatagagccttgtgtgacatagagataatatttgttgaagcaattaaatttgacttggaattaactctgccatcattctataaggaaggattgaaaatccttctcaccctgtgctgatatagtacctttctatacaaaaacgtccttctccctcttcccttggattgcataaactatgtacatgccttcctcagggcacttttctaggacagtgtcagcctaaggatctttgtttgggtggcttttagaaactcaggaagacaggagcatcatatgcctataggcagctggcttccaggtcagtagttttgctctgaccctaaaatcagactcccatcccaatgagtatctacaggggaggaccgggcattctaagcagtttacgtgccaattcaatttcttaacctatctcaaagatggagatcagtgtgagtccaatccatgtttaaatggcggcagttgcaaggatgacattaattcctatgaatgttggtgtccctttggatttgaaggaaagaactgtgaattaggtaagtaactattttttgaatactcatggttcaaagtttccctctgaaacaagttgaaactggaaaatgcaatattggtgtatcataatttttcttaaaaacatacctttgatgcttataaacatttcatttgtagtgatagttttcaggatatgagttcaagaagctacattaaaatcaataacaatatttggtaactaatattaagtaataatgatgttccactcacttattaatctttaatacaaccgtatgtggttagtactatcattatgcgcattctatgcagatgagaaaaccgcaactccaacggccaaaaattacagaggcataaatggtttagacaggacttaaacttcagtgtgaccaaaacccatgcttctaactactatattcaaaactcagagaaaactgaacccagaaaattgaaatcatgactaaattgctatcaacataggtagtgaaagtcaattaagtacagaactggagtatgactggccaattatcccatataatgggaattctccacatgtacaaaccacttcatatgctaaacttgttgacaacattcaaagctcatccctgaatttgactatattgattacatcaaaaatgttacatagcaaccttagaatccttgtgtaccttttcttctcaaagcctagattatttctttttccgacgtttcagtaattggagcagtaaaccccagtgtcccttacctacttgtttattacctccagatgcaatattactggtactgtgattgagaaacgcacacagtgctaatgaggaattcactttctactctgacactctggaagaatagagatgcaatcctaaggaagaatttaacaccacaggctacatgactaaggataaagagtagaaaattagcaggactctattaaggcattacagcaatccacctgacagatgaaaaaggcatgaaatgaaatgaaatgtagcagctacactcgtcctattgagaaaggaaaaaagtcacctgtaatgttgttcagaaatcctttcagtactaaaaaattcattgaccatcttcctttagtctcgaaaatttcttagaaggtaaaaaaaggaaaaggtgacagggcaaagacatttgaaaagaaagaaaagagtgaatgaacttgcacacctggcttggactcccattcccttaggtttccattgtgggggacaaactaatgcctgggttacctttcttgagagtgtgttaattgattcaatatctctgaagtgctactttcatctgaaaggttataatttgaaattcagatttacctggataaatttgatcttgctattatggaaacctctagaaatccttggagtagttactcattatcagcttaaataatatagccggtggagctgagggaatgagtaactcaattagtctcagttacaactgaagggcacattgttgtaaactataattgaaaacataaatatctttacctagtttaaaaataaagatgctttaaaaggaggaagggaatagccctgaggaatgtaaatataagcacaaaacttctacaacagagtttgctacgtgtgtggctgtgttccacccagcaaaaatgctaagtctacaactgacacaacttggatactctcatgttcccacattttggtttggtcaaggctgtgcagttgtactgcagccaccaccactcctggcctctacagtatattgatctgacccaccaatctgatcaaggtttagaaaaatattttcagcccagttagctcacaaacaaaatgagaattcccacaaattgctctttatctcagacaacagaggaaagctacagcaaaagcataaacaaattaccatttaagtttgttgcttcaaattaaagactaattgcaacagctactagatagcacagtttatggggcatctcggccccaagtcttttgtcttataaggtcttgaaaaaaagaaaggagattttcatcaataagagttttttgttatctttttcccttgttcatcaggcccttcactgcgagagagaggtgtaaacgttcagggcatgcattctagttaaagaatattaattggctattgggtccctttggttagaataaagacctctgtatgatgtccctagctgtacatcaaacccaaatatctctcagataaatgaaggtctgtaagaatttggtcattcctgtctcttctaaagagtaacagaggcattttcccgcagtaaagtagaatggaaagaaaacaaaaatcacaagcctataaacaccttcttcaattttcccagcatgtcacagacactactgtcttatttactacgtatttctgaggagtaaaaaaaggaaatatgttgagtttagctgaagcacagcatattttgtggtaaacttgttaaataaaacatcttttgtccaagctttggttgtcacacaagtggatatatcaggaaatataaaggcagaataaactaaagcagaacatactaacatttgtagtaggcatgaagggaattagaaagtgtttgtgttaacatggagggagggagaacagatgctttgagatgttcttcaacagatattctaggcactgagacccccttcgggaccagagagagcccatatccaccacagtacctgacacataaatgctcagtaattgataaatgagtcccattctaactgttccttagccctgctctatggaactctcccctggaattccttgtgccattattttatttctggaatcttcagccttttagctgagggcaaaagattgctgattaggaagcaatatttcccacctcctgcgcaaaacaagccaaagatcaacagcagcagcaacatactgagccctaaagggcaatgacaaatgtggagaatgatacagaggtctggttacttcttagccaatgacacagaatcacaattgagaaaacacagagtttattcattcccattgtgcatgccctggacaaaccaagctgcacctttcgtaacttatcacaatctcatattgacggaacactttctacaggtaatgtttgatttggctgaacactttagcattgcttcgtagcaacaaaatgatagctagtaacagaaaaagatccagggatattaccactgttagtgaggagaaaggccttttaattaattaattaattaattaataggaccaagtgccatctttttggatcatgcccttagtggattattggtagcaaaggttaaagctcaagctggttcctttgtccccctggcaacagttgatttgcctccctttatctcctgaagtatccgtaaggactaagagccaattattacatttggctatgctagcatatgtaaaatagagtttaaaagtttagattcatcactcaaaaattcatattctccaaaaccatacagtcactctgttagcctgtgttcccccagaaaaaaagtcacaagcttatttattaacatgtgcaatcccagggggcaagagaaaggaactgaagagtgaggcagaaaggaaaagaaagccaataagaggatgagttatcaaactactcgtttctaacagcaactgattgcttaacttcctgggactgtctccaataagtcaaattggcctcaggttagtccacctgagtgggaagaagcggtgaaagaatttgtctgtcagtatctgtctctcattggttagaagttcgacttatggggaattaactccctcacatttcctagttggatatgcttgggtacccagagggtcatatggcatccatgcctcagcatgaacagggaagcttcaaggcaaaagacacatagtgcagctatgagccaaggcaattcaaggatacacccataggaggctggttgacatccacccagagctaatcaccaccatgctggaaaaagacacaggtgaagctgagaagaatgaaggtggtgcataggaggtatctaatacagtcactcattttcaaactttccatgttatgattgcactgaccactgaggatttctattgaaagttttactgttgtcaaacacgtacacaaggggaaaggtgtcttacattgtttatgttcctgtgctgctctagaaacagaaataggctcaagagcagagcctgtttttcttaattcagcaggtctaagctaacaagtcctgaaacatggtacttcctgttattggtattgcataggagaaacaaagggaaagcacagtaattagaaaatacaaaacaagatggcaggaataagccaaaaatatcaggaaacacaattattgtgaattgggattaaactaatctattaataatgacaactttcagcttggagttaaaaatttaattgtatactgttaacgaaagtgatacctaaaataaaattacactgggaggccaaaatgaagggatgtgaaaagaactatcaggtaaaaactaacaaaaagaaactagcaaagcaatcttaatatcagacaaaatagaatccaagaggaaaatcatttcaaaagacaagagattttttttattaataaggggaattgcataggagagtaaagaaaatgtgggccactggaatgcttagcactaatgacatattggtctttggtcttcagttaccttacaggaccctatttcattctcttatgtttgatatgtaaccacctcagccagcttcaagttgctttttggccctaatggacttcctagcactataatttcttttttttaaatgttttattttaggtttaggggtacatgtgaaggtttgttacatagataaacatgtgtcacaggggtttgttgtacatattattacatgacgcagatattcagctcagtaccaaatagtgatcttttctgctcctctgcctcatcccaccctcctccctcaagtagactccagtatctgttgtttccttctttgtgtttataagttcttaacacttagctcccgcttacaagtgagaacctgcagtatttgatttttgttcctacgctagtttcctaaggatgatagcctccagctccattcatattcccacaaaagacataatctccttcttttctatggctgcataatattccatggtatatatgaaccacattttctttatccggtctgtcattgatgggcatttaggttgattccatgtctgctattctaacactgtaatttctaaagacttccagattctacttttataggtaacctgttaaacagtctagctctggaagccaagcaatttctagaataactaagcaatagaaattacacttcaatgcagaaaggcagtatctacatgagattatgaaattgcggttgctttttgtgttcactgaaaaaaataagtaaaactgtaactttcagaaaaaatgattgtacatatagaaaacccaaagcatctaaacaattaaaataaataagtatagaaagattactggatacagagtcaacatacaaatatcaattgtatgtctatataccagcaacgattcaaaaatgatttttataatagcattaaaaattagacgcttagtaataaatgtgagaaagatgtgcaagaactctacataaaaaattatgagacgttattgagaaaaattaaggaaaacctaaataaatgaatgaataggcaatgtttatcaattaaaggatacaatatagtaaatatatcaaatgtttactaatggattcaatgcaataccaaagtgcccagcaggctttttttggtggtgggaggtcgggcaggattcataagctaattataaaatgcatatggaaatgcaaagagccaaggatagccaagacagttttgaggaagaataaacttgtactacttacactaccagatgtcaagacttattatcgagttacatttattaagacagtgtggtactgacacaaggatagacaaatagatcagtgaaacacactagagtgctcagaagcacacctgtacatatataaaggcttgatttatgatagaggtgccagtgcagtagagaaggaaattattggtgttttcaataaaaagtgataggtcaattagatattcatatggcatgaagtatgaaacaataacaatttatattcataacttgcagaaagcaaaaatttcttaaaatacaaaaagtgatcaccataaaggaaaagattgataaactggactatattaaaactaaggactcctgttcagcaaaagacactacttcgactgaaaagacaagtcacagagtgagacaagatatctgcaatacagatacctaataactgaaccccatacagtgatggtgggaatttaagttcgtacaatcattttagaaaattgcttggcagtatctactagatctgaacatgtgatccagtaattacactcataattataagccagtaaaaaggcatgtttatgtcaccaaaagatatatacaagaatgttcattacactattatacataagagccaaaaactggaaacaaaccaaatatccattaacagtagaatgaataaataaaagctgtaatagtaatacagtggaatactacacagcaatgtaaatgaactactgctgtacaaaacaacatggtttaatctcacagacaaaatgttaaatgaaagacacagacgagtacatattgcgaacttctgtttataattcaagaactggcaagaactgtttactgtgttagaagtccaggtaatggtaacctataaaaaggaaaaagggtggaatgattgggagggggcatcttctggggtattgataatgtgctatgtattggtcagtttagtgtttaaacaggctcatttactttgtgaaaacttacactaaaattgtgtgtattttttgaatatatgttatacattaataaatagggtttttaaacctgtagttcataatttagtgaaagtagaatatccaaacatttagttttaaaccaatcaattatagtgctaccatcatttttatgcattattgagaagtttattttacctttctttccactcttatttcaaggctccaaaatttctctccccaacgtatattgggggcaacatgaatgcccccaatgtatatttgacccatacatgagtcagtagttccatgtactttttagaaatgcatgttaaatgatgctgttactgtctattttgcttcttttagatgtaacatgtaacattaagaatggcagatgcgagcagttttgtaaaaatagtgctgataacaaggtggtttgctcctgtactgagggatatcgacttgcagaaaaccagaagtcctgtgaaccagcaggtcataatctgaataagattttttaaagaaaatctgtatctgaaacttcagcattttaacaaacctacataattttaattcctacttgaatctgcttccttttgaaatcatagaaaatatcagtagcttgaattagaccaattaattttctagattgcatcatattttaaatataaactatgtaatcatctacaacctgaattctttctgtgtccaatttgtccaatttttttctctaacatttatatcacaaagcaattaatttgtgtgatttctgcatatgtatttgtaattcatcaagtcaaatcaatgtagtaatactatatcataaaatatacacaaataattgagtgataggcttctagtataaggacggtaagtttgaagcatgattctatctgggctggctagtttactctgagaaagttattttttattgttgggtcttaagctgagtttacacacttggtgtcagaatgattccggcaatgaactgttttatgttctgctaggctgatcagcacaatctatatggctgtgaacaaaacaatgtttcccagtcatgccaaccatgccaccattttaacagctgattagtgtattcagaacatctccactccatgttcgtatggctgttatctaaagatgaaagcagtagacacttttattttttgaaaaatttaggctctgcagggtcaattatatttgataaatgaggggcttttttgaagcaaactagatataatttcttttgcatttctaaagcctgatatcttattaattggtacattaaattgtgcaccatttctctgtaactgtttcagtacctgtctcagcactataccaggcagaagaaattaaagaaagaaccagtgccgagatcagcttggtcagggagaccctaatcctgcggcactagaggaattaaagacacacacacagaaatatagagtatggagtgggaaatcaggggtctcacagccttcagagctgagagccccgaacagagatttacccacatatttattgacagcaagccagtcataagatttactgaaagtattccttatgggaaataaagggatgagtctggctagttatctgcagcaggaacatgtccttaaggcacaaatcacttatgcaattgtctgtggtttaagaacacctttaagcagttttccgccctgggtgggccaggtgttccttgccctcattctggtaaacccacaaccttccagtgtggatatcaaggccatcacgagcatatcacagtgctgcagagattttgtttatggccagttttggggccagtttatggccagatttggaggcctgttcccaacaaaccagaagctaggaatatatatcctgcaaataaaatgaagaatctctaaggcttcagggcctgcccacttgttcttctgcctggttcttcacatacactgtctcaaagctagtctaccttgagaggagcatgaatatgtgtgtgggtgtgtgtctgtgtattttaaccttaaaaacctaacttccagtatagacagatggcatactagctaaacccttacaagttcttctatgctataaaagagaaacagaattgagaaccacctccaactattaagtgttatatttgaatatagccttagctttagcagaataagtaggccaaacttaaaataagcttttctgccttttcaatgataaaggtcccttttctgtagccattgttgattgtgtacacttatacataagtattttgaactaatttcctgttttctcaaccacttgctgtcttcatgatactttgtcgcagctggttgctatagaaatgtctgttacaaggaatgtggcttgaaggaaagtgataaatgaaaatgaaatgtgaagtgactttgtttgactacaaattcccattctggtagtccccagtgtatcaatacattatttttctttagaaaataaaccaacccaaggaaaaatggtgggcaggtcctggtgaatatggctgtgataattatattagcaatctctttggctaatatttgaagcccaaataattgaatcacaatgatctctccccagaaaatatataaaatgcaccttggaatctagaaggccttttagtctgcaaaagaaaccttcttaatcataagcagcagaagtcccatttaccaaattggaaagttaaagttacaaagcatcaatcataagacttccattcagggatggcaattgggagtaagactttttagtaaagaaactaaacacaaagtcattagactctgtaaaagtcttaccaaatttgattctggaacacctattctatttccgtaaagatgatgaattccggagccaaatgttcttttcatgaaggatttgaaaactgtccatgaaaataacgcaatcaaccttttagcttgagactctattcactgattagatttttttaaatactgatgggcctgcttctcagaagtgacaaggatgggcctcaatctcaatttttgtaatacatgttccatttgccaatgagaaatatcaggttactaatttttcttctatttttctagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggtactttatactgatggtgtgtcaaaactggagctcagctggcaagacacaggccaggtgggagactgaggctattttactagacagacctattgggatgtgagaagtatttaggcaagtttcagcactaaccaatgtgagaaggcctccagagatgagcagttggtgaaagagaggctcaaaaccagctaccatacaggtcaagaagaatttggcattaaggaaacagcatagcaggattccagacaggcaactggtcaacaacatgaaggtctggaagaaaggtcgcaggtactcaggttcagggcactacttcagcttcagcccttgcaaaaactggtgagagttggaaagtctttaggctaagaaaaattggattatttaaaagggggtaaagaaagggactcaaggaggaaggattaaggcaagaactaggttccaagaaacagggcatgagagagagtcttgatctaccactatagttctcgtggtagcatcagaatcacctgggaacgtagaaatgcaaattctcctgctctacactagacctaccaaatcagaatatctagggggtggggcccagcagtctgtgcgcaaacaagcactgcaggtgattttgatgcacattatagtttgaaaactaggccaggtgcagtggctcatgccaataatcccagcactttgggagactgagacgggaggattgcttaaacccaggagtttgagaccagcctgggcaacacggcgaaaccccacctctaattaaaaaaaatacaaaaattagctaggtgtgatggctcccacctgtgctcccagctattcaggaggctgaggtgggagaatcacctgagcctggaaagtcgaggctgcagtgaattgtgatcacaccactgcacttcagcctgagtgacagagtaagaccctatctcaaaaaacagaaaaagaaaaacactggcccaaaggaaatgaacttgttacagaagccggggttcaaaacaccaaataatgcacttgtacctagtccttcccgggtgctctgcagacatttctccaagcgtagtctgcaaacaacctacatatgtagaattacctatgcacatttttcatttaacaaccaagagctacatttgtagcaaaatctgggttgtaacttagcctacagctgaagcctaagagattccgtctgtgagaagaaataacccacctctttggcccccctccccaggcaggaagccaggatggtccttatataaagttgtgctgtccaataggtaaccactagccacatatggctatttaaatttaaattaactacaattaagagaaattaaaaattcaattcctcaattgcacctgccaaattttaagcacataacaaccacatgtggctagtaactactgtattggagagtgcaagcggagatagaacactctattactgcagaaatttctattggatagcacttataatagtttagtgtaacttaaaactccctagttgccacagtcatgatttagtagtaatttcatggatttctctactgaggttagaatctctgccattagagactgataaatttaaagtttgcaattatcaaactggtgacaatttaagccagaatcaggtaaatgtcctcagttttaacagcattggaattttctgggactagctgtgtatctatccaggattcttgagaatgcctgccatttttcaacataatggatgtaaggtattacacatatacctggggatggggtggtaggtataattgcacaagcattgtggagaatggtatcaaagagtggcagaacatcacaatcaaggttttccctttcttttacctttgctttttaaaaagacaatatttgctggacctgatcttataactcataaatgggacactgtatgttcctttttacctcctctgtttctacttaattgcaccctatgaggactgcttcccttacctaccataaccccttccttcactcatccatatctttactcttcttcacaactctgtaatattgaccttctttatgaacctttcctggaacaatccctcttaagtgcaagcactgttattatgccttcaatgtatttaatatccatgtatctattctctctaattttgtcattttgtgttctcatgtattttcattcattatgtgtccaacttccatggataacatggttacaacaaaagatcctactttatgacaattatcttccttgggtttgtgggacatagaacagtgctcagagtaggggatccaagaacccaggagaatatattagctaagaagataacttccgtttttaaaagtccaagattcaggagatcaaaaccatcctggctaacatagtgaaaccccgtctcttccaaaaatacaaaaaattagcccggcgtggtggcaggcgcctatagtcccagctacacgggaggctgaggcaggagaatggcgtgaaccggggaggcggagctggcagtgagccgagatcccgccactgcactccagcctgggcgacagagcgagactccgtctcaaaaaaaaaaaaaaaaaaaaagtccaagattaaaaaaaaaaaaaaaaaaggatgtctgctttgtgagtttagcattgtctccttgtcattccagaaatgaaatggcaaatacatttaaatcagaactaaaaaggggaacagggtataaaggctcaatttagtcacatcatttccgtttctcacccaccccctttaaaccagatgtttgccaatgcattaacaatgcagatgtttcctgaaagaaagtttagtaactcaagcagacaccttattttcttttcaagcagaaaagactatgagatggtggttgtggttgttccgggagggagaagatataaatgatacacattatttcaaatcatttcatgacctcactgcacacttatagttattgtacctgttgtctttttgctgtcaagcctagctaagatcatttggaatgttcaagatcactcatacatgcatgtgcacacatacacatgcacatatgttcactccctatttcatccacatgaactaagattactgatgtgtacagattcaaagcacttttattcttttccaaaggcaagaagctgagctactttccagaatagttgtgaaagaccctgtcatacttctgcattgtttcctccacaccacctccatccagttccttatgaatggttactggttttcaaaaatatgagataaattgagtgtataaaagtcatttttagacaaaatgaaacaggaaatgaaagaaaccagaatctctcctcatttgtggatgggccagctccaccatgtcatggttaatctgcagggaggaaatactagatttgattgcagatcagactgcagcaaacctgctgtgactaaggcatcaagagaaagcaagcaacagctggggcttcagtggtgaaaacattatatatctagctttgaaatatgaaatactgtttagcagtgtcacctagaaaagagtgtttcaaaatgctgatgcttcataagaacctttctcttcagagttgtttcttttatctttcaaattagccagggtgggaaataaagtgatcacttggtgaagaaatctcacaaagaagaacatagagagttcactttcatctggagtaatgaacagattgaacaaactagaaatggttagtctgttaaagaaaaggtgtaggtgagctgtttgcaagagccacaagggaaaggggaagacaacttctttgtggacttaagggtgaaagttgcaagcaggcaagacgattctgacctccattaagaaagccctttccaaccaacaaccactgggttggttacgcaggttgggcagcattgggagcaaatgttgattgaacaaatgtttgtcggaattgttgacttaaagagctgttctgtcactggggacagcagcggctagatagccccattcagggagagggcatttgttcacctggccagagatcagagcaggctaagggactgctgggatcctgtccagctttgagaccctacagagccatgttcacctagcacgtatcccgtctgcggtcacgctcatttcttaccttattccagggctttcacctcagcttgccaggctggagccaagggccaacgcagccgcgccttgttcgcgatggtagcttcccaggagccccctatggttccggaacggcgctgccggccccatcctgtttgctacctcctaaagccaaaggcactggcgggccgggccagcttctaaagtcgcgcaaggttagaaggttccggacaggaacggcgtgaggccaatggaaggaggtacttcagtttccctccagatgcccagcgatgggctcagagctccttgagaactcgggaaaggaagcagggtctctgaagaaatacttcaggagtagaaagaggaagctagagggttaaatgcactacacaggaacagaaatgagtttttcttagagttagtatatgtctagaggtgtagtaaactaaaacaagtcttgaattgcataccgccacgtagggaagaaatgaaaacctttgaatattagtgaaaaaagggaaactgcaacgcctgtattactagatagctttcatcaacagctcaaaaccgacagatttaaagaagcaacaccgcattttggctttctaaagctttaatttggtttggatcccatgcccatgaccctgccagctgacaattctaagcatgcgcaaactggccccaaaaattcctcccacatttccgaagaactatttggccctttatgtgaagtacctggtttttccattttctgttttaccataggcctcagttcggtgtgtggcgtatttattctacatttaacaatttgaagatcattctattagattaaaaaaaaagaatacaatggaagccaagtgattaagctttccttatgcttatattaagttgtagcatatgcatttaccgatagttaaccgtattaacctacagaaaatgtccagggaaatggtctatttcttattctatttttgacctaaagaaaatctttaaaatgtcttagcattttccccagtctccatccactttcctcagctttggcctgaagctatctttaaaggtaccctgtacagctcttgccctgtacagctagctacagagattcaatcctttctgttcgattaggacacatctcagtggcagataacatgcaaagttattatatgtatgaaccagaacttgtttttccttaggggccaggatgttacactaaggtcttaagactatagtaatatcttcacttgaaaaagccctctattattcctatctcagatgataaaaattcaattaagagaaataagaacgtgacatgtgtaatcgcacctggctctacaaagctagtctggacagacatttaaacaattatcctctaagattatttgatgaaatgcatttcaatgactagttaaccattaaaaaccaaagtgagcatcccatctgttcccagtcaaatgacctagagcaaaggactaggcaaaccacatctgtgggcatagcaagctgtacatcacaaacaaatgaatttgctttgtatatgagtgagagcaaacactctttattgtacaacttgggtgggtaagtagggagaataatggttttactgaaatcgcaggtaacggttacgttggagttaaaggttaggaagaaaaccaaagggtaagagctgttgttctgggctggcattgtcaatgaagagcataaattcagatgtgaatgtatattttgtagaagcatgtgtgttgttggtttttgtgtatgtgtgagtctgaaagagggaaaacaggctcccattagactatgactaacaaaaatgtttgacagattataactcagatgtcttactcagagcatatgccttcccattttccccattattccccaacatgatgtctttaagaacttgtccttgaccgagcagacatctcataccccaaatagctaatattttgatagctatgatcctgaacggccaaacattccaaaaccaagtagtttgtaatatctttaaatgcaaatatattttaggccttttccttggcaaggatgtttggtcaggggttggcaaaaataatgctcttcagacttaaaagaacacaaccatatttcttagccatccaccagaaagtagtagaagctccaggaagcaagtctttgtcaggagtcagactagctacatcataatctctctgcccaggggctgtggatgtcatccatcctggcctaactagcctactgagctgagagatgtccaatttccccccaatacactaaccagaggagaaggaccgtgatatcattgcatgtgaattcttaattccaattgcttaaacaaatatgttcagttgtaactatcaataccagtatataacagtgttggccaagttttattgatgctgacaatcaattggagttacagccagacacatggtcttatgaccggcgtacttacgcagggctttgcactgagacaggtcgtgcatctgaggtttactgctttgcatttttgttttgtaactgaagtctgatgagacagccagagcatgtgctacctagggacttgaatccctgcagccccatttcacttctcaccaccttccggggtggtttctcgacctcccactcccctaccacctggtgccttagccagccctggctctccctccaaacacctgcccaatgagcactgccaccccatggtgcccagacatgctctccctcctcatccctacctagctaccattgccactcccctcccccagcggggacatgggcataggagcagggagagttaaggttggtcaggtgcacgtgccctatgctatcttggaagggggcttggccatgtggcatctctggaccaagaatgcgccacagcacatttggagggtgaatggtgggggcacaccccttgtccacctctatttcaggcatggaacacatcctggcatgaaagttgcagtcccttgggaatcacctctccaccttgattgccacagtaggccagtgacaagggaagattgacacatcatcccctgctggggcccagtgtcctgtggctggcaggcaggggatcctaaggacatgtgggtgttaaattgtagggtgcacttcctgggcacctttgagggtctgcactgccccagcaaatatccccatgctagaaggagcaaaatattaaatggcaaattttaaaaatgtaacaagatgggttgcaaaagagactacagaggaaagcaaaagttttgtattttagtatcttccatggcacttttcttcctagcttttgaacaaggggccccacatttttatttctcactgagccccacaaagtatgtagccattcctgcccggagtgaggacttttaaaacataaagattatcaagtcttggaaattctgattcagtagatatataacaggtctcaaacttaattatgtaaagaatattctggagagcttccttttacccagtcccacccaccaaatattctgataaattaagcttcgattagcccccagatctgcattttataaggatccccagatgattctactgcaattggtccacagaccatgcctggaccgaatttgggtgcttaggagcacaaattctggagccgggcagacttgagtttgcttcctagctttaccaactgatctcaggggagttaatgtttacctctaaactttagctcatgcatctataaataaatatattaatatcatgtcataaggatattatgttgtattaaatgtctttaaaacaccacaatgattagcccaaagtaaacactcaataaatgttcaaaaatttaggaaaattgttaagactgggttgtatgcacactggtgtttattatattatgtagttttttctgtatttttacaacatttcagaattaaaagcaacagctagaaaaagagggaaatggccgggtgcagtggctcacgcctgtaatcccagcactttgggaggccaaggcgggcggatcacgaggttgagagatcgagaccatcctggccaacatggtgaaaccccatctctactaaaaatacaaaaattaactgggcatggtggcatgcgcctgtagtcccaggagaattgcttgaacctgggaggcggaggttgcagtgagccaagatctcaccactgctctccagcctggtgacagggcaagactccgtcaaaaaaaaaaaagagagggagagccagagtatgaaaaaggaagtcagagccctttaatgagtcagctttgtaggtctccaggtaggaggctagtgcttcagtgtctaggacatagtaggtgttcagtaaattaaattcaggacaaaaagaacatgccccaaggaccatctgatatccacttaaagtgatggactacctcgtttcccttgtttatgaatgggttcatgcctaagactgtgtgcactttaatacaagggcagtcgttcagaactagtcaggtcctgaaaaggatttaccaaatgttgagtgtgccctctagtgttcacacttcccagctttcttcctataaaggtggatcaaggcacttgcttacaactggaactgaaatcctccaagtcgatctagacattgagatggagaaaatattcattgtcgactgtaattatgcaacgaatatccagttgagataatggacttgcctcttatctaataatacccaggctcaatgcgtcactgctttgtccactttgcccaaaattcaagcacagctaagttgatattttaggacaaaggcagcttactatccagccagaggggagtagaatatggttaagagagagtggaaagaatgaatgagccctgctattcctcactgcctggatggctataagcacagcccttatggaggccttaggtcttgcttcataatattccagtttgaaaagggtttgaaaagacctcctagaaaaatcagtagtttttctcttttgagtaacatgtagcaaaaaaaatttcatcatgtaggtacagggaacaccctaataactattaatctcaaggagtcaagccagtgtgtttcctaatgtatctgctgtatccccatgaagcaaattttgccatcagagaaactgactcatggggaaaaaatccaaggacctcaaatcaccaaaagaagccattcctcagatttgcctaagcttaagcttccctgtctctcattgtgtgttgctttcaatgcagttacataaatggcttttttgtttatgcaccaaaaacactaattcatctgcaaagctcacatttccagaaacattccatttctgccagcacctagaagccaatattttgcctattcctgtaaccagcacacatatttatttttttctagatcaaatgtattatgcagtaagagtcttaattttgttttcacaggttgttttgaatggtaaagttgatgcattctgtggaggctctatcgttaatgaaaaatggattgtaactgctgcccactgtgttgaaactggtgttaaaattacagttgtcgcaggtaaatacacagaaagaataataatctgcagcaccactagctctttaatatgattggtacaccatattttactaaggtctaataaaattgttgttgaataaattgggctaaaggcagaagggtcataatttcagaacccacgtcgcaccgtcctccaagcatccatagttcttttgatatacccctattatcactcatttcagtgaggtacaattagttcttgatgtagccatttccataccagaaggccttcccaaaaatcagtgtcatgtcaccgatccttttatctctggtgcttggcacaacctgtagcaggtcctcagaaaacaaacatttgaattaatggccaaatgagtttgtgctcaaaaaaggggtgaggatacttgaaatttggaaaatctaggataattcatgactagtggattcattatcaccaatgaaaggcttataacagcatgagtgaacagaaccatctctatgatagtcctgaatggctttttggtctgaaaaatatgcattggctctcattacatttaaccaaaattatcacaatataagaatgagatctttaacattgccaattaggtcagtggtcccaagtagtcacttagaaaatctgtgtatgtgaaatactgtttgtgacttaaaatgaaatttatttttaataggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccgtagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcataccttggctttttgtggattccattgatgtgaatcagtcaccctgtatttgatgatgcatgggactactgacaaaatcactctgaccccgccaagctgctgccttctcctgccccaacctcacccccagccaggcctcactcttgctagttcctttagttcttttagtcaatatatttttgtcttcgcatataagtataaataaacatatttttaaatttcttggctgggcccagtggctcacgcctataatcccagcacttctggaggccaaggtgggcggatcacctgaggttaggagtttcaggccagcctggccaacatggtgaaaccctgtctctactaaaaatagaacaattagctgggcttggtaatgtgcacctataatcccagctactggggaggctgaggcaggagaatcacttgagcctggggagcagggggtgcgggaggttgcagtgagacaagatcgcaccagtgcactccccatcctgggtgacagagtgagactctgtctcaaagaaaataaataaataaatacatttcttgaggcgtttcttgttaaatcattcatggagaggcatcccaaacactacattcaacaaaacactctgaaaaatgttttcaaatgcaatataacacagcagagatttgatgctctgttatccagttttcatataaggcagtgtgagctgtgtcccagagaggacagtggtctgaatccacctgagacagaattgggtctaactaactgtgagtatggccttcaataagtcactctccatttgggaatttgatttctccacttctataatgagagtatttgacaggatgctctcccaaatcccttgcaattttgttagtctgtgatttcatgtttttatttttattccttcatccaacaaatagtcaaggagtaattgctgtctgccaaataccaacagtattcattaaattgtaattcagattttatatatatataaataatgtataatgtgtataaattgctttgtgagtgcctactacactgctagacagtagttgctcaataattgttagctgaatcagaatccatgtttatcccagagtagcaattagtcttgcatcgagtatcgtgaaagaaggccacgcttaaataagaataatgcctggggtttaggttttatgaaaaaatgaaaggaaattagttctgcttttgttgactaaaggaagggaagagagaagagactataattgtctgcctcagatttaaggaggaggctaattcatgcattaaacacgttacttcaaatttgaatgaccaaaggtctgtagcctcagcacttcaaaattggtaaaagtaagacactctggccttgtttccatagagaccaccccttacaaaggcaccaatgggaaactggcctcaggactcctgttattggtcttctctgtggcagagaaaggagctcttggacccataaatctctgagccacagttctttttgccatgggctcaaaaatgattgaattcatcatgagccacctgtggcatattgccaccactaaacatgtggggcctttaagctcactaagagccaatgtcttcagagccagccctggcttgattctacctagggcatttgcagttgccatataagaatcattagtgctttcaaaattactgtagatactttgcctaaatagactaaaacatgctgccgtcatattggaagtgacagattaaaatagaactcttgccaagtgaaggaaagtgtgctaatataatgcagtcattttaacttgctgtttaagtgtgattgtttttagttcttttgaatattatttgttttatactgacaggaacgaagtactgtccaattttctctgccaaggaaaaaagaaaaggtgttcttccttacttacctgaaccaaaacagaccagtttacaaaattgcctaattataattgctaaacaagttccgaatgcttacagtctaatccaagaatgtcagagctgcaagggcccttaaacaccatccaatccactccactcatttagcagatgaagagattgagggcaacataaggccaggcccaagataacacaatgacagccaggactagagctcaagtctcccaccctgcactttgaaagaataatgctttcaactggagtacattaactctactgtctatatttttagggcagctggggcattctgcattggtggcaatcctctcaacaaccctgggactgaaaactgcctggaattcttactaacaattctctaattgaccaaaaggtgacgaaatcaaggagaccaataaggtagcttggaaagcagagtggcagtcagataacaaactggagcttcaacccctggctcatagcaggttctcagtaaatacatgtaggataaacgtgtggtgctggtgtctggcgtttagcccagctgtgggcactgggccttccagatgtgacatttgactactatagcacattcaacagtgtcatctggcacacagtcattccagcaacaattcaactttattcactgcaactgtgctggggaagacgtgcggcacacggagacagcaggttactccagaagctgtttgagggttgaaggcaggcttcaaaggcccaccgaagctgagattctaacaatgcattgcacctgcggatgattgggaaacagactacagatgctgaaaggcctctctgagtaaagcaatcaggaatcagagctctttttgaatctgaggcttatgccatctaaaaaatctcagggttaaagccataaaaatcagcatgttgtgtaaactgtggaaactattgaaagaatcacagcaggcaaaggactgtgggacccctgctcttttcaatcaatccaggcccacaaatcactctagtcattttttcctacggtagtttcgaggcaaatctttttcatccagtctttggggctatggactgccttgagatttctgagtcaatctcaacttctaatataggtatcaaaagtgaagaagagcaggcagatcttttcttgcatatgtagacaaagaggcaaagacttctgtctggaagaaggcagagacattttctccatgccttcacagaactatttcaaactcctggccaggtcattccactctaataggagagctatccttctattctcttggttaagagaaagctggaaatagaaacagggatattccaggccagacacaatggctcacgcctgtaatcccaacactttgggaggccgaggcaggcagatcacttgaggtcaggagttcaagattagtctggccaacatggtgaaacccatctttactaaaaatacaaaaattagccgggtgtggtggcgcacgcttataatcccagctactcgggaggctgaggcacgagaattgcttgaacccaggaggcagaggttgcagtgagccaagatcatgccattgcactcacatctgggtgacagagcaagaaaggaagaaagaaaggaagagagagagagagaggagggaggaaggaaggaaggaaggaaggaaggaaggaaggaaggaagaaaggaaggaaggaaggaaagatactaatgattccaaaggctttcattcaaacagttgctgcattgtaatgttaagtatgagatactaattcataaaaatttaccaccatagtaaatctccctgataccatcactcttaaacctttagaaatgctacagcatctagcttctctagatcaataatcacagaggcttaagtgctgacctcataaagataaagagttcccatgatttacacattacgtgctttcataaatatctatatataaaagcctattttcctcttggactatattacaaaagtaagtatgcattttcataagattcaaacccagctctaaatgtaagaagccaaattaagaatgtagcaatgtatgaatgaaaaggaaggaaaaaagccattactaaccacaactctgtgcaaaactccctgtcatctaaggtaggaataagatatttatcttgaacacataagggaatatgtcatagaaagggagacagggaggttgaggcaggtgactggcttgagctcagaagttcaagagcagcctgggcaacgtggcaaaaccctgtctctacaaaaaatacaaaaattagccaggcatggtggctcatgcctgtagtcccagctactcaggaggctgaggtgggaggatcgcttgaatctgggaggttgaggcagcagagagccatggttgcaccactgcactctagcctgggtggcaaagtgagaccttgtctcagaaaaagaaaaagaggaagggagggagggaggaagggagggagggaggtaagggagggaggaagggaggaagggaaaggaagggagacaaaaatacaaaaaaaaaaaaaaaaggcctcctgcattcactttcttcctaggctataaggaggtgttttcattaatttctaggaaatgtaaaaaagattagcctaggaaactatggttataaccctggcctttttatctcctgttttgtgtttgtcttctccataagctgtatctacccctcttgtctgtgctttctgtcctcatttaggtagctattttgtttttgtaccttatttttatagattcagctcttagctttcatttcaatctctttctccctatagctattacccaatcaaataaccttgtgataaagtttaatatctgaacaaaactgttgttcttggccacagggatttcgtttctctcaatatgcctcccatattttagttgtctatgttctcttccatacactctgtttctagtcctagatgaacatgcttaagattagaatctccacttccttagtttagaaaatctagatttaagtaacagatatgctaaaaggacaggtgcacattacctaatagtgggattgttataattcagaagtcttagtacactctaataaagaattttactgtacactttctatgtacctagcgttgtatctatttcctaaggtgcaatgaatggtatgctggaactggcatatacaaactaactctcaaaaaccaatgttaaaagaaaaactttagacaaaataaattcaactggaggtcattatattaagtgaaataaatgaggcacagaaagataaacatcacatgttctaacttatgtgtgagatctaaagatcaaaataacttaactcatggacatagagcctagaaggatagttaccagaggctggaaagcgtagtggggggttggagggtaagtgaggatggctgatgaatacaaaaaaatagaaagaataagacctagtgtttgatagcacaacagggtgactatagtcaataataatttaattgtacatttgtaataactaaaagagtatcattggattgtttgtaatgcaatgcataaatgcttaaggtgatggagaccccatcttccatgatgtgattattacacattgcatgcttgtaccaaaatatctcatatattccataaatatatacacctactatttacccacaaaaattaaaaataaaaaaggaaaacaaagaaaaagattcaacagagtttatctgagcaaagaatgattcatgaatggtgtagcagtcagaatcaggggaggttcagagagctctgctgcagcagcctgagcagtgagtttttatgggctgacagagaaggaagacaaaatatatttaactggttagagtggaaataccctagttagaggtgagttgctgatttctgattgataaagtctccagtctccttttactgtttacactgggcttcagtttgcttatgtaggaacttaaagggcttgagcggtccaagtcgggtatccagtggcttcccctacccttttttttttttttgaaatggagtctcactctgttgcccggacttgagtccagtggcccgatctcggctcactgcaacctccaccgcccaggttcaagcgattctcctgcctcagcctcctgagtagctgggattacaggcacctgccatcacttccagctaatttttgtatttttagcagacacagggttttaccatgttggccaggctggtctcaaactcctgacctcaggtgatctgcctgcctcggcctcccaaagtgctgggattacaggtatgagccactgcaccagccacttttttaacaccaattttgcacatcacttcctaacttccagttctgtgtcctcatgttggtagcttgaaatctgccatggtaggaatctttacaccatagaaatcaacaaatggtacaaatagggttttggtgtgtcttttaaagagaatcagttgcttaccatttgccaacatacaactggacacaatataattgtttgactaacaactcgtcatttttgcagtacagctactcaattattgctatgactgagcactaaattcacattgtaaattaaaatataaaggttgtttaagggagcaaaatgttcatgaaatagaaatattgagaaaaccaggcctttaaagatgttcacagatggtaacagatactttgtgttgtaaaataaaatgtaacatttcttaagtgcaaatatttctcctacaacacattcacacattgtaatccaccaaggtttattttatggtatttttctgctgtgccagtatgtcagttcatagtaatttgtaatatgcttataaaaactgtggaaaagagttcttgactgctatttttggtaagcatgtaagaacactaaaactaaaaaaaaaaaaaaaaaaaaaaaaaatttccacagggatgtatggaaggtaagtgtgatgcggtttcactacatttcagtcagggggcacgacattttattccacttttccagtactgaactaaagtgagcagaatgttatacagtgtaaaatgattttgacatttaaaaatgtattcagaataatatcttgaactcccaagtaccagcatccatccatttctcatcttttatttctctctctctctctctcttcagaggtagctatctttcttagtttggtgttcatcattatccagcatgttcatatactttaaccctaaactatccactaaaatatatatttcgttttacatattttaaaacgttatacaaatgctatcatattgtttctatcctgcattttttttcctgtgggattcatttatgatgatatgggtagctctaggtcatttattttagtttctatatcaattttatggcatgatattcaataaactagttatgtaaccttctgtttgtggtaattcatgttgtctctaaattttttactcttctaaacattgctgctataaacattctggcacatgtgtgagccttcgtgtggggtacatccttaggagtaaaaatgctaagccatagagcattcacttcaactgtacttggtattagcagatagctcaccaaagtgttatcaatgtatgctcccagtagtagcatgtacaagttcttgcttcatgtccttcccaacggttggtatttttagaaatatgggcagatttttgagctaataatattcatacatagaatgcctacttttgcattgaatccaggtaatttgaaactatttgtaaatgtatgactacagccctaagtgcttcttggggtcagtaaagaaattattttagcctctaatatgagattacaaaatgtccattatgatatttctcttttaagtcatttttattatggttgtaaagttatggctcacttaattacttaacatgttatcatttggtttcttataacttcccatgtaaaagagtgcattcactatcaaactgtgctataacctatcaactaagacaactcagcccaagtccttctcatgctttaaatttttctgactctctcttctccacttctgcttcattataattttttaaatttactttttttttgagatagtgtctcactctgtcacccaggctggagtgcagtggcatgatcatagttcacagcagcctcagtctcctgggttcaagcaatcctctgcttcagcctcccgagtagctgagactacaggcatgtgctaccatgcctggctaattttttttttttttttttttaagagctggggtctcactatgttgccagggctggtctcaaactcccgagcttaagcaatcctcctgccttgacctctcaaagtgctgggattacaggtgtaagccaccaaacccggccataatttttcatttgttctccagaaaggttgtgtttgtcgcttattttggaaataattaagttagtgagtctgacaaatttttagatgaaatttatctttgaaatggtttacattttgttttgggtgggtttaaggaaagtttcatttagcttaaggaacttaatcttcacaaagttcaacttcattggctgttctcagtacacattatgagtcctatttgatggacacatgcttaaaacacctcctcagaatttaatgtgcttattcatacacgcaaaaaaatgaggtgatcaatatataggggcaactaagccctcaccaaatgcaaaggacaatttaatacttaactacgtcatgaaatttttaaaaatgcattttgaagtaaaaagtaattttttaaaaatctggttgtcacttttactaattgccttttgaacagtataaagagtttagtttttgtccataacaccggtttcttcccatgttttcccataaaaccccttgcaaactgaccagtcgaaatcaatgtgaggaagtgtactgaaatgtaataaaaatgacttgttttgatattttattgcctgagacttgactcattaaacaccgtagagtctgctgccctgcaggaagaaggctcctgtgttctaatacttactaaataataagcattttcctcagtgaaagtctgttgagtgaaaccaggttgatttctgactagacccaaaacaaaatcactgacctgatttctcttcaagtcaagtatttcttctgctctcctacactttccacaatgtattatgaaatttttctcttaagagaatgtaaacgcttagatgtcagggtggcttttataacaaccacgtatttttttagattttttttattattatactttaagttctgggatacatgggcagaacttgcaggtttgttacataggtatacacgtgccatggtggtttgctgcacccatcaacccgtcacctacattaggtatttctcctgatgctatcccgcccctagctccccaccccccgagaggccctggtgtgtgatgttcccctccttgtgttcatgtgttctcattgttcaactcccacttatgagtgagaacatgtggtgtttggttttctgttcctgtgttagtttcatgagaatgatggtttccagcttcattcatgtacctgcaaaggacataaactcatccttttttatggctgcatagtaatacatggtgtatatgtgccacattttctttatccagtctatcattgacgggcatttgggttggttccaagtctttgctattgtgaatagtgctgcaataaacatatgtgtgcatgtgtctttatggtagaatgattaaattcctttaggtatatacccagtaacgggattgctgggtcaaatgtatttctgattctagatccttgaggaatcaccacactgtcttccacaatggaacaactatgtattttatattgtgagactcatgtgtaattttggaaatatcaccaatagcattttacccctcaaacaacacaggaataaaacttgaatacacattttatttttcagggagttctttggagacgaatttaatttgattaactaattcactgatggtgctgatataatttggatgttgttcctgcccaaatctcatgttgaaatgtaattcccaatgttggaggtggggcctggtgggaggtgattggatcatcgggacgaatttcttgtgaatggttcagcaccatccttttggtagtgtcctcatgata

SEQ ID NO: 432 - DNA, 57984 bp, Homo sapiens
taagtgaaataagccaggcacagaaaaacaaatattgcgtgctctctctcatatacgggagctaaaaaataaatgatcttcagagttgaatgatggctaccagaggttgggaagaatagtggggaggcagaagataaagaagaggtggatcacgggtacaaaaatagataaagggagtaagatttagtgtttggtagcactagtttggttagctagtttggtagcactagtttggctagttagcttggtagcacaatagagtgactacagttaagagtaatttattgtatatttcaaaataactagaagagtaaaattggaatgttcctaatacaaagaaataatatcccaattaccgtgatttgatcattacacactgtatgtttttctttgttttttgttttgagatagggtgtcactctgtcgcccaggctggagtgcagtggcgtgatcttggctcactgcaacctccgcctcctgagcccaagtgatcctcccacttcagcctctggagtagctgggactacaggtgtgctccactacacatagccaatttttgtatttttttgtagaggcggggttttgttgtgttgcccaggctggtactgaactcctaggctcaagagatgcgcttgcctaggcctcccaaagcactgggattataggcatgagccaccatgcctggcctacacactgtatgcttgtatcaaatttgatatgtagcccataaatatgcacatctattatgttagccataaaaattaaaaataaattagaactgaaattattgaaaaaaaataagacaactatagtgatagaaaacagatcagtgattgtcagaggtgaaggaaagtgtaactacaaacgaatagcacaagggtgttttttgaggtggtgtaacatctatatcctaattgtggtagtggttacccaaatcaatacatctattacaattcattagagctgtatgtcaaacaaaaaggctcttactgtacaatcatttgaaaaatgaaatttttaagatacatattaaattatgtgtagctgtacatttcctactatgtacattttcttttttaaaattttctgtttttaatttttgtgggtacacagtagaaatgtatttatggagtacatgagatattttggtataggcaagcaatgcaaaataaacagtatggaacacttcacgaatctgtgttatccttgtggaagggccatgctcatcttctccgtaccattccaattttagtgtatgtgctgctgaagttagcatgcatgtccattttcttttagatgatacactctgaatcattttcatttattgtagttgaaagagtaactggtaggcccaaataaatttctttatatggtgtttttccccttcaccttcaaactaaatactttgaacactttttctacatttatttagtctgccatccatatttagtagctttatcttgacatttcatactattttatataaaagtataacttttgcttaaggaagtcaccttcccaagagatcttttaagatactccctacgactcttctcaatccacctcagatcgctctaccagcttttcatattcactctttttcctccttattctattcttcagtgcttgtcaactacaaagcaatcatggttcacataataaaataaatgcagagtcactcaccctgtagagtttccacggtgggtgccactggggttttggcattgtaggggcttttttagccatcagtgcagagttcttggtattgccagtctccatgacaatctagacatagaagagacattattattattaaagacatcatacctaaggcttcatgatatcaattcagaaatggaaatggaaagagggaacttacaaaagaatttttccataaatgaagaaatacaattttctgtatgttaacttaaaaaagcaattataaaatcacagacaggcagagcattagacttaagagcacacatcactgtgtacgggttcaaaacccagcttggccaattactagctgtttgacattaggtaacaatcatgtaacctctatgtggctcacctgtaaaatgggaagaatagtgcctatttcatagggttactacaaagatttaataagtagtaaatgctccatgtaagctcccaatattaaagtcattttaagtgtattagtgccactgtctttcattgtcatattttaacattattggtttaatatagcaaagactgacagttccttctatttatcttctaatacaatatttaaatactattttaacaggtatactgcctgatataccatctgttgttagcagtcatctagtcatccaaaacataaataagcccataaagttcctgccctcaagaagcttaaattataccctcataaggagggtagagagcctggacagaagacgtgctctgaatggaataaaggaggaaaggagatgtggcagttacacattcattcacttcataaagtcaaatcaattgcataatgagctgagaagcaaaaccagcacttatttcaagtggcagcatattttattatgctgcagataaatcaataaaataactatagaaaattcaacaactatttctaccatactaataccagttgccatttacttacaaacagataaacttatttctaaatgctcatttataagactagttgtatagcccatgaatagtacaacactaacagcactcaagataactgtacacaccaacttaaaatttaataaaaaaaaaaagactttcatattcaatacatactaacacaagtttcagaaaaactctccttgcatttttaatagtgggcaataaataccaacatcacattatctttatcaaaatatatattacacacaatgtacaagtagacaaataacagaattaaattccaaaaaatacgttaatttactaccaacttgagttttagggctatgaaatatgaatgactagctcaggctgctatttatcttaataattccaaagaagagggaaatatggcaacatgttccaaaagttagaaacctgctatttgatgcagaaaaacttactgaattcatcgctgtaggctgtggacggtcagaagccccaggatgtcggtattcacttccactaggggcagtacgatttgcatcagccctggggcaaaagaaataatattttcaaagtaattaatgcctccagtcatgtattctgcaaaactaaccctttattttaaattgttataaagtcctgataaaggaaaatgtcatataatagttataaagaaattttaaaaagaaaaaatgtgaacagtgaaatatgcttttaagatctttgtaattataatatttcatacttggtctgcaaaggtaatgccaccgctaaggactgtgcagctgattcacttggcattctctggatcttagtatctgctgtcaaagcaacccctattaaaatgaaaaatcaacttcttttagtagctgtgtattattcatttacatgcacttaaaataaaatgatgaaggaaaacatacaccaaatgtttattatctccaggcagtgatattatacaaatttgattaagttttgctcatctttgtttttaatttctacaataaatactgcttaataacacgtaactcaaatttgatttgatcacagcccacatggtattaaagcagcccagaatagtaaagttaatttccattatatttgggtattagtttcaagtcagtattaagcagttcctcaaatactaacagaatgtttccaagagtggatgtaacttactaaaactagaaacacccaatttccctgtactttctttacatactaagccttttgtcctctaccctgttacactggccactccatctgtggaccaatgccttaatacagacagaggacatgtttctcagatactgcttctaacatttccatcatttttacaagcttagtgatatttacatgtctgcctaaaccaccagataataaataactaggcctgcaacagttttactgtctttgaattcctagcacattgcctgaaaaattatacgtacttaagaatgtttgctgaatgaaggcatatgagtattcattattacctacaaagctatgcatggatgcttggctactgagcttatcttgcattttataggcaacaagaatctcattattggctcgttagtgaaaatatatgtgacatttttaagacattttcaatatataacagctcactaaccaggtcctggtgggtatggatgtgtacctgccacaaagtattcaacttcttgtcctaaaaaaacacaaaaaaaatcaacagtagtgaatttaccttatacaaaagttatcatctctttaaatgtatcaagtaatattaagttttcaactggatctatcaaattttctcaactaaagtcaagcctcagaaataagggaagttgatcacttttgctttgatctctgtaaaccatgtccttgaccatttgctatatagcaatggtatacaaagaagccctcctatcaagtgacaatccactctggtatttcttccaagcaaatggtttcctgtggaatcttgaattctctttacttattaagatttcagtatttaatttcatctttctgaattacagacaagatagatggtgtcctcacaggttaagaatattctccaattttttcctttaatctctactgtgaccttctccacactctaagaatctctgccatcattatactaccatttttatttcctataagaaaaaagtcatcaacagtattcccatgaggatcaaaacttccattataatacaggtacggccattaaatactgtacgaccacaataagtcctgccaggaggggcaaaaataacatattttatttttctgtttttaaaattcacatataagtctgacatttctgataataccatactcaccttgattggcagggtactgtttatgaacatatgaatccgttgcattctgaggacccttctctttaagattttcttttgaagtaggcatatgcaacacaggaccatactcattacgaagcttgattgccatttttcgtttgtgactatttagaaattataaacataagaacgtatccataaatactttaaaacaaacacttagcttaagtttgcccattcacgtagaaaaagtttctagtatgattttaagtagtatttaaaagaatcaaaaatttccaagggcatttccccaccatatctgttcttttgcttacattcgaccacacagcattcattaaacctacgtaatattttagtttgttacctaataaatagaaaaccttttatgataaattgtcaagggtctgactgaaagatatacagaaactaacataccctttaagaaacctcaaagtcaatatactttccttcaaaatataaatatagtaaaaactctatagcaacctttactagatgtatccaaacaggttagttagaactaatcaaagtacttaattggttcaatatcttaaaaagaaatgcatttatattacttttaaaaatagtctactttataaattaaatataaatgcttgtttgaggagttaagtagattttaaaaaggtaaaggacaaagaaggaacactgcacataatgcattcccagactggagctggatatgtagaaccaaaaatatgccaccactcaaaaatcttcatcatactaacgagaaaagatgggagtagaggtactagccaggtacaatttcagctcagcaaggctctgagagcagcgggaagctgaaagcacatacaaagtgattgattataaaataaaatacctaaaagggactctcttaattactgggtatttgtaaaatgcaattaattaatggaacttttactgtaaaaggccaaaaaaaaaagttaaatcagcttaaattatgccaaaacaccactcattattgaataattagcccatgactagcttatctttaaaggactccctctccctgctctcttcccctagtattagaatgttaagtattttagcaattgaaaaaaaaaaactacaccaacctctcttcatctaaaggcacaggttttccattatcagctacaaacatgtcatgggtcctcttcaacgacctgaacacaagggtgtgtacagaatgtttctgtacctcctaaaaaaaaagaatgtaattacacacctatctacaaattacacaaatcataacctaaagtcagattgattatacacttcacgtgtttaaatatgtaaaaagctttataccactcaccatagctacttgttgcaagctacaggagtcaagttcagagaagaggaggaagctcctctttggctagaacctcaggtttagcaactgagtgatgccggagtttaacttactcaataaatatttactgagctcctactgtgtgtctggcaggtattgtgctagaatctcacaatagaatgataaaaaggtggtcatggtccctgtgctcaagaggaaacagacaaataaaaagtaaaataattccacattttgataagtgctatgaaggcaacaagcaaggcgctgagtcagggaatgaaggactaagtataattgtgaaagatttcactaaggtgatatttaagcagaaagggagttagccttgcacaaaacagaggtaagaacgaaccaggctgatggaaatgtcatgtaaaaaaaagttcagttaactgaaataatacaaggagcgcagtacagctgtgtatggaggatgagatggtgctttgtagctgcaagggtagacaaggtccagattaggtaaggtcttttagactattacaacagcctatattttgttctagcaacatagggtcagtaaagggttttaaacaagaaaggtatgaacaacttacgttttaaacagaacaacttatagaacaaaatggaagcaaggaaaccaaccaacggggagctaatgcaccagtccaggtgaaagatgatgttggtctcaattaaggtggactgcagcggatatggagaagagtgaatggaatcaataaacatgtggggtaagatggacaagaccagctaacagcgttggctgttcatgccagggaaagatgtaaagaacggcaagtttttctgggggtagaggtgaaataagagacgacctgaacgcaagatagagaagactaccaatcttttagggcacagactcactgacactgccccgagggcggcaagtaccagtggtcgatcaccaacagaggccccgcctccgaggacactttccagctcccaagagtcaaacgaggactggacgaattatctcaggcttcgcgcccaggctgaacctccgactcgggttctcatccggcttctaccccttccccgaaaacccgaagaagagaccactcggccttggccaaatagctcccctcgtagcctcttttctctctggactccaagtactctcaatcccccacgcgcactgccaaaaaaaacagtccagagacaaacgactcttgagagccccagtgtcactttacctcgaccatgatgctaccgtgtatcccacctccggcagggaagaaactctaatcactaacgcagtacccgccgccacagctgtgcagcaccttccggaattgggcgcccaggcggcggatgtgatgcaagctctgcgcacgcgcgctagtctccctcggccatctaggatcaggaggcgggtctccctcctcgggaccgcctctagggcggagtctcgaggctgaaagccggagactcctggaagggcctgggtggagggtttcactcgtccctctgaagaaatcttagaattatgttttctgccttagttggggtcctggttgttcgtgctgtattccccggaagcttaacgctttttattcagagaacctaagcgtctggagagcaaactcccgtgggctctatctaaggcatttccactaccttgatctctttggaggtcgcctgcgtgctttgtgtctcctggttctaatcctggcgagaagcacttggacacttgtaggcttaacacctgaaaacaatttcgcttaaacagtccagtaaacacttgttaagtgaacgttgaggaatagctgttttaatttggaaaattttgacatgtagttataacaaaaccccatatttattttctgctaatagatttttttttttaatttctcaaaactgcatagctcttgtccatttcctagttgcctgctgattattgtggcttcaacaatgccagggtacagcttttcaaagctggtagaagacacaattggagactttagccatttttatttatacatatccttgtgccaagtattggtatttttgctttctaccctggtaaaatctgtggtttgtgatcaaccctacccaattatttttctatgtaaaaaaaaaaatggatggacttaggcatttacaaacttaaatagacaaacattttactggccctgtttcagtttcactaatcctgtcctgagagcatactgcttacactttgagagggggaaaaaatctagcaaaagaatagcaatataaatcaaccttacttggaaattcattaaaaacattaaggtcatgggtttttgtttgagacagagtttcgctcttgtcgcccaggctggagtgccatggcgcgatcttggctcactgcaacctcagcatcccaggttcaagctattctcctgcctcagcctctggagtagctgggattacaggcgcccgccaccatgcccggctaatttttgtatttttagtagagacagcgtttcaccatgttggccaggctggtcttgaactcctgacctcaggtgatccgcccgcctcggcctcccaaagtgctaggattacaggcatgagccactgagccctgccttaaggtcatgtttttacttgaagatacagcatctctgaatttaactgtgagtttggcctaagaattgcttttctgtaaaggtggcaggtgatggtatttccttgcaagaaaataccataattgtaaaatatatacttgatgaactaaataatatactcacctattaataataactatagaaaataacatgatttgaaatgacaataaaaccatagaaacctaagcaagactaatatatatggcaatatattaattgtctagttggatctattaactttttacatatttaatcatcctggagacattaatttaatttctcaataacaacatggtaatgattgaggtaaattgcctcgaatttgctccttttaaaacactgtcgtgaatttatagaatgatgtcatccccttgaaagtttacaatattttagataaatatagaactcaagtgaccctattatttagttcagggattcatgaattatgtatattgtaggaaaattttgtatttatatgggaatatgttttattttctggagaaaggatccacaagtttaattggattcctgaaaggctccgtcatacacacatggcctggctgacacccgaagctgccttatttgaacagcaggtgtcaccactgctctttgtacgggccctcagggctgtccttaaagcagacacggcaagtaacttattaatataaattattagtattatgtctgtgtaaaaccaagaatacaagttttaaggaaagccctccttctttaggcaagattttttaaactcaccaatacagaaactctttttattctccttcaaatattgtcctttgctcttgaacagtgataggtcatatgagtatagatttgagtgccattttcatcagctttttatgatatttttataggaagtgttttctgattcttataaaataataaatattactatttatttttctgtttcaacttagagggttaaatatacaagctttaaaaaacactatatgcaatgttctttagagttgtgtggctcagtatgtccatcccttaaatttcatatttgaaattgttcgttaattcaaaaggaagtaatcatgggagttatcactgtttatttgaatttctgaggtcaaaacctgtgaaaaatgatacttggacatttcttccaaaactttggtctttaattgtttagcacaatgctatgaatttgcctaaatactaaggtagtgttagcagatactttcttgtagcatagttgaaacaagcttctgggactataaggaacagtgaaggggctgttcttcctgttaatgcctggaaagactttgggaataattagattgtactatcagttataaactgtcagttataaatatcttagcaaggtgtatgtgtgtgtgtgagagagagagagagagtcctcgggtcttacttatcacaatttcaccatcctctactacatgaagccccatctcatgtgtattagtttgctagggctgatgtaacaaagtaccacaaactggatggcttagacaacaaatgtttattgtctcacagttctggaggcaagaggcttgaaataaaggcgttggcaaagttggttccttctaagggctgtgagagagaatgtgttctatgcctctcccctaacttccagtagttctctggcagtctttgccgtttcttgtcttctgctgcatcactgtcatgtctgccttcatcttcacatttcgttctcactgtgcatatgcctatgccaaatttctccttcttaaagaacatcaatcatattgaattaaaggcccaccctactccagtatggcttcatcttaactaattccatccaaaaataccctatttccaaataaggtcacattcttagatactgggggttaggaattcataatgtgaatttggggggacacagttcaacccacaacactatatcacaaaataagtgacaatattgaacataatcatgacttttgttgtttacctttacaaataagaatttgtacttacaaatatttgcaggcatttacaaatgtttttattttacagaaatatttttggtgtttatactgccacagaagaaataacaatgtcttggttccagctttcttagctgaatgttttgttgtaatatttgtttaaatatctgtatttcccagtagacttatggggtgaatatggcatgatgtttactatcacacagtcagaatctaattgacttgcaactggtaagttttcaatatttattgaatgaatgaataagtaagctattatattgtacacttaaatatgggtttaggtggctttgagagcttaattttttttgagacggagtctggctctgccggccaggttgaagtgcagtggcaccatctcagctcactgcaatctctgcctcctggattcaaatgattctcctgcctcagcctccggagtagctgggaatacaggtgtgcaccaccacgcctggctaattacttgtatttttagtagacatggggttttaccatgttggccaggctagtctcgcactcccgaccttaggtgatccacctgtctcagcctctcaaagtgctgggattacaggtgtgaaccactgagcccagccgagactttaattttgatttggagttgcagctactgaacatgtaggaaggatggtctgtgagtgtgtgtgtgtgtgtgtgtgtgtgtgtgtgtgatgtgctcactccgaaaagttgctatttcagtaaccattaatttaatcacagtctttctgtgtgtgtaatgcagataattgcttataaaaggactgttcagttctgtatttctgatctttgtaaattttatgacaatgaaaaatattttccattacatttaagtaagttaattctaaattttatttagtttctataaaacttagcaacttagttacaaaatacaatttatctgtagaaatatttgcaacagtcagtttagttagcagaaataccttttgacatgaataattaagaagagtaaggcatttgattgaatattttactattattattaattcatatttatagatcccattatatttatattacataatgctatttagacacttcaggctttcttttagaaatatgctaccaaaagccagaatcatgttcacagagaaatattaaaaatattcttattagtcacaatacaaggatgtccaccatcaccactattatccacgtgtattttttatgaaagcactagtcattcaattggacaaaaaaattaaattgtgtaaaataggaaatagggatgaaaagttatctttatttgcaaacggtatgactttctacctgaaaaaccaattgaaaaaactattcgaaacaatatgaaaattcactgagtataaaaatgttattaaaaatcaatagttttcctttatgcagttaaaaatacagcagggaaagggatttttatttaaaatagcaataaattttaaaatgtgcaagacctaaaggaaaaaaaaattaagagacgtgaaaacctgaatcagggacctccctcctctctgtgcatgtggcctcactactgctgcttctggagggactgaaaaatccctgagaccagcatctcagggatgctggtctggcagtcagagaggtctctgagctgacaggatttcctgaaatgctgtgaaaattttgcatcctgaaatccatgctggaatcctggctcataatatcccaaaaggtaatgctgacatggccaggcctgattgttgcctgtaatctctatcccttcctgaagacagtggcttctccaggtgtaatggttgagaggctgttgagcaaattggtactggtagagtaactttactgagagatgccaccaaaaaccacaatccagtgacagtggtgtgtcagaggactatgaggcagtgtccacagacaggcagagctccaagagtaaggacaccttcttggagactaggtgccagttagtcttgaaggcattcacattcacttatatggcacaatatgatgaagcaatttcagattacctcaggaaatagcacagtaaaggaatatctcagatgcccttgcagtacagaatgatccctcatcagactcctgtgcagctatacacactgaagcctaagcttcccatcacagttctaaatggagcccctggatttaaaaacttttgtgatgctttgaatgcctggcagctggtgaaggaactcaaagaggcattaggcattctatctgctgcccttttcaaacatgtcagcccagcagatgctgctgttgaaattccactcagtgaaaatgaggccaaagtctgcatatatcataagcaaagttaaaagacaaatgaaaaattgggaaatataggcaatgtgtatgttagccacagggctaattttcttaataagaaaagagctctcatgaatcaacagaaaaaatgaacaactcaaaagacaaggcacatggacaggcagttcacagaaagaccactgacattgtggctgatatgtaaattgaaaagattctcagtgtgctcatgatgaaagaaattttaatcacaataacaataagataacatatttcacctaataggttggcaaaaaattttaaaatttgacaacaacaagtgatgacaaggatgagggacaacctaaatattgatgagagtataaatggtggcaatcactttcataggcagtttagcaataagctgacaatttttttcgagacagggtctttctctgtggcccaggctagacttcagtggatgacctcctggggtcaggcagatcctcctacctcagcctcccaaatagctggaactacaggtgtgcactatgatgcctggctaattttttaatttttttgtagagacaggtgtctcactatgttgcctaggctgctctcgaactcctaggctcaagcacccttcctgccttggcctcccaaagtgcagggattacaggtgtgagccaccactcctggccccaaaattgtttgcataccttttgttacaatggatttactttccaaaaatgtccttggtatgtatgtatgtgtgtttgtgtgtttgtgtgagagtgtgtatgtctgtatgaatgtatgtatgtattatatataatcttcatagaaggatgcaaagatatacatacacaggtgttcattttgctaaggtaggaacaccacatcaatacaagagaaaaaatagctttgtacataacaggaagaaactgtccatcatagtaggtaagggtatagagtcagaatgccatgattcaactccttctctgcaagttacctgcagcatcatcttgggtaactttcttctttttgtacttcaattctcccatctgtaaaatgggaataatagtactactctacctcatagagttattgtaagaattaagtgtaacgtactagtaacagtgaccggcacagaattacttgatccataaacattagttatatgatactaattatccccgttgttctaaaaggggagaaagctgcataaatgtaacctagaagtcagaggtcaacacaggcagcttctattttcatcctaaactaaacctaaagtgggcctcgattctccccacaaggaaacctagtacacaaaatactagttagcacatatattagtctgttctcacactactgataaatacataccaagagtagataatttataaagggaagaagtttaattgactcacagttctgcagagctgggaaggcctcaggaaacttacaatcaaggcagaaggggaagcaaatatgcccttcttcacatgacagcaggaaggagaagtgcggaatgaaacagggaaatccctttataaaaccattcaatcttgtgagaactcactcactatcacaagaacagtatgagggtaactgcacccatgattcaattacctcccaacaggtccctcccacaacatatgaggattatgggaactagaattcaaggtgagatttgggtggggacacagccaaaccatatcagcaaagtagattgaaacattgagcaaataacaaaggattgaagggagatcctggacccaatagcatactttgtccatcctcattcaacttgcgtctttttcttagtttgtcgttacctctttattatgtggagaggatagagatttttctgcccacgtctcccccttccctaacattgtatccgtgtttctagaaaccagcctttctggctttctttgatttatatctaggttccatattttttcaagtacatgtttgtgttttttaaaatatatatatggatatacatacatgtatatatatcttttgcccatttttatctatagggctcatgctttctcatcaaactgtaactcttcataaaaattttattaaacctttgtctaatcctgtgcacattttacagaaaatattgttaatctaattcaagtaatacttattagttattaaattgtgaaagatttttgaaatttttgaaatgcatgttactgacatgcaccaaaataaaagtcctcattttccctagagtttcactgctaatactatcagactggctgtcttatttttaagcataaattccatgttggaaagagaagctttatattcaaataatgtaatccatcactaaaggttttcatatattatgtatatgggcggggcatggtggctcacagctgtaattccagcactttgggaggccaaggctggtggatcacttgatgccaggagttccagaccagcctgggcaacatggtgaaaccctatctctacaaaaaaatacatatatacatacatatatacatatatatatatatatatatagagagagagagagagagagagatggagagagacagagagagacagacagggtcttgctttgtcaccaaggctggtgtatagtggtgcaatctcagctcattgcagcctcaacctcccaggcccaagcaatcctcccacctctcagcctcccaagtagctggagtggctgagactacaggtgtgtgccaccatgcccagataattttttcattttttgtatagatagggtttcaccacgttgcccaaggtggtctcgaactcctgggctcaagtgatccttggcctcccaaagtgctggaattacagctgtgagccactgcgcccagcccatatgcttaatatatgaaaacttttagtgattgattacattatttgaatataaagcttctctttctaacctgcaatttatgcttaaaaataagacagccagtctgattcctaaaaatttgatcttaattttctcaacaaatgccaaaaatcatctcagtcaaagttaatgaaaggtaaaatgagtactatagaaaggacatcaggtgtctcacagactgggctgtgaagaatcaaattattatgtttggacgttttggttacttctgttgatgcagttggtaggctttccctctaaaatgctgccatggatataacatcagtccaattgacccagttcccttccccttccccttccccttccccttcttcttctcctcctcctcctccttcttcttccagcaaatatcaaatttggagagacaatctggtagatttagcttgcgtaaagggtctgtctacccctagcttggtcacctgtggttagagggtcagggtgttgtagtactgacaggaccactggagcttcatacctccattttaggggtcattccaggagaagggagcagcactcccagaggtgttcattacacccttaatggttgtgggtctcaatgtgacaaaagcagaagagcatctctatcttttcttagctcttgtgatctccatcctgttgtaggagaaaatgtcctattatcccttattaccatgctctatgtcagctcccataagaaatggaaactgacatctaagccagtagagggagacattccacaagagatggcgtcatctcctatttcttccccaccatatgctttcccactaaagatgaccaacaaattgcaggtgtcaccactgcactgctctcaggcttgccccaagagctctggtccagcctggcctccaactcgtcagtgttaatcaaggtaacacaaggaaaatatatacagagactaacaacttattacagtacctcaaaacctatgcatatttagacaacgagaatcagtattccttttagtcattcgttcatttatatattcatgaatttgctcaaccgatatttattaaatactggctatgtgccaggtgcatgacataaactgtacagtcattcaaaccaagtttcaagtctaaaagcccttttcctttgaagttcgtttccccctgaagaaagttagatccttaagttaccagtcccaaagcctcacctcccccaatcttaggctcaacactaattattgtaagtagttttcattttctgtctttccttttagacttaaggcttcgccaaggtctccccggcccccagcaaactacctgctatgaagtagatgctctgtaaatagttgttaagcacaaattgccttgtgctatggagactgggcctgacatgagttgtaaaagtatcaacaagtgtattgacaatgggtatcggcaagtctttgcccttcaagccagagagctgctgggcaggacagattatctctgttttctctgtcactgatttactacccttgacttatgcaatgacatcagctaatatgaagaacactgcactgatgacctcaaaataactgaacaaatagtactccctttcccctccaccaatggcatcaacattctaaaaaaatttaagcatcttaataagcggtgtctctgcaaatatatttcttccctgaaaacatgataatattctttgtaatattaggcaatttagagtcccagtgtaactgtacataactctacagaaaaaagacatatctaacaagaactagaattacaaaaactcattatcactgcattgcacatgcttcacacagacatgaatactatacccacatatgagggtaaaaagataagtgaaagtaaaagctatgagtgagtgtgtcagcctgatacattatggtcccaagatgacaggctggccaaaatactccaaaagaacaaacacacaaaaagaaggtagaggtaaatttttataatgtttgtatcctgttgggaaatataatgtaatgggcacagagtgtggactgtagagtcagacagtcaggggtcaagtcctcataccagcacctactacctatacactctggggtagtttacttaacctctctgaacctgtttcaccatctgtagaacatagtggtttcaagaattaaatacgataaatgactaccataatttggcatctgaggcatgtaccaatgacagccagttcactcattcatcccgtaattatgtattgaacgcctactatgtctgtcttgctcaccaatgcattcccagcccctatcacactacccgtcactgaggagactctcaagaactatttgtaagatgaatgttaagtctgtgctgttatggtgcatgcatgctggattgaatccatcctccttctgaccatgggaagaatgccaatcagagtagaacaaagtaggaaagtaaaggaaccttcactttagtgttgaacaagagtctattatatactagaaaaaactttacaaatttacagacttctgaaagttaaatgatgattctattgttagttgatcaaacatcagtcattgaaaatgtagtaatacgttacctcaaaagaaaaaaaaaaggttagagttttcttaacagataattctttttaaatctgtaagaatctgtacgtcactaaaataaaatcctgtctagattattaaaataaactttgttatcagttatattttcatggaaaatattcctgtatatattttaattaatagccacatagatatttgctttttctgtcagatcatgtatccctttaaaaaccattaaagctaaagaaaaaaatcttaaaatataatatttactcattgctaataaagggaacacaaatttggaaagactcaagtgaatattttttcttaatttaaactgagtactttgtctctattaagctaagttaaaagaatttgggaggacaacctatgctaccaagagaataatttgtttctaggaatctgagttaaaagaatttgggaatgcaatctctgctacctggagaagaaagaaatgtcgtgggtcccacaccattctcaagactctgtttcaaagcattgtttcaatacgctgatccaaaccctgataacctgccatctttttaataaaataatttataaatttaatgagaatgtttcactttccatacaaaaaacagaaaaatgctttgaatcaatgcacttactgggatttggattactgactggtgttcctattgattcttgtaggagttattaatcctgattgcaacacacaagtgaacagacaagagagataaattttgtggcttgtgggaaatgaaggaaaatgggcctcatttagtctgtgagcatactaattgaaatagatgtatgaagacttcaccagtgttaaaataacattgtttttataaatcatatgatataaactatataacaataaaatagaatgttaaacatgtatttaatcatcatcataattttgattcagaaatctataatttattagttatcttaataatgtttagaatttgttgaacattttaccttatgtgaattaaggacaaaatattaaagctattcagcacaaaaaaagggtctttctgatgtgtatttttcatagaatagggtatgaatttgttattttgttattttgattaatgtctaaaacaaaagataaacacattatgatataacattactattgattttaatggccccttttgaaatagaattatgtcattgtcagaaaacataagcatttatggtatatcattaatgagtcacgattttagtggttgccttgtgagtaggtcaaatttactaagcttagatttgttttctcacatattctttcggagcttgtgtagtttccacattaatttaccagaaacaagatacacatctctctttgaggagtgccctaacttcccatcattttgtccaattaaatgaattgaagaaatttaatgtttctaaactagaccaacaaagaataatagttgtatgacaagtaaataagctttgctgggaagatgttgcttaaatgataaaatggttcagccaacaagtgaaccaaaaattaaatattaactaaggaaaggtaaccatttctgaagtcattcctagcagaggactcagatatatataggattgaagatctctcagttaagtctacatgaaaaggatggtttcttggagcttccacaaacttaaaaccatgaaacatctattattgctactattgtgtgtttttctagttaagtcccaaggtgtcaacgacaatgaggaggtgaattttttaaagcattattatattattagtagtattattaatataagatgtaacataatcatattatgtgcttattttaatgaaattagcattgcttatagttatgaaatggaattgttaacctctgacttattgtatttaaagaatgtttcatagtatttcttatataaaaacaaagtaatttcttgttttctagtttatcacctttgttttcttaagatgaggatggcttagctaatgtaagatgtgtttttctcacttgctattctgagtactgtgattttcatttacttctagcaatacaggattacaattaagaggacaagatctgaaaatctcacaaactataaaataataaaagagcagaattttaagataaaagaaactggtggtaggtagattgttctttggtgaaggaaggtaatatatattgttactgagattactatttataaaaattataactaagcctaaaagcaaaatacatcaagtgtaatgatagaaaatgaaatattgcttttttcagatgaaaagttcaaattagagttagtgtgtattgttattattaatagttatgaaacacggttcagtctaatttatttatttgtagaacagtttgtcctcaactattatttttgctgacttattgctgttaatttgcagttactaaaaatacagaaatgcatttaggacaatggatatttaagaaatttaaattttatcatcaaacgtatcatggccaaatttcttacatatagcatagtatcattaaactagaaataagaatacacaataatatttaaatgaagtgattcatttcggatcattattgagtttcaagggaacttgagtgttgtacttatcagactctacatgtaagaacatatagttaatctggttgtgtgtgtaaaaacatatggttaatctggttaagtctggttaatcatattaggtaagaaaaatgtaaagaatgtgtaagacgaaatttttgtaaagtactctgcaaagcactttcacatttctgcttatcaactaaacctcacagagatagtttaatagtttaggctttaaaatggattttgattattcaacaagtggccttcataatttctttaagtgtttttctttaagtatatactttctttaaatattttttaaaatttccttttctctagtaaagccagaccatccatgctacctctctagtggcactctgaaataaaaagaaaatagttttctctgttataattgtatttgtaataagcagatgaatcacatttcttaaaatttgttttagagagggtaagctctgactaggaccatgacttcaatgtgaaatatgtatatatcctccgaatctttacatattaagaatgtatatagtcaactggttaaacaggaaaatctggaaccagcctggctgggttttaatcttagcaccatcctactaaatgttaaataatattataatctaatgaataaatgacaatgcaattccaaatagagttcatctgatgacttctagactcacaaaattgcaagagagctcagttgttgctcagttgttccaaatcatgtcgtttgttaatttgtaattaagctccaaaggatgtatagctactgacaaaaaaaaaaatgagaatgtagttaatccaaatcaaaactttcctattgcaatgcgtattttctgcttcattatcctttaatataatattttaagttagcaagtaattttaattacaatgcacaagccttgagaattattttaaatataagaaaatcataatgtttgataaagaaatcatgtaagaaatttcaagataatggtttaacaaataattttgttgatagaagataagactaaaagtgaaattcgaagtggagaggacacttaaactgtagtacttgttatgtgtgattccagtaaaaatagtaatgagcacttattattgccaagtactgttctgagggtaccatatgcaataagttatttaatccttacaataatcttgtaaggcagattcaaactatcattacacttattttacagatgagaaaactggggcacagataaagcaacttgcccaaggtctcatagctgtaagtcaaccctacggtcaagacctacaagtagccgagctccagagtacattatgagggtcaaagattgtcttattacaaataaattccaagtagaatcaacctttaataagtctttaatgtctcttaaatatgtttatataggagtctaatcaccaattcacaaaaatgaaagtagggaaatgattaacaataatcataggaatctaacaatccaagtggcttgagaatattcattcttcttgacagtatagattctttacaatttcgtaagttccaatgtatgttttaggaatatgaggtcattactattcataatctgatacagctttatcctaaggcctctctttaaaaactacactgcatcatagcttttttgtgcagttggtctttctactgttactgaacagtaagcaacctacagattcactatcaccaaccagccagttgatggatcttaagcaaattatcaagcttgtgataacctaaattataaaatgagggtgttggaatagttacattccaaatcttctataacactctgtattatatttctgcctcattccttgtagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctggtgggtgcactgatgtttcttgcagtggtggctctctcatgcagagaaagcctgtagtcatggcagtctgctaatgtttcactgacccacattaccatcactgttattttgtttgtttattttggaaataaaattcaaaacataaacatattgggcctttggtttaggctttctttcttgttttctttggtctgggcccaaaatttcaaattaggatatgtgggtgccacctttccatttgtattttgccactgcctttgtttagttggtaaaattttcatagcccaattatattttttctggggtaagtaatattttaaatctctatgagagtatgatgatgactttcgaatttctggtcttacagaaaaccaaataataaatttttatgttggctaatcgtatcgctgaattttcctatgtgctattttaacaaatgtccatgacccaaatccttcatctaatgcctgctattttctttgtttttagggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaaggtagatatccttgtgctttccattcgattttcagctataaaattggaaccgttagactgccacgagaatgcatggttgtgagaagattaacatttctgggttagtgaatagcattcatacgcttttgggcaccttcccctgcaacttgccagataagcactattcagctcttattcccagtctgacatcagcaagtgtgattttctatgaaaaattctactatgactccttattttaagtatacaagaaacttgtgactcagaagataatatttacagagtggaaaaaaacccctagcatttatagttttaacatttgaggttttgaatgagagagttatccataatatattcaattgtgttgtggataatgacacctaacctgtgaatcttgaggtcagaatgttgagtgctgttgacttggtggtcaggaaacagctagtgcgtgagcctggcacaggcatctcagtgagtagcatacccacagttggaaatttttcaaagaaatcaaaggaatcatgacatcttataaatttcaaggttctgctatacttatgtgaaatggataaataaatcaagcatatccactctgtaagattgaacttctcagatggaagaccccaatactgctttctcctcttttccctcaccaaagaaataaacaacctatttcatttattactggacacaatctttagcgtatacctatggtaaattactagtatggtggttaggatttatgttaatttgtatatgtcatgcgccaaatcatttccactaaatatgactatatatcataactgcttggtgatagctcagtgtttaatagtttattctcagaaaatcaaaattgtatagttaaatacattagttttatgaggcaaaaatgctaactatttctacataatttcatttttccagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaaggtaactgattcataaacatatttttagagagttccagaagaactcacacaccaaaaataagagaacaacaacaacaacaaaaatgctaagtggattttcccaacagatcataatgacattacagtacatcataaaaatatccttagccagttgtgttttggactggcctggtgcatttgctggttttgatgagcaggatggggcacaggtagtcccaggggtggctgatgtgtgcatctgcgtactggcttgaacagatggcagaaccacagatagatgtagaagtttctccattttgtgtgttctgggagctcatggatattccaggacacaaaaggtggagaagagctttgttcatcctcttagcagataaacgtcctcaaaactgggttggacttactaaagtaaaatgaaaatctaatatttgttatattattttcaaaggtctataataacacactccttagtaacttatgtaatgttattttaaagaattggtgactaaatacaaagtaattatgtcataaacccctgaacataatgttgtcttacatttgcagaatgtgaggaaattatcaggaaaggaggtgaaacatctgaaatgtatctcattcaacctgacagttctgtcaaaccgtatagagtatactgtgacatgaatacagaaaatggaggtaagctttcgacagttgttgacctgttgatctgtaattatttggataccgtaaaatgccaggaaacaaggccaggtgtggtggctcatacctgtaattccagcaccttgggaggccaaagtgggctgatagcttgagcctaggagtttgaaactagcctgggcaacataatgagaccctaactctacaaaaaaaaaaaaaataccaaaaaaaaaaaaaaatcagctgtgttggtagtatgtgcctgtagtcccagctatccaggaggctgagatgggagatcacctgagcccacaacctggagtcttgatcatgctactgaactgtagcctgggcaacagaggatagtgagatcctgtctcaaaaaaaaaaattaattaaaaagccaggaaacaagacttagctctaacatctaacatagctgacaaagagtaatttgatgtggaattcaacctgatatttaaaaagttataaaatatctataattcacaatttggggtaagataaagcacttgcagtttccaaagattttacaagtttacctctcatatttatttccttattgtgtctattttagagcaccaaatatatactaaatggaatggacaggggattcagatattattttcaaagtgacattatttgctgttggttaatatatgctctttttgtttctgtcaaccaaaggatggacagtgattcagaaccgtcaagacggtagtgttgactttggcaggaaatgggatccatataaacagggatttggaaatgttgcaaccaacacagatgggaagaattactgtggcctaccaggtaacgaacaggcatgcaaaataaaatcattctatttgaaatgggattttttttaattaaaaaacattcattgttggaagcctgttttaggcagttaagaggagtttcctgacaaaaatgtggaagctaaagataagggaagaaaggcagtttttagtttcccaaaattttatttttggtgagattttattttgtttttcttttaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggtatgtgtggcactctttgctcctgctttaaaaatcacactaatatcattactcagaatcattaacaatatttttaatagctaccacttcctgggcacttactgtcagccactgtcctaagctctttatgcatcactcgaaagcatttcaactataaggtagacattcttattctcattttacagatgagatttagagagattacgtgatttgtccaatgtcacacaactacccagagataaaactagaatttgagcacagttactttctgaataatgagcatttagataaatacctatatctctatattctaaagtgtgtgtgaaaactttcattttcatttccagggttctctgatactaagggttgtaaaagctattattccagtataaagtaacaaacacagtccctagatggattggccacaaaggcccagttatctctctttcttgctatagggcacaggaggtctttggtgtattagtgtgactctatgtatagcacccaaaggaaagactactgtgcacacgagtgtagcagtcttttatgggtaatctgcaaaacgtaacttgaccaccgtagttctgtttctaataacgccaaacacattttctttcaggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataagttaatgttttcttgttttgtaatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggctgaggcgggcggtcacaaggtcaggagttcaagaccagcctgaccaatatggtgaaaccccatctctactaaaaatacaaaaattagccaggcgtggtggcaggtgcctgtagtcccagctacctgtgaggtggagattgcattgagccaagatctcaacactgcactccagcctgggcaacagcgtgagactccacctcaaaaaaaaaaaaaaaagaatctgactatataccatggaaaagccaccactctgccacttaaataaacatcaggatcagagattccaagaggacaatctgcatcaagtcttcaccaagtgttttttaagcgaaataatgaaatagggagcagaatatgcctgttgcccatagaaacgaggtctattcttgtcctcaattaggcttttttttcttcatagttacaccagaactaaagtaaaagtggtttttctgttctttctacttctccccatgaaatgggcatatcatctcaacacttcactccaagtcgccacgggcaaccttatgaccctaggtcctccacccctaatgtatcatcattgccacccatttttatggtacttattgttcttaagcttatcctcttaatcttttcatgtaagcaaagctcattaatttctgtcttggaaatgctactactctctttaattactcaccaaatccaactttaacttttgacctggtttctctgccacaagttctgtcccactggagcccatactcacctaccgctttgccatcacatttaacagaaaactcttatcaacttacttcctgcttaacattagctccttcctatctatatccaaatttcttaaattcaaattttttagctggagtaaaaatggtcccagtaccatttcctgttcccttcactataacctacatttttgtcacattaagtttttccccattccaggacaggtcaggccctttaaaaatttcaacagctttattgagatataattgatataatttaaaaaatcctgcacatgtgtcatgctggagccctattgattccaacagggatggcgccttgtccaagaagagacccagagccagtgaatgggacatagggtttatttaggacttaaatacagatgtggtccagtggcagtgggctggacaggaccgctactatttgtaaagagtatgtagtttatataacatttctacttagcactctccacttagcaacctccatttaacccaaaataaaaggccttggttccttgcacatcctgagttccaacggacaggcagggagttcaagtgtccttcacagataagaagtgaatctctctgggttggccattcccggattccttagcttagactctgaacacatattcttcttagaccatacagtcattctcagggtatgcttgagttaatgctgtcggatgcatctgtcatacaaagtgtttaacatatacgatttcatgattttggaaatatgcatacacccatgatatcactggcacagtcaagatattaaatatatccatcacctccaaaagtttccttgtgttcatttattttagtttttcatggtaagaacatttaatatgaaatattatcaacaaatttttaagtgcacaatactgtattattaattttaggcattatgttgtacagtagatctctagaacatattcatctactaaaaatgaaattttatctccatttccccctacctcccatcccctggcaactaccattctattttccactttgactgtttcagatacctcatataagtgaaatcacacagtatcctttcgcactgttgtggggatgtaaaacggtgcagctaccatgggaagaaatgtggaggcccctaaaaaattttttaaaaaattctgattatcatatgatccagcaatctcacttttaggcatatatccaaaagaactgatatcaggatctggaagcaatatttgtgcatctgtggtcattgcaacattattcacaatgttcaggtccttttatatgatgccctcattgcagcaatgtcttcctcccaacaccatctgacaaactgctatttgtttttaaacctcactttaactgtcaccgcccagagaagactttctaaaacctttgggcaaattttattactttttgacaatgaatgcctgaggcttatccagctttgattccagaaacatcagcctgtcagaatggctaattttcatgcatttgtgaatgctggatggctaaatccagtgattttcaaagtctcgaacatcctctttttaaatgtagaacccattttccaataaagccacaaacagaaactcaacatgcaaagttcttgaatatggaacttttggggcaatactgagagtcgcaaaagttcactgaatgaaaaatgcgggttgggaagactgcagtcatcagacctttgctcactccttacgtgttcacagaggatcaaatgaatccctagagcttgaagtaatgccatagaagaaaaaccactaaagtagataatctgatggtcaattcttagttaatgtacaaatagaaaaaacacagagaccactcccaggtaatatgtaagtctatctagaaagaaatgcactttcttggctgggcacagtggctcccatctgcaaacccagcactttgctgggatgaggtgggaagattgcttcagaccaggagttagaggccagcttggcaacatagtgagaccctggctctactataaaacttgtaaaaacaaacgaaaatacagtaacgaaaaaagaaatgcactttcttaaggtgtcatttggtaagaaatgttatgtgtctgattttgcccatgcacaattttgaatataataaaaaaggtagcttcccctatttagaatatataaaacagtaacaacaagattgtataactcatgattttaagatgataatagaaagattagttgaaagtttttaatcccacactgtggtatgagaactattttatttatatatatatatacatatatatatatacacatatataattatatatatgtatatataattatacaattaggactgaaagtctgcaacaaactataatggatgtatgcacttgggacataagcttctagttcctctttatttatgaaccaagagaaacagctaactcagggattgtttttaaactgactacagattcccaccatggggcaaaaatatgggtgacatgacacatcaccagctgcagtagctcagctcacatttctgtttaagcattacacacataatatcctgtatgctgatcatttaaacttactgacgcttgtaatcccagcactttgggaggccgaggggggtgaatcatgaggtcaggaaattgagaccatcctggacaacatggtgaaatcgaaacagtgtctctactaaaaatacaaaaattagctgggtgtggtggtgtgcacctgtaatcccagctactcgggaggctgaggcaggagaatcacttgaacccgggaggcagaggttacagtgagctgagatcacgccactgcactccagcctgggcataagactgagactccaagtcaaaaaaaaaaatgcagatttcttggtactaacctaggtttattacatcagagactctaagggcaaagagcctgagtctccattttaaaataaatgtccctgagagtgactgatcactggttggatttcagagttactgatagaggctacatttgtatttacctgagactcccttgatatttcttacctactatccttttcactcaaatggtgaccatgaggcaatattttgagcaaatagtcatccttaaagttaccttgaataacttcatggtgaccactgcctatgtttaagaccagacttgggtttaacatctctccaaatgctagaatcactatttccactatacttccgctagtctctggtgattctttggattggacttcaaattctcttgcagtgtagaaaagaattacagatgctacctctcatgtgtacatagagctgacatttcagtttttgaattccatcctcccccctcactattgcatgtgatctgatgctcttgcttgaacttcttgtggtgtgcagctctgcaccaaatagcaatgaattggtacatagtaatgcagacacatggaaagtggaatcactgattttttttttttttttttaagatggagttctgctcttgttgcccaggctggagtacaatggcactcgcaatcatggctcacagcaacctccgtctcctgggttcaagcaattttcctgcctcagcctcccgagtagctgggattacaagcatgcaccaccatgcctggataatttcacatttttagtagagacggggtttctccatgttggtcaggctggtcccaaattcccaaccccaggtgatccacctgcctaggcctcccaaagtgctgggattacaggtgtgagccaccatgcttggccaactgacatttattttaacaacattagttgtggtattaaataatgaaagtagcccgtattctttgcagacattttgggaaatatagaaatgattagacccatttataatttcaacacaagcagtggaatagctaataccttcatttatgttttttgtcttaccctgtacatgttttagtgcctgaatttttcacactgagtcacaaaaagttttccatattatttaacattcttctatagtatcattttctgtaatttgctttttaatggccatatgatattccattatgggaatttatttaaacgtctcctctcatttcacatttaggttttttccaacctttttctattaaagagagtactgacattaacatccttctccataaaccttttgtgcatatatattatataatatattgtatacattatttataatataaatttattttatattttaaaatatttattttataacatggtttacacattataaatgtatatttataatatttatttatttatttctaggataaattacttgaagcagaatatctggaggaaataaaaggttttgggctcagcgcagtacctcatgcctgtaatcctagcactttggaaggctgaggtgggaggattacttggcccaggctgcagtgagccctgactgtgctactgctactgcactacagcctagatgacagagtgagaacctgcctcaaaaaaaatgtttttggcattttaaacttaaaaaaaaaatatatatatatatatagccaagtaactctccagaaagattgtaccaatttacctttgatgcacagaataacatatttaatttttattttgcttctccatcactaatattatgattaaaatattagtaattactttaattttaatatcttgaattagtagtacaagtaagagatttaaaaatgtttaatgactattttactatcttctgtgaattgcctatccacgtcctttgctcaattttcttttttttcttgttttttcttctcttctcttttttttgagacaaggtctcgctctgttccccaggctggagtacagtggcgtgatcttggttcactgcaacttctgcttcctgggctcaggtgattctcccacctcagcctcccaaatagctgggaccacaggcatgcaccaccatacctaactaatttttttgtattttttgtagagactgggtttcgccatgttgcccaagctggtctcagactcctggactaaagcgatctgccctccctgacctcccaaagtgctgggattgtaagcatgagccactgcgcctggccctttcctcaattttccattagcaaagtcatcttttatatgaattactcatttcataatatgtaggatagcaatcagaaacatggtattttcctctatacaaatattttaatttgtaagtaattacactgggagtcatatacttatgcaaataatcttaactggtacggatattcaccatcagacactttcttttcttctcccagccaagatgtgatgaacaggcaatacatctttttgtttgttttttgattcaattatatttatttctgccccaaactttttattttgaacagtttatactctacagagaaattgcaagaattttaataaatacctctctgtccttctcctagcttcaccctttgtttgttgaaaggagatactttagtgcagtattgcaacagcttatgtagacatgcaaccttgaggtcacagacctatgagggattgagacaaaggcaaatttagcaaatattttccagagtactctgctgcaataaccacgtacccaccttcagcaatgacctggtgaacagggagactactgcttagtaacggagcaattctcagctcaaatctggcaggttctaagttttcttgcctctgtggttttgaatggttgctcttactatgtgaaaatggaagacatcatgtcctgttcatgtttaagaattaattgagatttccccaggggcaaatacttcacgatactgctttcctcagtgatatttaatgcacttcctgccctcatccccaattaattaagcattttcctctatacaggagatttatgaagtacttggaattccattaaaaagaggtaatatgtgacttaaatgaatgcataaatacatcaaatataagatatctcagaaatggtttctgtgtgaattttgttatccacaagcaacttgtattattttcatggctacaagaaatttcaatgtggctgcttcccaagctgtttcccaagcaagtaataaatgttgtattactttatttgaatataacaaagctttaatttatgattgcatgtgcttacattgacaccttggcatttcccttcaggcttttctggacatgaaaaagatgagtgaatttggctggatgggtctttctgttctgattcaccagctgcaccccaagcatcagctaactaacttggaaatatattttgttttggtggggaatctatgacaaaatataattagatcagtgataccactgggccaataatgaaaagcaaatgctatgtacaatagtgtcatgtttatttatgaagtgtagtatcattatcccagaatgaataatgaatgaggcatggaacttaggtggttagaacctgtaagaacaatactgtgggcttcatccccaggtgtcctccttatcatcacattatttcacctccttaaattactatttactcacctgaaaaatcagttcataaaatgttctcaccttcattaaaagaacactagtaataattgatttccattaaaagtatccacatatttggggggaaacttgtaattctttattctaaagagtttccaggaactgaaagtaaatacataaacacaagacttggattaaaatgtaaataatatcttttaataagaacccaacaaggcatcttaacttcattatattatgcattctgtagaaagttcaaaaaagatgataagttccttgttttgttttgtttgagatggagtttcacgctgttgcccaggtttgagggcagtggcacaatcacggctcactgcaacctcaaacgtgatctcctgggctcaggtgatcctcccacctcagcttcccgagtagctgggatcataagtatgcaacaccacatgcagcctatttatttatttattttttatttatttatttatttatttagtagagacagcatctcactatgttgcccaggctggtcttgcactcctggtctcaagctatccttcttccatagcctcccaaagtgctgggattacaggcatgagacaccgtgactggtcccaaaagttcctttttaactgttagattccttagctcacaaaaatttgttgagtcattattatgtgtcagaccttgtgttaagtactagatatcaaatacagttcctacacctaagaaaagaataacatatactatggtataccaaaggagaacatcaaagacagcttcaggctaaaggatggagatagatatacctggaagtaaaattaaaatctagccagatgttttttctattcctgactcaggattaaaaaccccacttcaacacttttctctctagcagaaatatttaaaaccatgtcttttcctggcaagattttcacattcatatctgttttgttcattaatccattcattcaactaaggactaatttgaaatggatagcctgaatagaacttgcatgttaatggagggataccatcttatataagtaagggagcaaaagttaaggaaagaggaaacaataatattttaatgtaaatgtaaaataattaagttttaaaatttattatttataagaaagtattctaaataagacgaaaaataaatcttgaaaatcaagggatatataaaacttaagaaaagggaaaacaatggtaaaataaaatcatgtttaaaaattcatctgttattttgggaaagtcttccaaacaaagtgacaaaaagtatgttgaaaatgaaatgacatgtcaagatatgtaggcaaattcaaagaaaagaaaatcaaaagtgatgacaatgttgctatttcaccagaaggaatttaattccaaaaggagaaatggaaaaaaaaagagaaacattatgtaatgatagaaagtacaatttgtgaagaagatataacagtcataaactttcatgcactgtataaggaaggagccaaccttatgaaacagaattcctaaaatgcagagaccacacacatgcacagaaccacagagtgaggtctttttatacacacacacacaaaaacatgatgaaaatctcataactataatcccagtgctttgggaggccaaggcaagaggccaggagtttgagcctccagtgagctatgattgcaccactgcactcttccaccctaggtaacaacagagtgagactctgtctcttacaaaaagatacataaaaaggaaaagatataggatatttaaataacaccatcaataggcttggtaatatggaatattataacatatgggtgtgataatatacattcttttcacctatgaaacatttgcaaaagttaacgcaacttgttcacaaagaaaaccttaaaaattctatactttgggagacagagacaggaggattgcttgaggccaggagttcaagatcagcctgggcaacatagcaagactctgtctctacaaaaaatgaaaaaattagctggacgaggtggtgtgtgactgtagtcccagctcctcaggaggctgagatgggagaattgcttgagcccaggaggtagaggctgtaatgagccatgattgtaccactgcaataaaattaattaatcaattaattaagaaaatctaaaatgcttagaatgaaacagttggttaaattaacaaaatttataaaatacttgaaaactaatgattgaaagatgactcactctaaccccctgaaaaaataacaaattgggttttaagacgagaaaactggaaattaagaaaaacttctctaagtagtcccagaacaacaaaataaataaaaattaaaagtacaattttacagactaaaaaaaaaaggaaaaaaaatggggaataggatggagactacgtcttccaaactctgtacttgaaatgtgagcaaggaggtgtaagcacaggagagagtttagatatagatcccaagaaaatcttatagaaaaaagttggcattttaattctatggacaacgaatgctttctttattaaaggatcccagtataactggctacccattcacaagaagataaaagtagattttcttcatgacatattaaaataaattctaggttaaatatatacatgcaaaagaaaaaacaggaaaaataaaaaacatttaaaaatttaaggaagtatttgaaatactgtataatcttagaatggggaaacattttgtgtaggacaggatgcaccatataaatgagctctgtcccaaaggagttcataacctagtgccacaaataatataaatatgttagaggtagggatagaatatgctatttttgagataagaacaaaaacagtgaggacctagaggacaattcaattcattctatgatgggcactggggaagggttcacagaagcagcattgagctgtttttaaaggagtgaatgggtgtcttctaggtagtttgtgaaaaggccccaaatcattaaaggacctggtatttcagtgccagtgagaaattcagtgtaactaatgtgtagaatgaatgattgcagaggttgaaaatggaccaatttttgaaagagtttatattccaagctaagaagttttaacttaatcttaatgtctgcctcctgcttaaggccactgattgtagttgaagctatggtgattgtcagatcaatcaaggagaaagagaagagcgagaaaatgtttggccaagactggtaattgcagacttccttatctattctccctcttttccttattagcagaatcctgattttagttaggatagtcttgtacccaagctaatagtcaacttgactcagcttctcctgcaactgagcttatctatgtgactaagttgtggctaatataagcagaagtgctgtttagaacactcaagaaagttccttaaaaggagaaggtactcctttgcccttctttcttttctccttcttccagattgccagaggacatgatatttggattacaagttgaaccaagggatagaagtcttttattaaaatgacggctttctgaagactatgtggacatactcctacataggcttttttgtgagcaggaaatgaatttctgccttgttgaagtcagatgtaccaaacctaatcccaaatgataaagatgagtaccaatgtaaatgcaatgagaaacccctacatttaagaagtggtcagagaagaaattaccagttaaaaacactgaaaagagtaagacgggaagaaatggtatagaaaccaagacaaaaggacaggcccaagaggcaggataagggcaaaataagtagcagatgtttaaaagagagaagtagaaagaggcttgaatgcagcacatttaatttacaattgcaaagttgtgttgatttgagatcaatttcaagagtgtggtaattgcatgaaaaccaagttgaaatgggcttctgagtgaataagagtcagggagctaaattaatatttaatttcagaaaaaatgaaataatttcagaaaaaatttcacctaaagataaggtgaaatggaaaatagatgtttcatgtcttttctgacaaccaaattgtatctccaattctcatgatcctgctaatattggctaccatttattaaattaaaagaggtttatctaatcctttgataaactcaaaatcttctgaataactagaaatgaatggcccttcccgttcataatcactttcattccaggaaccatttatattcctacatagtatgctattctggaaaacaaaatattttctagtctcaactcaaattctgtcaaggcaatacgtgtgagtgtaagtagagtggggatagagatagcatgaagttctgatgtctgaaagaagtgaagcttcatttgattctgaagaagttcttgtccaagtatccaaccatttgaaggtatagcgtttagtttgtatcagagatttacaattccccataaagaaatgcaagaactctggggttcatctgtgatgcatttgcaaggttatttcccctttgatccccaggctctggcccctagctgtagcctctttttcctcctccctctcttctcctctccttccctccctctctccttccttctttgagggataatgcagttatatcagaatagaagctatgtaagaaagggtggtatactggattgcttgggatattttaatacatattcaagagaaaatgacaaatatatcttaatagaaaaggatacaaattaaaaatcagaaggcaagaccaccaggattaaagatgcaacttagatcaaatattgaccaaagtaaatgggttgaattttgaatatagcatagatcatacttagtgagaggctttcgaactaacgacttacatttaataataattagcatgtcacagaatatagtttatgattattagaaaaatgaagttaaatcaatacttgggagattgtttattaatgtgtgaattatgtctttttttaatattcataaatagttttaaaattttaaatgtgttttagaaagaaattggttactccttgggaaaaaaataagtgtgcattacaacgtctagtggaagagtttaaaggatagattttcatttatatttaggaaagaatgtttctcttgccttcctggatttgctccatagcaaaagacataaatacatattgtaattataaattgtgcattgtaattataagttgtaaattctactacaaaggtcagctatggttagattcagtgagttttaccttaaaatattggcttaaaacaattcaaatcaaatggataaaacaactttttgctttccaatggcattatgattttgggtggtatgggaagagaagttctcaaaccaatagtcttcaaggttgcagagagaagcttctgtctgccactttcctgatgtactgaatggcccttggtatatctttataaaaatgttaaaacccacagagctatttaaagataaaaaaaaccttacataactttatttttcaaagactaatatgtctcaggtacatttagctacagtacaaaggataagaaaatagcacctaggaattttttaggttgtagagaatctcaactgctttaccttttgtattttctctccacttctctagcaaagaagacagagtgctcccattcccacttcttcagcctattgggtcacaaggggcctaattttcatgcgaacagccctgagggaataatctgcccctctaaaggaaacccagaccactccattctcaatctcataaggactgttattccttgggtcataggagcccccagggtagtagattccattgagattggctgcttggcagttattataccaccagcctcccccatagacttctgcacagttctcttcccactggtctgcatccctgtcaaaggtgctgaactgcatgttgttgtgagaggtgtactctgccccttcctctacggaaccctcaatcagagcatcacccgcagtgccttcataggaggagacttggagggcatagccttcagcctcagagcctacccggaagtgatattctgcataagcttcattcccagcccagtcctctaattcaaccctaagaacagagcccctttgggttagtaagtggaggtagtcattgcctagccagaattctccttccccctcgtcattcaggctgccgaaacctctcttgtagtcttgccaggtccggttaaaattcagtgatccatccattctttgctggatcaaaagccatcctcccaaactggtctcttgatcgcaataaacagaaaaaatcttactggatcccggtagcttgatattgaaaatgccactttgggtacctgaaggatgtgtttggaggacatcatcacagtctaaaaaaaaaattaagctggttggaagaagttattctcatttaactttacaaagataggcacggctcagattaaataaggcaaatactgtttctttcccttcctttctttcttcctcctttccttccctccatagggaaaggatgcacttacagtgggatagaacttatgcaaataagcggttatttatacctacaaattgcaaaggggattttcctcaaatgtatttggaattttacttgcacaaactaatagcaagtaaccagtacaggtagctaagcatcacttaatactaacacaacttgtatttagcctgacctaaatgtcaactgagacacatactaaaaatgtgattaatcagttgggtgacaattctaatagcacacactttgaatagtgaaagaatttgactaaataagctcaaatagagtttcagaggaattcattcatccatttaacatgtatttattgagtcatggctctgtactgttaggcatttgggaatacagagatgagacagacaaaggccctgcccccaaggaacttacagtctagcacaaaaacagaccaaaaaagtgtagtttcaatgacgtgtaacagagagttaagaaggaaatgcaaggggccatgggaacactgtgcagaaatatttaacttagtctagggggacagggaaggcttccccaaaggagaagtgtggatacctctgacagggcgagatttagcatggcctctcttggtgctatgtgttccttcatgatcggcttcacttccggcctcatctgccattttatagctcttgctttcaaatgtggagtctcctctgttgtaactcgtgctactagtaaattgtttgctgtaacttgaagatttaccacgggaagggaattcagctatcccagggtgatgagaactggattcctttgtatttgtgaagatgccagattctgagcccctagactcagtctcactgacaaactctcctaacataggtgagaagaaacctgggaatgtttttccagttgaggcagtgtcgaagaaggcagcttcatcagggtgcctatggcggaacccatccagagtacctatgccagacaatgtgcctaaatccattgcctcgggacagtcagaaccatcttcggaggtcaccacttctttggtaacttctttgtgaccatcaggaccaataacagtcttagtaacggttttagagcatgaacgacgcgtggtggttgtgctaccagaggtgaccttctctttaccagtcctgagctctttatctcctttagaagtgaccagtttttctgtgtggtactctctccttgtccctggacttacatttcctgacacctcttcaaatgtgccccagtctgggttgttaggcctcgcgttcccagagcctgggctatctggcctaaaacttccagattcagagtgccattgtccagtactaccagatacagagctctcagaggtccagtgcccagcacttccgcgttcagagctgccaggattccaggttccggtactaccaggtctagggctcccagggttttggtttccagtacttccagttccagagctcccagagttccagcttccagtacttccaggtccagagctcccaggtttccaggttgcagtccctccagtcccagagctcccagggtttcggtttccagtacttccaggtccagagctcccagagttccagcttccagcactgctagggttcctggggctttccgtctctgatccggttccataagaggtggagcctcctcgagtaatctcatttccaccaggtctctctaactccattctcatctgcggcatgtctgttaatgccttccactctgggggtaccttctgaagctggctcttaaaatttccgggaaccaagtctggaactggtttcatttttatcagtggtaagtgttgcctatctctagagggaagtaagtctttggcaatgacctgttcaagttgcttctgctgatcttcatagtccttcagatctacttcacgagctaaagccctactgcatgaccctcgacaagatcggatcttaatatcaatgtccacctagagagaggggagaaaaataaagagaaaatgtagatacaaatacataaactacgtctattgagttcctggtagttaattttccttctggaaactggtttcattttttttgactcggagacctaccacttaatattctctgttttctgcctatcgagcaccctcagtggaagagatgttgggtattgcagggctagccaggataagcaatggatgctgtttaattcatcttagcctcagaatggatcaagagtaaggtgctattccctctcaaaggaaacgctaattaaatgatccttggtgaaactcaggctgagggctcagaggtgtggtgatgtaatgggctttggaattagacagggactgaacatttgcttttgaaatttactatctatgtaccgttggaaaatttacttaatatctctgaattttttttcttcaactgtggagtgaggaaaataatacctacttttaggtagatgatggatataacacttttctctgcatatagtagacactcagtgcataactatcgccttccttttccctctactcagaaacaaggacatctgggaccacagccacatacttacctccagtcgtttcatatcaaccaactgagctctaacatttttctgcagaagctggatatgctgtactttttctatgactttgcgcttcaggacttcaattctgcttctcagatcctctgacactcggttgtaggtattatcacggtctgaaatcgaaaatatggttattgaagtagctgctgagtgatttgtctgtaattgccagcaaaaaagaaaggaagaaaggaaggaaggagaaagaaagaaagaaagaaagaaagaaagaaagaaagaaagaaagaaagaaagaaagagaaaaaagaaagaaagaaactagcttgtaaatatgcctaattttattttggttacagtttaatctgtgagttcaaaacctatggggcatttgacttttggataatgttatgccctgcagccttccatgaatgccagttaagatgtcctaatagcaattagtaatcccaaagaaatatagaagaagaactttctttggaattttaaaggtgtaatttggagttaaaatagttggtttgattgcatttcaattattttataacatccttaatcaagggacttgaacatattggattttcttactgatgagcttttctttttaatctatagatttgaaatggttcctaagctgttttgggtcaacaggatcactcacttgccagctagtgttgcatcactgattttaaatgtcaagtgtttgtgaaggtgtaaaaaggcaaagcaaaacttgagaaactgaggactccctagactcgctgtccatgcccagagtgaatgcaatgtttcctaaccctaatgagtagactgtgagaatgacgtagcttgaccctatattttaaatttaaaaatctacctaatcagctcagtggagtctgggagttgaattcccagctctgtgtctttgaacaagttccttgacctctcagttttcacctttacaaagcagaaacaaaaatatcaactcaaagagtctgacccatcctactttcagtatatactgttgaaaagaacacatttaaattcttgtttttaatccaaaattctgacttattttgtgaccttaaacaatctcagttaacatcttttactttgaaaaaataacgaaaacaaaagctccctcttaaaattttcagggatattatgaaggtatgtgtttctacactaagtactttgggatgaaattgtcatagatataagcggatatcatatttatttaggatttttgttgtttctgttataaagtcaaagcagtaaatatgtaatacttactattggctgaggaaaaatcgcctctcaaaatttccattatattagtggtcaacgaatgagaatccttattgttcttctgatattcaaatagtgaatttttgagcttatttattctgtttgtaaaatcttgattgacttcatcaatcaaccctttcatcctgcagccagaagggcatttgtagttctgaaagtgaagggagaaaattacagtaaggatctatctctcagattcagaataattttgcatgtttccatgcagcccccatttcttcctaccctatctcttccagataagttggcttaaaagtaggtaagaggactagttagaggtcgcagagaaactctggaatgagggtccacttagccataaattaggtgccaggaaattgaggccacaatactcaggagcctggttttgcctgagcatgcaactgaaatcctgtctgttcacccactaatgatccagagttggggaggtaaataaacagtgctcttgggagtaggttccttttctttatttgctatgtaggtaactattcaattattttctatttaaaaaagtttctgggaccaatcaggtcagcctgtgagcccctctagcatcagagggaaggaatctcctgcttcccccgctgactgcttacccagtcttcatcagagcagaagggccagtctgaatctttgcaggcagattgatgtctttccacaacccttgggccacgcacgcctcctccttcagctagaaagtcaccttcaccactatctgcagtctttaaagattcattcacatacacaaaagagagcaacagcaatgttagccagaagaggagacagtggcatgcctacaagtccccaggaagagatggcactctcacagagattaaggagagcagacacagggcttcggcaagcttcaggtttcttatcttcaaatggaaatcctaggacccattttatggagttgttatgagaattaaaggagacaaggtgtacaaatttcttaactgtgtgtgacacttaaataagcatttgataaatattaggagttttaaagaatccatcctaaaaggaaaattatttgaatctataaaatcagttaaattttaccttttcatttttactaatgactgcagacagaaagttgaaaactactgtagagctctttctcctgtaattgctgcttcagtagaaaaacctagactatcttaactgaatgttcctctctccttcaagtttctatgtaacctttagagatggattcataatttaaaagaataccattactgcggaaaagcgtattgccttactaactaatctcttctgatactgcaaagatatttccaaagataattcgtttgctttttcttctgtcttgacaaacacaacaataacctttcagcaaaactgtactaacactaaaagttctgcttattatggacaagtagcaagaaattaataactaaagaaaacaaatcttaccataaaatgttttattccattaactagcattataatgcaccaaggctttataggtacaaggatggcaaataattcttgccctttttaaaacaaaacaaaacaaaatgtggtaagactgaatgacagatgctaaagtttcccttgtgagtttgtacactctcatccatctaagatcttcctcttggtgtcatattaccctgtattcttgaggtgtcaagcccacccaggaaatttcctcccaggcctggggtcataaagctaagagtgtgtcaggacatagagcaggtagactctgacctccaggctctttgtggaataaacaccagagagaaagcaagaagaaaaaatgaaaagggccatacccatgctgtgcccaccacacttaggaccaggcagacgatcctcatggaaaacatcttttctaagggtggggctggctcctgaggagcactccagctgaaagaaaggattgctgccactcctagttcccatcctatttaaatctgcaagaggtttggttaatcattggctttgtcctgtgtagacagtcaaccctccctctacgtcctttgttcctcctatgctgttggtatcccagaaattcttgctcaattcccctcagcttgtttgcttccgataagctgttgcaaaggtagcatttgattctccagtcaacaattaggagatctcacattccaggaacagggtggctttgagaatgaaaagaggagcataggagggtatatccatatttctaaacgtgaaagaatatagaaggtgcttaggtaagctagctgtagcccccagtagtagtgatttagcaaacaatatttcactttatgcagaaattagggttgggtgatctggcttataaaaaaaataactttggggataagctggccctgaaggctttctataagtttatttagaacatattacttttctctatttaaaatattaagatgacagcagccccaggaacaaaacatcttgggttcataatccaagctgcaccacttccctgctctatgttcttggacaagttactttacctctttatacttcagtttcctcatttataaaataaggatgctgataagctaccccatgcttttatgaagaataaatgagttaattcttgtaaatctctcagaacagtgactgtcacataggaaatactcagtgaattatgggagatcataaagtgccatgaaaaataccatttatttcctgtttctgtgctagcaatctcatttctgagtgtatttccaaaggaaatgaaatcaggatcttgaagagacacctgcattcccatgttcattgtagctatattgacaatagccgagatatgaaaacaacctgtttccactgatggatgagtagataaagaaaatgtgtatatatatatatacacaatggagtattactcagccttgaaaaagaaggaaattctgtcatttgcagtaacattgatgaacctagagggcattatcctaagtgaaatgagcagatatagacagacaaatactgcttagctggtcgtggtgacaggcacctgtaatcccagctactcaggaggctgaggcagggagaatcacttgaacgcgggaggtggaggaggttgcagtgagccgagattgcatcattgcactccagcctgggccacagagtgagactccttctcaaaaaaaaaaaaaaaaacggaaaagaaagacaaatactgtatgatctttcttacatgtgaaatctaaaatagtcaaactcacggaagaaaagtgtagaatggtggtggccagggcctgaggcataggagaaatgggggagatgttggttagagggcacaaagtttgagctatgcaatataaataagttctggagtccaatgtgcagcatggtgactatagttgataatattatgctgtatatttgaaatttgctaaaaaggtagatcttaagtcttctcaccacacaaaaagataactatatgaggtgttttaagtgctaattagattaatagtggtaatcatttcacaatgtttatgtgtatcaaaacaccaatcagagagaagttcccctttaaaggaaaataaaaaaacaaacatccagctgtacaacctaaattatgcaatttttatttgtcaattatacttcaataaaggtaaaaaacatcttcagcttacatttaccagatgtattaggttggcggaaatagcaaataaaaataagagtgtcccagttaaatttgaatttcagataaacaacaaatctatttgagtataagtatgtctcatgtgatatttgagacacacttaaaatttttttgttgttcatctgaaattcaaactttactggacatcctgtactttatctggcaatcctaccttgcctcaaattctgcttcctacatgaagccaatcctaatagagtaatagctaatgtgtattgaatgtttactaagtcttgggttctttgctagacattttgcagggtacctgattcaatgtccaattaaaaggaatctcatgttctttcatacttccttagactgtgcaccactaatggcatttatcattataggagtaccgtctgtctcctccactagatcataaacttgagaattgaaatgttttattggtctttatattctccccaaaaggtgtgggccctcattgagcaagaaagcataagtgggttccagagatgcgaagttgcctggctgcctcccccagcactgcagacgtgtgaagctttctataaatggatggaagccctggtgcaaggcagtgcactgtctgctctatggaagactccttgtctgatcaagctcacccctgaagcagcttgctatgattttagagttaactgcagagcaaagaggaagccccagagccccatccaggttccagagggcaatgattccatgaaaagctgggttacactcactcacaatgactgcactggcaaaatgtcaggattagataggaaggtgaggcttgatctctgcacacattttcctatgcccacaagaagtgcccctttgggaggtgaacatggtatatagcaaagaagttcccgagagtaacctggtaggccttaggtgagtcggctgaacataatctgattgaaggtaaattaacagaaaacaatttggttgaatgccaccaccctagtgccatgtcagggtgtttccaaggatgccacctgagggctttatccttgcctctcagaatcagcacatctcacaccctttcttactcctggcctctgctcacatggcatctactcagagaggccttctctggccacctgatctaaagagctgccactctcgcatgtcattccattgactctgcttggtttttccacgcagtaccttataactcctggacaatgtgcatttgggaaggtatttgtttattctgtgtcttgcctacacaaagcttcctgaggccaaggcacaaggactggcacaaatgtcaggcatagagcaattgctgctcagtatctgctggagaaatggaaggctgtcaccatatggtggtgacaatgcatggtgggctttccagcatgtgagacctggattccagctaagtgacatgggcaaactatttaaattctctgagctataaatgggatgatgatatttgtcttacaggattgctgtgaagattatgtaaaatggtgtatgtaaaatgttggccatacacagcaggagctctagaaacagtagcttttattgttcctagaatatcccaatgctccatgataaaatgttcccttgttttgactgtagtaccaggagtccctaatgaggcacttctgtagctcactgtttggccccacactgcaggctgctcactaggctgggctctctgccccatgaacaggctgtattgtaagctttggaggagtaggttttgtttagctggaaaaccatgcaaattaataggcatgatacgagtatcattttttaaaaagcatgtgacaataagcgtatctttaaatgtgcaaaactggaaaaaagatggaagaaattttcagttgcttaaattataatctgccgtgcattggctttttctttttgagatggagtctcactctgccacccaggctggagtgcaacagcgccatctcagcttactgcaacctctgcctcccgggttcaagcgattttcctgcctcagcctcctgagtagctgggattacaggtgcccaccaccatgactggctaattttttgtatttttagtagagatagggtttccccatgttgaccaggctggtcttgaactcctgacctgaggtgctccacccacttcagcctcccaaagtgctgggattacaggcatgagctactgcaccaggtttgtctttttcctatagataactacatcctatttaccttagctctaatgagaaggatgtttgatatatctatccttttgaagttaatgtaatataaacatttaaatataaatgttaatataaacatttgaatgcaggaatttacacatttgttatgccataacttttggcatgactagaatagtttttactagttttaatagctttatttgtgtggtatataatgtatacagaaagagtagaaattctatagctatatgtttcagttttaaactatatctactcatcacagcttccacaggaaaagtaaaatatataaccagttatctatatatttgcaattgtataaatacaacttaaaaatacaaaacaaaacaacagtgttattttgaatggaatatttgtcttaccctgggctgacaccagaaattaaatgcattgatttctgagagcagctcactcattcactcatttgtctaaatttagcaatcatttatcctatgtatattatttctctagtcctgcatactatgtgcttaagataaaaaggcaaacaatgtatagtcttttaccttcaagttgcttacaattggcaagcaagtcaaatacgttatgcagctgagaattaagttaaactatgtaaacttgacatttttgtaggtcaaaacaataatatctacagttttatacggtttaatctaatataaaacaatggaaaaaatctgtaagctatatgctgagttctgttagaacacacagcagagagtgttatatcacttacgtattgctttttgttttgtttgtgtgagatatttcttaaaaagtcagatttaattcaggtctcaaaatacaagatgtttctgaaaaattcttatgtcatctatcataaaaatctacatgaatctgtacattctttccaaagacatttggtatcctaataacaagaagataatagtactttgacaggaactattttgttaaaacaatattaagtgcattcttggaaagtactaaaattatcttctaaattttgaaatgactaaattataaaaatttacaagattttggcatttataaatacagtctgatctgtaatgaattcactggacaacattggcaaagctatttaactttctgtagtttttttatttttcttttttttttttttttttttttttagagacagggtcttgctctgttgcccaagctggagtgtagtggcacaatcatggcttactgcagcctgaactccttgggctcaagggatcatctcacctcagctgcctgagtagctgggattaccagcttgtgtatcttattttctctatttgtcttgtgcacctcaagggtattgcaaaagtttgtctttaccaagctgcttactgtgaaaggtaaatgaactggtaggatgacctatgtaagtgtgactaatggagtgtttaatgtttattttcagaactcatcaattttctgacctcaaatggtttccccagaagttacagctgcaaagataaaataggaatttccttaatacccagaagtgattctgagttgcacttaagaaagtgaggaggaaaaaaaaagagctttttgtgatcgtgatttattctatcacactgttatttctctttaatctctttcttcaggaaagacacccattttattttttgtagttgaactgactttagattaatgaccacttaattgaataactttttatcatttttgagattaaaatctattctgttccaataatataataataattctgtttttatccttaggcataattttcatggtcttttacttaagcacttttaatcaagttctcattaagtagttatgagagtgtgtgtgtgtgtgtgtgtgtggagagagggagagaaagagaggtgaaagtagagtctttgagtttttcttactgttttatctcttttcatgtttaactgcagtatcaattacataattcatttttcaagattaatttatcttacctataatgtgcgtgatctagatttactaatttttggcacttaacgtatattaaaacttaaatgctagttttgaaaagtaaaaccattatacagataatcaattgatgtattaatatcaacaacatggattcattctcacatcatatctattaaatccatggtattcagtgcattgctggatggtctcactgtggttcttctagtaaagactggcaaacaaaatctaccggttggtgttggtttaacagtgacatgttaaaaattggagaaatatcatctgcaaggcatgtggaatttccacaaacaaggaattatatgaaaaaaaggggtaagtcaattaccaagatccatataattatctgtggtatttattgggccctatattaatggaagattttacataaaaattttacttagataaaatttgacaaaaagttaccaagaaaaacagtagagaaacctaaactgagggacattttacgaaattcatgactggcacaccagaacagacttccttaatttgtgaaggttgtgaaacgacaaagaaagactaagaaacagggaaccagaggtgactaaggagatgtgacaactaaaggtaatgtggtatttggatgggatcctggacagaaaagggacagtagtgtaaaaattgttgaaatctgaataaagtgtgaaggttacgcagtagcaaggtacctgagttggtttcttagttttgacgaatgtactatagtaatgtaagacactaacgttaaagaaaactggggcagggcgcggtggctcaccccgtaactggggccaggtgcagtggctcacgcctgttggggccagggatggtggctcacacctgtaatcccagcaatttaggaggccaaggtgggcacatcacctgaggtcaggagttcaaggtcagcttggccaacatggtgaaaccttgtctctactaaaaacacaaaacttagccgggtgtggtagcgggcgcctgtaataccagctactcgggaggctgaggcaggaaaatcacttgagcctgggaggtggaggttgcagtaagccgagatcatagcactgcactccagcctgggcaacagagtgagactcagaaagaaaagaaagggaaagaaggaaaggaaagaagaggagaggagaggagaggaggagaggaggagaggaagaaagagaaagagagaaagagagaaagaaagaaagggaactaggtgatagtctagtgaactctgcatagtacctttacacattttctgcaaataaaaacatgattccaaaattaaagctttatttgaaagcaaaagcaagcaaatattaaagttataaaattttatttccaaacttaacataattcaaaccccacacagcaataccaatcttaagagtaaaaaacaagagtaaaaaaaaaaattttgttttattgtctctgaaacagttacacatattatctcacttgacccttatcacagctttgtgatgtaaggaggacaaattatgaaggaaaacatttccagtccaaggtctcttaaatgttaggtcatattgtcttaatgtcacattttaactattcgtcccgaaatatttcaaagaagccactttcataacagagtggaatctgccctcctatgtttatctaagtagagtcaacatttagatttatttagtgaggattctctacttgcctcagttcacctcatgctttaaagttgccagtagaagaaaatctgggtgaggatctgagaaataggagtgagggccaaggatacggattttggatttgggaaacacatttttgacccagctgtagacatgattaaatgtcatgatcctgaatttaccacgatttcttccttcaaatatttcccaatgaaattgaggtgagcaagagcttaaaattgtgccagctacccttcccagaaagctttccaggttgctacagagcagtgttctataagccatggttgagtctaccatcaatgcccagaatgagccaatggcaacaataccatttgggccaaagctcatgtttatgataaccgttagtctatcttttaactaattttttttttgagacagagtctcactgtgtcgcccaggctggagtgcagtggcgtgatttcagctcactgcaacctcccaggttcaagcgattctcctgcctcagcatcctgagtagctgggacaggcacgtgccaccatgcctggctaattcttgtattttttaatagaaatggggtttcaccatattgcctggctaatttttgtatattttaatagaaatggggtttcaccatgttgcccaggctgttcttgagctcctgaccttgtgatccaccctccttagcctcccaaagcactgggattacagacgtgagccatcacgcccgtccccttctttttttttaattttttttttaattttttttattttgaggcagggtttgctgctgttgcttaggctggagtgcagtggtgcaatcacggctcacagcagccttggcttcctgggctcaaatgatcttcccacttcagcctcctgagtagccggcaccacaccattcccagctaatttttgaatttttctgtatagatggggtttctcaatgttgcccagaatgatctggaactcctgggctcaagtgatcctcctgccttggcctcccaaagtgctgggatcataagtgtgagccaccatgcctggtgtttttttccttctcaaagcaaaaaatattaacaggcttccagtatatagatcattagtggagaataattacaactgatgtacacttttatggggtgagttaattctgtaacaaacatttgttccaaaataatttgtgaaatctctctcctgagaatcaatatcatcaaaactatgttctctgattataatgcaataaatttagataataattaaaaatagaccgttgaaaaactcataaactttagaaccaaaaagtgttcacttcataacccttgggttcaaaaggaaatcaaggaaaattatgaaatactcagattgtagatagatcttttttttttccttttcattctgctttcaaaccacaaattcatgtgtggatagatcttaaaaacacaatgctgaaataaaaaagtagtaagtatgatgaagacttcagcagtgattgtcaaaggatttgtggtgaaggactagttttattaaaattctaatcagccacagaccaggtttttatagaattcaataaaaataattactaaaaaaatgaaatgttaaaaagcaatgatattcaaaatataggcccatatttttattatgagatttgaaagatataaaattctatctcagtaagtatatcagaacaaatataacataggaaaaagtttctccctgctaattctcaatttttgtacttagtgcagaaaagtaacagaagtttcgggaccagtattctaagtaacactaacttatagcataatgtcatttgcataatttaaaaatacatacacacacaaaaaaaccatgatttataagaatgcatacaaataaagaaacaaatatcaaacctattaaggtgattgtttattaaggggaagatggaacaaaaaggaaatgtgaataaatgagaatcaatcaatcaacagagcaatgagaatgatgtactgggagtgtggtaacaacttctgtctctgcacgcatacacgcacacacacacacacacacacatgcacaaacacaaagagataaatgaaacgtagtctttcccacactcttggtctctttcaccaacttatttatttatttattttgagatggagtgtccctctgttgcccaggctggagtgtgatcttggctcactgcaaccttcgcctcctgggttcaagtgattctcttgcctcagcctcccaagtagctgggactacaggtgtgcaccaccacgcccggctaattttttggtatttttagtagagacggggtttcaccatgttggccaggatggtctcgatctcttgacttcatgatctgcccgcctcggcctcccaaagcagcttattattttccatccactttgactcatcttactatctttaactttttctccctctttgagctacatcaaagtgat

SEQ ID NO: 433 - DNA, 49787 bp, Homo sapiens
gctgggctctctgccccatgaacaggctgtattgtaagctttggaggagtaggttttgtttagctggaaaaccatgcaaattaataggcatgatacgagtatcattttttaaaaagcatgtgacaataagcgtatctttaaatgtgcaaaactggaaaaaagatggaagaaattttcagttgcttaaattataatctgccgtgcattggctttttctttttgagatggagtctcactctgccacccaggctggagtgcaacagcgccatctcagcttactgcaacctctgcctcccgggttcaagcgattttcctgcctcagcctcctgagtagctgggattacaggtgcccaccaccatgactggctaattttttgtatttttagtagagatagggtttccccatgttgaccaggctggtcttgaactcctgacctgaggtgctccacccacttcagcctcccaaagtgctgggattacaggcatgagctactgcaccaggtttgtctttttcctatagataactacatcctatttaccttagctctaatgagaaggatgtttgatatatctatccttttgaagttaatgtaatataaacatttaaatataaatgttaatataaacatttgaatgcaggaatttacacatttgttatgccataacttttggcatgactagaatagtttttactagttttaatagctttatttgtgtggtatataatgtatacagaaagagtagaaattctatagctatatgtttcagttttaaactatatctactcatcacagcttccacaggaaaagtaaaatatataaccagttatctatatatttgcaattgtataaatacaacttaaaaatacaaaacaaaacaacagtgttattttgaatggaatatttgtcttaccctgggctgacaccagaaattaaatgcattgatttctgagagcagctcactcattcactcatttgtctaaatttagcaatcatttatcctatgtatattatttctctagtcctgcatactatgtgcttaagataaaaaggcaaacaatgtatagtcttttaccttcaagttgcttacaattggcaagcaagtcaaatacgttatgcagctgagaattaagttaaactatgtaaacttgacatttttgtaggtcaaaacaataatatctacagttttatacggtttaatctaatataaaacaatggaaaaaatctgtaagctatatgctgagttctgttagaacacacagcagagagtgttatatcacttacgtattgctttttgttttgtttgtgtgagatatttcttaaaaagtcagatttaattcaggtctcaaaatacaagatgtttctgaaaaattcttatgtcatctatcataaaaatctacatgaatctgtacattctttccaaagacatttggtatcctaataacaagaagataatagtactttgacaggaactattttgttaaaacaatattaagtgcattcttggaaagtactaaaattatcttctaaattttgaaatgactaaattataaaaatttacaagattttggcatttataaatacagtctgatctgtaatgaattcactggacaacattggcaaagctatttaactttctgtagtttttttatttttcttttttttttttttttttttttttagagacagggtcttgctctgttgcccaagctggagtgtagtggcacaatcatggcttactgcagcctgaactccttgggctcaagggatcatctcacctcagctgcctgagtagctgggattaccagcttgtgtatcttattttctctatttgtcttgtgcacctcaagggtattgcaaaagtttgtctttaccaagctgcttactgtgaaaggtaaatgaactggtaggatgacctatgtaagtgtgactaatggagtgtttaatgtttattttcagaactcatcaattttctgacctcaaatggtttccccagaagttacagctgcaaagataaaataggaatttccttaatacccagaagtgattctgagttgcacttaagaaagtgaggaggaaaaaaaaagagctttttgtgatcgtgatttattctatcacactgttatttctctttaatctctttcttcaggaaagacacccattttattttttgtagttgaactgactttagattaatgaccacttaattgaataactttttatcatttttgagattaaaatctattctgttccaataatataataataattctgtttttatccttaggcataattttcatggtcttttacttaagcacttttaatcaagttctcattaagtagttatgagagtgtgtgtgtgtgtgtgtgtgtggagagagggagagaaagagaggtgaaagtagagtctttgagtttttcttactgttttatctcttttcatgtttaactgcagtatcaattacataattcatttttcaagattaatttatcttacctataatgtgcgtgatctagatttactaatttttggcacttaacgtatattaaaacttaaatgctagttttgaaaagtaaaaccattatacagataatcaattgatgtattaatatcaacaacatggattcattctcacatcatatctattaaatccatggtattcagtgcattgctggatggtctcactgtggttcttctagtaaagactggcaaacaaaatctaccggttggtgttggtttaacagtgacatgttaaaaattggagaaatatcatctgcaaggcatgtggaatttccacaaacaaggaattatatgaaaaaaaggggtaagtcaattaccaagatccatataattatctgtggtatttattgggccctatattaatggaagattttacataaaaattttacttagataaaatttgacaaaaagttaccaagaaaaacagtagagaaacctaaactgagggacattttacgaaattcatgactggcacaccagaacagacttccttaatttgtgaaggttgtgaaacgacaaagaaagactaagaaacagggaaccagaggtgactaaggagatgtgacaactaaaggtaatgtggtatttggatgggatcctggacagaaaagggacagtagtgtaaaaattgttgaaatctgaataaagtgtgaaggttacgcagtagcaaggtacctgagttggtttcttagttttgacgaatgtactatagtaatgtaagacactaacgttaaagaaaactggggcagggcgcggtggctcaccccgtaactggggccaggtgcagtggctcacgcctgttggggccagggatggtggctcacacctgtaatcccagcaatttaggaggccaaggtgggcacatcacctgaggtcaggagttcaaggtcagcttggccaacatggtgaaaccttgtctctactaaaaacacaaaacttagccgggtgtggtagcgggcgcctgtaataccagctactcgggaggctgaggcaggaaaatcacttgagcctgggaggtggaggttgcagtaagccgagatcatagcactgcactccagcctgggcaacagagtgagactcagaaagaaaagaaagggaaagaaggaaaggaaagaagaggagaggagaggagaggaggagaggaggagaggaagaaagagaaagagagaaagagagaaagaaagaaagggaactaggtgatagtctagtgaactctgcatagtacctttacacattttctgcaaataaaaacatgattccaaaattaaagctttatttgaaagcaaaagcaagcaaatattaaagttataaaattttatttccaaacttaacataattcaaaccccacacagcaataccaatcttaagagtaaaaaacaagagtaaaaaaaaaaattttgttttattgtctctgaaacagttacacatattatctcacttgacccttatcacagctttgtgatgtaaggaggacaaattatgaaggaaaacatttccagtccaaggtctcttaaatgttaggtcatattgtcttaatgtcacattttaactattcgtcccgaaatatttcaaagaagccactttcataacagagtggaatctgccctcctatgtttatctaagtagagtcaacatttagatttatttagtgaggattctctacttgcctcagttcacctcatgctttaaagttgccagtagaagaaaatctgggtgaggatctgagaaataggagtgagggccaaggatacggattttggatttgggaaacacatttttgacccagctgtagacatgattaaatgtcatgatcctgaatttaccacgatttcttccttcaaatatttcccaatgaaattgaggtgagcaagagcttaaaattgtgccagctacccttcccagaaagctttccaggttgctacagagcagtgttctataagccatggttgagtctaccatcaatgcccagaatgagccaatggcaacaataccatttgggccaaagctcatgtttatgataaccgttagtctatcttttaactaattttttttttgagacagagtctcactgtgtcgcccaggctggagtgcagtggcgtgatttcagctcactgcaacctcccaggttcaagcgattctcctgcctcagcatcctgagtagctgggacaggcacgtgccaccatgcctggctaattcttgtattttttaatagaaatggggtttcaccatattgcctggctaatttttgtatattttaatagaaatggggtttcaccatgttgcccaggctgttcttgagctcctgaccttgtgatccaccctccttagcctcccaaagcactgggattacagacgtgagccatcacgcccgtccccttctttttttttaattttttttttaattttttttattttgaggcagggtttgctgctgttgcttaggctggagtgcagtggtgcaatcacggctcacagcagccttggcttcctgggctcaaatgatcttcccacttcagcctcctgagtagccggcaccacaccattcccagctaatttttgaatttttctgtatagatggggtttctcaatgttgcccagaatgatctggaactcctgggctcaagtgatcctcctgccttggcctcccaaagtgctgggatcataagtgtgagccaccatgcctggtgtttttttccttctcaaagcaaaaaatattaacaggcttccagtatatagatcattagtggagaataattacaactgatgtacacttttatggggtgagttaattctgtaacaaacatttgttccaaaataatttgtgaaatctctctcctgagaatcaatatcatcaaaactatgttctctgattataatgcaataaatttagataataattaaaaatagaccgttgaaaaactcataaactttagaaccaaaaagtgttcacttcataacccttgggttcaaaaggaaatcaaggaaaattatgaaatactcagattgtagatagatcttttttttttccttttcattctgctttcaaaccacaaattcatgtgtggatagatcttaaaaacacaatgctgaaataaaaaagtagtaagtatgatgaagacttcagcagtgattgtcaaaggatttgtggtgaaggactagttttattaaaattctaatcagccacagaccaggtttttatagaattcaataaaaataattactaaaaaaatgaaatgttaaaaagcaatgatattcaaaatataggcccatatttttattatgagatttgaaagatataaaattctatctcagtaagtatatcagaacaaatataacataggaaaaagtttctccctgctaattctcaatttttgtacttagtgcagaaaagtaacagaagtttcgggaccagtattctaagtaacactaacttatagcataatgtcatttgcataatttaaaaatacatacacacacaaaaaaaccatgatttataagaatgcatacaaataaagaaacaaatatcaaacctattaaggtgattgtttattaaggggaagatggaacaaaaaggaaatgtgaataaatgagaatcaatcaatcaacagagcaatgagaatgatgtactgggagtgtggtaacaacttctgtctctgcacgcatacacgcacacacacacacacacacacatgcacaaacacaaagagataaatgaaacgtagtctttcccacactcttggtctctttcaccaacttatttatttatttattttgagatggagtgtccctctgttgcccaggctggagtgtgatcttggctcactgcaaccttcgcctcctgggttcaagtgattctcttgcctcagcctcccaagtagctgggactacaggtgtgcaccaccacgcccggctaattttttggtatttttagtagagacggggtttcaccatgttggccaggatggtctcgatctcttgacttcatgatctgcccgcctcggcctcccaaagcagcttattattttccatccactttgactcatcttactatctttaactttttctccctctttgagctacatcaaagtgataagaaatcaacgggtacacatatttcccacagggttaaatgtgtattttgttttcacccttttcatctgaataaactgaaggtatctattataaataccttggctagtttatactaattagaatcagagcaaaagaattttggatcttggaaagatttcaactatgctgtccatacatttattttttcatttctcgctcactttcaacccacccacaggtatgaaacagaatcttcacaggtatattttaaaatcttggtatttggtcaggaagtcatcaccctctctgttgattcaagaactctgctctgtagttgtatggtttaaagtcacagtatcactacacctgatctcttcctttgtagatgcttccctccataggtttgtcacggtgtaagacactacacatctgctttgcacttcgcctcactacttttcagtgactagagtttttctgtgtccgggaaaataaagaggagggcttagcaatagtcacctgtgatttgagctgtgaaaaaaatatataatctgtctctgggagaccccaaactctttttttcacttaaaaggtttttttggttgatttctcaacataaccctttcaattgccactttatttgaggagacatgatgcaactgagtctagaagggtttttcatgctttagttcttactgtaggctttcagtgctcaccgctggatattaataactaaacaagtagaattttgaaattcttttttttgtctctgcctcactgggttgcaaagtgaaccacaaaattaatatgtactcgttataacaagccaaacaatgcagagatatctaaagaaaaagttagtagcctctttctaccaatgaatgctggattattcaacatgcagatcaagcttgtactcaggatacctacaaaaatcaggagactcctaaatgtttttgaaagaatgctatatttgatatttcagaagaagaattggacaagtgataatgggagacatcaggaatctttagacttccttatatttattttgtgttttagtatttttttgtttttgagacaaggtctcactcactctgttgcccaggttggagtgcagcagcacaatcacggctcactgcaggctcaattccccaggctcaagtgatcctcccacctcagttttcctggtagctatgactacgggtgtgcaccaccatgcctggctaacattttttggtattttttatggagacggttttaccatttcgcccaggctggtctcaaactcctgggctcaagtgatcttcccaccttggcctcccaagtgctgagattacaagtgtgagccatcatgtccagccatgttttagaattttcatgtaattatatattgtggattggttgacaggagaacgagtatgtacaaataaggatatatgtcaagattatattttgttcatgaagtatatgtatatacaactttacataatttttattttagaattattcttacatcttaaaatttcacttattttgtaaatatttccatattcataaaaagctattgtgcttatataatccttatattctattttatttactaataagctatcttgcttgtccattcttccactgttaaatattttcttaatttcctactaatatgaaatttacatctatatttttatttctgtatataactattttcttttttaaaaatgattttcttgggataaatcactagagtgatattgcatgaaaactcatgaatattgtatatctctttgtagctatgaccagattgctcacacaaaggattttataggttcacaaagggtaaactgtatgcattctggctttagaagtggtttggaggaggatgagatggtagcaggagaggctggatgtaagaaagggaacaggaagtgggtgattgcccttatcctggcaagagatgtatctcaactacaaaggtgacaatcggtatacaggaaaaaagtgaatatgataaatatataggaggtgaattcagcaggcttgatgagtaattggatatagggaggtagaaattggatatggggaggaagattggaggatgagtcactgttttttttgcatttgaggactggatggagtagaacaggtttgggagagtggagaacactaagcataccatgtactatatccccaaatccaacacaatggctaccacaaggaaggcattcaataaatgttaattgaataagtgcttcatgcatacatgtatatatgaaggctgcaaacaatgaatcaatgtttctattttccaaagcctcccacgtcttcggttgtatatctagaagctgacttactgtttttatctcttcaataggatatcttaaattcagcactcctgataacaagaaagtgaaaagattaagaaggaaattgtgggcctggcatggtagctcatgcctgtaatcccagcacttttggaggccgaggcaggaggatcccttgaggccaggcatttgagaccagcctgggcaacacagtgagactctttctctacaaaaataaaaattaaagaaaaattaggcaggtgtgatggtgcactcctgtagtcacagctactcgggaggctgaggaaggaggatcacttgagcccaggagttcaaggctggctgcagtgagctactgttgtgccactgcattacagactgggtgacagagtgagaccctatatccaaaaaaaaaaaggaaaggcaagaagaaagaaagaagtgtgaaaagaaagagagtgcaaagccaaagctcaggacttcggaacaaccagacccacctcataaaattagccaattacttcccacagtcagccttttgctaagttatgtagatttagctattccttagaaagttggcgaatgaacctgaactcaggctgctaaaaagtcaatatccctgaatcagaaggaagagatggttccattcagctcacctcatgactagtgagagatagggcaaatagctccctaaagctctctgctctgagttgcagtcctttcagagtgaccaggtcccaccacaggtgtttggagctaaaaggttctgctgggagactccccaagcagctttcctgtctccagctgcactttggatactatgcatcttggttgtgtggctgtgactcctgcttagtgattatgttcttgtatagagtattgtcagtttgggttgctgtattttcctgtatttgtcctgtatctcctagagggcaaaagccataattgctatttcctttgtaactcccaaagagttaggcataacatttagcataaaatgaggactcaattactactgatggttgcccaattgtaattggtaaattggcaaaaagtggtggtttttaatggtcaataaaggtaccatgtatctagtcttaggaaacaaaaggtttattgaaatgcatgtagataaattatcatcagcataaaactgttatggagttttcaacatggggtcttttgctcttaaaatgaagtgaagctttgcaagtccattgtccaataggaaaaatattatatctctctgttcagataaagtcctttaaaaaagtaaatctcttttgaaacggtcttttaaacgtctccagcctgtgaatatataacaaaacaaaaaccatattaaaaagacataattttctccatttaaaaagaagaattaaataggaatgatttaggggtaataaacaaggaaaatacctgggaatttgaaactctaaaatgttctcctattttattaagtacatactaaaatatttgatataatgaaaataatttacgaagacaaaataaatgacaagtggtcataaaaatgcaaataaagtcaatcattttattattatatatttaggaacaaagttgaaatgttatctcctcaaataaacaatttttaaataactctgatatcagtaatttggaaatacagtcctaaatgagttttaatttccattgaaggctaaatgtccttaatagaagacttgaaatcaataaatatagtaagagaaaaaaggaagaaactttcagagaatttctgaaactttgtgggtcaatagaagttagcagttaattttctacaaatcatcctcagggtaaagtgagtcatattctgtttccgcagggtgctctggtctgacctgtttggctccccccaggtggtgttgctgtccttctccaattgtgagtctgttgaatgggattatcttcatagtggttttcttcatggaataccaccgggttttccaagtggcccaaataatgccattatcataaccattaggagtagatgcttttgagtaagtgccacctaaaacaagtcgtagatgtacatatcattattctggaatctttttacctctgcaagtctatgaagagctgtctattacgaagtgcattgccagttacataaaatttatagtattatctgctaactgaaaatatctccaaagattcctaaaatatcaatttataaaataaacatattattaaacaacatctgtgctgtgactcatagtcacatccacactttaaatttattcactactagtagggctagaaacccaaagttccctaattggcctctgtccctaagcttatccatcccggactcagctgctgtggaccatctttcttcaggcaggttagaagagaaggagccacaaaattcctgatgaggtcaactcaggttatttgaaagcacaattttgttggttgattgaggagctttaggaaatggttctggcatgttattttatgtctccattttaaagtgcagcctctgttgatttgccttctccttgtcctagggaagcagatctcatgtaattctgtaaaaggcttgtcagagcacaacactggcatgaactacagctctggcatggcgccccgggtcacacagatcaagcattttcccttagagtttcttctcattatgtggtttgtgagtgcaaagataagttatgtttctccaatttaaaaatattgtgaaaatcaaactgttactttaaataaactgtgcaaagtttcctagttggtgattggctaggacatcaggaggtaaggttgctcatcttggtagatgaggagactatggtttgctacaagcccggagtggtttggaacactggtttcactcatctacccagcagatatggtagggaagtcctactgatgctaaacaggtctggtctgactgtttggctttcccagggtggtgttgctgtccttctccaacggagagtctgttgagtgggattatcttcatagtggttttattcatggaataccactgggatttccaaataatgccattattgtaacatggatcctttagcatcggtaaggcttccccacacataactgctgggtaggtgagtgaaaccagtgttccaaaccattccaagcttatagcaaactatagcctcctcatccaacccccatcctaaaataagtgtctactgtcctcagactggtctcttctctcaagctttcacaaacccctgcccttaccagtgcttgccttctctttattctgttcctccaaacacctgttcactgcgtgtatctgacacaaagctcatgggaagccaggttaatgtgtcaacaagcatccatgtagtaatgttaatccatccagatcatttatgttgtatgtctaaaggagatcccacaacccacagtgccagctatgatggtgatagtttcacatataatgccaaactactggatattttgcagcaggtggatttctttagaagggctaattttaggcatgaacttggtattatccacttccagtttcaaagaacttagttgaaataaagaacatgataaaatccctactatctttataaattattcttcatttcttcatatctatttattattttttatgaaaatagtatacactatacattaacttggaatctaagaaaggaaaacataccttggtaataaactccattgagatggccagcgtgacacttgttcatccaccaaccagatccatcctgttcagcacagttgccttcaaacttatcattgtcattgtcccaggtactgaactgcatgccattatgggatgtgaaaaacttgtcactaggatcatcgccaaaatcaaagccatcaaaggcatctccagcatccccaccagcgaagtaggcatatgttaggcggtacttgtcagcttcaggtcccaccttgaacatggcatagtctgcagtactgagaagaaggaaatacaaccatcacatgctgaccctcctcagggatctcagaagttccctctttcgtaggatgcttccttggaatttttgactttgtttcttaaggctgaaatttgctcattgagtgaagttttttgcaaatctggcaagaggcaatagatatgtgaaccagtccacagctcattaacacttcccgggatgggcctagaagcctttgaagcatctctgaaaactaataattgcactcacttggatgcttttttgcttgtttcattctaagatcaaatccagatgtgtagatgactctaatttcatattttctacttttattgaaatgttatgtgttgcacacacattatcatagatcacagaaagtatctgacagtgagtgacccttaattattgcacaaaacttgaaggaggtacagttccattagccactcatagcacctgaagggttaggtgctaaagggattttcttcctcaaatcagtgtggtagtggcaagaaggagagcttctgagggcattacacaatcaaagtcttccctgtgtggtccaaagcatgtgagctgaaggagttagagagattctttcctggaaaaaattgtgcaagtggacaacacttctatagagtgggggaaaggatgggccttaatgaatgaacagaaatttccagaaaatatttagcttattttctaatctccagtggctgggaaatggaaggtcctttcctagaagaaggtctactgactatagcactttctggattaaaaaccaaccaagcaataaaaaaaagtccatgtgtttgaagacaatatatttcactattccttatacataacaagagggttggatatttttctgcattttaattaggtaacaatgcttaaaaccttcaaatatctcaagcaaaaagaagcctctagatcatcaaaagagctagctggtttacttttagggtagctcatgatttgacagaataaatggccatcaaggcactgagaagtctgaagaggctgtatttgcttttcaaccaggatagttgttaagaggacaggctctaaagttaaactacttgagtctgaattctacctctaccacttatcagcaatgtgactttgagcaagttaatctataaaatgggattaataataatacctgcttcatgaaatagtaatttagactagataaaattataattttatgctcaattcctgggactgattaaaagttcagtaattagctattactctgaatggttccagggtaattagattgtaccaatacacttagattcatcctgaatagaatttacctttttggattgcccaagaaccaaacagactcctggagaaaatggtggctggatgtgctgtttgcatttgtcaggctgcatttgccattgtctattgatagttggaaagtgcacattccaggcaatctttacaataaaaagttggaagtcatttcaaaacagtacctggttctgccattccagtcttccagttccactcttaatgcatatgggatggcagactgtgtgcttatcaaatgaatcttctcatttcccagccaaaattctgttgtgccagtaggagacagatgtccaaatccttctttatattgaatccagtttttcttgaaatctacactgccatcaagtctctaattacacatttgcaagagcaaaaggagaaaatagactatcaatgcatgtaaagagaatgctgtcaacattttgtcaaaaatacagagcactggttctatcaactcccaactaagtgatcttggccaagctacctcagtttcctcatgtatcaaataggaaaaatgatggttacttcttagggttgctgcaaggatcatgagagagaatataagagaaatacttaagagggtttctggcacatcataaattctaaatgagtggtaatattaaaaagacacctagacgacttcagaactctagctggatattactgattcttacacttatgatggaacccattgctcaatcggtgtctggcaactaatgcttccaccattcattccctctgagcgccccctgtagaaacagttataacagtggtgggaggtaaacagaaagtaaaggagccaagattcctagtgggtatcagcaagtggcagatgcaacacaggttccttgtcttggagcagcccaagtgtatcctctggtgtgtgaaagggtggtgatggtggtggggtggtggggggtggtgttgggcttcctcatcttgtgatgggaaacctcaggtcttgacctacctgacaaaagagtttccttctttttatttgtcactgtggtactatgattatgtgccaccatgaatctacaaagtcagtgccagtacaatatagagtcaagtcacaaactctgaaactatactgcctaggttcaaatgctgactctgttgcttattagttatgtggtcttgggcaagttatttaaccttgtgtgcctcagtttccttttctgtaaataggagtaacagaagtaccttcctcttagggctattgcaaggattaaatgagctacggttcacaaggtgcttagaaaagtatctgccatatggcagaaacaatgtaggaatttattaaatacacatggtggggaaaaaattaccttctgaaacacagtccatccatttccagacccatcgatttcacagtagactaagaattgctggttagctttcagaggtttaataaagtaaagcccgctctgtttagctcccttattggcaatgtcttgacaatctagagaaggagaatcgacttttactgtggtttgaaatgcaggtaagactgtgccagccttgaaaaatagcttttaacatgtagtaaactattcattttccaagaataattttcttacttttcacatcagcattccttttaaactgttttttttagctattcaagaaaggtctagacaactgaaattcttagacttaatgggtagccactttctaaactattcctatactttccagtacatactttctcctttacattacttactttgatgaacctaatcccaatataaccttcatcagttacctttcccagtgatatcatggatttgcaccgtgtctttgcaaggttcctggcactgtgcttcaagctgggctaccttctctttcaggttaacaatcttttgattatttgaattatatatttcctgcaaatatctacaaacagaaacataagataacaaaaataagaagacaaaaataagtattcctttcagaagagtaattttatattttctttggaaactgctaagtattttcttaagaagtgctttctgataaattattccattcttgaggaaaatgtaaaattatattactaaattaacatgaattaaaattataaactttttgaaaaagaaaaacaaatcaaaaaatcaattaaaacaggaatacaatgtggacctgaatctttttacttagaatggggcatattgtctcaactcccaacacaaataacaaagtccttgtcaataagcaaatgtcattgacattttgctttttactttatgcataagggacagcagatagcaacctgcaagagtggcgggactggttaataggaacaccccctgatgctttagaagcaggaaaagctcagttcagtaattcacatgtgctgaaggagtatacctttcacttgtggatctactgaggctatacatataagcttcaatctaaaatataacttacacagggacatgatctggaacgttattgtatgtaaaataaaacaacagatacttcccctttcttctttaatgcttctggttacatagctttgggaatggactgggggaagtaaaaaccctccttttgtagttacttacagggtggcttgcaaatatccaaaaatgatagaaaactgtctacaatgcataaaccgttctttctttgaagtaaaaaagggtagacaaactatttgtccacgttttccctctaccttgtcttaggcaatttctgtacaataacctccttcaacttcaatgatggacaataataatgcaagtaataataataacaataataacaagggccctctgatagcaaaaagaggagaaatctttcctgggccacttctccctagctactatttatctcaatttctcaagctgctttgagaaaaattcagaaaaaaaaattggggaaaaatattaaaactgtatctgagaccttatgttcagaaagtttatgagtccctgagaagctttaacagagacattcacttccaaatgaagggaagagactatgcaggttcattctgcaatgatcaatatgagctttgcaatatttgccacacttagtctctcaagacatgtttcttcctgctccacattcaatataatttactttaggagccaaaatccttactatgcctctgcttgctaatttttttaaccaccaatttgtcagcatttttataaagaggattttattttcaacacccaaattcctatgagattgattttatgttgtaagataaatgggggatggggaaaaaatttttgataaatatggtcaaactagcatttgaagacatctagaacatctttcttcaatgtgattattaataagcaattataacccagtataatttatattgcactaaaaacttctatctctactatgctcaacataatcaggcataatgtcactgggatattataaatggggaaaacacattaaaaattactttcactcaagtatagaatattaaataaaaactaaatcagtcttgcagagcaaattaaaacaaaaatccttaccgaatacttgagtcatgtgttaaaatcgatgcttcatatttcataatttcttctaacattttcctggacttcaaagtagcagcgtctatcatatctgtaatataggatcagagacataaaaatccttaagcaaatagaacaactaaaacaacagcaaaagaacttcacagattattattattattttttggtcagtagtctttattttctcacttggttttgatgattcatcaggattataagtgagttggattgcttttatcagctgtttgacttctgatgttttgttttcaacttgatgtaagatgtcttccaaagactgtagatccttgtctactttggtttgataagtagacaggaaatctgcaatgccacaggtagttggacaataactaccctgaaaatataacagtgattaaaaatgtagacagatgctactcttaaaatctattaagaaaaataggtaaaacctagactatgtttttaaaaagttacaagtgccagatgatatttatgagggaattatttctattcctctgcccctctccagttcacacacaaagggagaaacataaaaactacttacgaatctttcatctaagatgcagcagttgtctctggtagcaacatactaaaagagaaaaaatacagaaatttcactagtttattatctgttttattttccagctttccattttaaacaacgttttgtgaagagcacacttactgctacacatgttgaagagagaaataaaagagcatagaagtagagaattaaattccgggggtgcaaggaccaactcatgatgtctgagtgcccggagctccgagccttgtagtgtcagcactgtcacctctcaggctccaattgtccctttatgtaagctcctgggatagccaggactgcaaatggctggagctgatcacggggcctccttaccagaagggtgggcaggtctttcccgttcctttttcctcatcctggcccccaacctatactgtcaggttcccagattttgcacacaggttgaagctcctcctttttggcccagctcaaggttttttctctgatccaaaattatctgcaaaggctagtgaagcattatccattgctgtgaggaggagggcagtcctggaggctgtgtgatgcaacttcttccagtacatggctgagagcaaacagatatgacctcgaactaagcaaacctagtctatccttaagatgggtcctgctgccatcacctgaattaccaaaagaactttcttagcttagggatcagttaacactattattttagcctagggatcagttaacattattatttttaatctgtggctgtggcaggaggagactgacttcccccatgtcccagttcactattcccaggaatgaatgaccctggaaatacattcctgtccctctgtgtcaaccatgttcataggctctcacttctcagggagcttttgagctcaatcttccctttgtctgaaggtgggcatggcaccccatctgccacagagaaaagagccaggagcccacttcattgttcctgtggttccatcaagctatctcagagaagagaaaaatccacctcccttgtatctaaggagagtagaggcatagctgaaggaaggggcaaaatgaggtgctggggaggggccatcatttctgtttggcccttacagcatccttgtgtttgggaaaacatgtctgtcatcactgcctattgagatttatcactgggcgttacactattattaatgtctctatttttggttatccctcatttcttcctctggaaccaagcttattataagttttgatgaaatatgttagtgggagaaatgcctccagtttgaaagaaatactaatactttaattctgtctttacaaaggtatatttattgactcaaaaacaaagataaatattcatattcagtaaataatcaataattataacaaagtgaacacatcaaaaccagatttgttgcttttcttctcctccttaatatatccctctctgacttagcagttattgtcaatcatatcaccataccaccagccaattaagtctcacaatctttctcatccatcttttccactcagctaatcagttgtcaatcaagtcagttgaattaaacatttaagtattagtattctttcaaacagctctacctcagatagcatttgtagcaaccttatattatatgtatacatgctgtatccactgcattagattgtaaactgatttctgtggctacggcatctaacatatatagctgtacttaacatagttgtagttaacactcaataactatgtaatgacttgaatcagttgcctctgtgaagaagaatgggatgcagaggtggaggacaggattggaaaaaaaggctttatttttctctgtaaactttctatatttagaatgttgaatgtatataaatattatctactaaaatatatataatgaaaatatgtaattattgatcattcacaaagatttacatagtacactgataattacatcttgctaactttttaatatgatttgaacatgaaaggtgactcaggcattgcctttgccttcaagaagtgtgtagctcaattggagaatgtataaataaatagttgttaaggctctggagtccatctccctaggtttgagtcccatctttacaatttactggctgtgtgattcagtacaagttactcaatctccttgagttccattatccatgtcagtaaaagagagataatacttatgatatggtatttacttaatagggctattactaagatttagtgggataatgtgttgagcacattacccaattcatggtaagtgttaagtaaatgtttgtaaggtttatgaattaccaaatatatttggtataaaatctatgtaaataggaaactcttttaatagagctattattggtagatttggttcacagggaacaagctttgttgttctagctacagaaattctctttaataaaaaatctgttgcaactaactgcagtctccttctgtaagattccccagagaagaaagcacctggtcgtttagtttaggaaattctatccaaattgattttaccaatcaaagatcaaatgataatataaatggattgcatgccttgtgagaaggtatacttcctatctgtaagaatgttcaagcaaagtgtgtttagacagagcatgtctttgtggttctttttgctgaagaccataaaatattagtttgttgaatttagggtaacaattcatgcagccacaggttgggttctgagctccttaatgtcataaagtttcattggttgtgttaagatatataatattcacaaagttgataaacatttaaattgaggacattagaaattctatcttatcccattttagaagtggaatacttgtattacaggcttttaactgacttatattggaatccagatgtgttatcacaattttagagaaaataatttccttttactacaatctcaagtcctaaatccaaatcatataagacaagatgcttgctctctgagaaaaaaaaatggtcaacagtgatttagcggtctacattggccctgcattcaatctagtatcacttaggtttattaaattttaactagttttttcatgtttgggccaattttttctttgaaaaatgataaatgattgatgaattccaggaatgaagaatgtttcttaaatcacagttcttctacttccaggtatgttttttgagataatagcataggtagtatttaagccaaaataatcatttactgtaactctgaggtcagtgggcttgtttattgaaataataatgtcccaaattccctatcgtccaaccgtttgtgttctgatttgaaaacacaaatctacagctaacagtcttcgtgtatattggtaatttactctgtgagccaagtctgttacattcatctttgctccaaaattatttgctgaatttaaatttgattatgtagaagacttcttgacctagtgacaaatgatatagccctaaggaataatagaaagaactaccaattttgagcatcttctttatgctagatattatgtggtagtatagtttttgttgtcatgtatattctctcatttaatcctcaccacaagcctaggaagtagatataattacctgtatcttataatgaaaaaagaaaggcctagagatgttgtgtaacatatgcagggtcagtgtgccagaacaggaactcaaacccatggggcccaatgcctgtgctcttaaccatgaatcttaatacaaccatgaagcccttcttaatttaaaataatacacagatacaaggtgttatgagactcaaagttattcactgatagaatggattttaaagatgtgtgtgtgcatctacataactgtgtgcatgattatttgaacacacatttacatctatctaccaacttatctatcttcttctctgggttagagacaagattttgtgaatgatcttttacagtctttgagtatttctcaaacctagatttgtgttgttttatgattagcttgtgtttatggtccttttttttttttctctctctttagagatgcagcctagctttgttgctcagtctggcctcaaactgaactgctgggcccaagtgatcctcttgcctcagcctcctgagtagctcggactatgggcacgtgccaatgcacctggcttcagtccaattttagatggaagcagtttttcaatgctaactgcatggttcaagtttaataggacttgataaattgaattccatcagtaagttaaagggagagacagccactgcgtggtcaaggaagctcaaatcaatggcgacaatgatatatctgtttttctaacaagtaaaccatttctagatctaagctaaatttatagcctgaaccctcagaactggatttcctaaaaactggcagaaagaaaatgacctattggcatactgaaagccagtccaacctaatagtaaaaatatcccattaagggcaacagagttgtctgttagaatatttgctttgtgtataaaaatagcccagggaaagtgaaaacgcaaaagtttcttggtagtctgtgaacaatgtgcttttagtttcactatgtaaatcaaagacaaaaacaacattgggcacaagtaaaatggactccctcactggcagcagaacagcacccacaggttgagttttgcacttcttaacttcataaagtttcattacatgtgtcatttgggggatctgtcctagcggcagggatgttgaaaaatctctgctgtgattggaatttaggaaataaagtactgggtgcctagagaaagaaggattatcccattggcaattacagaggccaaagaggctggaaattagccatttttaatactagtttgagactaaggaatgatctgaggtgccctggattgagacaaattgaacagagaagttggatttaagtgttttgctgtgccacattggtatctgctactggtttgtttgtgtttttccatctttgtgtaatctacgattttaaatctctcaccccatgaaagaattttcatgactaaatatgattagcaggagatttacaagagcaaatgagtttggggggaaaaataaaccaccaccaaccaaggggccaagttatattcacaagaatgtgctccggaaagaagaaactttttaagcctttgagtagaaatactggcctatgttgaaagtggacaggcccctgtttgagaaaaactgtagttattttgtcatataaactatctttggaggaatatatatatatttctaaagaaggagagaaaataagaagaacagagaatgctatcagatcatcaaagcaattcagtcatcttatctagcttaacgcacacatttgctttaacctgcaattttgaatgaggacaaacaaaacatttataagatttagatctttgttttaaattctaactacttgggttagtttattgtcttagtgtaattgcactatagtcctttcaaagttaaatccatataggatttgctgtgtacaaaggctaactttctattgacattttgaaggactttgcttcatccatgaaaggtgacatatctctgtcttcttcaagtgtagatttctgtgtatactttaccttgagtggtggagcagtgacctctactaagtaaacaaagatacgatttgcaaaaccagattaagtcaaagacccaaatatttattgaatgttgtgcaagaaagcctagagtgtaaatcacactcttgatggataacactatggctgcaagttaccgaagaatggtctggcttcagggctgaccagagcaagctcattcacaaagaaacaaggttaggtcaaaatttagaacactgcattttaccttttataaacagcagagaggaaattctgttgaccaagatccaggaaaccgattgcttaattatgcatccttctgcgtcggaaaactacctgatatttacatatcaatacttcctgtggatctcactatgctttataaggttaatttcctcattagtactttattgatatttaatactacatcatctaattatggctatggaaggccccatacccctcctcatattaacctgatatgttaagccatttctagctctgaccgagaaactttatagaatttatctaggataatatctaaaataatgctgaatcaaatatgcaccacaaaatttggctgccgggtaactgcacactgtcccatggtgttcctctgctggatgctcagatcaaagtggtcattcacttagtaaatacatattgggcatatactatttgccaggccctgttctacacaatgaaccaaagtcgctgctgataagtttacattctagtggagagaaagaggatataaacaaaatattatataatgtcagttggtgacacgggctgtgaacaaaaatgaagaaggattaaggaaatgaaagactagaggaggtgctgttttagatatggtggtcgggcagcactctaggttaaggtgacatttgctgggtttctggtgaggctagttacaaagctcatggctggctcactattgccacctgcaggccccaatacatctggaggatgaatgatttaaagccaacagacacatattttttcatttagagctgtcagagatttgacaagtgtaggtaagtaatagaatgagaagtatactaagagaggaacactgcgcaagttagccagaaaataccacaatgaccatctacacattactattgagcttgcgagttatgccattctcttcatcaaaatcctctgaggaattcccatttcctgtctaattaaatataaacttctcagccttgtatttaagcttctccaaaaaaaaaaggccaatataacttgttaggtatatcttataaattggattgaggtagcatatcccataaaatttcaaaattttgccttcatgaggctgacataaaaggtattttaattattatacaattattattatataataccttaattaaataccttcataatcatataataataccttaattaaagtaaattttatgtaagcctcatgaaggcaaggatttttaatctgttattatctgtggtgcttgatcaatgcacccaataaatatttgttgagtgaataaaatatattttactaaaatattaagaattactaaatattactaaaacactaacataaaatactaaaatgcagtttgaggcagagaacatgaccattaagcagataacaaaatcattcaagaaaaggaaatacacccatttcaaaaccatctgtttcagagcaaaaatctgtagcaaggcaatcagatctcacagtgtgggtcagtgatagagctgatggagagtactggggagggaccacggtgatcctcctgactccatttgagtggatcaggagaggagcaagacattcaccgtgattttttgactgaaggaaactttatatgtatttaatttttggaaaactaaagcaaaattgtgtcacattttaaaacaactccaagtttgaatgataaacataaaatagagtgggcaagtcctagaatatcacaacactaggaggaattgcctagagccattggtcactgtttctcctgatttgctttataaactataaggagagaaagctccacataggcctctgaaccactcctgcttgactggaacaggtgggctgccctaaccaaacagtacaactttaacaaaggtcagtcaaatcctagaagatagggaaatgagggagtttatagcattgtgttgtgcatattctctagaatacgcagaactagggctagaatgtgtcatagagaaagccaagtaaccttcacctggccctttccttaggtttgtctgtcttggtcccatgctttagctcagctcactcagctgtgctccaagtcagcaagtggtcatgacctacatttgggacactattgcaggaccttgtgtcacccactgcactccatttctcaactagaatttgccactgggcctcaggctgccacagcctatggttactgtcaggaaatgcaccagtgcattccagcctggccccagcacccagccctacttaggtttgttgtggtcccttctttctccattcaggaatccctctctacttcctgctctcccaatgacaggatctggtaaactcatatgaagtaaggtaggaaagactgagctcgcctaaggtattacttctaccaagactgaaatttaaacttgagaaaaacccggaaactgaagacatcagaatctaaaaagagaattttacaaaacagtcagctattagaagagaattatgggatcaaatacaaattaggtaactaagagaagttgtataaagccatttaatgacgtaaagacgttttatttctattttaagtacttagaatttcttctaagcgactatttcttaaaatgctccttagattactctgtttcactttgttaaaaatgttaggttcctcagcccctttccagatctaccgaagaagagtatctgggagtggaccccaagaatcttcattttattaacaaacttccccagatgattattatacacagtaaaataggacaaccactgccctacacaggagagtaaccatacctgctttacctaagaaggccttatttccattagacaatctcaaatcttgtatacttcctctttgttagagtatttaatactgaagatatgccataatcatttcttgttgcaaaaagaatttaaaaaccaacggtatcagtttttttctattgaagtttaaaattagattttggtaattcagaaacaaaaagacaaatacagcatgttctcagttataagtgggagctaaaaatctgcacacatgcacatacagagtggattaatagacactggagactccaaagggtgggagggtcggagaggggtcagggatgagaaattacctattgagtacatgtacatcattccgatgatggttacactaaaagcccagacttcaccactaaaccatatatctgtgtaacaaaactgcactggtaacccctaaatctatgaaaataaaaaacaaaacaaaaacaaaatagattgtggataatccagtttaatgatgcatattgctttattgatgaatatggcatcaatgctgcccaaagaataaaaagtagactggccccaagccccagtgccttaacacattacagaagtaggtgttcaagaaattcaatcgctttacagaaatagaatagaaaggacttagggaaagactgaatgaacacgtaggagaggggtaaaagtttcacagataataactctgagaaacagtaaatatgggagaacactaacatgaataggaaaacaagaagaggaactggtctgctgaagagagaaaatgaagagtccaatttccaacattttaagtttggatgggagtgagacctgtaagaggagatggcgtcagaatgctggagatgatagagctttgggaatgagaactagtggtgagctgatggagggtgaagtgagtttccaaggagaaaacaacctgaggacagaatgtggactgaatttaagagctggcagaacaggcagagaggggaagaatggctctgactctacctcatggccctgtgcctacacaaaagccaaagactttcatatctccaaatgacaccgcttggatgtgatttagctgtttatctgtgtcttggaatgctttcaaatgaaagaattataaacagtattttatatatatatacacagatatatgtatacacattatatatacatatacatacatatgaaacctttgctgttagatatgtcagataatacagaatgagtggtaatcatttaacacatttcatgttctgtggtgccagaaatgggtaggctgtctagtaaatagattttgttaattagtacattctgtgatataatctagttgtgctgaatttcctgagatgcttggaggaaactgttggatttcattgtgaatggatttttatgttgcatatgtcattacagattttgatgaatacatagggtttattagggctaattcaaaccaaaattcaaataatttagaaatatagtactctattctagctgggtgctgtggctcacgcctgtaatcccagtattttgggaggctgacgtgggaggattgcttaaacccaggagttcaagaccagcatgggcaacaaaacgagactacaaaaagtaacaaaattagatgggcgtggcagtgtgtgcttgtggtcccagctacacaggaggctgagacaggaggattccttgagcccaataggtccaggctgcagtgaactgtgtttgaatcactgcattgcttttcagagcctgggtgatagagtgaaaccctgtctcaactttgtctcaaaaaaaaaaaaaaaaaagacaagaaaagaactgtattttaaggcactttgttggaagcccagtcctctctaatggttagtgtaatacagccacctgctggtgaagttattgctagacagcaacagccacttctgtggatacacctgtgcactcaaattgccacatagattcttgtagattaaatatcccccacctattctttttgtatgtgtgtaagttcttatccatatgttaggtttctctgtttttgtgctgaaggggtggtgaagtagatatttttcttagtgtcagtcaacagcatttgaaatgggtcctcaggtcaaaatctgaaattcagaatttgggattctctgtgtgtttggaggtacttccaacctagcagttagggtataataaatgacccccaaatggcctctgtatattggcttctaagctgttgatttttttttattttttccaatttattattattattttaaaggataggtgggggtgggggctctcgccctgtcacccagcctggagtgcagtggtgcaatcatagctcactgtaatctccaactcctgggctctagtgattgttcaatctcagccttttgagtagctgggactacaggcacacgccacaatgcccagctaattaaaaaaaatggtaaaaatgggatctcactgtgttgccaaggttggtaaggttgttgagttttgttttaatggcaggttgtcaacaagtcaaatgtttatatatcttaatgttttaaacacagtccaaataaacagattttcagctatttagaaactgcctgctctgtataccctgagcaactgcacccaagatctgctagccatagataagataaactttgcagctaaaaaaaccccactcagcagctgccctttgagggtatctgatcctgagattttgcagtgtgttgagggacgttacctaaatacagaagtcccctctctgattcctcttcttcagggcttcctttatcctcctccccttctgggtggtggcctccatgctgccagagctctggatgggtccacgctgtgtgggactccccctcaccacgcaaacctgttaaagtgcttccaaaatagagctcattgtgtgctactcccacttcattattatgtttttttccttgatcagcctcaaaatcccttgaaaaactcattctatcaggtgagaaaggcctcacctcagcagggagaaagaaatgaatgtcataaactctggtaactctggtttttcatatggtcatggccctaagtttccctctgtgcctcttcttcaattactgttgttcccctgcagaaagcaacattatttcctctaaaagggcaaagattacttggcgatactggtgcctctagtcgtcccttcccaaagcgtccaggagaactggtcacagaagggatgagagcgcaccatgtgccacaccatgtgccacaccatgtgccccactgtggaggctttttttttatgccttggcctcctaagggaacagttgtttcagctgtaggtaatacagcgggaccttagtctggccctgagtttggcgaagggctctttatgctcttggcattgctagtagagtgcaggaagggaggagctgcttaaacagacagttcagctcaacgtcaggccttgactctcagggactcagcctgaaacccaggtggatcattcagggtactctagagggacaggactaataggatagatgtatatatgatgtatatatgaaagggagtttattaaggagaactgactctcataatcacaaggtgaagtcccacaataggccatctgcaagctgaggagcaaggaagtcagtctgagtcccaaagcctcaaaagtagggaagccgaaagtgcagccttcagtctgtggcctaaggcctgagagccccggcaaaccactggtgtaagtccaagagtccaaaagctgaagaacttggagtccgatgctctagggcaggaagcatccaatacgggagaaatatgaaggccagaagactcagccattctattccttccacattcctctgcctgctttcatcctagctgcgctggcagctgattggatggtgcccacctacattgagggtgggtctgccttgcccagtccactgactcaaatgttaatctcctttggcaacaccctcgcagacacacccaggatcaatgctttgcatccttcaatctaatcaaggggctggatttgtttaaccatcacacaaggggctgtttttgtttttgttattgtttaagagatgagctctccctctgccgcccaggctgctgtgctgtggcacaattaaagctcactgcagcttaaaactcctgttctcaagcaatcctcccacctcagcctcccatgtagctgggactacaggcatgcatcaccacgcccagctaattttttaaattttttagttttgtagagatagggtctcacaatgttgtcctgttagttgcctagattggtttcaaattcctggcctcaagcaatccttggactccccaaatgctgagattataggcaaaagccaccaagcccagctgggctcactaattgaaggttatgaaagcatcacaccctttttaggcaatcccttctccctctgtatggctgaatgtaggaaaaaagtatctccctcccatggttagttaaggatcagactcacttgttctaatcttgcctgtacaagttagtagctctgtgttcctggactattagttagcctctctgtgcctgtttccttttatcagactgacttccttgctcctcagcttgcagatggcctattgtgggactcaccttgtgattatgagagtcaattctccttaataaactccctttcatatatacatcatatatacatctatcctattagtcctgtccctctagagtaccctgaatgatccaccaggctgtcggggcttaaattccagctttataacttacttctagctgtgtgaccttaggaaatgttcctgcttctttgtctcaatttcctcaattgtaaaaagggaataatattattacccatcttatagggttgttttgtctaatgtgttaataaatgtaaacatttaaaacattacataagagctgattttactattattataaaaaagctcttaaaacagtttctggtcagcattaagaactcaataattgttaatggttaatattagtcatgtaactacccagataatccataaactgtattagtcatcctgttaagaagcaaggcctggtttgtcttcttccttttattatacaattttactgcttctaatttaaactcttgcctccctaagttcaatccaggaagagagtcaggattaaaggactagaaggaaagacaagagtgctgatggaaacaaaactactcaaatataggtgttaaagagagagaaagagacagagagggagacagagagagagagagagagagagagagagactttgtcagctaaaaattaactagactgtcagctcctgcgtcttctgcatccctctcagaacctggaaaaaaatatttgcagtggtcctgatgtccgcagcaggccttgctccgatggttttgcagagtagcaagtgaagatttccaaaaggcggaagagcgggataagagaagaaaaagagatagataagctagcacaggaacaaggctcagagcaggaaagttaccaggacagaacagggagggactgactgtcacagggcagggagcaggaggaaagaagccacttttcagtgaaaggtatttgtaattacaagaaagccaggttcttcagggccctggagaaacagaaatacaattccctggcttctggggagagcacttaggggctcctatatcctcatccctttggattttcccttctcaaacgccagaatttggaaaagggtggggagggtctttaaattatttggcacaaactccgaaaaagtggagaggctgtgagccagccaccctccgactaggttttgtggtgatggttgctgaaatcacttgcgcacaggatgacaggagctgggaacctcaaggtaggtgagcctgccaagacgcgggtccgggactcggctggggcgcagatggagcccgcccggtagggggtgtgcggagccctgttttctgggctccggcccccagcccagcccagccgccgcaggagcgctcggccagtaggtgtctctgctcctcgggcggccttgagcagtgcctaacgttgagcgtgaggctcgtgctccgggtctcgcgggcggccgcctcgggcgtcgagtcccggagattggacagacaccagagcctggggaccgcggagtgaccgggtggggctggagggcggcgccgcgccttctggggagacgcggaggtatcaggtaatcccccggcggcctgcgccaggcagtcatgcccacccgagccctgggacctttttcacctcctctttccagggaggaaaggcggcaagggaggcgcgaggagttagttgcagccctggaggcagacactgaactccaagataatgccacttggactctgaaagtgggctcttctctaccacgcgatccagcttagcttttaccttttctctagaggtagagagggccgggtgccaactccttgctcaacttctcactggaaaagtggctgccttcctccgtctccctcccctgggctccggccaggggagcaaggcctgctgtggacatgaggaactccctgccctgtcctggtaactttcctattctgcaccttcgctttgctagcttgtctacctccttcttttcgctagcttatctacctccttctcttcttcgctcttcctcccactggaaatcttcacttcctagtccgcaaaaccgtccagcggaggtttgcaacagagtcggctcttggaatcatagccctcttaggttggtggtggttgtggattagagggcagcagtagggacgattaaaagtagtttttaatacttaaatggtttagggctttcctgtgcctttgttctgcctaaacattagtttgatttactaaaatcctctcctaccccatttctggcatttggtaaagaaaccaagtgaaggtaatcaggcctcgggtatttatgtatgtagaaatcatctagcaaaatagaacgaatagatcatttcttttgaggggccgtaaacttttttgtatgttgaagtgtgttttgatacttgggtgttcccttgttgctgtggctgcctgtttcatttgatttgagggcctttgagcattgtctgtcattgacattctactactgaagtttattccttttgtttaaagtcttaatattcttttccagtccccctaatgaatcacggttaccatgagaaggatgacctcatgttattgaagaaaagtcctggtctgagattcaggaaacaagattcagatggcttgtgtccagtgtttagttctggacccatttctggggctaagtggctatgtgattttggttgttcaatttatttaacttctcagaaccttggttttctcatttcagggaatctgggaccaataacccccatccattgttatatgactgctaaattcagtcttcaattcttggctgtcttcttccttgattaccagtggcatttaaccaaagtgatcattgtctccttgaaatactttctacttgaagtctcatgaggtcttcctccttcctccttgcccactacttctcagtctccttgactggttcctcctcaaccctaaaagctaaagtttgatgtgtactaggcctcttctctgactccatcctctctaagtgctctccatctatgacatttaacatcaccatcttggaagaatcccacacttatgcctccaacatggacttgtcctcctctaaaatccatactcaggtatccagctgccttcttgacatcttcataggcatctcaaaagtaacatgttcaaaacagaactcctgatctttaccccaaatctgattcttcccaagtcttgttcacctcattaaatggaatccctatctttccatgctcgagccaaaatctttgcagtcaaacttgatgtctaccatcagcctagtccacacctgcatctctctagttgatctatatcaatagcctctgatctagtcatcctagttgctctcttgcactcccaaagttttttttctgcacacagctgcaagagtacctatgcaggagaatcatatccctcattggatgaaaacttcccaatggtttatctcatttagagatctacaaaactgatttagtttcctcttcttttctggtcttatctatttctactctcccttttgctcaccaacactgcaggcacgttggtttcccagttatgactacaatatgccaagcacatccctgtcttgggaactttgcacatacttgcccctcggtgtggaacactctttccccagacagtgcatggcaagcacttcacttccttcaggtctctactcattcaaatattatcatatcaaagacgctgtcccctgaccactctacatccagtagccacaattctatgggattcctcttggtattattcttttaactgagacagggtcttgctttgtcacccaggctggagtgcaatagcatgaacatagttcaaggcagcctcaaactcctgtctaaagcaatcctcctgcctcagtctcccaagtagctgggactacaggtgtgtgccaccacatttggctaatgttaagattttttttcttttctttccttttttttctgggtagagattttgtcttgctctgttgctcaggctggtctcaacctcctgggctcaagtgatcctctcacttggcctctgaaactattggaattacaggtgtgggagacactgtgcccagccttcttggtacttcctaaccccttacctggctttagttttctccacagtacttgacagctgacaaatattttgttgtttcttttcctacctatactccagaaagtgaactccaaagagggcagagattgtgtccattttgatcactgcattgtctccagtgcctagaacagagattggtatgcaagattaccaatgtatctttactgaataaattatattcatgatatttataccatagggctaaagtgaagatcacattgtgaggccagtttgtatactggaaaaaaccttggctttacaattagtgaaacctggtttccaatcatggttgcacactcactggtaatgtgaacttctcagaaggtccattttccacacttgtgtgatgggtataatataatatcttgaaggtttattttaggcataaggtgtaacaaaaatgctcataaaggactcagctatgaggaggctagaaaatgagcagttttgagaatatatgtgtgaatctattttgtaagctctaaagccacatttatacatatagagctaatattactggggacagttgtgtgaattgtactgtgcaaagcatttcagggtgaatggtttcagtgcttgtagcatactgaaaattagaaaatgaataatggctgggatctatacctatatttacacattctaatggaattgaatgtctgacttcctattatttctgcataattttcccaataacctgtagttctgctgtgcctgagaaggcaatacattatcttattgtatcttatcttattatctcaatctgtcaaaaaaacatgtgcacaaattcagccacttaacatactcacatgaaacccaagtaattagctggtgacaagctgccagtcagcacttcctcagcatggtcctgctagatgagtactgactggtttattttagttcagcacacattgctaggttttgaggattcaaagggaaatatagtatgtccttattttcagggtactcatagtctcttgctatagtctagcctagctttacaaggggtatacaattcaggctctttgaggacaggaaggaggtcagctagtatataggtctgtaagagcttttaactgccacagtttgaagacagcaggaaggcagacagatgctatgctgattccccttttcatcttgagtttttccacaaaaacttcaaggtataggccatattctttagactatgagttagatttgaagccttaggacacaaagagttgtgagttgagggtccctgaaatccaggttcagttctgtattcttgtttgttgaagtttaagaatcacagactacaggactcttaggtaaatgcggacagcttcagaacccaagtcatcttgtcttggttgtgatgtaccctttccctggtttgcagtcccttccccaatgaccacacgggctcagaacaggacttaaagaactcagatacattgctgaactatctgtgtccacctgccccccaaacccttctcacctgctgcctccccagcagccccatctccccaaataaggttgtgcttcttccagatgtggaggttaaggagaaaatgctgcaaggtcaccagaagatgatccccacatatgagggctcaaccagggtagagttgttctagatctggacagcagaacagcttgcttcaccgtgagacagtgcacttcaagttaaaagaaattcttcaatgaagaagttggctgtggccagtaaatgccttcatttccctatcaagtaaaatagccttgtaagcactctcagaacagggaccaggatttattcatccttgcctggcacagtattgatcaactgtacatggttttattctctaggaatattcattgcctcacatttattcatcaggaattctgatacaactacataatgtgaaatacgtagacattgttttggcctcacatttacttggcaataaatatttcttgagcactgtgctagatcttgggagtacaaaccagaatacgacctatttcctgaacccaggatactgttcttggtgtatttttatttccagatttataccaaaattaacacattttttaccttttgaaaatccgtggctggtataaatataaaccatagagaaatactttaagatgattacttctgttatcttctcatctgtatttacttttttaaaactctgatgaacacagcacataagcacattcgttcattgaattctttagtaaccttcaactccacagttggagtgagacagagtccagctgagctccccagggctccatcccttgtagagaatgacttcctttagggagggcatagtgcagcccttgggagagggttgtctagctagacctctgctgctgctgtatccttgaaccttaatggcttggctttggactgcttgccgattcttgtacactgaagggaaggaaggaagactgacagcccatttgactgctttttgagttttccactgtgtcttcaatttattcaaatgcctttcctgaagaaagcaaatttcatggaccactccatttgcttctggactattgagacactggcagatatgatttaagaatctgaacatggaaacatttaaaaatacatgacactaatttgcagtgcagtttacatcttcgtctcggattttacattgtctctggaacctatagcagtcatttgaattatccatcattcacaaagccagctttgtctgatttttgtggcatccatttgttcttgtctttcttttcttcctttccacaatattcccacgatcattaacacaactgcttgttgtgccctgtttgaattttgcatttgtatccctgttactaaacatctcaatgtcaaatcccaaagtgagatttttcttccttcgctgaaacctttgatgaaaagttactgttttgtgtgcagtttgtagaattgcttaattggagattgtcagagtttcactggagggtattgcatctcattttgaaatagttgctgttgatttttctgagctcaagtgctctaaaaacaggcgagctgcgtttaagttatcattattatccatgataaataatgtataattaattatgggaccatttatctttcagtatttcccttcttatatcttaatggttttccatacgcatattacataatgtctgagtttactcttttatgattgtaaaagccatccagcttatagggtattgcagttacattatacagaaaaaaatgtgtaaatgtatatttcaataattaaaaaatacttttaatgctgcatttattttatgtatttccataagactgctatgccaacgcctctgacctagtgggaaatatttccatctttggtagatctttacctaaaatctttatggtaggttttaggaattccaactgaatttcaaaataaaagattctatggtagttaataagaaattagagacaaggaatcctggagtatgccatgagagcttacaaaaagtgagagatatgaaatgaagaaactttaaggtgaagagctgttttaaaatgtgctttcctattcattcagccattattcagccaacatttgctaagtgctcatcaggtacagtcaaagagactagggacacacacacatcaagacaaagctcctacctttaaaaatactgttttagaagaaaacgctgtcttgtgatggtactttttctttaggcttttatagctctttttttgtactcttggcactgcctttgcataacatttttaaataaggaagtaacttgaagaaaaccagttattttaggattatggaaaactaggggcttggtaacagcaaatctttcctttgaggatgctactgacccctcatgtttacatcatttgtcaataagcaggatcaatttttgccttaattatgagcttggaatagcaaagacaattgtacattggataaaggaaatatataatttgttttaaaatgagacctttgccattggaaggaaataattcctggagatcactgggaattgggaaatctgctaccactgctatattttccttacttgtctgttaccatataataatttacttttagtcagcataattaagtatatggattaccactctaatatgccaatggttgaaatgtaaagtacagtgacaactcattgagatagagagggttggcaggaaataccccaaatgaataaaaatatatctacaacttctatatttggataatgtactgtaaaataatattttactcatacattttttcaactttgattaattcattgttaaatttaaattttaaaaagtaaaatatactttgtgtttttcttccagttcctcagcttctgatgtggtttggctttgtgtccccaaccaaatggcatcttgaattataatccccacgtgtgtccaggaagggacctggtgggaggtgattggatcacctgggtgatttctcccatactgttctcttgatagtgagggagttctcacgagatctggttgtttgataggtgtctggtgtttcccccttctctccttctgtctctctcctcccaccatgtaagacatgtcttgcttcctctttgccttccaccatgattgtaagtttcttgaggcctctccagccatgtggaactgggagtcagttaaacctcctttggttataaattacccaatctcacatagcatctttacagcagtgtgaaaacggctaagacagctactgtatggaaagaagctagattcttttcttttctttttttgagacagaatcttgctctgtcactcaagctggagtgcactggtgctatctcagctcactgcagcctctgcctcccaggtgatcctcccacctcagccacctgagtagctgggactacaagtgcactaccacacctggcatatatatatatatatatatatatatatatatatatatatatatatatatatatatatatttttttttttttttttttttttttttttttttatagagacagattcttcctatatttccccaggctggtttctaactcctgggctcaagaaatctgcctgccttggccagcctatttgattttttattatctctcagagataaactatgttcctgctaactgctacaaaagtaaaatcgcctataagttaactattgtagtcaccttaatagccccctagccttacctctaaggctagaccttgaagacaataacttaaaggctaattatacaatgaggtgtttatgtaagtgatttattgtaaaactttaaaaatgttaggtgctattgttgttagaaaaaaggtaagtagtttggttatttaccatctttatgtcagaatatcttaaggaaatatagctaattatagaacttttgttcacagagatggatacggtagccttatttataacacacacacacaaaaggaaagacctaaatgcttaacaataaggaaatggttaaataaatgaggagagagtcaggcaataaaatcttacatagccattaaaattttatttatggaaaaccttattaccatggagaactgcttatgctgtcatatattgtacctgataaatgtcttagtcttaattttgaaatatttcagttgctacagatggattaaattttcttattttaatatttaaggcctagagattggcctgaggcatggaatatcccagcagaaattccatttagacaagagaaccattcaaattatttagcttgttagagaatatgtaagtattattatagctatagcatcaactttgtgatttttagtttatgtaagaagctgctttgatttggtgaaattaatttaaaaagtcctcatcataacatacctagattaattatctagtctgtgctttaaagggcagtttgttcacaaaggaggtacttttgaatagctacatcacctacagtaactcttactccaatctacccttttggttttctgtatctgtttctataatctattaactaaatattaaatcactggtttctctaaggaatagtgtagacttttggtaatgaatgttcagggcatgtaaaatgttggtaactttaggttttagtgaaactttggagttaaaactgcggctagttgggtgcagtggctcatgcctgtaatctcagcacttttggaagctgaggtgggaggatcacttgaacccaggagttcaagagcagtctgggcaacatagtgagaccctgtctctacaaaacaattttttaaaaaatgaggtgggaggatcgcttgagcctgggaggttggggctgcaatgagctgtgcttgtgccactgcactccctcctgggtgacacagcgagaccctgcctcagaaacaagtgaacaaaaaagctgctaatagatcacaaaagagaagtggttactttgtttagttcctttaaagcccaattttttcactttggtggtaatgaaagtttagtgcatcttgaacataataccagatctttccatcaattgattatatttcaaattcacataggattagttcatatcaaacaacataaatattacaatttcttaatgttcattatggccttggaaacattaaaaggttgactagtctgcattattgcctttgatagccaaatatattttatagtgaataatacatttctttttatattttaggacctgggctatgctcctgattttatacagactgccatggctccagatataaaagaccaaataaaaaggtaatttgaaaactatttttcatatggattatcttaattttttgtattcagtagaatgtcagattttaagatagaatctcacacacacacacacacacacacacacacacacttagtaaaactgtttgacttacatagtcacaaaaagtaaataacttgatgaacctttaaaaggcctttaatagacacatgcacacatatgtttattgcagcactgtttacaatggcaaagtcatggaaccaacccaaatgcccatcaataatagactggataaagaaaacgtggtatgtatataccatggaatactatgcagccataaaaaagaatgagttcatgtcctttgtggggacatggatgaagctcgaaggcatcatcctcagcaaactaacacaggaacagaaaaccaaacactgcatgttctcgctcataggtgggagttgaacaatgagaacacatggacacggaggggaacaacacacaccagggcctgttgtggggtaggggaaaaggagagggaacttagaggtcgtgtcaataggtgcagcaaaccaccatggcacaggtatacctatgtgacaaacctgcatgttctgcacatggatcctggagcttaaagtaaaatttttttttaaaaaagggctttattggccaggtgcggtggctcacgcctgtaatcccagcactttgggaggctgaggcgggcggatcatgaggtcaggagatcgagaccatcctggctaccacgatgaaaccccgtctctactaaaaatacaaaaaaaaaaaaaaaaaaattagctgggcatggtggcgggggcctctagtcccagctacttgggaggctgaggcaggagaatggcgggaacccgggaggcggagcttgcagtgagccaagatcgcgccactgcactccagcctgggtgacacagcgagactccgtctcaaaaaaaagggctttgttagttgccttgtggttctgaggaaagaaggcggttgccattatgtgaaagaatttttagaaatacaaagccacttttaatgccccagcattttgggggatgatttccagttggagaaagttagaactgaactgtttgctctctggcactctggatatcctgtgactcaggacgaatcattttatgatgactcccgggagttagtgtgaaacttgaggctatgaaaccaatcaaagcagcttcccaaactagaaccaaatccaggactctggcctcattatcacagtggtttgatttattgagctaatgaagaaagtcttttgtaattgagtactgaatatcatatggtgttactgaatatctccttttgaagtactgaaaatgtacttctgcttaagaaggatcaattccttagaacgtgctgttgttttagatctacatgaggagctttgaataattaacagtctggatgttgttgctatgtacgacttagttttattaatgacacatttcagaatgcaccatagagttggaagggctgtctttaaaataccgttatcatccaggagggggaggtatatcttcttttaagaagtcaattgcccagaaaaaagaataaaactagttatactatcttgcaaaaaaagaaagcaaagcttcatttgaaaaagtaaattttgtcaaatttgcaaaacttcttataaaatcaccagaattgttgctaaattttctatttgtatactatctttcacttttttttttctatttgtatactatcttcactgagatgtgaggaaaccctcacatgtcagttaatccacatttatactgctcttgctatgtatgtatgtgccaaatatagagctggacatcacagggcacaagcagtgttcaagtcaccagtgcctcatagatgagagggtggaaataggaacaggttagggggaggaaattatattcaataaaggtacctgttgaaactattattgggaagtatttctgtaaacagggtgagaatggtgtcaacctaaattgagcaacagggattaattctcaagcttattagggaatagcaaggaactgcaatcaacataatacataatacatgcctgctatggaggaccataagggtatccgagggagttgggaaaaaaaggaagcttttaaaggcaaaaagatatccatgtacctgttttgaaataaagaccactggctacaggtctttttacatgcagtggcatttgctcattggtggtactggctgttggtaggagagagttttcatagaagtggcttaactggaaatttccagttgaggaagtcatttctggcagttcctggtgcaggcacacatgtgtgagggcccttccttcatggcctcccactgcattttgttagggtttgacataagtgactccgttttgggtactgacaattttcacaggagttctattcaatagaagtaacagtaagaaggttgagaatggatataaaggagagtaggattgagctttagggaacccctggagagaggagaaatggtagcagctaaggagataacaaatgggagaggataccaggtgcggtggctcgtgcctgtaatcccaacactttgcgggttggaggcaggctgattgcttgagcctaggagttcaagactagcctgggcaacatagcaagacaccttctctaccaaaaatgcaaaacttagctggaaccatggtgcatgcctatagtcccagctgctagagaggctgaggcgggaggatcgcttgagtccaggagtttgaggcttcattgagctaggattgcatcactgcactccagcctgggtaacagagcaagactttgtctcttaaaaacacacacacacatgaggggagggaggtgaaccctggaagaagtgggaagaatctggatgatcacaggaaccctggaaggagggagttttaagaaagtagtggtgctgggggaggaggctaggaggatagagtgagttcacatggacctgaataggtttaggagaatgcacacagagaaaaagattttgtatttgattagaaagagtactagtgggtataaattctaattatagacacttagtaaccattctttggccagttgatagaagtggtttagtagaacatttaagtccatatagagcttgatgcagcagatgacagcagacaaggagcaggaaaagcagggtttccatcttgcctctgtcactaacaagctgcatgaccctggttgaatcactcgtctctcctctccttaattgcttcatctataaatgaagtttcttaaattgatgtccaaggatgagcttcagagattctgagatgtctgaaattataagctaaaaaaaaagggggttttccctctagggagaaggtctatagttttgatcagatcccccaaagtgataatgcatcctaaaaagttaaggactactggattaggtgatcattaaagtcctgcttagtatacaatatcaggaatttttaatctctgactttcgtttctctattgtattccatatggcctgtctcccaaatcactctcagagaccactctaaggattagattttctgaaatgtaattgactgtatcagtcatccccaggggattatttagaaaatccaggcaatttttaaaattaaagttaatcatttctttagtagtccacagacattttcattaggacacaacctttatatcactatttatatcatttactagccatgcatctaatgatcataaacaccagaagtggctgtagccacttaaacacatgtggatgtcattgcctttagtgttttccctccaaaaggaaaaaaaattgggaagaaaaagcagtttattgaatgtaaactggtgactgagctcccatcagagtgattgctttggtggttctcttctggcaggcatgtaagctcttagcagtagaggggtactgagcccccaagtatgctgctgcccttcataagatggccaggaaggccggtgtggatttgaatacaacagttatcactgtagataatgtcatgggggatgttattgacatttatattatatgcttctaagcaagaagccatcctgccatgtaatatacaattatgatcatttaatttggtgtaattaatagataaatcttaggattgagctctagaaatccctttcaggtctcttgttactttataaaatctggtgtgtcagctgcctttactggttaatgatttatgtctataaaccacctatgtggatggtattcaagatgtattgtttcactgaaagcaatgtttaaaataactctggacatttctaattcacacagaaggttaagctgaaattgtgcttcttataaatcataaagttatttagcacaatctgttatccacctttctcatcttaccatcatttggttctaactgatggattttgctgcaagtgatacattctacgtgtcacaacagaaagggaaatgaagttaataaatacttttattaacacttcagtttgaaaagctaaatgttgaaggcaagtgtcatacttttccttggagctgtttctttagcaccgtctttagctcccagtgaaatgcaagaggtggaaaatcccacctgtgaaatccaaacacagttcttgctggtcatggatatttgcaatattggtatgagctgtcaggtgcacaaaacactaatttgtttgcacgtagacacaagagttctgctagttatttatctttctaaagccattgtcctccctgacaggggcctgctaaatgtgctgtctatgcagaaggtttagatttatgatttgtgaaaattgttctggagataacattgtagagttgttctgttgctgtatagatagtgtattttgagtttatctttctctttcttcgaaaaagaggttcttgtttttacactaccgacgtagtaactggatgagtgatttcactgccataactgcttgttggtttattttaaatatggtgtttgctagcatgtggcagacttctgctttaatgatcacaatgtgatgacaaaaatgctaaatcttatccaatggaattacaacatggacccgtttttgccttatggaaaggaaaatacccctcagagattttaatttgctcataaaaagcaaatgtggaaacagaaacaccttgaacagagaggagaagtaggaacctgcctgggaatgtagaatttaatagccgaaattctatttcctgttgtgatagtaactgaagacaacataaaatatacttgtcaaaataataacactctttaaaattccacattggtgatttaaagatggagaagtttcagctttaatttttggtagggaacttgctttttgactttgattgctgtggacaggcaatccacagcaatcagtcaatgtggagtagcagaaaatgtcctcggcagctataatggcttgataaggtgatatgcagtttttatgaatggctgtacccaagcagcatcagctgatgctatggtggcttagaaattttcacaggcttttacctgttttccataactctagccatgcaccctcctttttgaggtgatacagagatcaccctttataaaaaggccctctctagtgctttggcacttagcctgggaaaacatgcctgcttcaggaatccctggacacatgcctcatgattataagagagaagattacaaacctcatgtcttttcaggaaatatattgatagtttattcttaactttggcttgttagggagcatcattctttactagacatagactactggtaccttccaaatatggtaaatcactttgcaagaacaagaagaggttatatctatgtgtttataacaaccctatgaaacagataactgtcattgtcctactttaaagatggagcaatttccatccttttgtagagagctaaaaaaaaaagaaaagaaagatgaagaaacttggggatagaaaagtcaggtgggttgcctagggtccagagcctacactttaaaccaccaggcttcacttttcattgtgtttctaaggccctaacaacatgcttattgttactagagaattgatgaatgttatgaaagtgaggtaggagactggcaggacttgttttctggtcacaatcctgctgaccaaaacaggatctgatccagacaggataaagtgaaaaactagcagaagccagaagatggcaacaaaagccatccctagctgccctcattgcttattggcataagatactcccaccagtgtcatgacagtgactggaaagtgaccactcatttctatggcaatgactcagaagttaccgcccctttctagaaagttctaatttacccattcctcaatttatattgacccactccttaatttgcatgtaattgacattggatttacatgaatataaatacagctgacaagagcccgtacattgctgactctgggcacactgtctatgtgttagccctgctctgcaactgttcaataaaagattgctgtctaacaccaccggcttgcccttgaattctttcctgggcgaagccccagtgttggggcttccctctcctgcatgaaaaggaaacgttcagggagcttagaaaatttataactgggggtcctaacatgttctgaaggggatgaggatggtctttcagcagaagtgatgttgaaattgagatctttagggtgaatataatttgctctggaaaaaaataaaaggtttcaagtagaaaagactacactgcacattttcagccctggagggatatgctggagggatgcaggaactgagaagtccagaatggtgacatgcagagaaaggagggtgatgtgcctggagagacaggtgggagcaagaggggagaggactttgaaggtcatggttctgattttgtactttactttgaacacaaataaaaaacaactaaagaaaagtaaaagcagataagttatatgatcagatgtgagctctaaatatatcgttctggctacaaggtggtttagagacaagagatggaaataaggagcttactgatgaaaggcaattgagagctagtggcttgggcatgagaaagaactgtgagtagtgtattgattgaagaaatttttaggaggtagaactggcaagatttcataatagagggaatataaaaggttagagaaaagtaggtctcagtcttgtacaccatgccagtctcattacatttaataaagtagtattaaagagacataaacccatacacactttaaaatctctaacagttaggaaatgactaagcaaactctttgctctattgagtaatatgtcatcattaattattgtgtttataacagttgtaagacatacaaaaggcatattatttaatttcaggtaaataatgagtgcatgatgataaaagtataccagtagtctgatttaatatatgctgaaaacataaagatgtcaaaatcctacgcatagggaagaatcaggaaagaatttacaaaagatggtatgagtaatttataccggctgctatgagtaatttcttcttctctccttatttatt

SEQ ID NO: 434 - DNA, 79794 bp, Homo sapiens
gcaccccggggcacccacgtggcagagtggatcacgcagtgtggcaccccggggcacccacgtggcagagaggatcgctgcggagtggcaccccggggcacccacgtggcagagtggatcgctgcggagtggcaccccggggcacccacgtggcagagaggatcgctgcggagtggcaccccggggcacccacgtggcagagtggatcacgcagagtggcaccccggggcacccacgtggcagagaggatcgctgcggagtggcaccccggggcacccacgtggcagagtggatcatgcagagtggcaccccggggcacccacgtggcagagaggatcgctgcggagtggcaccccggggtatcagtgtgcaagtttaaccatttgagttatttcagtttctggtaattacaaataaagttgctatgaacattaaatatgggtttttgtgtgaaaatagttttcatttgtctaataaaagctcaggaatgcagggcaggtttaacttcctaaaaacctgccaggctgattcccagagtagctgcaccacttaccgtccccacctgcaatgcacgaggcccagtttctctaaatctctgctgactatatatatgtatactatatgtgctatatgatatacacgtatcatatgccatgatatacgtatattatacatcatatataaaaacatatttttatataaaataaatcagtatttttttatttcagccattctcaaaacaccaccctcacccgccgccaccttgtccgcagctctgcctggatgatgccgctggtgacagtaacagcactcagaggtgcttaacacataccaagtgctgcacttacccaactcccaaaaaagcctaaccaggtatcactatcatccccattcctaaaagagcaggctgaaaacaggttaagcccacagcaataagtggtagggcccggtgcgatggctcacacctgtaatcccagcattttgggaagctgaggcaggtggatcacctgaggtcaggaattcgagaccatcctggccaacatggtgaaaccccgtctctattaaaaatacaaaaattagccgggcgtggtggcaggcgcctgtaatcccagctactcgggaggctgatgcaggagaatcgcttgaacccgggaggcggagcttgcagtgagccgagatcgcgccactgcactccagcctgggccacagggcgagactacatttcaaaaaaaaaaaaaaaaaaaagtggtagggccgagacacaaactcacacaattggacaggaatccccactcaatcatcagaaagcacctctccgcagtgactaacagtctgacaatttagagtaaaaacaaactcagtttctcccactagtcttgcaacatgcttcggacaccaggtatgtggggattttctccccacaaatcacgcaggtcgtcagttctgcagtggacacaggctgggtgtcgtctgtcatcctaattcagtcatctattctgacagcgtcttcctggagataccagcagacccccacaggttaacggctcagccccgcaagactgccccccacttccagtgcccaggttgtttgacctgcgcttgggaccgacggggcgtaacccggtgacctcctcaggttgcggtaatttgctagagtggctcccgaactcacagacatgttttacttacacttaccagcagagtataaaggattacaaagaatacaggtgaagagatgcgtgacgtaaaaccggggggaagcgcttggaaattcagggcctctctgggcaccgcctccaggaacccccacgtactatctggaagctccctgaacccagcccttttgggtttttacaggaacttcatttcacaggcgtgattcatcagccactggtgatcaacgcaaccttcacccctctctcctccccagaggttgggggtggggctgaaagtccccagaacctctaaccctgccttggtctttcctgcgaccagccccatccagaagctccctaggggctgccggccaccagtccactcagcctacaaaagacatcactttggaggttcccgggatttcaagagttgtatgccaggaaaaggggatggagctgaaatacacagttcactgtatcagttacctcaaacttaaaacgaccaaaacccacctctgatctccacatcacccagacccgacagtctaccgcaaagcaataaatggccaccttctccctcttcctctggccccaaacccctgagttacatttgccttttccgtctctgccttatgttccatgaccagtaaccgcaatggcttcacgttccaaacacatccgggacccaggggtttcctccccgcgccgccctcctttgggccatccctccccaggtctcgagagaccgcagcaagagtctccgctaacgcctcgccgggcccccgccgccttccccggaggctgctccagggcccgggaaagctctcacccccgaacccggcgtggcccctccgcccccggcccgggaagccaagtccccgcaactgccctttccgcggccggaatggcctttcccgaccggccctggtttccccggccgcctcgcccaactgctgccggctccaggggcgcggccgggaccccaggcccgaggagggcgtcggggcggggaaggggccagggtgcggggacccagcgaccgcctgggccttacctgaggcgggggcggcggccgcgcttggcggaggaactggggtcccgctgcggcccagacctcccggccgcgggcccagccgccgcaccagccaccgcacagcgatcagcagcaccgaggcgcccagcagctcccaggccagcgccgcccactcggccgccgccagccgcggccacagcatcgccgccgcccgggccgcagccgccgagaagcccgcgccccgcgccgcgcccgtcccaggaccccgcgccgggctgcccgcgccctgcctgacggcgccgcgctcgaggcggccggggcggcgcgggggacacggacggcggccccgctcgcggaggcccggcgagggcgcggccccggccctgggacccaagcgggcgggaacgggcgagcggacgggcgggcgcggcaggcggggcgcgggcagcccgacgcggggtcctgggaccggcgaggcgcggggagcgcaatgtgctggcgggggccggggctggggcccggggaggccaccagggcggggccgggcgcggggcggcgcttcttcgcgcctcccggccccggcctggcgtccgtggggcgctgtgcgtctccgagaacgaagcggcctccgggttcgtgtgctccgagcccgagtactgtttgcggccgtcgtcccgtcctggagcaggagtgaggaagcgcctctcactcccccgcgaacccgcagaacaggccgccggcgctatggagaccggcggagcttcccgctccttcaccaaggggccctgacgcgcagttgaaagcgcggattttgccgggcgcggcggctgcgtccggagtcccagcgccttgggaggcgaggcgggaggatccccacggcccgggagctcgagaccagcccgggcaaatattttgaaagtcatggtaaaagccgcaattacttttgcaccaacctaatagtgagaccctgtctcgaaaaagggaaggaggattttactgtatgtaatttagatgttttatttattttttgatgcggtgtcttgctctgtcgcccaggctgaagtgcagtggcgcgatctcggctcactgcagcctccgcctcctgggctcaagcgattctcctgcctcagcctcccaagtagctgggattacaggtgcccaccaccacgcctggctaatttttgcatgtttagtagagacggggtttcctcatgttggccagactggtctcgaattcttgatgtcaagtgatccaccagcctcggcctcccaaagtgctgggattacaggcgtgagccaccgcgccccgcctaatttagatattattaaatgaaaatgaaagacctgaaaaatataattgatatccttggttaaaaacataattgatctgagcgaggtggctcaggtctgtagtctcagcaactctggagcgtgaggggtgatggtagtttcagtccgggagttcgaggctgccatgagcgtgatctcgcctgtgaatagccactgcacgccagcctgaccaacatagcaagaccccatctcttaaaaaatatcattggatggtactaatggttggttgggcactacagaagaaagggtcagtaattttgaagatggatgaaatggaaattcaaaccacgatgagatgctgcttgaaatccaccagaatggctaaaatttaaaaattggcaatatcaaattttgctggcaagagcaaacactgagttaaccaccttggaaaatagtgaggcagtttctttcaaagttaaacgtacacctctgctgtattctgagtgtctgtccccagcgttcgtatgttgaaaccctaaccccccttggccgggcgtggtggctcacgcctgtaatcccagcactttgggaggccgaggcgggcagatcacgaggtcaggagatcgagaccatcctggctaacacggtgaaacccagtctctactaaaaaatacaaaaaattagccgggcatgctggaaggcacctgtagtcccagctactcgggaggctgaggcaagagaatggtgtgaacccgggaggcggagcttgcagtgagccaagatcgcgccactgcactccagcctgggtgacagagcgagactctgtctcaaaaaaaaaaagaaaccctaacccccaaggtgatggtattaggatgtggggcttgtgggaggtgataggtcatgggacagagccttatatacttcccttagaagaggcccaagaaggctgggcacggtggctcacacctgtaatcccagcactttgggaggtcgagacaggaggatcgcttgagcccaggaggtggagaccagcctgagcaatatggcgagacgctgtctgtgctaaaaatttaaaaaattagctgaacgtggtggcacacgccttgaggagggaggattacttgagcctgggaggtcaaggctgcagtgagcgaagattgcgccattgccctccagcctgggagagagagaccctgtctcaaaaataaataaataaacaagtacgtacatacatacataaaaaggtaattatgtaagtcctcgttacggagcctccatacatgaagggctttagagccgatttgttaaatggtcagctgtagtcagctgttgacacccagcgtccactctccattaagttattaagagctttttcttagttacagaagctctcagtgggctgtggagacgctgccgtctcctgaacacatccagcgaccacatgactaagcaaaggcagcggagagtggacggacggtgatggacgcggccacggagcccaagcgcccacaatgcgcattcctgtcttttctctccccgctcacctcagagcgggacggaaggtgggactgggagagctgttctcgggcaggtggacgctgtggattagcggagagggaaggcactttcgttctcggcaccgtgaggctgtcctggtcaatcctgttttcatgcttgagggtctctggtgcagcagctccaccagccttgacaccaggacttctgtggaatccaggtaagcagccagggtcctgatagggccatgccctcacccccatgtaatgcatccactcccagttaaatgagaaaggaacaatcacaggaaaacatggagaacaactccactgttcagaagccaaccctatattagctactgtttaggtagaaatgaaaaactttgagacgtaaactcctgcaggtagaagtagatttccggtgaatgaacaaaatgaagcttattagaatcaatggcctcttctgagagccgttctgaatttttttttttttgagacggagtcttgctatgtcgcccaggctggagtgcagtggcgcgatctcggctcactgcaagctccgccttccgggttcacgccattctcctgcctcagcctccccagtagctgggactacaggcgcccgccaccacgcccggctaattttttgtatttttagtagagacggggtttcaccgcgttagccaggatggtcttgatctcctgacctcatgatccgcccacctcggcctcccaaagtgctgggattacagtcgtgagccactgcgcccagccctgattttattcctagttgtaatttaacttctacttcatttctgatccgagatcacaaaggggccatgtgagccccagggactgagcggaagctgaagtctcacagctcgaggatttactcccaacgtgctgggaaaagccctagatgagcagggagtagctaatttcttttcttccccttctttttcaatattaattggatttccttaaaggccgtgtgtctattaagtttgttatcaatggctatttagcacttgtagaaacccagccgtatgttacatacagtagggtctagtcaggaaaacagcccaggccaagtggttcagcagaggaaatgcaggggcagggacggcaaccgcaggacgccagaggccctcaggtggagataacggccctgagtggaaacgtacaggctccagaacctggtgggacctgggctgatgcaggggaatgaggggtttcaggggagctacggccgtgaccatcagacgcccagctgcagggacaggcaggtggcggggggggggggtctgttttctgggtgaagatgggggcatttttgaaagcattgggaagatacacttgacgtatctatccagtctccagaaatgcacgtttaacgctcagaaggaaatcttgcaacaattgaagtgctgtgggaggctccgcgagcagagacaagattgtccttctctgggtttcagggcatttagacatgacactcaaaaatatttcactgtgggccgggcgcggtggctcatgcctgtaatcctagcactttgggaggcagaggcaggtgaatcacctgaggtcaggggttcaagaccagcctgaacaaaatggtgaaaccccatctctactgaaaatacaaaaattagccgggcgtggtggcgggagcctgtaagcccagctactctggaggctgaggcaggagagtcacttgaacctggcaggcagaggttgcagtgagctgagatcgagacactgcactccagcctgggcaacaagagtgaaactccgtctcaaaatatatctatttcatgtgaaggtgaaatccaaccccgacgatgtgtagaaaagcccagcaatctcccgcaaatccctgagccgatggccgcggagatgggtgtcctggtggtgctcccagagctgcctccccaggtgccaccaggacatgctgcctttggggctagaggttcccacctcatcagtaacgagggcatcgccagccctcagctgccttgggcgcccacagtcggctttcacgcctcccagaggttccgccaccttcagccctcacttcagatggagtcagaacttagagatgtggacactgtgaaggtcaccggcagccagtggtggagccgggggaagggtgtaggacgcccccacacacaggtgaagagggcactgccagggggagggctgtaggacacccccacacagaggtgaagagggcactgccaggaggagggctgtaggacgcccccacacacaggcgagcagagggcgttgcaaacatgggcagaggcggcccagcagcagtttaacattgccctgtgtccaggagaaaggccactgcccaagtatgctctttatcgcaacctgcaacattccccctcagacggaagcttgtgtagaggccgccaagttccaacaaatgctcccgactgtagacgccaccaagtgctgggacttgctctcgtcatctgggaaaggcttggggacgctgccagcaactgtcatgtttatccatcaagctagacggcggaagtgcagtcgtcttagtttcccccattatctgcttcctgctttttttttttatctcgagtctcaactttgttgcccaggctggagtgcaacggcacgaactccactcactgcagcctccacctcccggcttcaacaattctcctgcctcagcttcctgagtagctgggattacaggcgcccatcaccacgcccggctaatttttgtatttttagtagagatggggtttcaccatgttagccaggcgggtttcaaattcctgatcttgagtgattcacccgcctcagcctcccaaagcgctgggattacaggcatgagccactgtgcctggcctgcttcctaatactacccgaggtctcagatttctgagtgacctggtaatttttaaatcctgagtctccttcatgcctgtaatcccagcactttgggaggccgaggcgggcggatcatgaggtcaggagatcgagaccatccgggccgacacggtgaaaccccgtctctactaaaatacaaaaagaaattagccgggcgtggtggcgggagcctgtagtcccagctactcaggaggctgaggcaggagaatggcgtgaacctgggaggcgtagcttgcagtgagccgagatcgcgccgccgcacaccagcctgggccacagagtgagactccgtctccaaaaaaaaaaaaaaaaaaaaatcctgagcctcccatcagcgatacgtcctctgtcctacactcaacccaaattcctgacagtacctgccgccactctaagccaggaagaagtgacccattcatctctgccaaaaccactcctgacacccactgctgagctctgtagcaggacgcagcgtggagcttcgagctgctgagacagacacagcttaaaatatacctgtcagtgcagtgcctgcaaacacgtagcaactccatggagaaaaggaaaaagttcagatacatacatgtccccttaagggttctatagaccaaaaaaaattatatccttaatatttcagaaagttaaggccacagaaggtggtcagggaatttttactctgtgtagcaattctctgggtacagaagctggtaacgctcacaggaagaagtgcattaatcccacagggccaagcccagcgaccaccacttcctgccccttttctgtactttttaaaccatggtggcctctaataacgtctaactgaaaactctgtacctggttaactctttttttttttagacggagtcatgctctgtcacccaggctggagtgcagtggtgtgatctcggctcactgcaacctctgcccgatcaagcgattcttctgcctcagcctcctgacaagtggggattacaggcgcccgccaccacgccctggctaattttttgtttagtagaggtggagtttcaccatgttggccgggctggtcttgaacccctgacctcaggtgaccaccccctcccagcctcccaaagtgctgggattacaggcgtgagccaccacacccagcttacgcctggttaactcttaatgaccaaaatcaaagtatggatgaaaaagacgagaatctgggaagtcacattgctgaggtctgagagtcatgactccactgtcaccggggaggcccagcagagggcagcacctggatgatgagacccagttcaggaggcgcagcacagagcggtcaccatccttccccggttcaccgggaagcttgctccccctccttctgtattcctggcaaatgacaacgggcaaagcgaagcgtgggccaaggacggaggaggcggtgccgcgcgtctgccgtggtcacaagccacagaagtttgcttcactcctgccagaaaccggcaggacagtagaattctcttttaaagcacgtgttgaacagagtgtgtaataacatgagattaaaaagttactgccaaacgacaaaatataactattaaaatgaagcttccaatgaatatgaaaatctttaccaaaaaatagtttattgcacaaaatttaaggaattcccaagcacacttacatttgtaaaaaatcaacgtgctttttaaagttacactttgtcagacacggtgacccctttcccaagaacagccacaacttgaggactctcttttgtgaggaaatttttaataaaaacaagtaactcaaaagcactgaattttccagaccctctaacacatttccctccggatcctgtgagagcctgagatcacttatgacgagattcacctggaccttccggtcagtgagctcagaacacctcacaccacagcgtcactcaactcaagtccctcctcacatcagagggctcctcgaagggaggccccaggacggttctctcagatttgctggtccctcccctcctagaatcttcacgtacaacattctgtttttgtttttaaagacctcagggaactagaactcggttgtgggaaccctgcaccaaggagagttgagggccagctccttagcgcagcacagcacggactgtgttctggtgggcagggcccctgctggacccacccgaggagagtccatttcacatcctatcagaaacactgcctgatccatattgcagagagtgggaacgggtgtgagtccgtaagacccgtagcatcaatctcacatataccacggaaaaacacatgaaaaccaagttacgttgtttttggaacatcagaaaaacaagtagtgacatcgtgaagtgccctagcctgttgtgacacacggtgtggggatgaacacgccgccctagcccgtgacacacggcgtggggatgaacacgccacataatgcactggtgaccctgttttgtaagcagtactcccaacttcactgccttttccgtgaggatattccatcattcccacttctgcccacaagaacaaaataattcaaactttatgcactgaagtaactctggaaggtagaagtgccgggagagtcccttggagataaaaaaacctcaacaataaaaaaaagcaatttaaaaatccaactgcagccgggggcggtggttcacgcctataattccagcactttgggaggctgaggctcaggatcacctgaggtcaagagttcaagaccagcctggccaacatggtggaactccacccctctaaaaatacaaaaattaggctggtgtggtggcgggcacctgtaatcccagctactggggagaatgaggcaggagaatcgcttgaacccagatggcggagcttgcagtgagcagagatcacgccactgcactccagcctgggcgacagagcgagactctgtctcaaaaaaaaaaaaaaaaaattccaacttcctcttttaggcgtcttcttaaggaaggaagtgtccgcgtgaacacgagaggcctcagatccagaagcacaagccgtgcatgaaaacaccaaaagactcactgcagggagcaaaggcagccaggccctgccaaaccagagggggccctggcaccggcgaccacagagcgctgggggaggcatcgcacccaagggcacacacgcaggaaaaccggggtgagaacatagagctacttttccttcggtattttcagaattagtctgtcctaagagaaaaaaaaatacatggtgaacatcactcacttgaggacttcccataagcaaggagaagtcgctccccactgaatgtgtgatttctcgattttagattttttaaaatcatttatttatttttgagacggagtctcgctctgttgcccaggctggagggcagtggcgcgatctcggctcactgcaagctccgcctcctgggttcaagtgattctcctgcctcagcctcccaagtagctgggattataggtgcgcactacgacacccggctaatttttgtatgtttagtaaagacggggttttgccatgttggccaggatggtctggacctcttgacctcaggtgatccacccgcctcggcctcccaaagtgctgggattacaggcatgagccaccgcgcccggcccgatttcttgattttaaaattaaaacaaaggggtagtacagccaaaataaataagaacgtaaattgccgtatttttttttctaatggtacaagaacaatttagtaaataacatcttcaacttaagataaaaagtaggatatatttataatgaaattttcaagtattatttcaaaattaaccctgtacaaatgatatattttggaaattccaatatttgctagagaatattttttaaataccaaacatctttgtggttaatgctaccttaaccttaccaattaaccttctaaaagtatattacaacagaacacaaatagcttaaaacacaccatactgttttctccacaaaacagacaccagacaccgacatgagcacatctggcctggccagtgactcagaacctcatttcagaccagtacatctgcagaggaggccacgcggacccattctctctctcctaactcatataataaatattattttagattttcttagcaaactaggggacaacttacagaccccacctctcccagtcagccagtgtctgcagggtttcaggatttggggtaggaaacagaagatctcacacatgtcgtgctgattttaaataaggcatctgtctctgagacacctgggagagcacagccaccttcctcacggtgcctgcctgtctcttccggaagtcgcctctgcttgccacatgatgctggtgtaaccacaaaagatccaggacttctcgatgactgcagaagtacaggtgctcctacacacgagtacaggcgctcccacagacaatggtaaagattttcacttggggaacaggagtgtgaggtttgttaccgcctgcgacctacacctggctgactccaggggaaaccgcgggagtcgctgcagggagcccctggtctgctctcctcctcctcctccaccggcctctccctgtgcccccccaaaggtcagatcagatatggggcctcagtgtccttgtgcctcctgatggccgtcaggcctgaccaagggtccaagctgccccttcccagtggccagccacggtggaatcacacagggccagtggcctgagaggaagagaccagcaggaaggaaagatcctcagcaacaaagtaaaaccagaacaacagaggacctttctgtgtaagaatatttggctttagaaggtaaataaaataattatatttcttagaattttctgactatccctaaatcctgcaggtaaattattcccaacaaattttcaaaaggcaatcaataataagtaggttcttcttcaataacatgagcatatgcttcttaaagactgggtgacaggccgggcgcaggggctcacgcctgtaatcccagcactttgggaggctgagatgggcagatcacttgaggtcaggagatcgagaccatcctggccaacatggtgaaaccccattgctactaaaaatacaaacattagcctggcatagtggcgcacgcctgtaatcccagctactcgagaggctgaggcaggagaatcgcatgaacctgggaggcggagcttgcagtgagcggagagtgtgccactgcactccagcctgggcaacaaagcgagactctgtctcaaaaaaaaaaaaaaaaaaaaaacaaagattggattatgatattcagtatctatgtacacatcctatggtgggatggctatccaaaaaaacaagtaaaaagccaaaggtacagataaaatttcatttctgcggaaaagtaaagctcttactgaatggaacagggaagtgagaaactgcagccggcctggccaggcgcggtgccgcagaccctgtcacacagctgctcccagttacgcagcctctccctgtcacccgcagagagcagcatcggtggccgctcagaagccacgacctacaagtaacccttcagacacgttcaaagctcctcgccgagagcctatcaggcttttaagagttggtcattccatgtgaaaagctaattgtgatcttcgaatgtttttctagtccttggctctcattctgctatatattttacttcttgttaaaggcaaaacaaaacttaaatttcatgtcttagaaaaacatcgaccacacaatcaaataaataacattgataagagccttctggggcagcggcgcacggaggcgagtccacagcagtcactctcccggcccttctttggaagccctgctctgactgtgtctctgtgggtcgccgcgtgggccggcgtgaccccccgggggcacagggctggcagtggctggctccagcggcgtccacgaggacagagactcgtgcaccgtcagggcgtgctcctccatctggcgctgcaggctgtccatctcctgcctgggacagaagaaggaggaagaaggcccagatcacacaagtgccaggcagaacgcgccacctgtggacagcgtcactcgctagcacctgagtggaccggggcgccttcggggatccgcaaaccaactgagaccacagaagctcagctgttctcagcaccgttctctacactgtgcagaggacacaggctcaaggaccagtcctgaccaggcggcagggtggaagctgtcactgaggcctggcacacacgacttccactccgttacctgccctcggggcgccgcctggctccgccctacacacttcgctcagcctcaggctgccaggtgcaccatgtgtggccttccagcttctcagggcctatcagggtagtttaactccaggcagtttccacctatgagttcacaggctgtgtgtgcgagttcccccacctttatataaacctcagaggctgtgcgagtccccctcccactttatataaaccgcagaggctgtgtgagtccccctccccctttatataaacctcagaggctgtgcgagtccccctccccctttatataaaccgcagaggctgtgagtccctccccctttatataaaccacagaggctgtgcgagtccccctccccctttatataaacctcagaggctgagtccttccccctttatataaacctcaaaggctgtgtgtgcaagtccctcccttatataaacctcagaggctatgtatgcgagtcccccacccttatataaacctgctgaaactctgctgggcactcagtactggcaccaggagtgccctcccaggtaagagggcattaatctttaagactagctgaagtgcagcacggaatacggtcgtacttgagctgctggaggcagctgttcaggttcttgaggggctccttgctcacggcgggcggtggtctcagcagctcctccagcagcgaggcgggaactgggcagtccgggatcttgatgggcgtggcagggttggaagagctggcctcgcctttcggctcctttctctgtttttaaaagcacatgatcagctttcccaccgtcccctccctcgggtcagtctcactagcacagcttgtggcaaacgggcctccccaactggtggacgtggggcctctgggaaggggaccgtcctggccgccgtggcagcccagcacgacagtccccggagctccagaatagctggctgaggaaacacctttattcctaaggcacaaaaccagagcaaagcagagacaacctaagtcctgggtctgcggcaggacggggccgagccacagactacagctctcccagacgcttctcccatcagatactcaagaccttgatgtggaatttccgtaagaaattaagtaagttttccagcttaggctcccttttctgggacttcaaactttttccacagataagcacacgacgctaaacggcctctcaatccgagcgctgccctcccacctgcctcctggaaaacatggatgtggaccgagcacagaaaaccgccgggcgcctgggcacagctcccgggccccagcccttcacacacagcagggactgccgagtcacagaccaccgctcatctgctttacaaagcacattacaacaaagtggtatttgaattcacagaacgaggaaaacactgttggatgaatgaaaccagaatgaaatgatttcatctgtcaccccattaccactgactacacagcagctgctcagtgtgggctcaacaaatccgtttatgtctgaatgactaacacgtctgccagcctcctgtccgagagcatctacagcgcacgtcggctaccccgggagggacgcgggcctgagtaccgtcttggccgcgccgcggcgtaggtccagcttgagctgctggttctgctggagcagggtcttcatgttgttcttcagctccgacacttttgcctggagcataaatttatccttctgggtcatggacaggtcttcctgggccatctccaactcagacttgacgttctgtggaaaatgaagtcagatttttaaaagctaacagatcttaaacatcctgccaagatccgagtttgtattttcataggttaagcacacacatgtcctcctcggcgccatctagatgatgccagtccaggtccaaaatgctcaggaccagaagtgtgtcaaattttggaattttgaatatttgcgttacaactaccagctgagtatccacaatccaaaaatttgaaatgttccaatgatcatttcctttatcatgttgatgctcagaaagtttcagattttggatttttgttcttgttttttttagacacagggtctcactctgtcatccaggctggagtgcagtggtccaaccacagctcactgcctaagtgctgggactacaggtgtgagccaccaggcctggccaggttttggatttctggatgatggacgcttgtcggcctgtgtctataaataaattctcactgtaactcaagcccctcatttacaaggggaacttagcaattacactcctttcccgagcagtcaagaccgaaccctgagttctttgttgagaagtttatcgcaaattggcaaacttttcccacgcaccctcccatttgctgtagtccatgaaatcacgttcttggtccgtgacacacagcgcggccaagggatcggagccggcccaggcttcgcccctgcctctgtcctgccgcatgacgtggaccaggtggctttgcgagcgccccactggacgagggcgccagctccccgggagcactgcctggccgcaggccgcatggcacaggaaccaggggctgccccagaagtggtgctcccgcctgtgtccagcacctcatacacaggtacctgcagcagctgctgtagcccctccagctccttcctccctgctgctcccgcctgtgtccagcacctcatacacaggtacctgcagcagctgctgtagcccctccagctccttcctgccctgctgctcccgcctgtgcccagcgcctcagatacaggtacctgcagcagctgctgtagcccctccagctccttcctccctgctgctcccgcctgtacccagagcctcacacaggtacccgcagcagctgctgtagcccctccagctccttcctccctgctgctcccgcctgtacccagcgcctcacacacaggtacccgcagcagctgctgtagcccctccagttccttcctccctgctgctcccgcctgtgcccagcgcctcacacacaggtacccgcagcagctgctgtagcccctccagctccttcctccctgctgctcccgcctgtgcccagcgcctcacacacaggtacctgcagcagctgctgtagcccttccagttccttcctgccctgctgctccgtcaagtccagctgctgcttcaaggactggatttctctttctttctgatccacctcccatttgagattttccatctaaagaggggaaagtcacatggccaaaagaatattaaagtggctttactgccctggaaaatggctctagctgtgttttggtttatcttttaataccatattcagaaaaccatcactgttgctccccaagcaggatggagtgaagtcacccagggcacccgtgagtccagccctgcaagtccagcccccgtgaaccgtcacctcttggtttcccacgggctgtttgctgagctgctcgtccagctgcttctgcaggagctggagctgtgcccgggcctcggccagctctgcttggaactgtgctatctcctgggaatgtttcccctcccgaatcctagcgtaaaaaaacaagaaagaagggaatcgccacgctcctccagtgtgctgtgccctcccgctgggaaatgctgcctgtggaaggcgttcgtcctggcaggccctctgctgtgcactgcgtgctgcagccatgcttggtgcccacagtgtgcactcgggcagtcctcacgaagcacctgagactcacacttcactggcacccctcacagatcccagagactcactttgccggcacccctcacagatcccagagagtgccggccccgagaccacagtgcatgggacccacagagccacagcatcagccccgcgccgggccgccccttcccgcctctgacctgaagctaagtactcctgctggggcgctttctctcttggggggaggacacggggcagtgagtgaggctcaggattctggagacggaggctgggtgccttctactcctatgattcactcaagtactcggcaatttgcaaaatatagatgaccctcgctgtgctgaaggtgtgaattagaccccgcccattgccaggacagccatgtttgagggctggcggggcccaggcactcactgaaggtcgtcggcctcggcctgcagcttctgcaccaggtgttccttggcctgcagctccttcttcacctcactcagctccaaggaggccgccttgaagtggcggcggttatgcccggcttccaccttggcagcagccacctaggaggaaggaagccacgttgtccatgccctgcgtgacacccacagctttatgacgtgccgggcgcagggggtgaatgcactcccggccccgtgcatgtcctggctgccggcgtgtgcttctccacaggcctgtcaagttccttgtaaagatgaaaccacctgacccggagctcggcacgcagcaagtgcacacttatgtggctgctgctatctgttgaatgaacacatttattcgagatttctcggtctaaatagtttttatagtcttcttccagtgtattcacagcctggacaacatagcaagaccctgtctccacaaaaaataaaaaaattagcagggcatggtggtcccaggtactcaggaggctgaggtggaaggatcacttgagctcaggagttccaggctgcaggggagctgtgatcgcgccactgcactccagctggggtgacagagtgagacccggtcccaaaaatgaaataaataggccaggcgtggcggctcacgcctgtaatcccagcactgtgggaggccgaggcgggtggatcacgaggtcagatcgagactatcctggctaacacggggaaaccccgtctctactaaaaatacaaaaaattagccaggcgtggtggcgggcacctgtagtcccagctactcaggaggctgaggcaggagaatggcgtgaacccgggaggtggagcttgcagtgagccgagatcgcgccactgcactccggcctgggcgacagagcgagactccatctcaaaatctcaaaaaaataaacaaataaataaataaaaataataaaataaaataaatacatttaaaaaataaaaataaaattaattggaaggccaaggcgggcaggtcatcaggtcaggagattgagaccatcctggctaatatggtgaaaccccatctctactaaaatacaaaaaattagccaggcatggtggtgcacgcctgtagttccagctactggggaggctgaggcaggagaatcacttgaacccgggaggcagaggttacagtgaaccaagattaagccactgcactccagcctggtgacaaagtgagactccgtctgaaaaaaaaaaaaccgaaaaaaattcagtgaaccctaagcacggagcgaaagctggagagctggggcaccgtgtgagccagcctgaaccacggcccagcagcaggccccaggccagggttaaacggccgggcggatgaggcctgtggggccaagagaaagctgttaactgctcctgttaaaatattccagccacattttttttttgagacggagtttcccacttgttgcccaggctggagtgcaatggtgtgatcttggctcaccacaacctccgcctcctggttcaagcgattctcctgcctcagcctcccgagtagctgggactacaggcatgtgccaccacgccaggctaattttgtattcatagtagagacagggtttctccatgttggtcagcctggtcttgaactcccgacctcaggtgatctgcctgcctcagcctcccaaagtgctgggattacaggcatgagccaccgcgcccagccacctgccacatcttaaaattaattctatttataaagaaactttgttgtttcaccccttaaaaaaaatcaagaacctttttcttttcatctcaattacattatcatagaaaagttcttaaaggttgtggcaaagccaggtcataggaacgaaagcagcttcactgttaggccgaaaagtttgaattgtgaagcaattacttttttacaagttcaattcaaacgggatttaaaggaaaagtgatgtgttctttcctgcctttctctagagacaaccagttatttcttgtgttcctcctagaaattttctacatatacatcagcatcaaatgcatgcacacacaccacagcccaggcacacacgtgcgcacacacaccacagcccttgcatggacaccccccccgtgcacatacacacaccccaggcacacacgtgtgtgcacacacaccacagcccttgcacggacacccccccgcgcacatacacacacctcaggcacacacgtgtgtacagacatcacaactcttgcacgcacagccccccgcatgcacacaacccaggcacacacgcgtatacagacatcacaacccttccacgcacagcccgcgtgcacacacaccccaggcacacacgtgcgcacacacaccacagcccttgcacggacacccccccgcgcacatacacacacacaccccaggcacacgtgtgtgcagacatcacacttgcacgcacagccccccgcgtgcacacaccccaggcacacgtgtgtacagacatcacaacacttgcatgcacagccccccgcgtgcacacacaccacaccccaggcacacgtgcacgcacaccccccatgtgcacacacacggcaagcgtactaggagtagctgctctgtgccaggtatggcggaggtagccagcaagcagcagcgttctaacagaggagcagggcccagacagggcacctgggggtcaggatgggcctctgctggcgacgtgaccaacgtgtcagtgaacacctgaagcagggcaggggccagccacgaaaagacagctctctacacagagaagggtccacagaaccacccctcttatctgccgaacacaaatgggatcatatgctattctcaagtttgcttttgcaatgcaacacgacatacaggacaccactcccagcacaatataaatacacatgcacgcggagctcattggccccaggccctcacagctgcactgccatttaatctaacgccaccttctacggaccagagcaggtgctctgcggcctccgtcaccaacaactgcaacacacctttgctctgtgtaactgctggaaggaggctggtgtgtgaaggaccctgcatagatttctaggcactggagcgtcctctggaacgccctgtgagacggaaggtggcacgcacctgctccttgaggctgttcaccttctccttctccttctctagtgaggcctgcagggcctggacaagatgcttcatctggcgatcctcctcttctttgcgctgcaaaactgcctgcacctagatcagattgcaggaggacagataaggaaggacgtcgaattacaaacacacaaggctgctacagcaggcaacgtgacacacgccacatcacaggcacacgccagggaggtagagggaacttcactgctgaagaatctgtgacaaaaacagaatcctaggttgcgggagcatgatcacagggccgcactcaagaacgtggcacgcctgtgggccccacggctccagaggccagggcaggaggatcgctggagcccaggaggttgaggatgcagtgagctatgatggtaccaccgcagtgccctccaccgcactgccctccactccgggcaagagccagaccctgtctcaaaaaaaaaagaatgggccgggcgcggtggctcacacctgtaatcccagcactttgggaggccgaggcaggcggatgacagtcagaaaatcgagaccatcctggctaacacagtgaaaccttgtctctactaaaaatatgaaaaattagctgggcgcggtggtgcacgcctgtagtcccagctataccagaggctgaggcaggagaatcgcttgaacccgggaggcagggagccgcgatcgtgccactgcactccagcctgagagacagagtgagactccgtattactaacaacaacaacaacaaaaaaatggaacatggtggctgggaactcaaaaactacatacaaatcaggggctgcagccgggtacaaaaagaacagaagtggtgggaactagggcaaaatatggaactaagatgggatagtcaacaccagcagctcgatttggcccccaggatttccctgaaatgcccagcctagtcctcaattcagagaggctgtggagactaagtagctgagtgagaaccaggtcagggttcaagtcccagttctgaattgtgtgaacctcttgttaagtgccccctacaaacaatgtcaccgtctgggactggaactcagccacacccacatggaaggtctacccctcaactaagcaggtctgccccccaactaagcaggtctgccccccgactaagcaggtctgcccctcaactaaacaggtgaactgagcacacgcaggggctccagcctcacctcagagagcccagccctgcaccaacagctggggactcagggctgtgggtcacccagacccctgagcctgttcctcccctcggagagcccagccctgcaccaacagctggggacccagggccgtgggtcacccggactcctgagcctgttctctcggctgcaggccgggtgggctaggagtcagcacaggtgactgaatctggatgagattctcggagtgcgcacagccccaccaactctcacaccgttgctggcgtgagtttgacgagtttgaatacctgaaggttcaactggactaggtctgcctccctcttggccaaagctgtttctaggatgctgttgtgttcccgcagagctgcgttggactgaccgaggcccgtaagcttccctttctcgtgctctaattcaagagccaacttcttgtttgactcctcaaggcgttttatcttcttcctaaagcctctggattcttgaagctgaaacataccaatgtcactgtaaaattacctgcactggtgagtggagttcacataccccagaaacaggtgagttttcaacaagaaacagcgaaaacttaggccaggcgcagaggctcacgcctgtaatcacagcacattgggaggccgaggcagggggatcacctgaggtcaggagtttgagaccagcctggccaacatggtgaaaccccgtccctactgaaaatacaaaaattagccactatcgtggcacatgcctttagtcccagctactcaggaggctgaggcagaaggatcgcttgaacccaggaggtggaggttgcagtgagctgagattgtgcccctgcactccagcctgggcaacacagcgagactctgtctcaaaaaaaaaaaaaaaaagaaaaagaaaagaaaagaaacatcgaaaactaaaacacagcaatgggctggacgcagtgactcacacctgtaatcccagcactttgggaggtcaggggtttgagaccagcctagccaacatgatgaaaccctgtctctaccaaaactacagaaattatccaggtgtggtggcgatcacctgtagttccagctactcaggagaatgaggcgggaaaatcacttgaacctgggaagtggaggctgtggtgagccaagattgtgcactccagcctgaatgacagagtgagactctgtctcaagacaacaaaaacaaagaacaatggacaccacacaaccctgcgatggacaccacaggaccgtgcttgcttcatgatctgaaggctgtcgtggtcatggtcagttgcttccccaggcccctctcattcctccccatggccaagagcccagccttctcctggggccatgggcttctggagaagtctgtccaggcactgagccctggctaggccactcagcagggtgggcatgagcaaaaccacttcagggcaggacacagccagagagtggaacaggcggccctactgtgacggagctccacagggaggggctggggagtggggggcgccgggacactgagctgccaccagcagcgctgaagcgagaactgtctctgaacctgagatatctgacgtttttctttttttgagacggagtctcactctgtcgcccagcctggagtgcagtggcgcgatcttggctcactgcaacctccgctcctgggttcaagcggtttacctgcctcagccacccaagtaactgggactacaggcacccgccaccacacccggctaatttttgtatttttagtagagatggggtttcaccatgtcggccaggctggtctcgagctcctaacctcatgatccgcccacctcagcctcccaaagtgctgggattacaggcatgagccactcgcctggcgaagttgggtttcttatttgcaaccaaagcatttgaactgagaagggttccactatgaattctgtaaccattccaccaaagaggctgtacagtgatcctccccagagggctggaatcagggcctgccccaccacagagccagaggccgacggtcagaaggtggcaacaccaaaagtagcaacgctgggcacacggtgaagttttgttcttcgggtctcacgcgtggcggcatgtccagggctcacgtgacctgccccacgctgccgccacagcagatggccaggcctcacctcgtcctccagctccagcaccttctcccgggactcctccagctcctggctggtcagcgctatgacctcctgcagttccttttccagcagcgtcttgctatgactgacagcctgcagctccgcctccagggcctggatcctttcctaagggccaagatggaacgggcgcttggtcatgggacaggccctgacccccctcacttcctgtggtgccggcaggcatgaggctgtgtggctgcacacaccagacaccagctgtctgacacagtctcacaaccttcctttttgttaaagaagttgaattaaccgaccacagcatgcacacgatgacacacggggatagttgggacaaacaaaatcatctcttcagttcaatgcttcaaaaatacagaagaaaatctgacctgcagataatggctataaatcaccatctgtggcaagcaagcagcaccagttgtaataaataccacacacatgctcacgcaccacacatcacatacacacactcatgtaacacacaccacgtgcacatgttcacatcccacacaccacacacacacgtgctcacaccccacacgcacatgctcacaccccacgtgttcacaccccacaccacacatgcacatgtgctcacacctcacactgcatgcacacatacaccccacactgcatgcacacatatgctcacatcccacacaccatgcacacaaacactccacacgctgcacacacacatgctcacacctcacacatgcacggatacatgcaggcacaggtgtgctctcacaccccgcccacttgctgcctcgatggtaccaggcccttgccaagcatgttccagtaccacctaacttaacccttacatgagaaggttctcattcacctcaatttggcctcattttgctgaggatcaaaaaggtgagaaatttgccaaaagtcaccacttgcgaggggtgaagcccggacggacacaagacatcggctcgcagctgtgctattcctcagctgcaacagcgtggcgaggggccagctctgcccggcctttgcgacctccccaccccagcccttagtgagcccaaagaaaatggcaactgaatcaatctccccaacattttacaaagcaaccaggtgagaggaagcacttgatttatttattgaatttcagacacagagtctctatcgcccgggctggagtgcagcagcaaaatcatgactcactgcagtttcagcctcacctcccaggctgaggcgatcctcccacctcagtgtctcaagcatctgtgtccacaggcacgtgctaccatgcctgggttttatttttgtattatttgtaaatacagggtctaattatgttgcccaggctggtctcaaactcctgtgctcaagcgatcctcctgcctcagcctcccaaagcgctgggattataggtgtgagccaccgtgcccggccgagtttatttgacaagaaaaccccacgttatgatacagtctcttcctacccataaattcttaagtggacaggagatagaaacaaaccacatataagaagaaatactaagttgtcagtgcaaggacgtgaattggagaataataaataaaatgcggatgaactcactcaggtagaatgttatgcctaccacgaaaggtgacagagcacggagggccacggcctccacggaaggctctgctcagagccctccagaaagggcacccgcttgttctgggccaccgcagcatggctacctctaaacgctccctgaaccctgtcaatcgctgaccccatgccctcactcctgcttctcagtgagtgcggaggctgcttttcctcctgagatgcgaggaggcgcagaggcagctggaacgcgagcggaccagggcaggccctccctctgccccaagggagcagctgaacttctctgagccaaggagatttcttgaggaaaatcaggtgaacgccacaggccacaggccatgtggggttcatgagggagacgcgaggcaatgctcagtcactgtgggttcctggtaacctggaagatgagcgggagtttagagagttgccacctcccacgcgagctcggccccgctaggctttaggggacaactgctgatggagagcccttccctgcactgaggggctggtgaccctggccggggatggcacggtgttacctacatgtagagccaggctgctgtcactgctgccaccctgggctcggagctggcccagctccgcgtccgcagcctccttggccgcgagggcctcctgcaggcggcggctgaggatgcccacggcgttctcgtaggccttatgtttggtcttcatctccttctgggcgctggtcaagtctgagcccagccgcctcatcttctgcttctgttccgtgatggccctggggtgtcatgagggagacacaggaggaagctgaattatcccgatgtgaccgtctggcattctggttcgcctcccccccggcccccgcacctcccacctggcccccgcacctcccccgggcacatgcagacttacttccgggcctcttgctgcaactcttcgatttgtttcttcagcgcctcattggcctctgtgaccgcgaccatctgctccttatcgaactgcaacgactgtggaagggaaggagggcgtgaggagcggcactgccacccccagcctgtctccccttcctggctccagcccatcacccccaccaaaggcactgctcaggctcgccctggaggacttgggccttgagaaaaatcctgagagagacgtctgccttcttacaaaccactcttttttttttttattgagatggagtctcactctgtcacccaggctggagtgcaggggcgtgatctcagctcactgcaacctccgcctcccaggttcaagtgattctcctgcctcagcctcccgagtggctgggactacaggtgcccgccaccatgcccagctaatttttgtatttttagtagagacagggtttcaccatattggtcaggctagtcttgaactcctgacctcgtgatccacctgcctcggcctcccaaagtgctgggattacaggtgtgagccactgcacccggccacaaaccactcattactgagaccaacaagcgtttccaaacactgtccagagcatcagaggcacaacaggacatgactggttcataggaaagcctgtggacccaggacctctcctccaaaccctcaggacccaggacccctccccagggccccaggaaccctccccaaggcctaggacccctcctcaaggatccagacccctcctaggaaaccccaggacccctccccaagagcccccgggaaccctccccacaagcccctggatcccctccccacagtccccagacccctcccccagagcccccaggacccttcctgagaccccgggacccctccccagaacccctgggacccttccccggagaccccgggacccctccccggagaccacgggacccctccccggagaccccgggacccctccccggagaccccgggacccctccccggagaccccgggacccctccccggagaccccgggacccctccccggagaccccgggacccctccccggagaccacgggacccctccccggagaccacgggacccctccccggagaccccgggacccctccccggagaccccgggacccctccccggagaccccgggaccccttcccgagaccccaggacccttcctgagaccccaggacccttccctggaccccccccggatgccctcctcaggatcaactgtgaacactgagggccgcgtccccgacctgctcctgccctcgcagcctttccccagctcctgtgtgcgaggcgagtccccacaaccagcccaggcctgcagctgtggggtccgaacgtgctctgcccgcactgctgagtcctccaagcctcctacagtccaaagagccggccctccccttggcccacctccccaccccggcaccagcgctaatccatcagccctcactttccaacaatgatggtgccggccacaccgcctactcacaggcctcagcctggctcctaatgagccagacatgctgaccaatctgcctgctgggaccttggctcggtcctctccggcaacttcagaaacttcataagcaaaacgtagcacttggtctaacgtgccatcagacgactctccccaaatttactgttgctctcctgatttctcgtctcacctcccggttcctcagcctggatgtctggacaggatcctggactgcggcctccgtcccccgcctctacccctcacctgctctgctacctgcagccgagaaactgtcaccagcatctcggacacccactgtgtgcagaagccagcccaggctcagcttccacaggaacatgactagctctggtcagtcccagctccgcactcagccacgagggactcccagggtccccgggccccgacgccctgccctgacgtggggtctccacaaaacactcacccttgctttctgcatgacagccgctgtcctctcacatgctagatcccgggagcccatggcaatggggagaagctgggtgcctcacggggcctcctcactccctcccttcatgcaccatcaccacctggacttatcaggcctcaccggactgcccctctgggacctatgctccaggtgggccttgttcccagctgttcttccaaaagcctctcccaccttggccccaccccagacacaggccccgacccagacagaccccgccccagacacaggccccgccccagacacaggccccaccctcccgacaagcactttggccgaatcctccccatcaaatgagtcaacccgacacggacagacctgcaagtgtgtttccatctcgtctcgctccttctgcgccgactggagatgcccttcaaggtccgccatgtgctgacggacctgggccacctctctgtgcaggcgcgagagctccgcctcggcagtccgcttctccccgtgcacttgcatcagctcctgccgcagctccttcagctccgagtccagcctcttcctggtggctttcagctcactgatgagctggtctttggaggtggcgtcgcgccggtaggcctccaccatcacctgccaaagacagaggctgtgagcggacgctgggcggcggggcgtggggggcgtacctgggggtcaagctggcttcaacaaaaatgtttaccacttatcgggggcataacttttttgaggtaaagatacatttcatcaaatctaagactccatcgactgagacacaccactgtttatccacaggtgacatcactgcctgttgagagactgcgtggtgcacaaggcagtcacaccggcctcatagacgtctcctctattccaaggagtctggctctctcctgacttcagttgcacggctttgcttccaacaggtaatccccttgcttgtggctcagtaataaagcaaagcaggactcacgacaccgcttcaggggccgcccttgctcagaaataaaatacagcaggccgggcgcggtggctcacacttgtaatcccagcactctcagaaataaaatacagcaggccgggcgcggtggctcacacttgtaatcccagcactctgggagcccgagctggctgatcacctgaggtcaggagttcaaccagcctggccaacaaggtgaaaaccccatctctactaaaaatacaaaaaactagccaggcgtggtggtgcatgcttgtagtcccagctactcacgaggctgaggcatgagaatcatttgaacctggcagttggaggttgcagtgagcggagacagcactactgcactccagcccgggcgacacagccagactctgtctcaaaaaaactaaattacaggccgggcgtggtggctcatgcctgtaatcccagcactttgggaggccaaggtgggcggatcacgaggtcaggagattgagaccatcctggctaacacggtgaaaccccgtctctactaaaaatgcaaaaaaaaattagtcgggcgtggtggccggtgcctgtagtcccagctactcaggaggctgaggcaagagaatggcgtgaacctgggaggcggagcttgcagtgagccgagatcgcaccactgccctccagcctggggtacagagcgagacttcatctcaaaaataaaataaaataaaatacagcagcgctcacaacgctgcttcaggggtcaccctcgctcagaaataaaacacagcagcactcacaatatagcttcggggtcacccttgctcagatcccataaaatccaacaggaggtactggcttcactgacacaaaatttatattccgtgtctttttggataaccaaaatttgtttcaatgctggaactctatgtgcatttttcaaagacattttaaatggcaaacccaacctgtgtgttaacaacactgcacaacacacagctccctggagtgagcacaacagggtatgctgacaggcgctccagtgacagccgcccctggagatctgaggggccaagacccccaccccactgtggaagtgtgtcttgactttgcagattaagtacctttaaaaaaagttaaagagggccgggcgcggtgactcatacctgtaatcccagcactttgggaggccgaggagggtggatcacctgaggtcaggagattgagaccatcctggctaacacggagaaaccccatctcaaaatacaaaaaacaaaaaattagccggacgtggtggagggcgcctgtagtcgcagctactcgggaggctgaggcaggagaatagcttgaacccgggaggcagagcttgcagtgagccaagatcgcgtcactgcactccagcctggctgacagagagagactccgtctcaaaaaaaaaaaaaaaaaaaaaaaaaaaaaaaaaaaaatttaaagagaactcaagatgttaccttcttctcaacttcaatgacattggaattgctaagcaattaaaccacagaaaactctgttcatatgcttgtttcaagtgaagaaatcaacaacagatttttaccttttgttggagaaactgttcctttattttttgcatttgctttttcagagcagcagtctcctgctgcaggtgttccacctgtgggagacatgtgcacagacattacactgacggctccaggaggggaatctgtctgcacagatgttacactgaagcctccaggaggggaacacatctgcacaaatgttacagagagctccaggaggggacacatcctcacagatgttacactgagggctccaggaaaggacacatctgcagagatgtttcactgagggctccagaaggggccacatctgcagcgatgttacactgagggctccagaaggggccacatctgcagcgatgttacactgagggctccaggaaaggacacatctgcagagttgttacactgaggactataggaggggaatgtgtctgcacagatgttacactgagggctccaagagggggatgcatgtgcatgaatattacactgagggctacagcagggggacacatctacacagatgttacactgagggctccaggaggggccacatctgcagagatgttacactgagggctccagaaggggccacatctgcagcgatgttacactgagagctccaggaaaggacacatctgcagagttgttacactgagggctccagaaggggacacatctgcagagatgttacactgagggctccaggaaaggacacatctgcagagttgttacactgaggactataggaggggaatgtgtctgcacagatgttacactgagggctccaagagggggatgcatgtgcatgaatattacactgagggctacagcagggggacacatctacacagatgttacactgagggctccaggagggggatgcaactacacagacattacactgatggctccaggagggcacacatctgcacagatgttataggaagaagcacttgtgttctgacgggaactggtggttcctaaggcctgggctctccctcctcaccactgacagcatgaaggcacagtgagtggcagggaggtgggagaggggatgaggccaggggacactgcagcccagggctcggcaagcctttcttggagatgcctgatgggaaaagactgcagctcacaggctgcacgtcagtcacagctgctcagcaatgctcttgcagcacaggcgagcgagcagggctgttacagtgacagtttacagaacccggtgttgggctgcgcccacaggctgagggtgctgaccccaggctctggtccttgtcctgcaaagtctgttggagcccagcccattcagcccaggagcttgtgagaaatgcagagcctcgggccccacacagacccaccgcacaggacctgcactcagagggctccacacagacccaccccacgggacctgcactccgagggctccacacagaccgaccgcacgggacctgcactcggagggctccacacagacccaccacacgggatctgcactcggagggctccacacggaccgaccgcacgggacctgcactcggagggctccacacggactgaccgcacgggacctgcactcggagggctccacacggacccaccccacgggatctccactcggagggctccacacggaccgaccacacgggacctgcactcggagggctccacacagacccaccacacgggatctgcactcggagggccccacacagacccaccccacgggacctgcactcggagggctccacacagacccaccacacgggatctgaactcggagggctccacacagacagaccgcacgggacccgcactcggagggctccacacagacccaccgcacgggacccgcactcggagggctccacacagacccaccccacgggacccgcactcggagggctccacacagacccaccgcacgggacccgcactcggagggctccacacagacccaccgcacgggacccgcactcggagggctccacacagacccaccgcacgggacccgcactcggagggctccacactgacccaccgcacgggacccgcactcggagggctccacacagacccaccgcacgggacccgcactcggagggctccacacagacccaccgcacgggacccgcactcggagggctccacacagacccaccgcacgggacccgcactcggagggctccacacagacccaccgcacgggacccgcactcggagggctccacacagacccaccgcacgggacccgcactcggagggctccacacagacccaccgcacgggacccgcactcggagggctccacacagacccaccgcacgggacccgcactcggagggctccacacagacccaccgcacgggacccgcactcggagggctccacacagacccaccgcacgggacccgcactcggagggctccacacagacccaccgcacgggacccgcactcggagggctccacacagacccaccgcacgggacccgcactcggagggctccacacagacccaccacacgggatctgcactcggagggctccatacagacccacggcacaggacctgcacttggagggtcccggaggactcaggaatccatgtgtttgtgaaacacttctctacctcagcaaacagctctcagtgcacacacacatggggcggccgactccagaaatagggaagagcttgtttagggcctaggttttctgtctgaatacagaacacactgcatgcaaatcctagttatcactagagcatgactgaagaatgagcctttttccctacaatatggagggcggtccctcaggagcccccctgcgaaggatcaaagtgctggttgttccacacgcatcattcatccgttccgatgatcctcacgtcacctgcccctggtcccacagcggctcccacagtgggcaacagacttggaactcagcaaacagggagccatggtcagagaaacctcagcccccacgtggatactgctgtgtctagatgcctagggaatgcagtggctcacgcctgtaatcccagcacttcgggaggctgaggcgggcagttcactcgagcctaagagtttgagaccagcctgggcaacatggcaaaaccccgtatctatttaaaaaaaaaaaaaaaaaaaaagatggccggggatgtgtgcacattccgacaaggccaggcagagtggccaacaccaggcaggcccaggaggccagtccgtctcccagtcggctgactatggtccccaggtggaaaacagacttcagagctgggaaggcagcttccaagacaaggtcactgctaccaccaccttcatctgccctggggaaaacagcccaacccagaggttaacttggattaaataactgccagtaatgacaacacaggtaaaattccaatatgagaaataacatatagctccacaaaagtctctctcgcagtcttccaggtatcagctgtttcttactgagctaatggtcagtaaaatcaagtttaaattcatccacagaattgggacaattcctctaaatttactcccccaacactgtaaacagtaatgacctgtctgagtgcctctttactagaaaatcacttagtacaggtcagtgtttgtagtgacagcttccttcagaaaggagggaaaacaggctcatgatttcctcttgcccttgatccttatagagtgggatttaaagacagaataggtggctcacacctgtaatcccaacacttcgggaggccgaggtgagcagatcatgaggtcaagagatgcagaccatcctggccaacatggtgaaaccccatctctactaaaaatacaaaaattagctgggtgtggtggcatgcacctgtagtcctagctacttgggagactgaggcaggagaatcacttgaaccccggaggcagaggttgcagtgagccgagatcaccgcactacactccagcctggcgacagagtgagactccatctcaaaaaaaaaaaaaaagaaaaaaggggtcgggcgcggtggctcacgcctgtaatccgagcactgtgggaggcggaggcaggcagatcacttgggtttaggagttcgagactagcctggccaacatggcaaaactccatctctactacaaatacaaaagttagctgggcacaatggctcaggcctataatcccagcactgtgggagactgaggtgggcggatcacttgaggttaggagttcgagactagcctggccaacatggcaaaaccccatctctactacaaatacaaaaattagccaggcatggtggttcagcctgtaatcccagcactgtgggagaccgaggcgggtggatcacttgaggttaggagtttgagactagcctggccaacatggcgaaaccccatctctactacaaatacaaaaattagctgggcatggtggcgcacacctgtaatcccagctactcaggaggctgaggcacaagaattgcctgaacctgggaggtggaggttgcagtgagcgcagatcatcccactgcactccagcctgggcaacacagcgagactgtttcaaaaaaaaaagaaagaaagaaagaagcaaataatcagcatcattcctgcaaggagggttctgattcaaaacaaaacacagcagaatgcattacctggccggatttgatagctaattcttctcttaacttctctaaagtttccgacgtttcctcggtaccttcttccaagcgtcttgctcctctgtcaagctcctccttgccactcttggccgcctgcaaagccgcctccaagatgatcttctcgttctgcaggaggcagatcgtgtcctccctggaggcggcctcgccctgcagctcccccagcctggcctgcagctcatcgtagtgtgtctgcagggcatcgagggactgctccctgctctgcagagcctcctgagtcaaggtgagctgtttcatcaggtccaggtgctcctgctgcaaagcctcaagctgctggtctcgctggagtaaagtcaacttcacctggagaaggaatgaagcccacatggctgcgcctgaccctcctccgagagcgtatgcccttttcctgttcgggtttcaagtaattttgatggacactatggagggtctttttttcacgcacaatcctggtatagaagaaccagcagggcaaacacagggtcaggtctgcagcagcagcagcgtctgaccgacagcccaactcccacctgagcggacgtggccccacagcagaggactgctcggtctccttgtgtgcagtcctggctgctcgggatcacctggggcctgggtccagcctgaagggctgcagggacttacctgctccagctgctgctccagggatgccgccgagtccgccatcctctgcagccgctccctctcaccttcaaactcttccagcctcctctgaaggtcctcctccaccatcgtctttgcctcctgaatctgcatgaaggctgcttcctgatccaacatgtcagcctgagcccaggaaacttgtttttaaaaaggcaggaaaccttaatagtgaacagcagccggtggccccgtgctctgcagagaaacccaccgccctggcatgggccccatccacctcctcatcctgtctaccgactgcagactgagggcccaggatgggcagcttggccgccccccaaccaggagaccgaggccaggcccagcccaggccagcaaccccgtgagaaggacttggacccactggtgagcagagcctccccgactttctcgtgtggcgacagctgcctcctttcgggagtgagacccggacatgctctcacaagagcggtgcttggtgctaccgggtaagagaccagaggcccccgcagtgaacacagcctcacatcggggtacacttcttagggaaaacacaaattcctaacttgaaacttgaaattcttttcagttcttctctactaagcccttgaagcactatggctgacgcaacgtgattcttctcatcccagccgggcagcccagctaatgccacagagaggtgggagcagtcgcaggagatgagaaaccacgtgaggctgcagagagctccctgtacaactggcaagatcggcaacgagaccagcccagcaacatccagcacagaacctccctccatacactgccttggggttttacaccatttcttcttctttaatttttccacaaggctatcgagtaggtgacactatccccattttataaagatgaggctcacgcctgtaatcccagcactttgggaggccgaggcaggcggatcacctgaggtcaagagtttgagactggcctggccaacatggcgagaccccgtctctactaaaaatacaaaaaattagcagggtatggtgacgagtgcctgtaatcccagctactcgggaggctgaggcaggagaattgcttgaacttggtaggcagaggttgcagtgagccaagatcgcaccactgcactccaccctgggcgacaagagcaaaattccacctcaaaaaaaaaaaagatgcggctcagagaggtaagaaattgtccagcgccccacagctaaaggagaacagctatcaaggctgctgcatttctgtcctctggagatggctgtgcaggcagcggccatgacctcgacagcgtgtggttgctggagggttaaatggcaatgcagtctgagtgctcagtaagcaaagaaaatcctctcatccctaggcttcgacaggctgtcaggcaaaaacgcactggccccttcctccgtacccactctgtacccagcgccatccctgactggcaatgactgacagccgggggcccaggcccaaggcggggcttgcaggaaaagagccgcaagtgctcactgcactaagcccccacaggtgaggatgaggggtggggggggtcccaaagccttaacgagcagtcactgcaggccatccatgctaagcccccacaggtgagggatgaggggtggggggggggtcccaaagccttaacgagcagtcactgcccgccatccatgagaatatttaagagatacacacagagagacggaacatgtaagaaaacacacatggtatcgatgtctgcgtctgttctcctaagcttccacggccccggccgcagcctcacctcaatgccctgcagctgtgccgcgatgcgccccttctccttcatggacctgtgctgagtttccgtcagctgctgggacagggacacattctcgagtttcaggtgctccaggagacctgcctgggtcatctgtccaaccttaaaaaaaaaacccacaaagtaaaaagttgctcaatttcaagcaagaaatgcagaccagcctgtccctggaggccccagggtgagggtcactggctgccccctcagtgtctcccacgcaagccccactacccactacacgtcttcccatctcaaaatatgcgctgtctgggctctgcgtgcctgagtgggagggcgggcgggccatcagccagcgctcatcatgctgtttgtagctcatcagactgcggtttgtagcaggacctacccaaaagtccccattgacaaggcatctctgagcccctgtgggtgaggaggggcatctctgagcccctgtaggtgaggaggcttatcttaactgaacaaatccagccagacacacaccagggcctgccctcagccagacgcccgacaggtgccattccagggatacagccttttcagccagctagggcccggcccagacctccaggtgctcaggcccacgctggccaagcgtctcgtgaaaaagcccaggaccatggccctgaggaggacggcgtcagccaagggaagtagcactgaaaaggaggtgtgaggacagcctggggcctgaggctagacctgcccgcatcgcctctagctccatgctgcttcctggagtgcacagtgcgagacgtgacagaagccacacgctccaggacctcaggagaaggtgcacggagccagggaagacagcctttgctgggactgtgtttcgagaccatgaaagcagactgactgcctggaattctcctccctcctgaacgttactgggaatgaagggatacatttgggtaccaaaaaaatgtattaaaaactctgattaaggaatgctgaacctgggttccaaaggtatttggaaaaagcagtgagggcccggcagtggctcatcctgtaatcccagcacgctgggaggatcgcttgagtccaggagttcaaaacctgcttaggcaacatagcgagaccctgtccttacagaaaacttttaaacaattagccaggtgtgatggtgttcacctatgtcccagctacttggggggctgaggcaggaggactgtttgagcccaacaggtcaaggctgcagggagctatgatggtaacactgaattccagcagcctgggtgacagggcaagaccctgtctccgaaaaaacagcagatagggctctggagccaccattgctttaaagcttcctctctttttgttgtccaggctacaccaccatacttccttgttgttggttttttttttttgagacaaagtctggctctgttgcccaggctgaagtgtggagtgcagcagcgcaatcttggctcactacaacctctgcctcctggattcaagcacatctcatgcctcagcctcccaagtagctgggactacaggcactcaccaccacacctggctaacttttgcatttttagtagagatgcagtttcgctatgttggccaggctggtcttgaactcctggcctcaagtgatcggcccgcctcggcctcccaaagtgctgggattacaggcatgcgctactgcacctggcccaaactatacttctaaaatacacctggcttggcctacgtctttaaatacctcatataaatgcactgcagctgtaaaaaagtgtattaatttgtatactgatttgtttccaagctatgttgtaagtagaacaaatgcttttccgtattgttctttggcttaaaaaatatgtaacagtcgagtgtggtggctcacacctgtaatcccagcactctggaaggctgaggaaggcggatcacaaggtcaagagttcaagacgagcttggccaatatggtgaaaccccatctctcctaaaaatacaaaaattagccgggcatggtggcgggcgcctgtaatcccagctactcgggacgctgaggcaggagaatcacttgaacccaggagacagaggttgcagtgagctgagatcacaacactgtactccagcctgggagacagagcaagactccatctcaaaacaaacaaaaaagtaacgaaaattgaagaaaagttctattgtgtatatttgtaactctagatgtaaaaggaacatttggtggaattagtatttcacgttcccctcttgagaaataaagttttaataaatttataatattttatctgggaaaaaaaaattccacagctaattaaaaaataacaggccaggtgcggtggctcacgcctgtaatcccaacactttgggaggctgaggcaggcatcacttgagcccaggagttggaggccagcctgggcaacatggcaaaaccttgtctctacaaaaagtacaaaacttagccgggcatggtggcaaatgtctgtgatcccagctagttaagaggctgaggtaggagaatagcttgagtctgagaggttgaggctgcagtgagctgagatcgcaccactgctctccagcctgggtgacggagtgagacacagtctcaaaaaaaaaccaaaaacaaaaagactgaggctgaccaaaggtactcttcagcatctctgaggtcatcctaattagtctaggtgctgagactcggatcgaggttcactcgaaccattcgcctgtcggtctgggcgtctccagcacacgaagcagttgctgtgggccgaggcacaggcctggacggacacacactcccacatatgcgggaccaagctggacatgggctgtgcccgctaacgagtggacgggagaggaaagagttttccaacaggacgtagaaaatgcaaggcctgctgggaagacgtggtccccgtgtatcactgagggctcaggcagcagggaaaggaaaagctccaaccgggaagagaaccccactggcaccgcacgcctgtgagacatcacagcagagtggggaggctgaggtgggagggtcctgagacccaggcagatgaggattcacaggcacgcaacactgtgccgagtcaggaggccagggtgggagggtcccgagacccaggcaaatgaggattcaccggcatgtgtcaccatgcccagcaagagaggctttggaactgaaaatgctggcagaggctgccgtgggactcccatgtcagaaggttgggggggggcccacgggacacgtcctgcatacgacacgtcctacatgggacacggggtgggctggacagcaggttaaaaacaaaaacatgcctgtgaactctaaaaacagaaaaatctcaggaaaaagcaccgttctacatgaagacaagaagcgtgacctgccctggaaggtagatgtgggccgtacctggatgtgggccatctcaccctgcagcctgacgcgggcctcctgtgccagggcgagctgctgctggtaccactgccggacactctgcagggacgagatctccgcctgcgacgccttcagcttgctggtcagcgtcgtccgctccagctgcacctgctgaagctggctctgcaaggctgtcatctgctgtcgcaggtcgtgcactgaaatggggcaagcacagcggctcaggccagcgacggccaacgggggagtccgcagctccgcgcgtgcgggacacaaggcgggactctcaggggagaccaagaatgagtcagttccggttattccccatagctgactccatgaagtcgccgtgaacacggcattagtgggcgctgagagatgccgctcctggcagaaatgcagggtgaggttcctgcaggcctctgctcacagcaccttcaccagctcatcaatacataacctctgttcagtgtttccatttacgacaccgatctaatacatagcgtcgattcattcacaccgagctcacggccaacagcaacttgaccaacaagcctgagcaaagattctctaggaaataacagtggccggacacgggggtgcagggggcatggggggtgcagggggcacaggggtgcacgcccaggagatccagaccagcctgggcaacacagcgagatcccccaccaccaaaaaaaaaaaattagccaggcggggtggcatgcatctgtggtcccagccacttgggaggctgaggcgggcggatcccatgagcccaggagtttgaggctgcagtgagccacaactgcactgctgcactccagcgtgggcaacagagcaacccatctcaaagacaaatgaatttttaaaaacaaaaagaaaatttaaaaaaatagaaacaggatgaattgaaaaaaataaaccaaaagaaaaaaatgaagtacatcttctccatgaaacacctcacatcctctctgtgtttaaaaacactagacagtgttggccgggcacagtggctcacgcctgtaatcccagcactttgggaggctgaggcgggcggatcacctgaggttgggagttcgagaccagcctggccaacatggagaaaccctgtctctaataaaaatacaaaattagccgggcgcggtggcagacgcctgtaataccagctactagggaggctgaggcaggagaatcgcttgaacctgggaggcagaggttgcggtgagccaagatggcgccattgcactccagcctgggcaacaagagtgaaactccgtctcaaaaacaaaacaaaacaacaacaacaacaaaacaacaaaaaaaaacactagacagtgtttggggccatctttaactgcaaaattaccccccaaagcacaaacatgtaaacatggccctggaaagaactcctgcctgcagcccggctgagcaccaaggcaggcagagtatcctgccctcctcagcgggcgcctaggatgactcacgtactctgctgctccacacgtgtccatgaatactgagtttgtggttcaaacaaatttaatcaagtcggcaaattcacacttaggaaatctgtgaaaatggtcatggacgccgaggctctgtcttcgacccaacgatgtctaccagccatcaacaaacagcaagggtatccgtgtggctaattccaacttaaacccaccggttaggactgggcggcctcatcaaagttcaggttggttttgccaccccccgatcactggtcaagtgaagcgtggcaacccacagggccccaaactactttagtgttgagaactttttgggtttcatggtttttcctaagggattgggtatcacgaaatgctcaaggactaaaatattaaagcgattacaagagtactactgtctctcggccggctttctctttcctagtattagaatgtagcctctgtgacgccagcttgtcaccttcctctgtgtcatccaagacccagtctcacagcctcataggcggaccggctcacatggagtcagccctcacagcggctgcaccagggacccctggctcaggagatcccaagacctgagagatgagcccaccaagcggcctccctgggaggactctggacccgggtcactctacacccctcgggctttgtcttcaatcttcccaccctgcttcgccctctccttcccactcctgttcacgcttgctctgagcaggccaaccacagtcttctccgtgtctgctgggcactggagtgtgagctctgggactggcccgggcggggactgagggggtggaaggcgtgctgccaagccacatggaagcccgccgcggcttccgcaatccactgccctacttgtactctctgggcgagccctatagggaggcagctggaccgacgcactgcatccagggagaaaaggttgccagacggacagtcaaggagctgttcttgaatattttaaatggaatctgcaattctgtggaataagtgggcagctctatactcccaaataacactggacttttgaggcaggatcaccgcagatactccagggtccaaggtcaatctccaagacctaattcattcccctggatgtgcacacaaaaatgtacacaattccacaagttcaactaaaacttgtatttcctttagaaaagcagcctccttatgtgtaaactataaaccaatgcaaccctcacaggcacagtcacatgccgacagagctgtcagcaccagggaggagggcgtggcgaggaccagtcagggaaggagggcgtggcggggaccagtcgaggaaggagggagcagcggggaccagtcgaggaaggaggagggagcagcaaggaccagtcagggaaggaggagggcgtggcgggggccagtcgaggaaggaggagggagcagcagggaccagtcagggaggggagggcgtggccagggccagcctcacctgtgttgtccttgctgagcatgctcctctgcatgtcctctaccttggccataagcctctggtactgctcctcggccacctgcaagtcgttgttggacgacgccaggctggcattttttgcctccagcatgttctgcaggtcagtcatggctcgctccaggtcccagcacgactgcttcagggtgtccacctccgagctcagcgaatcctgccgctgctggctgctgtggctgcactccacctgcgcctgcagcttcgtgctgagggcggccagctgggcctgcagctcagccttctctttaagtgcctgaaaagatcccaacaaccacaatgattttaagaaaacgagtcacttccatccagtgtattaacaggaacacaaccagcgagtcagtcagggcctgacaggggaccccgagacccccaggcgctctcccaaggcctgacagaggaccccaagacccccaggcgctctcccaaggcctgacaggggaccccaagacccccaggcgctctcccaaggcctgacaggggaccccaagacccccaggcgctctcccaaggcctgacagaggaccctgccccgagacccccaggcgctctcccaaggcctgacaggggaccccgagacccccaggcgctctcccaaggcctgacaggggaccccgagacccccaggcgctctcccaaggcctgacaggggaccccgagacccccaggcgctctcccaaggcctgacaggggaccccgagacccccaggcgctctcccaaggcctgacaggggaccccgagacccccaggcgctctcccaaggcctgacaggggaccccgagacccccaggcgctctcccaaggcctgacaggggaccccgagacccccaggcgctctcccaaggcctgacagaggaccccgagacccccaggcgctctcccagcacagccgtcacagaaaaaggcgactttccaaacaggcccaggacgcacagggagcctgcactggttttgggcccaactgcacctgcacagggcagcgctagggcagggctggggaagcacccgtctcctgcgaggacactggaaacgtgttcaaaacaccaaacgtgtacacgggtgcacatgtatgcgcacacacacagaatgccagacgtgtagagggacccctgagagattaaaagcggattcagatctggggggaaatgggcaaaaaacacaggcagggaaaggcggctgcctaagtgcggctccagccagagccacgggacacagcacagtcctgagtggccaccgcagtgctgtgtggtcccaggagcagcagagaatcgccagaggaaatcgccccaccacctgcccccacgctgaggcctacaggggcagggatccagttcacacatcaccaagacaacaaacacccaaagcaattgaggaactccacaaactccaggagaccctagagcaaggggccagcaaccaccacacctgaaacaaccctcacgatcttggtgtggatgcaaccgaaggaccaatcagtgatcctaagaggataagaagacaaagtgcagtgacagcaagccaccgttcgagagagtggctacacagaggaggggaaatgcatccgacggagggaggctcacgctgtaacactggagaagtgacgaccgtacaaccagaattagcctcaaaacagccgaaatcacctcttctgtagacacagctttaggtgtcacaaactggttggtttgtgtccaaggaccatgttgtatgagaaaaccatcttcgacatgaggcgtgcatttagcaaggcaagctccggacactgtgagcagctccagccctgctctgcggcctcgcaggccacaggaggctccctcagctgtgtcacctcagggcctgggtgcattctcaccctcccacgccagaagcggacagctgaaccccactgaacagatttactcaactgccgacagaagataaatacctagctcttcactgtggataaagtgcatacgacaaaatgacaaaggagagctgaaataagggatggaaaatgatgtttctggcacatgctaaccaagccagcgtgtgcagctttctctgatacagcacaattagtatcagaaaaagcagaaatcactacaaagaaaaaaggttcaccatgccagaaaaagctgcaacccaccaagagaatttgactcttatggactgtgagacacctaacatctagcaaatattctggtagagacgcagggagaaacacgcccatgcacgatgaggcagaaaactcacaactctttctaaggctgacaagtagacaaaaaacgtaaagatgcagaaccctcggctgccacacatgctgcggcggctgattcccaaccacatctgtgaaacctcgtacccaacagaggagccacacatgctttccgacttcgccgcacgctgagatgtcagtcgaacgtccgttacctgactcgcctccagtgacaaggcttccagctgtccttcgagtcgcattttctctttgagcacctgcagcatctcctcctgtgtttctgctgcagagctctccaaggacacgctggggacaaaggcacgggtcaggcctgtgcgagccatcctcattttctttcacactcctccacattctccaaattccacacacccctgctgctctctcccaattttttaaaattaagtaagagatttaagtagagagctgaggcttgcatgatgcacggatgaacattcctgccaacagttggcacctcacgcagtgggaactgttacagaaacatgagacatgcaagcgtcgtgcagcttagtgacaagtctatgtaaacgggagactggatattttagtaacacagaccattgctgatctaattctactgattaaaaagcagcagacttgttatgaattaaatgttcatgtcaagactaaggatagaatcaggaagaaaagctgtgtatcacctgttccagtgcggagagccgtgggcccgggaagcaacatctcaggccaggccctctgcctgccctgcccgtctctgcccaccccgccccctctgttggccccacccacctctgctaccgccccacccacctctgcccgccccacacccccctctgttggccccacccacctccacccaccccgcccacctctgctgtccccaccacctgctgcagatgctgtctctccgactccgcacctccccgttgacctcctgcccctggtcttggtgctcagcggctgcggcctggaggacgtccttaatggaggggaactggcccagggtatccgcaggaatctcctggccgttgaccatatagggggtgtcctgcgtgcccactgtcttcgacagaatgccataggtccctcgggtggaggcgctgctgtacgatgagctgtcgctgtcatttccatccacctcagacacgctgtctccagccagggaggtgttctccagacggtcgtcagtgtcgggggacaggctgatctcagacacaacggacgccgcactgcttctgttctgcttcagggaacccttggtagaatcgggagccgggacatttcccccagaattccccgcatttgaatcttcagttctgtaatcggccagagaccggattttgcttgatttggaagtttttttctccctaggatgtgccggaagccccaggctgcccaccttaggcccccgagggacactggtgcgcaggaaggaatattcttttgtcatagccagggtactggcccttggtaagttttctgggtttaacatgagctcaggatcaagcgtgctaaaaagtctcgttttggttgcaggttgactggactgagaagaaaacaaaagtacaaaaattacatttaaaatccacaagcagcatacttaaaactgccattcagaaaggtggcaccgatcactactccctccgctgacaaccagagagcaccacctccccagcccctcaccacacagggtgcggccaggcctccgatccgtggtggtctcactgccgcaaggccccactctagtgaccagcatgaccacctctggtctaaagcacactcttcagtgactgtgacctcaacacgtttaaaacacatcccagcaagtacctcctcatcagacttctgtagggaccagccccacagggtcagtgggtctccccctgtgtgcggcgacgagagtgtagaaataaagacacaagacaaagagacaagagaaaaggcagctgggcctgggggaccactaccaccaatgcgcggagaccggtagtggccctgaatgtcgggctgcgctgttatttattggatacaaggcagaaggggcagggtaaagaatgtgagtcacctccaatgataggtaaggtcacgtgggtcacgtgtccactggacgggggcccttccctgcctggcaaccaaggcagagagggagaggagacacaaagacagcttacgccattatttctgcatatcagggactattagtactttcactaatttactactgctgtctagaaggcagagccaggtatacaggatggaacatgaaggcagactaggagtgtgaccactgaagcacagcatcacagggagatggttaggcctccggataactgcgggcaggcctgacatcagtcaggccctccacaagaggtggaggagcagagtcttctctaaactcccccggggaaagggagacaccaacccccacccccgcccccccgccccccggttcccggtctgctaagtagtgggtgttgttccttgacaccttttgctaccgctggaccacgatccgcctggtaacgggcgtcttcccgtcttcccagacactggcttcaccgctagaccaaggagccctctggtggccctgtctgggcataacagaaggcttgcactcttgccttctggtcacacctcactatgtcccctcagctcctatctctgtatggcctggtttttcctaggctatgattatagagcgaggattatcataatattggaataaaaagtaattgctacaaactaatgattaatgatattcatatataatcatatctaagatctatatctggtgtaactattcttgttttatattttattatactggaacagcccgtgtcctctgtctcttgcctcggtgcctgagtggcttgccacccacagacttcctcaacagaactttcctggctactctccagtttattttatttttttggataaacatagaaattttcttcaaggccgggcgtggtggttcacacctgtaatcccagcactttgggaggctgaggcgggcagatcatttgaggtaaggagttcaagaccaggctggccaacatgttgaaacccccgtctctactaaaaatacaaaaaaatgagccaggcatggtggcacacacctgtaatctcagctacttgggaggatgaggcaggagaatcacttgaacccaggaggtggaggtcgtaataagccgagatcatgccactgcactccagcctgggtgacagagtgagaccctgtctccaaaacaaaaaaaaatttcttcaaaaaggaagaacattctgttgaactataaccaccttaaatccataatttcctccgcctgcccacatctgcttgcacgtgtgggcggcaagccacccaggtgccgaggcaagagactgaggacgcgaactgttccagtataataaagtatataaaataagaatagttataccagatatagatcttagatatgattatatatgaatatcattaatcattagtttgcagcaattactttttattccaatattataataatcctcactctacaatcataacctaggaaaaaccaggccatacagagataggagctgaggggacacagtgagaagtgaccagaagacaagtgcgagccttctgttatgcccagacagggccaccagagggctcctgggtctagcggtaacgccagcatctgggaagacgcccattgccaagcagaccatggtctagcggtagcatcagtgtcaaggaaaaacacccactacttagcagagtttagagaagactctactcctccacctcttgtggagggcctgacgtcagtcaggcccgcgcacagttatccggaggcctaaccatcaacctgtgatgctgtgcttcagtggtcacactcctagtctgctttcatgttccatcctgtacacgtggctctgccttttagataacagtagcaaaattagtgaaagtactaaaagtctctgatatgcagaaataacggcataagctgtctctctctctccctctctctctacctcagctgccaggcaggggagggccccctgtccagtgggcacgtgacccacgtgaccttacttatcattggagatgactcacactctttaccctgccccttttgctttgtatccaataaataacagcacagcctgacattcggggccactacctgtctccacgtcttggtggtagtggtccccccggcccagctgtcttttatctctttgtcttgtgtctttatttctacactctctcgtctccgcacacagggagaaaacccactgaccctgtggggctggaccctacatgcacgcccctcaacagagcagctaccccacccccatctagaacccaggccctctgcggccattctaacttatttctcagtttatcctttttgttgttataaatgttatacttcccactaatcttacaactgctaggataactcttcatttttcatacttgcatttttattttttttttgagatggacccaggctggagtgcagtggtgcaatcttggctcactgcaacctctgccgcctgggttcaagcgattctcctgtctcagcctcctgagtagctaggattacaggggtgtgccatcacatccggctaattttttgtatttttagtagagacggggtttctccacgttggccaggctggtctcaaactcctgacctcaagcaatccgcccgccccaccctcccatagtgctgggattataggtgtgagccactgcacccagccagattaaagtatttaaaaacataaccttaaaggtataagaagaacacgctggtcattttattgatcttcttctactgaagagatccttttgaaacatgacataggctgggcgcgatggtgggtgcctgtagtcccagctactcaggaggctgaggcagagaatcactggaacctgggaggtggaggttgcagtgaaccgagatcgctccagcctgggcaacagagtgagactccgtctctcaaaaaaaaaaaaaaaaaaaaacattaaaaaaaaaaagtagccgggcatggtggcacgtgcttttaatcccagttactcgggaggctgaggctggagaattgcttgaactagggagacggaggttgcagtgggccaagactgcaccactacacacctgcttgggtgacaaagcgagattctgtctcaaaatacacacacacacacacacacatatatatatatatatattttttttaactgctcattgacaatacgccagatcacctaagagctctgatgggagatgtacaaggaggtgaatgtcgctttcctgcctgcagacacaacatcccttctgcagcccatggatcaaggactagttttgactttcaagtcttattacttaagaaataccttctgtaagggtacaactgccatagtcatagtgattcctctcatggatctgggcaaagtaaactgaaaaccttctggaaaggattcaccattctagatgccattaaaaacattcatgattcatgggtggaggggtcaaaatatcaacattaacaggagtgtggaagaagctgatttctaccctcacggacagcgttgagggattcagtgcttccgtggagaacttgactgcagatgtggtggaaacagcaagggcactagaactagaagtggagcctgaagatgtgactgaattgctgcaatctcaggataaaacctgaatgggtaaaatgccatcaaatagcaccgcatgttacagagacatcttttctaagatatggtaaactttagtgcggttttaagaaattaccacagcccaaccttcagcaaccaccaccctgatgagtcagcagccatcaaacttgaggcaagatgctccaacagcaaagagattacgacttgctgaaggctcagatgatcgttagcattttttagtaataaagcattttcaaattaatgtgggtacatcagttttatttagacacagtgctactgcacacttagtaaactacagtagcgtatacacataacttctttatgcactaggaaaccaaaaacattgtaggacttgctttattgcaatgtttacatttttgtggtggtccagaactgaacccacagtacctctgaggtcacccgtgtttgctttctttgcttttcaattggcagatttagaaataaaatgtgcttgttgcccctgagcccatggcagctcagagaagccaatggcaggtccccgggttatgtgggaccaacagttgtctctggcacaggaagctttccatgagcttgttcgggagagggagactcaccctctcctgctggcgcttcaccctgtactgtttgagctgctcttccagccacttccgagcctgaagtcggacctgctcctccttctccaggggcaggggagaatctgtagagcctgcagtgggaaaagggcaatttggaaactcataaaataccaggatgcagaacaatcaggcacaagaacttggtcattttgtacttaattacccatatactttacacctaaacaatgcacagccatcttgtttggaaggacaatttctagatcaagagagaactgtgagccccggacacggaccacaggcgggatctacctcacaggagacacagtggccaggcactgggtctgtgatcccatgatgagtacaccccacctggggcattcccctggtaaaacaggaaatggcagcaagtgcctttttttttttttttttttttgagatggagtctcactctgtcgcccagaatggagtgcagtggcatgatctcggctcacagcaacctccgcctcccaggttcacaccattctcctgcctcagcctcccaagtagctgggaatacaggcgcccgccaccacgcctggctaattttttgtatttttagtagagacggggtttcaccatgttagtcaggatggtctcgatctcctgacctcatgatccacccgcctcggcctcccaaagtgctgggattacaggcgtgagccaccgcgcccggccttttttttttttttttttgagacggagtttcattcttgttgcccaggctggagtgcaatggtgcgatctcggctcaccacaacctctgcctcctgggttcaagcgattctcctgccacagcctcctgagtaggtgggattacaggcatgcaacacgacccctgacgactttggtatttttagtagagacagggtttctccatgttggtcaggctggtctcgaactcccgacctgaggtgatccgcccacctcggcctctcaaagtgctgagattatgggcctgagccaccgtgcccggcagcaagtgccttttaacaacagaaagaactgggttcaaagctggagccgtgccgagcactctgaggcaggctcagctctcaccacgctgcaacttgccctggcttcacagcaggttctcgtgaccccgctgggagaacctgaaacgccggcaccgtggagttacaggcagtacccagccacaggagctcagccgtcgtggggtcacgagaccccgagtgcatttctttgctcagttacatttggggtccgctctgacgcacagctcatctcagctcctgcagtaacaagtcacattacgataaggctctggcggtactcaaatggctgaagcctggcgccaggcctcactgcagggtaaatgctgcacaggctccgccctccagggctgggggcgggttacctcagtttccagacagacaagactccaatccgaggtcatgctccgggacaggaggggaaaatttacaactttttagccaaaaccagaatttaaaatatctaaaacccagacctttcattgtaggtgatgaaagagttgcatggtacgtgccaacgtgttatagttacaaacccagggctccacttcccaggactgagtgtgtggcctcatccttcctaagccatcagcagacaccgcccgacggcctgggtgccgaccagagtaggaaagcataatcacacagcaacgctttacacatgacaccctccttacaggtagatgctgaggagatgagcagctactgtcctaaataatccctaacatctgagcagtcaccaagaatttcactgtaaatgtaccattattagtttatacattttatcactgaaaagatctctagtccttttcacatggcaaagtggtccagatggctagaccgtaagtggcaaattcaggcctatggccaccaggcagatatttatataagtcggcaaaataagcagggtttcaaccaaacactgacgcaggagataggctcagggccaggcgccagcaggaacaggtgaccaggggcatcccgcaaaggtgtgcacgtagacccagcgctgctgccccagacacctgggccagagctcacacatctgtaacttcaggaccccaaagtaaataaactaagttgaaaaaaatcaggaatctagacttttttacatgctacttctcaacttaaatgctggcagtgagttttcagaattgtttcaaataaacacatgtgaaatgcagtctgatttcagtaatttagggttttttgttgttgttatttagttttaagaaatttttaaaaatatactgcaggccaggtacagtggctcacgcctataatcccagtattttgggaggccaaggtatgacgatcacttgagcccaggagttcaagaccagcctgggaaacatggtgagaccccgtttctacacacacaaaaaattaaaattagccaggtgtggtgacacgcacctgtggtccaagctacttgacagcagaggcaggaagatcccttgaacctgggaggcagaggctgcagtgagctctgactctgccactggcctccagcctgggcgacagagcaagatcctgactctaattaaaaaacaaaacaggctgggcctggtggctcacgcctgtaatcccaacactttgggaggccaaggcaggcagaccatgaggtcaggagatcaataccatcttgactaacacggtgaaaccccatctttgctaaaaatacaaaaaattagccgggcctggtggcgggtgcatgtagtcccagctactcgggaggccgaggcaggtgaatggcatgaacccaggaggcggagattgcagtgagccgagacagcgccactgcagtccggcctgggcgaaagagcgagactctgtctcagaaaaaaaaagcaaaccaaaaaaaaccaaaacaacagactggatgcccaccgtctgcttaccaagcacctgggtgacacaggacatgcaggctggcctttaacgcaaaagcgtcagcactgctgccagtcagaccacagcagaaccttgactccacctgcatcttcactctctaacttgaagctctccttgctaaactcacagccccacgtgggactcagatggcacacggcaggcacaggcacacaacagctcagacagtgagtgcgcagggcacctgctcccaaggggctgagcgacgcggacgtggagggtgggaaaagcggggtaacggatgcttacacagttgcgtttcttgcataggaagactgagtctgagagactgcaaagcttcttttctaacactgccctcagcactagttccctgagacttccttaggttgtcatggaaaccagccacacctggagaggcatcagggcccactgggcttgtggtgggatcgagagacgacggagggtctgggaagggtggcgttggcccgttctgacagaggcctccctggccaggtccatccgggctttccccttccgtggatgctctgtttacctcggcacctggaaagacagagcacgctggaccaccatggctttaacaacaaggtgacgtcgcttttcagacatgcagctggagtaggagagaagaggatccagactcatgagcacggcactttctcatcccacaaaggcttcactctgagaggagcagcccatgggccccgtcccacaggcggggtggccaggataaggcccacagcccctctggtgtccacgtccttcctgtaaggtgaacctgccctccacacctccacactctaacgtgaacccgccctccacacctctacgctctaacgtgaactcaccctccacacctccacactctaatgtgaacccgccctccactcctccacgctctaaggtgaacccgccctccacacctccacgctctaaggtgaacccgccctccacacctccacgctctaaggtgaaccccccctccacacctccacactctaacgtgaacccgccctccactcctccacgctctaaggtgaacccgccctccacacctccacgctctaaggtgaacccgccctccacacctccacactctaaggtgaacccgccctccacacctccacactctaacgtgaacccgccctccactcctccacgctctaaggtgaacccgccctccacacctccacgctctaaggtgaacccgccctccactcctccacgctctaaggtgaacccgcactccacacctccacgctctaaggtgaacccaccctccacacctccacactctaacgtgaacccgccctccactcctccacgctctaaggtgaactcaccctccacacctccacgctctaaggtgaaccccccccccacacctccacactctaaggtgaactcaccctccactcctccacgctctaaggtgaacccgccctccacacctccacgctctaaggtgaacccaccctccacacctccacgctctaaggtgaacccgccctccactcctccacgctctaaggtgaacccgcactccacacctccacactctaacgtgaacccgccctccactcctccacgctctaaggtgaactcaccctccacacctccacgctctaaggtgaaccccccccccacacctccacactctaaggtgaactcaccctccactcctccacgctctaaggtgaacccccccccacacctccacactctaaggtgaactcaccctccactcctccacgctctaaggtgaacccaccctccacacctgtacgctctaacgtgaacccgccctccacacctccacgctctaaggtgaaccccccctccactcctccatgctctaaggtgaacccaccctccactcctccatgctctaaggtgaactcgccctccacacctctacactataaggtgaactcaccctccacacctccacactcttggctgtagaatttatgtagtaacgacagtaacatttcctcttctcttttttgagacggagtctcattctgctgcccaggctggagttcagtcacacaagctcagctcactgcaagctccactcaccagattcaagcgattctcctgcttcagcctccccagtagctgggattacaggtgcccaccaccacacctggctaatttttggtctttttagtagagatggggtttcaccatgttggccagtctggtctcaaactcctccccattcaccagcctcggcctcccacagtgctgggattacaggcgtgagccaccgcacccagccaatgtttcctttccatttaagtaaaaccaataagaaatcttatgaaagtcgccagtttaaaacaagcgaaaaccacaaacacttaaaacacagctgacaatctttctagcaggcactggtaacagcagtgttaatcagagtcacagcctcacatttacaaaggctgattttggagtcatttcaaagcctcagcttatcctccaaggcgaggaccctaaggcgaagaggtggatgatgtcatcacaccacccgtgaagcagagacagcccagaaccgcgcttctgcttgatgacagcctgctgggtaaaggcctgggttggaccagtgacaattctatacccacgtgttacctcagttcacccactaaaatgattatatacaaattacccacaacacaaactaaaacatatttcctcatcaaatggaacaaagaaagatttctttcaatgaagtgattttcagtcttttccctgccccctaactgctgactggtgggtgggccagttcacagtcaaagaaccaagacatgtgaggggggagggagggtcctcagggggttctggtcctggttccggtggctctggaggcccggcaacacctccgtgtctcacaggggtcagcattcctcggatcccacgtgcatgcaggacagcaaatttgctttttgctcaagcaaattaaaaatgagtttcttagccgggcgcggtggctcacgcctgtaatcccagcactttgggaagctgaggcaggtggatcacgaggtcaggagatcgagactatcctggctaacacggcgaaaccccgtctctactaaaaatacaaagacttagctgggcgtggtggcgggcgcctatagtcccagctacttgggaggctgaggcagaagaatggcgtgaaccctcgaagtggagcttgcagtaagctgaggtcgtgccactgcactccagtctgggcaacagagcgagactccgtctcaaaaaaagaaaaggtttctttcacttgcaaatgtgagttcaaactaacagcagatacttactgtcatgcctcccgaaagaaaaaccagaataaaagcaggggtgccagacaggaagccagaccacgggcacccgaccaacgcactgagacgcctttcatgcaaaggacccgtgagctccactgctgggagagggggaaccttgcatttcagataaaagttactgggttaggccgggcgcagtggctcacacctgtaatcccagcactttgggaggccgaggtggaaggataactcaaggccaggaattcaagaccagcccgggcaacagcaagactgtttatacaaaaagtttttaaaatgagccaggcaacagggcgcggtggctcacgcctgcaatcccagcactttgggaggccaaggtggggggatcaccagagattgggagttcaaaaccagcctgatcaacatggaaactccatctctactaaaaatacaaaattagctgggcgtggtggcacatgcctgtaatcccagctactcaggaggctgaggcagaagatcgcttgaacccgggaggcggaggttgccatgagccgagatcgcaccattgcactacagcctggacaacaacagcaaaactccgtctcaaaaaaaaaaaaatcagctaggcgtgctgacacgcatcgatagtcaccgctaccccagagaccaaggcaggaggatcacttaagcccaggagttcatggctgccgtgagctatgattacaccactgcacttcagcctgctcaatggagcaacaccctgactctaaaaacagtaataaaatgtttaaaatagaaaaaggggcggaggctgagattaacccagcgtcttgctcgagggcacattgctcctgagcagcagatctaagagcaggttccacggccgcgggtctcagaactcttgatcttgggcctctaagttgttatctgcctcacctgatgcttatgtagcaaggaccagcaaagccatcctaagcgcctgagtatcattttacaggaattagactgtgacttctgctagtaaattagcacatctgtagtctacagttttaaagcactgaacctcctggccaggaagaggcatgagaactgagtgaataactaagtcaccctttccctctgacacgtgaataacccagggggctaacataacactgtgctccgtaatccttagatctctacgggacgacttctgaattctagctattacaaattcagcaactgaccaatcaaaaaggcagaattcggccaggcacagtggctcactcctgtaatcccagcactttttggggctgaggtgggtggatcatttgagatcaggagttcgagaccagcctggccaacatggtgaaaccccgtctctactaaaaatacaaaaaatagctgggtgtggtggcaggtgcctgtagtcccagctactcgggaggctgaagcaggagaatcgcttgaacccaggaggcagaggttgcagtgagctgagatggtgccactgcactccagcctgggcgacagaacaggacaccgtctcaaaaaaaaaaaaaaaaaaaaaaaatggctgggcgcagtggctcacgcctgtaatctcagcactttgggatgccaaggtgggcggatcacctgaggttgggagttcgtggccagcctgaccaacatggagaaacctcatctctactaaaaatacaaaaaatagctgggcgtggtagcgcatgcctgtaatcccagctactcgggaggctgaggcagaagaattgcttgaacccgggaagtggaggttgcagtgaaacgagatctcgccattgcactccagcccgggcacccagagcaaaactccacgtcgaaaaaaaaaaaaggtagaattttaggcagggaacatgataaagacccatagatcccttcagggaaacactgctgctgccccacacgtttaatggagttctgtttagcaggaatgtgcctgatctaaaggtggcatcattcagttactaaaacatactttgggccgggcacagtggctcacacctgtaatcccagcactttgaggctgaggctgaggcgggcggatcacgaagtcaggagatcgagaccatcttggctaacacggtgaaaccccgtctctactaaaaatacaaaaaattagccgggcgcggtggcgggcgcctgtaatcccagctactcaggaggctggggcaagagaatggcatgaacccgggaggcggagcttgcagcgagccgagatcacgccactgcagtccagcctgggcgaaagagcgagactccgtctcaaaaaaaaaaaaaaaaaaaaacaactttgaattaagtgaaaagctcacagtggtctcaacgccacatcctccctcaacaccacgtcctccctcaacaccaggtcctcctgtgaccagcacacagaggaacctcacgacttacactggactttgtcctgctggtcaggtggcaccagtgggcccgggggcttcagtggggcctcggggagagacgaggggccactgtgggatctgtcctcctggaggccatcttgctcggccgacgcgccgtccatggtcaggacgacaccagctgagctgacgctgaggggctacaagtgaaccttggacaagcttggcttctgccatcagcaacagccaagagctcctgggaggggccctactgtgtctcccattttcaggagaagatctgatgactcacaaatgacttgatgtcaaaccagctaatatcatgatacctgacaggagagagagacaaaatgtattatgaaacttgtcagatttcaagtatcaattacaaaattagcatttggttcccaatttgcatacgtacaagaaacaaatacaaactttttcattcagcaaataatcctggagcacccacaacatcctaggttttgaggctaagatgctgacccagccacactgggccctttcctgaaggagcttaatgtctgtatcggtgccaactaaagaacattctgctgggacagcgcagctctgaatctgtggagtaggtgtcacacagggcaactgagctttaaattttatttaaaattaatttgggccaggcgcggtggctcacccctgtaatcccagcactttgggaggccgaggcaggcagatcacctgaggtcaggagttcaagaccagcctggccaacatggtgaaacccccacctctactaaaaatacaaaaaatagccgggtgtggtggtgaacacctgtaatcccagctactcgggaggctgaggcaggagagtcacttgaaaccgggaggcggaggttgcagtgagctgagatcgcaccactgcactgcagcctgggtgacagagggagaccccatctcaaaaacaatttaaaaattacaataccagactcacaggcccccctctcagctagtgagtgactctgcccaaggccacggctcctgccggcagccccaccccttcaggttggacaactcagatccagagaaacaaaactttaaaaagcaggtgccatgggatgtggtaactctatacagggtgtacaaggacaccagaaaggcagctgccttggagtgggggcacagaaagggcatctcacggcagggcccgttcccgtctttacctctagctgggttagctctctcagcctgccctgccgggctacattcaggggagcaaaactttgcccaacatttggcaagtgattatccaccctgaaatgtgctggtgatattattaactcatttccttatcaacaggtaagacactagcatgagcttccattcattctgcagaaatgttggcatttattcctttaaaatcagtttcatattaacctacattatgttctgtgtttaacatttttcatgagaaacattacacaaccttcgcctctagcttacaaatcccacacagaaggtatagacaagaagcccacatggggccgggtgcggtggctcatgcttgtaatcccagcactttgggaggccaaggcgggcggatcacctgcggtcaggagtttgagaccagcctggccaacatggtgaaaccccatctctactaaaaatacaaaaaactagccaggcgtggtggcaggcgcctgtaatcccagctacttgggagcctgaggcaggagaatcacttgaacctgggaggcggaggttgcactgaaccaagaccacgccattgcactccagcctgggcaacaagagtggaaactccgtctaaaaaaaaaaaagggctgcgtgtgatggctcatgcctgtaatcccataactttggggggtcaaggtgggtggatcacttgaggtcagaatttcaagaccagcctggccaacaaggtgaaacctcgtctctactaaaaatacaaaaattagccaggcatggcagcgcgtgcctgtaatcccagctactcaggaggctaaggcaggaacatcgcttgaacctgggagacagaggttgcgtgagccaaaattgtgccactgcactccagcctgggagacaagcacaaaactccatctcaaaaaacaaaaaacaacaaaaaaaagagaagcccacgtggctggtcctcgagagcatgtgtgtcactgaccccgcagcaggacgtgcctgtctttctaggggtttttactctacctgccatctagactggtcacccgtaaaagaggaaacctatgggtggtgggtgtaacccagtccactgacacagtcaatgactcactgaagggcgtgcagacctgtgagtatctgctcataactataataatccaccattcctctctgccaccttgcatcctacaggccagagacagttatgagttcataacagtgttgttcagaatattaaaaggttacgtatgctattagtgtaaaactagcattaagggtttgtaaccagaaagcactgtgaatagaaatgtgtcctaacattagtaactataaatctcgcatagctaatcaagaaactactgtaaacaaaggatcctagatgtcttgactcagggtgcctggcacataaaaatatttaaagattaaagcaatgtctgaagcacagaagtgaaggaagttaccaaggctggtcaaaagctaatcctgtgtgcaacgaattctcaatctcatgtttgcgtctatgatcatctagtaacatctctcatccctggattttccgggtgggtgggtgataaatgggccttagagcctaggcagggatctgaactacacacctgtccttacacacagcacagaaccctctgaaaatcactttccaggaaaaacactgcgatctccaccaagcctgcccctcagctacaatcccagacacactccaagagaactgggggtcagccggccacgcccacctgggaatggagaagacacccacaaaacaaggggaggagcatcagcaaaatgatggctgcttatcacaggcttgcccctttgacagatgaattacaaactggcacggaggactacacgcggtggaatgtggactcgactgcgccactgaatactggtaccctgtacatctggtcctcttgaaaatttcctagcaaaagaaaacttgcgttttgctttgtgatgtctttgcttctgccttgcgggggtggggtgattatatggaaccgaccgtgtgtgcctacgcgtgcagaccctcctggcccctcaggtaaaggaaccgacggtgtgtgcctgcgcgtgcagaccctcctggccccgcaggtaaagtgtctcgtctaccccctctgccatcactgtacctcacgtggcctccaccacagcacgtcatgtctgccattgcgtgtgtgcccattacatggcgagatccttgaagacagagactcattccccgtctgcctcccaccaccttgaacactcccaactcctaaagtgccaacacaggtttaatttgccgaattaaatcttcagttctgctgattctgctgagtacattcctctgctacaaagctaatggttccaaaacaaaatgattaagtatttgaatcctggagcatcaacactgccttttaaaatacagcaaagtctaaactagtccagctgaaacatctgtgagcttcagttccaatgagggagtccagggagttagaaactggaagagcaccttttttcagtggccgggaagatggcggacattcagactgagcgtgcctaccaaaagcagccgaccatctttcaaaacaagaagagggtcctgctgggagaaactggcaaggagaagctcctgcggtactacaagaacattggtctgggcttcaagacacccaaagaggctactgagggcacctacattgacaagaaatgccccttcactggtgatgtctccattcgagggcggatcctctctggcgtggtgaccaagatgaagacgcagaggaccactgtcatccgccgagactacctgcactacatccgcaagtacaaccacttcgagaagcaccacaagaacatgtctgtacacctgttcccctgcttcagggacgtccagatcggtgacatcgtcacagtgggcgagtgccggccttgccggcctctgagcaagacagtgcacctcaacgtgctccaggtcaccaaggctgccagcaccaagaagcagttccagaagttctgaggctggacatcagcccgctccccacaatgaaataaagttattttctcattctccaaaaaaaaaaaaaaaaaagaaactggaagagcagcatcacggccacggcccagacaggcaccaccacctgaacagaaggaaggatgggatgaccagcaggactggactcagccattacaggtggaacatgcagaggagaactgctgcagaggagaactgctgcagaggcccacagtgacgacgcctgggccttacactgaccaagaaggaacacagccaaagacgctcaggttccaccgagagggcacgccaacatggtgacagccaaccgcaccgagctgagtccagtgcaatcacagattctgctcacttaattcccctgctggtgtccaagcagcccacctctccagaacagagaccccatgacggtgactgtaagtcacaaagacggcccctctttacaggcagctcctcctgaagccggaccagagagagaattcactaactgcctggagtttggtgacagtgatacttctccctgtagggcaataagctggcagtctcggtcgattcccagtcttgcttgatttttagttaaaatttggaatgactcagtcgtcagggcctcattacctcagactactgacaaaaagcgatctccgggcagcgaggaggaggagcaactgccagtgcatcacagaaagctggtactacaaacatggctctattttaaataaagaggccagtctaatcagtctcacttatgatcactcgcactcctgcgtctctagagagaagagacaggacaaagctgtcacttagaactgcgaaaggtacacacaaccctaggttcacagctgggtaacatcaagggacttcatactgagaaaccaccacctcaggcacctacaggactttctgcttcccccacacctgaattctgtatacaaacattcacggctccatctacaccacctcgtttcacctgttcctatcgggtattagaaacaacagagcacagccaaaaaccaaacacgatttcctcaggaaaagagtacctggtggaggccacactagtatccaaaagtaaacacagatctatacacaaagtgaaaaccaaaagcaagcaagcctcatgtcactgcagagacgtgaagggcaggcttggaagtcaggactccggcctcagctcccgaccctccaccacttacctgtgagagcctgggctaaagatttcttaatcacatttagcctgtttcctcaccagtaaaacaatgagaaaatgaacgcaaaattttgccaggattaaatataacaaggcacagagtctgtcccgtgtcctcaataaaatgacagtaattatcacgattttccctttagttgttgcttgtcaaaatcgctaaaagccaactgaaggcattctcacttgggaaagtatgctacttcttaaggcaatcgggggaaaaaaagctcctcttcaatctgagtgatgtcagatgatttatttccttcttgccatttaaggtatactgcctgaaaagatattaaagggttataaagcgctatgttgatgtcgtttaaaagacagttcaaaataatccacgacgacgggtgtggctgctcacacctgtaacaccagcactttgggaggctggggtgggaggatcgcttgaggccaggagttccacaccagcctgggcaatacagcaacacacccagtctcttaaaaaaaaaaaaaaaatccatgagtcatctgtaaatggcttacactggcccagtgacaataaactccaacctcttaagaatccagcacctgcctacaccaacatccttaccgccatcgctttccccctttgccattacactgtggccacatcctccgccctcagggtcttcaaactttctgcctgaggcgcgcttttctcacaattttgcctggcttgcttctcgtcatagaggccttagcacggaagtcgcccgccccccaggctcccacttagagtagcggaccccacccaaccaccgcccggtaccctctcgctggcgaccctgggtgtccctgtcctaggtgggctccgcgggggcagtgacccagacccacaatacccaggacccgccacacgactgacattcgtcgggttcatacccgtgacaacgcccggccccactcgctctggccacctggaatgaagacaagtcggccagcgacaaagacaaacaaggaagtacacggactcctgaaaccccgacttcccacgaaccacccgacaccatgtcacgcctttcagctgcaaagggccaggctaaagcaagcactgcccgagtggtggcagtggacagcttcgggacaggccgcgctcgtcgggcgcagacaagcattcaggagggctcgcgggcaccggcatttacagagccagctccgccgcagctgaaggcgggcgcccaggcccgaggccaccgcagcgaggcgggggtgactggaacggggccgtcccgccacgctgcagggacgcgcccaggccccgccgccgcccctcgagcctcccccgcccatgcactgcgggagcgggagcgggagcgggagcccgagccccgaggcgccgcggcctccgagcccctcaccctgctgctctggcagccccggaggccgcccggcccggatgctccggcggagacgtggccgtgagaggggcggggcgagcggtgcatcggcctcgggtccccggaaacagcctgcacgcgctactttcgttccggaacagagaacgtcctcctcttcttcaagtggccaccctagggccggggaccctctgcccacagggtccggatcgagctcacctccgactgtgatgaggccgccttcagaaagtgaccttaagagtttgcggacctttccctagtagaaacgcaacttccggaactgcaggaccaactctttcaggaagctgaaccgagcttccggcggaagtggcgtggccggggctcggcatgggcgcggccgagctcggtgtgggcgtgacttccccgcccgccctagtcgggtccccgccccaaccccgcacctccacccggccggcgcccttcgcgcttcaggtgccagatcaaaggcgacgctgctttggaccctatttgcttcccctttaaaaagggcaaagctggacggcgcgggccgctggccgctggggaacggctttccaccttccctcatccgccaggccgctcttccagctgtcaggaaggaaatggcctggagggcgcctcggggtcctctgtgatgttgcgctcatctctgcggattttggaatacgcttcagtctacgaagttttctgggattttgatgggaactgctgcagatcgtttggggagcacgggcatcgctgactcggtccttcatctgcgtccctggtggcccctccatttatttcggtcttttgatttcttccaccagcattttgtaatttcagcatacagattctgcaccttttaagtttatagtatttcacatcaaacaactgtaacactgcgtttttgacgttttccacgtgttcactgttggtctacacaaatgtgatgaattctatgttgattttcttatcctgagacctcgctgaactcattagtttgagggttcatttggtgttttgcggttgttgttgtaaaatccttgtattttttacatgggccatcatgttatctgcaaatgcaaattctaacacaaaatgatcagactgaggcgtaaaatatacaacttttagaagaaaacagaatttctcacatctagagcttggggaagagttcttagatctgaccaaaaaaacacaattcacaaaagaagttgatagagtaaacttcatgaaaaaattagaaacttttcaccggatgcggtggctcacgcctgtaatcccaacactttgggaggccaaggtgggcggattacctgaggtcaggagtttgagaccagccaggccaaatggtgaaacccatctctactaaaaatataataattagccgggcatggtggcatgtgcctgtaatcccagctactcaggaggctggaggagaatcgcttgaatccaggaggcggagaggttgcagtgagcggagatcgtgccaccagcctgggcaacagagcaagactccgtctcaaaaaaaaaaaaaaaagccgggcacagtgtctcacgcctgtaattccagcaccttgagaggccgaggcaggtggatcacaaggtcaagagatcaagactatcctggccaacatggtgaaccctgtctctatgaaaaatacaaaaaaattagctgggcgtggtggtgtgtgcctgtagtcccaactactcgggaggctgaggcagggggatcacttgaacctgggaggcagaggttgcagtgagctgagatcgtgccactgcactccagcctgggcgacagagcgagactccatctcaaaacaaacaaaccaaccttgtgagaaagaccacattaagaggatgaaaagatgagttacagactgtgagaaaatattttcaaaccacgtttgttgaaggactagtagctagaatatataaagaactctcaaaacttgacagtaaaaaaaaatacaattattctgggcacaatggctcatgcctgtaatctcagcactttgggaggctaagggggcaaatcacttgaggccaggagtttgagaccagcctggccaacatggagaaaccctgtctctactaaaaatacaaaaattagccaggcgtggtgacgcacacctgtaatgccagctatttgggtggctgaggcacaagaattgcttgaatctgggaggcggaggttgcagtgagctgagattgtgtcactgcactccaacctgggtgacaaaatgagactccatctcaaaaaaaaaaaaaccatacacacacacaaacagaagacaagcaaaaaacatgaaaacacatttcactaaaaggatatatgagtggcaaataagcttgtgaccaggttcagcatcactagccattacagaaatgcacattaagactatcttgaggtcaggcgcggtggctcaagcctgtaattccagcactttgagaggccgaagcaggtggatcacctgaggtcaggagttcgagaccagcctgactaacatggtgaaatcctgcttctactaaaaatacaaaaattagctgggcatggtggcaggtacctgtaataccaactacttgggaggctgaggcaggagaatcgcttgaacctgggaggtggaggctgcagtgagctgggatcacaccattgcactccagcctgggtgacacagtcagactctgtctcaaaaaaaaaaaaaaaaaaagactgccttgggatattagtatacacctattagaacagctgaaataatatacagcagtggcaatatgaaatgctgggaataatgtattctggagtaactaatctcttatacattgctgatgggaacagcaatagtgcacccactctggaatatagttgggcagtttcttcaaaaagtaaacaattttatgacccagcaactgcattcctagacattgaactcagagaaataaacttatgtctacacaaaagcctgtacattactgaccccaaactggaaacaaccaaaatgtcctctgacatggtgaaacaaaccatggaccccccacgccactctgacatggtgaaacaaaccgtggaccacccacgccactctgacgtggcaaaacaaactgtggaccacccacgccactctgacgtggtgaaacaaaccatggaccacccatgccactctgacgtggtgaaacaaaccgtggaccacccatgccatggacactactcagcaataaaaaggagctgaccactgatgtgtgcaataacttggacgaagctccaaggcattacatccagggaggaaaacatctccgaaggtctacactgcatgaactgtacgatgtgtccacttatgtcacaaaatgacagcattatagagtggtggtggggttcggatgactaaaaaggggtagatggagagagatttttgtggtgatggaactgttctgtattttgtgaccgtggttacgtgaatgtcctcatgtgataaaatgacagaatgaagaaaacactccaccaagctcagtttcctgattttcatattgcactatcctaaggtgtagccaatgggagaaatagggaaaacatttaattagcataagatctagtattccatagcacaggagggtgaatatagttaataataatgtattgtatatttttaaataacaaaaagagtggaactggaatgttcctaacaaagaaatgatacaggcttgaggtgatggataccccagttactgggagttgatcattatacattgtatgtctgtattaaaatatcaaggtactccataaatatatacaccttttatgtacccacagtaatttaaaattttaaaaatttagcaagcaaaatgtgacaaacattaaatttaaatacagttagaaacaatgaatctaatcatatactaagttgatggcacagtgtgggaaaaatgctaatctaagtaaaattcttaacagctttaatacaatttctatgcaataaaatatacccgtgttgtgtgtgcagttcagcgactgtagtaaatgtgcagagctgtgcacccatcactccaacccagtttccggatacttccgttacctcagaaggatccttcttgcattcactccctatcccctccacccagcccgacaaccactcagtcaccttctgtctttatgaatgtgcctcttctggacatttcatagaaatgggatcatatcgtatgtggccttctgtgacgccttttcacttgcatggtgtgtttaaggtccatccacactcagcacgtttcctcgctgcacgatactccagtgtctggatacacccattttgtctgtccatgcatcagctgatggacccactgaggtgccttacgcgagcccagcactattctgcgtgcggggggtccctgctttggtccagtttcatgtttgtgtgtggataccttcagagggcggtaactgatgaaaagaaaataaaactgggtgaagcgttcgagcgagaggggctaccatctgcatggggccgtcattcatatttatcgtagcctactgtctgcaagtactattctaggcactgtcccaaatccctgctcttacagaaggtatattctagtggggaccagacaacaagcatagaaggtgacagaaagagtcaagaaaaggcagaggcaaccctggggaggctcgctgctatttcaggccgatggttgagggaggacttctcaggagaatgtgagccaacaagtaagaaacggagttgctgggcgtggcggcttacgcctggaatcccagcactgtgggaggtagaggcgggcagatcgcttgaactcaggagttcaagaccagcctgggcaacatggtgaaaccctgctctctactaaaaattagctgggtgtggtggtgtgcacctgtagtcccagctactcaggaggctgaggtgggaggatcatctgagcccaggaggtggaggctgcagtgagctgacattgcgccactgccctccagccctgacaacagagcaagacactgtctcaaaaacaaaaaaagaaaaggaaaagaaaaaaaaggaatcatgcaggtactggtgggaacagtgtcccaggagagggaaaggcaaggagaacgagtactcaaaggcacctttgaggaagtaatatttgagctgaacgtgcgtgacaaggaggaccaatgcacgcacagatctgggagaagagcagtgaggtgagggggcaacaatcagagccacaagaagcccctgaagagaagcctggggcactgaggacagccagcaggatgactcctggggttgggcctgagctacagggaggccatgccatcttctgacagtggagagggcaggtctgccgggcgtacgtggtgggcctggggtccccactggaaacagctctctttgacaacatgaatctgggatgtttgaacaccaagtggagccatcaggtcagcagttagagctgagtgtctgccacagagacctagagctacagggtgaaggaacgtgctggggagcaggggagagggtgaagcggatgttgggtgctcagccatgccccacactccacctccaaccacagcacctctgagacagactggacccttcctgaaaacaaaaaccaaacgggatgagtgtgtggggggtagtgagcttcctgtggctgctctaagaagttaccaccaactttgctgcttaaactagatttattctcttgcagttctggagctcggaagtccaaaatgaaggggcaggcagggctggttccttctggtggccctgcagggagatctgttttcttttctgcttcgacagcctgccctcctctcctggctggaggcccttgctccctctgcaaagcacatccctcccacctcttctctgtcaccaagcctcctcttcctgcctttgacttcttgcttgctttttttttttttttttttttgagatagagtctcgctctgtcgcccaggcgggagtgcagtggtgcgatctcggttcactgcaagctccgcctcccgggttcaagccattctcctgcctcagcctcccgagtagctgggactacaggcacccaccaccacgcccggctaattttttggtattttttagtagagacggggtttcaccatgttagccaggatggtctcgatctcctgacctcgtgatccgcccgcctcagcctcccaaagtgctgggagtacaggcgtgagccaccacgcccggcctcttgcttccctcttacaacgactcctactgttgcacagagggcccacaagctaatccaggatcctcccctcatctcaaggtccttaattccaccatatctgcaaagccccttttacggtgcaaggcaacatcatcacaggctcaagtgatcggatacgggtatctgtggtggcgggacggggacatggctcagcccaccacggagtgtcaatggtatccagcatgtggggtttgccaaacaacaacaaacaaaaccacccaatttttataaaaccccgtggcgtgcgagctttgatggcagagtgttacaatatgttcaagccctaaatcccaggacctcagaggtgactgtatctgcagacatggaacacgtcatgaatttgggtgtcatgcctgcacgtgggccatgctaatcttctctatatcgttccagttttagtaggtgtggtctttaaagaggtgattaagataaaatgaggccactggtgtgggccctaatccaataggactggtgtcctcgcaggaagagattagggcacaaacacgcatgaagagaagatgacgtgagaactcaaggagatgctgcccacgagccaaggagacagaccaaagaggaaccggccccgctgacaccctgatctcagagttccaggccccagaactgtgagaaaatactttctgttgtttaagccgcctgttctgcggcgttttgatccagcggcccaagtggacccacattcaaggccagcactgggcagggcgggtctcacaaatgcatgctcccagcacagcgcacggccctcacagtgccaggctcccagcacagcgcacggccctcacagtgataggctcccagcacggcgcacggcactcacagtgccaggctcccagcacggcgcacggcactcacagtgacaggctcccagcacggcgcacggcactcacagtgacaggctcccagcacggcgcacggcactcagagtgccaggctcccagcacggcgcacggcactcacagtgccaggctcccagcacggcgcacggcactcacagtgccaggctcccagcacggcgcacggcactcacagtgccaggctcccagcacggcgcacggcactcacagtgacaggctcccagcacggcgcacggcactcacagtgacaggctcccagcacggcgcacggcactcacagtgccaggctcccagcacggcgcacggccctcacagtgccaggctcccagcacggcgcacggcactcacagtgccaggctcccagcacggcgcacggccctcacagtgacaggctcccagcacggcgcacggccctcacagtgacaggctcccagcacggcgcacggccctcacagtgacaggctcccagcacggcgctcggccctcacagtgacaggctcccagcacggcgcacggcactcacagtgacaggctcccagcagggcgcacggcactcacagtgacaggctcccagcacggcgcacggcactcacagtgacaggctcccagcacggcgcacggcactcacagtgacaggctcccagcacggcgcacggcactcactcctggtctgactggccttcaacattctctcctgagtccattccttccacagacatgcacgaccaagtgtctgctctgtgtgaggaactttaagaccccaccatctagactcaccgcctcagaaggagacaaccgtgaaaagtgagcgacagaggaaggggcgcctgtttgtgccgcgggaaagatttcaagcccaggggacggctcatcagctcatcagaccttcaccgttcagtagccaactggtcagtgatcagtagatgctgccctggggccaaacatttcagacaaataaacaacagtgggcagacaggcaagatccctgctctatttttttgagagggggagacaaacggtaaacagatgtttcctttccgatagtgacaggtgctggggggaaactagactggctggcggggtgggggcagccctgcaggagctgaatgaggagaggctgcagagggaggggctggtacctgaggggctgtttgtgagaattagctggttcggtggagaagcagaggaacacctgaggggctccaggagaagcaggtagggagaagaggttttctgaggggtggaggcaggggtcatacatgctgggccttcaagggccatgatatggttatcattactatgtaataaaccaccccaaatgcagtggcttaaacaactacttatttctcatgattatatgctggctgcctggtgcagcactgtgctggtgtttaacaaccttctcttcagaagaaaacaaaagcaaaattaaaaaccaccctgatttgaagcatttaccaatttccacagtgcaaacactcctcccagggcccattccaaccaggccaactgagctgagtgggtaaggctggaaggggtgccatcccacacaggccacagaagcacacaccctcgggcctgcaggtaacaggcaggtgcggtaaactaactagaaagtagtgcgtcctgagcactcatcacctttgttttcagtgtaactcaattctaagtgtagaggatgcttgaataatggctgtctaccagttaccagcactaggcgtttctggaggtggctcccccgaagatcacccggctccgtcctgctgctggtcagcgcgcggatctgcagggctaggctgtgctctgcatgcggccctccgtcctcagggaggcaagacccggcttctctacacggctgcagccgccctcagaaggcgcaggagctagcgtgcatgccaaaacggagcccacgtggaggcagagggcgggcacggccgcggggacagcgttctggtttccccatcaagccaggctggagggacgatctactttcctaaatcccctccgttctcatgctttccttcccttcccagtgcagggctcccggcaacctagcggccctggcagtgactctggggcctcttcagggagccggctgcagctgcctcagggccagcattgctccactctcccagcctgccagcccgaagctggggggctgtcaccaggaaacccttgctggcggaagccccttccaaactcagctgcctctctgccttggccacacccctggggtgaaggccgtgtggtgctgggagcagcccctggaccccggctctcacacctgggcccgaccactcccatcctgctggccctgaggtcattaagatgacttaaagcagatttaaaacagcctttgtagctggcctagggaggagggttggcctgaatccctcagtctgttttaagccaatctgcccagacttcctggctgcagtcagaagctatgacagaggccatcccagagaggcctcactggggtggacgggttcacctagaacctgaggcccccttccctggcttggagcctgggcagcacacggaggggtgggcagggctgacccccgcttctgaggggcaccagggagcacagagggagccgcagatgaggagtgcgtggggagacggtctgtggggccagcgggcagctgcagccctgccctgggtttgtcccaaggctgggccaaggagccaggaagaagcagtgggatctgcagcagcaccaggctgtcctccagaaagcctgtggacgacccacgcagccaccccacaa

SEQ ID NO: 435 - DNA, 44560 bp, Homo sapiens
gctgggattacagacataagctaccgtgcccggcctccagagcatctttattctcagtttcagcgggaagaagggggaaggttggtaaaaagagaggcacaaagtttaaaaaggacattgcgtgaagaaactaaaggtttctccttctccacactattgacatttgggatcggatcactactcgttgggaaacgtcctgtacatttccagggtgttcggcaccatccctagcctctaccccctagataccagctcacatcctcacagttaacagtgatcaaaaatgtctctgggcagtagaaaatatttcctgaaatgcaaagttttcttaggttgagaaccattgtaatctagccccatctttagagaagaaattgagtaacggatctacatccattgaggaactatcgacaccccaggggcccatgaaatgtaaactcgcactcacaattaaccatctttctccaacgtgtgtatttcatgtagccacactctcagatgcccacccccatgacctacaagtcctaaacagggaaacctgtggcacatgggttcatgtgtgtctgaatctatacgttcagagatgaacaagtactgctctccctatacctgtgaccactcgcctccgcccatcactgaattctgaaaatgtggcctcaggctcacagcagcattagcacttgcttgctctggatctcatcacattgatgatcaagaacaaagtattcactgggttctctgctaaggatacaaaaaaaaccattccacaattccacggccatgtttgcacccaggaaccacgagggctgggttagcccagatggtgggcttgggaaatgttcctggagcaaaaaaaagagccagaagtcatgagagcctgaccccctcccccaacgcgcacacacacacaccactctctacctccaagcctcattttcaggcttctcaaagctaaggtcactcccatgagctaagccgcgcttttctcaatcctcagctcttccacaagaataggaagaactctctcctgttcaagatcctgtggctcagctgcagctctggaagaaagaccccggtgagggtcttgcttttcacaatccccaatcccagaccacatcctgtgccccaaaacaacttccatggtaaccacatccttcaggaagtgaagtcaggcaggaagtcaagtcagaagacggaatgggctgggcatggtggatcgcacctgtaatcccagcactttgggaggcagaggcaggtggatcacatgaggtcaggagtttgagaccagcctggccaacatggtgaaaccctgtctctactaaaaataccaaaagtagccaggcttggtggtgcatgcctgtaatcccagctactctggaggctgaggcaggagaatcgcttaaacccggaaggcggaggttgcaatgagccgagatcgcaccattgcactccagcccgggggacagaaaaaaaaatgtagctgagcatggtagtgcacgtctgtgatctcagctacttgggagtctgaggcaggagaatcacttgaacccaggcggtggaggttgcagtgagccaagattgtaatagtccaatgtgttcaccttgcccactgcctagacagagctgattcgtcaagacagggaatcgcaatagagaataattcatgcagagctggctctacgagagaccagagttttattattattcaaatcagtgtctcccagcattcaggaagcgtttttaaggataacttggtgggtgggtgggaagccagtgagccaggagtgctgtttggtcagggatgaaatcgtgggagccaaagctatcttcttgcactcagttcctgagtggaggccaaaagataagatgggccagtttattgatatgggtggtgccagctgatccatcaagtacagggtctgcaagttaaacgctgatcttagaagcagtttagggagggtcacaatcttgtagcctccagctgcatgactcctaagtcataatttctaatctcgtggctaatgttcgtcctacagggccaatctagtccccaggcaacaaagaggtgtgctttggaaaagggctatcatctttgtttaaactataagtttctcccaaagttcagcctatgcccaggaatgaaaaaggacagcttggaggttagaagcaaaatggagtcagttaaatctctttcactgtctcagtcataattttggaaaggtggtttcaagctggcacaactgcactccaccctaggagacagagcgagaccctgtcaaaaaaaaaaaaaaaaaacaagaagtgaagtcaagataggaggtaaattcggaagacaggaagtggtggtagaagacaagaagtgaagtcatacaggaagtaaagtcagaagacaggaagtgaagtaagaagacaggaagtggttgtagaagacaggaagtgaggtcatacaggaagtaaaatcagaagacaggaagtgacgtcaaaccaggatttgcagtcggaggcaggcaagaagtgaaatcagaagacgggaagtggctgaggggaacgtcttttctctctcctgctcagcccgaagtgaacaggtagcatcaggtgtgccatttcagtgactgggcacagcccaggcacccacatctctctgcagcgcctattcttggaacaccagagacctctacactattttctgttgcttttttccttcattttcagagatgagatcctggattgaatgactactatggaaagtgattgaccaaggtaagtcacaactatcttgttctttaattttggtgttgtttgttatgacttgttagccgtctagcactcatagctttgcatttccactctgcattacttgtatttttattattttgtgatattcgtaataatttattataaaactgtgttatttttggatatttttaagttaaaatgcgattttttaactaagtggcagtatgcaaagcaagtggttcagaactctcccccattaataagtcttctctcctgaaagaaacaattttgagacttcctgttcttaattctgtttaacagcatacttctaaaagaaaaagtgtatactgttattatttattgtgttacaaaaatatacacgcacctttcatgcacgtccgtgtgaagagaccaccaaacaggctttgtgtgagcaataaagcttttaatcacctgggtgcaggtgggctgagtctgacaagagagtcagcgaagggggataggggtggggccgttttataggatgtgggtaggtaaaggaaaattacagtcaaaggggggttgttctctggcgggcagagtcggggtcataaggtgctcagtaggggagcttttgagccaggatgagccaggagaaggaatttcacaagacaatgtcatcagttaaggcaggaacaggccattttcgcttcttttgtggtggaatgtcatcagttaaggcacgaaccggccatctggatgtgtacgtgcaggtcacaggggatatgatggcttagcttgggctcagaggcctgacattcctgtcttcttatattaataagaaaaataaaatgaaataggggtaaagtgttgggacagcaaaaatttttgggggtggtatggagagataatgggtgatgtttctcaaggctgctttgagcaggattaggggcggcgtgggaacctaaagtgggagcgattaagctgaaggaagattttgtggtaaggggtgacattgtgggattgttaaaagaaacatttgtcatttagaattattggtgatggcctggatacagttttgtatgaattgaaaaactaaagggaataaggaaaggagaaaaacaggtattaaaggtctaagaattgggacgactcaggacatctaattagaaagtgcctaaggaggttcagcatagccttgccagcaaagattatttatttattttaagagttaacagtggcggtatggggatagtaccaggagataccagctgtgctggcttggagaaacagtgtaaactggcagtgtaaacaagagcagggcatgtgtgagtagttgagaacggtgaataggagtatgactagacagaagatagtagggatgacaagttttttggggcacaatctaagttggtctggtgtctggaatgagactggggcctaataaaaaggagtgtctacacaggagcttaaatgggctgtatcttgtagcattccaaggacaggcctgaattctggaagcgaaaatggtaaaagtattgtccagtcctttttaagttggtggctgagcttggtgaggtgtgtttttaatagaccattagtctgtcactgaatactaagagcctgaaaaaatgcttggctgatttgactaataaaggctggtctgttagcagactgtatagaggtgggaaggctgaactgaggaattttgtctgacagaagggaatgacaaggctaaactgaagaattatgtctgacagaagggaagaaatgactgcggtggccttctcagaccctgtaggaaaggactgtacttacccagtgaaagtgtctacctagactaagaggtattttagttatcttactcggggcatgttgagtaaagctaatttgccagtcctgggcgggggcaaatccttgagcttgatgtgtagggaagggagggggcctgaataatccatgaggagtagtagaatagctgatgcaacactgagaagtgatttctttgaggatagatttccacaatggaaaggaaatgagaggttctaagaggctggctagtggcttgtaccatagcatagcctgcctttgctggtgtgtggcgattaggcctggtggaaccgccatcaataaactaagtgtgatcagggtgagaaacagggaagaaggaaatgtggggaaatggggtgaacgtcaggtggatcagagagatgcagtcatgggggtcaggtgtggtatctggaataatgtgggaggccagattgaagtccgggccaggaacaatggtaattgtgggacttaacaaagagtgagtacagctgaaggagccagggagcagaaagtatatgcatcaggtgtgagtaagaaaatagattttggaaattatgagagctgtagagagtgagttgagcatagtttgtgattttgagggcctctaaaagtattaaagcagcggcagccacagcacgcagatatgagggctaggctaaaacagtaaggtcaagttgtttggacagaaaggctacagggtgtggtcctggctcttgtgtaagagttctgaccgcgctaaccatgcctaggaaggaaaggagttgttgttttgtagaaggtgctggggcttgagagatcagtcagacacgatcagcagggagagcacgtgtgtttttatgagaattatgccgagataggtaacagatgaggatgaactttgggcttgactgaagtaatgggggctgtctgtgaaaccttgcagcagtacagcccaggtaatttgctgagcctaatgggtgtcagggtcagtccaagtgaaagcgaagagaggctgggacgaggggtgcaggggaatagtgaaaaaagcatctttaagatcaagcatggaatagtgagttgtggaggaaggtattgaggacaaaagagtgtaggggttgggcaccacagggtgcataggcaaaacaatttgataaggcgcagatcctgaactaatctgtaagacttttccggtttttggacaggtaaaatgggggaattgtaaggagagtttataggttttagaagcccatgctatagcaggcgagtgataacaggctttaatccttttaaagtgtgctgtgggatgggatattggcattgagcagggtaagggtgattaggttttaatgggatggtaacgggtatgtgatcagttgccagggaaggagtagagatgtcccatacttgtgggttaaggtgggggaataggagaggaagacgcgaaggaggctttgggttgaggagaagggtggcaatgagatgcggctgtagtccaggaatagtcagggaagcagataatttggttaaaatatctcggcctaataagggaactgggcaggtggggataactaaaaaagagtgcataaaagagtgttgtccaagttggcaccagagtgggggagttttcaggggtttagaagcctggccgtcaatacccacaacagttatggaggcaagagaaacaggcccttgaaaagaaggtaatgtggagtgggtagcctccgtattgactaaggcgacggacttaccttccaccgtgagtgttacccgaagctcggcatccgtgatggtctacagagcttccgaggcgattgggcagcatcagtcttcagccgctaagccgagaaggagtcagagagccttgggccagagttccaggggctctgggagtggctgccaggtgagttgaacagtccgatttccagtggggtcccgcacagatgggacacggcttaggaggaatcctgggctgcaggcattccttggcctggtggtcagatttctggcacttgtagcaagctcctgggggaggaggttctggaggaacgcctggccgctgcggttcagttcccttcttgtgtgctggagatgtggctggggtttgtctcacagtggaggcaaggaattgcaacttttttctattattgtacaccttgaaggcgaggttaattaaatcctgttgtggggtttgagggccggaatttaatttttggagttttatttaatgtcgggagcagattgggtaataaaatgtgtattaagaataagacggccttttgacttttaagggtctagggctgtaaagcttctcagggttgctggcgaacgagccatgaattgggctggatttttatatttgatgaaaaagagcctaaacactatctgatttgggataaagaaaaaggagcattaaccttgactatgcctttagctccagccacctttctaagagtaaattgctgggcaggtggaagagggctagtcactgaacgaaactgtaagctggaccaggtgtggggaggggaggtgataaaaagataatacggtggaggagcggaggctgaggaagaattgggacctagctcagcctggggaggagggagaggtcagacgggtctgtagaaaaggaagattagaaagactcagcgacgcttggggttgagactgaggggacaggcaggagggaaagaaggaagatttgggacgagttgcactgggcacagagactaggaagggactgatgtgtaaaagaatgcctggacgtcaggcacctcagaccgtttgcccattttacgacaagaattatttagatcttgcaggatggaaaaattgaaagtgctgttttctggctatttggaactgctgtccagtttgtattggggtcaagcggcattgcagaagaaaataaggcatttaggttttaggtcaggtgtgagttgaagaggttttaagtttttgagaacacaggccaagggagagaaggaggaggaatggagggtggaaggttgcccatagtgaaggaggcaagcctagagaaaagagagagtagagacacggagggaaggggttcgggagttcttaccttccagaaaagcgggaaaggggttggggcatggatataaggggttggggcacagagataagaggttggggcatggaaataagggatcagggtgcagagatacgaggttggggtacttgcccctctagaaaagcgggacttgccgctaagagtgaaggagaaggggttgggggtttcttgccccccagaaaggtggagaaggggtagagacatggagaggaggggttggggaacttgccccttccccagaaaagtgggacttgccactaagggtgaaggaccaaggcaggcatccctgcgtgatctgacacctctgaagcgtgggtatataatcagagaggcgtccctgcaatgattaaacgccaagggaaggctgccttccctagtccgtgaccggcgccggagttttgggtccacagataaaacgtgtctcctttgtctctaccagaaaatgaaaggaattgaaattaagagaagggagagattgaagagtggaaaggagaaagtggttgagggacagtgagagaggttggagaagagagtaagaagaggtcgcttacccaatttaaacttggtgagatgttccttgggctggtgggtctgaggacctgaggtcgtaggtggatctttttcacagagcaaagagcaagacaggggattgatctcccaagggaggtcccccgatccaagtcacggcaccaaatttcatgtgcgtccatgtgaagagaccaccaaacaggctttgtgtgagcaataaagcttttaatcacctgggtgcaggtgggctgagtccgacaagagagtcagcgaagggggatggggtggggccgttttataggatttgggtaggtaaaggaaaattacagtcaaagcggggttgttctctggcgggcagagtgggggtcacaaggtgctctgtaggggagcttttgagccaggatgagccaggagaaggaatttcacaagacaatgtcatcagttaaggcagtaacaggccattttcacttcttttgtggtggaatgtcatcagttaaggcaggaaccagccatatggatgtgtacgtgcaggtcacaggggatatgatggcttagcttgggctcagaggcctgacagcacctacctaaaaaattccaatagcactaaaagggtgtgtacaaaatgcagtggctgactaaccatctcctccattgctccgcctaagagacacccacttttagctgttttctttaggaacttgttaatattaggtttctaaaaacatgtaaccatgtgaatgagcttagacttactggattcctatcataataggcggggccttagttattctacagcgttgttcttactgttttttctcttccaatgtttatctctatgtctgcatatcaacattcagtatcacattttttttttttgagacagagtctcactctgtcacccaggctggagtgcagtggcgcaatctcagctcactgcagcctcagtctcctgagtagctgggactacaggcgtgtgccaccacgactggctaatttttgtatttttagtagagacagggtttcaccatgttggctgagctggtctcgatctcctgacctcgtgatctgcccacctcagcctcccgaagtgctgggattacaggcatgagccaccacgcccggccagtatcacatgtttatacccacagatattcgcagccgagaattttcgggtaatataacttgcttcttttatttttgttgttgttattgttcccctaaagtttatatttgttttttatttttattttcttttgaggcagggtctcactctgtcacccaggtttgacagcagtggtgcaatcatggctcactgcagcctcaacctccccgggctcaggtgatccccaacctcagcctcctgagtacctgagagtaggcatgtggtaccacacccagctaattttttatattttttgtatatgagacaaggtttcaccatgttgcccaggctggtctcgaactcttaggctcaagcgatcccgcctcagcctcccaaagtgctgggattacaggtgtgagccactgtgcctaggctatactggtctttttaaaatctacttagtttacttgacctctaaaattatttttcctctgtcttctgatagcatctcagtatgattttccactatgttaagacgaggaattgacccattcttacatttggaggcttctctaagcaactttcccattcccccttcacccaagctgtgtgctcactagccctgattcacagccgtcgtcctggaacttcttggtgccatccttctgtcttttcccaagtgactcacctacctcaacctcccaaagtgccgggattacaggcgtgagccactgtggccagccattcttttccttttttaaaacaatttttatcttctttattttaagtagagatggggtctcactatgttgcccaggctggtcttgaactcctgggctcaagcgatcctcctgccttggcctcccacagtgctaggattacagacatgatccactgcacttggcccagtggtacagttttacactcattagatggtcaagaaatgcctaaacgctataataaatatagaactttaccttgagaagacctaacatttccttcagaaagtaaatatgagaggggtggagacggtgcattatcttatttttatgattttaaaaatgtatacagaattgtacatatttatggggtggacagcaatattgcagtacatgtatacaacgtgctatgatcaaatcagggtaattgacatattcatccctgtattttttgagacaaagtcaggcttcgtcacccgagctagagtgcagtggtgtgatctcagctcactgcaacctctgcctcccaggctcaagccattctcccacctcagccccctgagttgctgggagtatagggatgcaccaccacacctggctaatttttgtgtttttttgttttgttggtagagatgaggtttcaccatgttgcacaggctgatcttgttttctaatgtgaagggaagcgggcaacgtgctagttttacactaaggaaaatgaatgacatacccaaactgcctgcaagacccgttctgagagacgaaaggagatttgttagaccgcagtgggagatggagtgagggtgagagtttctggggaaaaccagacaagagcacagagggccaaagggaagcacgggaggattttgcacagaggatggaacagagtcaaccctgagagctgggaaccttagagatccgtctggagcccatattagagaggttgaagaaagaggccagtatgtggtccagccagggtaccatgtcatccacagtgtgcagggaggaggatggggtctccacagattccttccatcccaaatggagggtgccctcagacagagaggcagacagacagacagacactggccgaacggctccctgatggaacaccaggaggaggcagcatggcctcgtttccacagctgtagcctctgccctcctgcttccacgctccacacacgccagtctttgagtcgcctcccatgccatgatccctcccttggatacgaccgtgcctggggttcagcggtcatgaacataacccgcggctgtgaacatcctgtcggcctccatcctgacccccgtttgatttccgggtcagcgggaggggcgggaggggcggaagcggcctctgcacagccctgcccctgtgccgcaggcgcttcctccggctgtgccagtcctctgccagaaaccccgccaggattattaggatcacagccccgaggcatatccggaccaggttgcccttggtgtagtactggcgggcaggacctggaggaatgaggagaggcaggagcaggtgaaagagcccacctccaggaccccctccaagccacatctgggcttctcagagatcctattattctctactagctaggggatgccgctcactttcctggagggtccctcccttcccgagtaggggtcagggccagatgaccccaattctctaagtagcacctctccctcctgtgctctcacagggctctgagacaactcctccccagacacagatgctgcctcgttatctgatgcattgcaaaagagaggacagttataaggggtggggaagagatggaatctctctttctctgaccctttttaaaatctcaaccttcccacctgatcttaatgcccaattctgaaccccatacgctgatattctgcctttactctacacactggaacccaagatctgagagctgcagcccctgcgtagacaaaggagttggctttggtgaagagacgggtgagaaggaagggggtctggagaggatgacttactcaccagctggagagtctgactcctttggactggcggtgatactcctagaagtctctgggaaccaaacaaaggctaagtgtgaaatgaaaccatattcccgccccctgtcactgtgcctactccgaacacacacacacatggggaggcacaattccacagcatttaagaaaagcatgggccgggcacggtgcctcatgcctataatcccagcactttgggaggctgaggtaggaggctggcttgagtccaggagttcaagaccaacctgagcaacatagaaaaaccctatctctacaaaaaaatacaaaaattagccaggcgtggtggcacgtgccagtaatcccagctactcagtggaggctgaggcaggaagatcacctgagccctgggaggttgaggctgcagtgagccaggattgtaccactgcactctagcctgggaaacagagcgagaccctgtccaaaaaaaaaaaagcaagaactgtagagtcaggctgtcctccagatttgaaccccaactctatcacctattagatgtcagttatctggcaagtgactcagcatctgtgagccagttccccatgtgtccaataaaattaacaagatcccttataggttgatgtgaaagtcaagataataataatggtagaaatataaagcaccgtgcttgacatatgagcacctcatacgtgccagcttttttttttttttttttgagacagagtctggctctgtctcccaggctggagtgcagtggcccgatgtcggctcacttcaacctccgcctcctgggctcaagcgattctcctgcctcagcctcccgagtagctgggactacaggcgtccgccaccacgcccagctaagttttgtatttttagtagagatgggatttcaccatattggccaggttggttttgaactcctgaccttgtgatccgcccgcctaggcctcccaaagtgctgggattacaggcgtgagccactgcacccggcctccagctctcttattcctcaagtatctcctgagactcgccaggtactcagccatgtgctgggccatgggaacccaaatattaataagacattgtcaggccaggcatgacactggctgaatgcctgtaatcccagcactttgggaggccaaggtgggcggatcacctgaggtcaagagatcgagaccatcctggccaacatggtgaaaccccgtctttactaaaaatacaaaaaatagctgggcatggtggcacacacctgtagtcccagctactcaggagccggagattgcagtgagctgagatcgcagagtgagccgaaatcacagatcacagagtgagcagagtgagactccgtctcaaaaacaacaacaaaaaacaaaaaaaccataagacattgtccatctgcggttcccagactattgcaggagaccaaaaagtaaagcgatttttttttttttttaatacggagtctcactctgttgcccaggctggagtgctgtggtgtgatctcaggtcactgcaacctccaactcgtgagttcaagcgattctcctgcctcagcctcccaagtagctggaattacaggtgcccaccaccacgcccggctaatttttgtattttcagtagagacggggtttcagcatgttggccaggctggtctcctgacctcaggtgatccactcaccttggcctcccaaagtgctgggattacagacaaagcgataattttaatatactgtaaaaattgctgtaataggcagcccacaagacactgagcgagagcagaggaaaccatcgatccagcctggacggtcaaggctttcttgaggaattgatgccatggggaaatggaagaaaaggcagagtgagtgggttgggtgcagagtcaggagaggttaggaagcctccaggagagcttcaagtgactgtgtgtggctgagaacagcatgggaatgcgtggaaggtatgcagacaaaattggagggatcaacaggggctggatatctaagctcacagaatagcaagctgaggaattggaactgcatcctgagggtgattgggaggttccgaactgaagatagggaaggcttccatcacagaactccctgggatatgccgggcgcggtggctcatgcctccaatcccagcactttgggaggccgagacaggtggatcatgaggtcaggagttcaagaccagccttcccaagatgctgaaaccccgtctctactaaaatacaaaaattagccaggtgtggtggcatgcacctataatcccagctactcgggaggctgaggcaggagaatcgcttgaacccgggcagcagaggttacagtgagccgagatcgcaccactgcactccagcctgggcgacagagcaagactccacctcaaaaaaataaaaaatagaactacgtgggatcaggtgcctcatgaaagccagagtcatgtgggcccagtggaagtatctaacctattatcagggaatctgtgaaggtgtttagtctggaaggaaatggagattttccaggacaggcaaggggaaagagactgaggaaagcgtatctgcagaggcctggagcggttagaagatgtgctgtgtccaggtgcctacagtctgtgtgcgtccgagcatgggctctacctggacacagtgaggagcgagattaaatacctggatcacagccgagtccaaagcctaggacttcatcctgggagcagtgcgtagggatggcggtcgtcccgccacagccttggctccgccatctttgaaatggccccatcacccaaaacgctcctccttctgaaccccagagctccactctgcacccatgctctagcctcacaccaaggactttcttggtaagagacggacagttcggtgaagtgattaaaagcctacaggcttagataatggaagagagagctccgtcctcacactcctttctgctgagcatgaaatgcctggttactcaccagttgtgaagacttcgtttgtgaatgagacggtcagttcagcggtggcttctgagaattctaagaaagcaaaacaatgttaggtcttccccgtggttccctatatcctctagatatctccattccccttttgagatatctaggctccctgaaacccctttctctgacacactgcacagacactgaagacagacaaattcgaaaggtgtaagacttatcttccatgaccggcttagtaagaagcagatccgttcagcaattgatagacacttggttttttttccacgttttgctgttatgaatattgctgctgtgaacattgacgtacaggtttttgtgtgaacataagttttctgttctcttgggtacacacccaggggtggtggaatcactgggtcatacagtaactctgtgttttactttttgaagaactaccagacttctttcttttttttcttttttttttttttttgagacagagtctcattctgttgcccaggctggagtgcagtggcgcgatctcagctcactgcaacctccacctcctgggttcaagcgattctcctccctcagcctcccgagtagctgggattacaggcacctgccatcacgcctggccaacttttttttttgtactttagtagaggcggggtttcaccatgttggccaggatggtctcgatctcctgacctcgtgatccaccctccttggcctctcaaagtgctgggattacaggctgcgcctggccacagactgtttttcaaagcagctgcaccattttatattcccaccagcaatataagaaggttcttccaaatcctcaccaatacttcttgtccgtttgttttgttttaaaaatcatagtcatcctagttggcatggtgaattttatggtatgtgaattatatctcagtttgaataataagatgtggatccatgtcttcgtgagcctagaggaagaatgagctcgtgttagcctcagaacacgggatctccaccttccaacttaggccattttctttttttctttttttttttttttttgagacagagtcttactctgtcgtccaggctggagtgcagtggtgcaatctcggctcactgcaagctctgcctcccgggttcacaccattatcctgcctcagcctcccgagtagctgggactacaggcacccgccaccacgcctggctaatttttttgtattttcagtagagatggggtttcaccgtgttagccaggatggtctcgatctcctgaccttgtgatccacccgcctcagcctcccaaagtgctgggaatacaggcgtgagccaccgcgcccggccaggccattttcttaaccaggggcctcctgaggccaccaaaatattcctgaactgcctcagctgataaatacgaagctcttgttgcagtgggtactatcctgggagtctttttatggtggaaccagcttggaaaaaactagtttatgctcagctctcggtggcataatgagagtgtgggtattatttggtctttgttatttctcttcgtgtgagatgcattaataaaccttttttttttttttcaattaaaatttcagttccagaatccatgtgcaggacgtgcaggtttgttacataggtaaacgtgtgccatggtggtttgctgcacccatcaacccatcacctaggtattaagccccacacgcatcagctatttatcctgatcctctccctcccccaattccccctacaggccccagtgtgtggtgttcccctccctgtgtccatgtgatctcattgttcagctgccacttacaagtgagaacatgcagtgtttggttttcagttcctgtgttagtttgctgaggataatgttttccagctccatccatgtccctgcaaaggacatgatctcattcctttttatggctgcatagtattccatggtgtatatgtactgtatttgctttatcctttctatcattgatgggcatttgggttgattccttgtctttgctattgtgaatagtgctgcaatgaacatatgtgtgcatgtatctttataatacaatgatttatattcctttgggtatataaccagtaatgggattgctgggtcaaatggtatttctggccaggcgcagtggctcacacatgtaatcccagcactttgggaggccgaggtgggcagatcacctgaggtcaggagctcaagaccaccctggccaacatggtgaaactcccgtctctagcaaaaatccaaaaattagccaggcgttgtggcatgcacctgcagtcccagctactcgggaggctgaggcaggagaatcacttgaaccctggaggcagaggctgcagtgagccgagatcatgcccctgcaatccagcctgggtgacagagtgagactctgtttaaaaaaaaaaaaaaaaaaaaaaggtggccctggtgcggtggctcacgcctgtaatcccagcactttgggaggccgaggcaggtggatcacctgaggtcagaagtttgagaccagcatgaccaacaaggtaaaaccccatctctactaaaagaaaaaaaaaaaaaaaagccaggcatggtggcaggcgcctgtagtcccagttacttaggaggctgagacaggataattgcttgaacctgggaggtggaggttgcagtgagccgagatcgcaccactgcactccagcatgggctattgagcaatactacatctcaaaaaaaaaaaaaaggaaaaaggatttctggttctgggtctttgaggaatcaccacactgtcttccacaatgaactaatttacattcccaacagtgtaaaagcattcctatttctccacagcctcgccagcacctgttgtttcttgacttttgttggttttttttttttttttttgagatggagtcttgctctgtcgcccaggctggagtgcagtggcacaatcttggctcactgcaacctccgcctcccgggttcacgccattctcctgcctcagcctcccgaatagctgggactacaggcgcccgccaccacgcccggctaattttttgtatttttaatagagacggggtttcaccgtgttagccaggatggtctcgatctcctgaccttgtgatctgcctgcctcggcctcccaaagtgctgggattaccggcgtgagccaccgtgcccggcgtttcttgactttttaataatcgccattttgactggtgtgagatggtgtctaaatgtggttttgatttgcatttctctaatgattggtgatgttgagcttttttttgtatgtttactggctgcataaacgtcttcttttgagaagtgactgttcatgtcctttacccactttttaatggttttttttttcttgtaaatttgtttaacttccttgtagattctggatattagacttttgtgaattgatagattgcaaacattttctcccattctgtaggttgtctgttcactctgatgatactttcttttgctgagcagaagctctttagtttagttagatcccatttgtcagtttttgcttttgttacaattgcttttgacgtttttgtcatgaaatctttgcccatgcctgtgtcctgaatggtattacctagattttcttctagggtttttatagttttcgggttttgcatccaagtctttcatccatcttgagttaatttttgtacaaggtgtaaggaacgggtccagtttctattttctgcatatggctagccaattctcccagcaccatttattaacccacagccaatttcatactaaatgggcatttcccttgaaaaccagcacaagacaaggatgccctctttcaccactcctattcaacatagtattggaagttctggccaggataatcaggcaagagaaagaaataaaggatactcaaataggaagagaggaaatcaaactatctctgtttgcagatgacatgatcctatatctagaaaaccccatcatctcagcccaaaagtttcttaagctgataagcaacttcagcaaagtctcaggatacaaaatcaatgtgcaaaaatcacaagcattcctatacaccaacaatagacaggcagagagccaaatcatgaaggaactcccattcacaattgctacaaagagaataaaatacctaggaatacagctaacaaggaaagtgaaggacatcttcaaggagaactacaattcactgctcaagaaaatcagagcggacacaaacaaatggaaaaacattccatgctcatggataggatgaatcaatatcgtgaaaatggccatactgcccaaagtaatttatagattcattgctattcccattgaactatcattgacattcctcacacaattagaaaaaactataaaattcatatggaaccaaaaaagggcccatatagccaagacaatactaagcaaaaagaacaaagctggaggcctcaggctcagacttcagactatattacaaggtgatagtaaccaaaacagcatggtactggtacaaaaacagacacatagaccaatggaacagaatagagatctcagaaataagaccacacatctacaaccatctgatcttcaacaaacctgacaaaaacaagcaatggggaaaggattccctatttaatacaccttgttttgattttgatttcaacacagcgtgtggtatttgcatgccatgtgatacagtttgaatatgtgttcccaccaaatctcatactggattatgatccccaatgttggaggtgggggcctggtgggaggtgtttggatcataggggtggatccctcattgcttggtgctttccttgcaatagtaagtgaattctcacaagatctggctattgcaaagtgtggcatgtcccccagtcccaactctctctctctcttgctcctgctcccaccacatgagacagctaccccctctttgccttctgccatgactgtaagcttcctgaggcctccccaaaagcagaagccagccttctgcttcctatacggccttcagaaccatgaaccaattaaacctcttttcttatcaatgatccagtctcagatatttatagcagcacaaaatcggcctaatatagcatgaaatattgctcagcaatcaaaaggaacacatcattgatacatacagcagcttggatgggcctcaggggcattgcactgagtgacaaaaggatatctcaaacggttgcatactggatgatcccatttacatcagattctagaaatggaagattatagagatggagaacaaattaatggataccaggagttagggatggcaagggaaggagaagggtgtaggtgtgaatataaaagggtagcccaagggaggcccttgtgagacggaagagttctgtacagtgactgcggtgatggtgacgcgaatctacaactgtgacaaattggcatagaactagacacctactttatgccaatgtcaaattcctggtttttatgttgtactctaattacgtaagatgtaaccattagaggaaactggaaaaagagcacatgggattcttctgttctatcattgtagacttcctgtgactctagaaccatttcaaaagagaaagttcaaaaattcagtcagaagcacacgcacacatatgcacgcatgcacacacacacatatgcacgcatgcacacacatatgcacgcacacacacatatgcacgcacacacgcacatgcacgcacacacacatatgcacgcacacagtatgtgaccatcttccatgtccctgcccactaggcataatagccctcactctgccctcaaccccgcaaatctcatccttatcaacctcggctctttccagcatgtttctcctgccttggtgcttcactctgagacacagggaatgttagacacgcccagcctccagcctagcgtatgatattcttaaagtgcaggccgtagtctggtacaccgtattcagctgagatgtttgtgaaagtggaggggataacacgcctcacacaaaacttaccgcagtggttctcaaagcagcattctggagccatagcatcagcatcacctgggaacttactaggaatgaaaatgactggattcaccccagacctactgaagcagaagccctgggggctcagaaatctattctttaagcctccaggtgattcttatgctcatggaagtttgagaaccgctgatcaatgcattcagtgactcagaaacagagtcccggactctacaggtttgttggttggttggttggttggttggttggttagtttgtttgtttttgtcacccatattcaaccagctggactccacagtatagcaagccactccgattattcttctgcatgttatatgtgataaaccatccacctagagtaggattgggggcagcatcttaacatctaactacttaggacacccaccctgtttacaggcagaaataaaggatttttaaaacaaagcaaatctgtgaaagaaccaactgaattaaatcgagaagtctaggcagagaggagagagagaaggggtccgtgtacctcatacgctgtgcaccagaatggaccctgcagaacctacctgctaccggggaaggtggttctgttggtaaccggctgggggtcacagaggttcctgggaaatcagaaaatgagataaatctgtgctctgtcgctgtgggtcctgaacaaataacgaaacatctccgtgactgagtttcctcaccggaaaaatgagcctaaagtagcttacatcactggactgttgtggatgttaataagcatttgagctgggtgcagtgcctcatgcctgtaatcccagcactttgggaggctgaggagggcagatcacttgaggtcaggagttcaagcccagcctggccagtatggtgaaaccccgtctccactaaaaatacaaaaattagccaggcgtggtggtgtgcacctgtaatcccagctgctcgggaggctgaggcaggagaatcacttgaacctaggaggcagaggttgcagtgatctgagatcgcaccactgcactccagcctgggtgacgcagtaagactccatctgaaaaaaaaaggcttagccaggcgtggtggctcacacctgtaatcccagcactttgagaggccgaggcaggcagatcacctgaggtcaagagttcaagaccagcctggccaacatggtgaaaccctgtctctacgaaaaatacaaaaattagctgggcatgatggcaggtgcctgtaatcccatctactcaggaggctgaggcaggagaatcgcttaaacccaggaggtggaggttgcagtgaactgagatcactccactgcactccagcctgggtgacaaagtgagactccccccaaaaaaaaaaaaaaaaaaaaaagcagcagcatttgtaaagcacacctggcacattctgggctattaacaaggaaatgcatgcagctcccgtccacctttttcaacctcagttctatttcttctggattcctgtgtcctacccctcactgtgaccctgggggcaaaacagatttttctaccaaaaactaaatgatgtattttgtttgatttaatatgacattgttaaatgtactgatcagtggcgttgggtatgttcacattgtggtacaatatgttgacctctagaacttatttttcttgcaaaactgaaattctgtgcccattaaacactaattccttctctctcctctttctggcccttaacaaccaccattgtactttgtgtttctacagtgttgacattagatacctcctttgactagaatcatacagtagttgtccttttgtgactgacttagcataatgtcctcaaggtatatccatgttgtagtatgtgtcagaatttccttcttttttaaggctgcataatattccattgcatgtatataaccacattatgaggtatgctgctcttttttgaaagaaaccccctttaagaatggtagtcaagtccgacgcggtggctcacgcctgtaatcccagcactttgggaggccgaggcgggcagatcatgaggtcagttcaagaccagcctgaccaacatagtgaaaccccgtctctactaaaaatacaaaaattggccgggcatggtggcaggcacctgtaattccagctactcgagaggctgaggcagcagaatcgcttgaacccggaaggcggaggttgcagtgagctgagatcgcgccactgcactccagcctgggtgacagagtgagacttcgtcaaaaaaaaaaaaaagaaacctccattctcccagctgcctgtagcccagggcttcctgccctcccacttccttcccacctctggccccgcccctgcagcccagggcttcctgccctcccacttccttcccacctacggccccgcccctgcagcccagggcttcctgccctcccacttccttcccacctacggccccgcccctgcagcccagggcttcctgccctcccacttccttcccacctacggccccgcccctgcagcccagggcttcctgccctcccacttccttcccacctacggccccgcccctgcagcccagggcttcctgccctcccacttccttcccacctacggccccgcccctgcagcccagggcttcctgccctcccacttccttcccacctctggcgccgcccctgcagcccagggcttcctgccctcccacttctttcccacctatggccgcgcccctacagcccagggcttcctgccctcccacttccttcccacctacggccccgcccctgcagcccagggcttcctgccctcccacttccttcccacctacggccccgcccctgcagcccagggcttcctgccctcccacttccttcccacttatggcccctcccttggaatggccatcaggacctataaaggctgaggaagaaaggtttggtctgcactacccctacctgtgaccacaagctccagggggtcgctgggggctgaccacaggtatgggtccctgctggagaagctgtagcatcggtaggttccgctgtgggcggcggtcaccgtgatgatgggaaaactagccctgtaccatctctcgggattcttgtagggcgcagggtccccttccttgtacagagcaaattggtcaaagccataccgagtctgacactgtagggttacgtcccctcctgacgacaccgccgggccgggctgggctgagagcgagggtttggcaaaaactcctgggagaaaaagaaagtctgatgttgaaggcaggagccagcatctcagctgagactggggaggtccccacacctgcctaagagctggggagctttttggctgtatccctcccagagagcgcactcccccacccaagctcacagagaggtcgagtcacccagtggttgaggaaggaggctgtgctcacgtcctagtgcttgggtgcaaatcctagttctgccttcaggggcctggtggccctggagacaaatctccctctgtatctgagcctcactgccttgttctgttaaaatggggatgactgaatgagacagtacacagtaatttgcagagtgcctgttgcctagcaagcgctggagtaagtaaatagcttaagcttatactgtgctgtaagcttgtattgccacatacaattgttacgttgtaaatgtggctgacagtgctagcttccgggtgccttccaaacttatgatgtatatcagttcagtgaatcctcagagacctatggagtcctcactcttaatgtccctattttataaatgaaactaaggcacatggcattaaataatttgtccaactctaggtaacaatactgcagtgtacagctgaaatttgctaagagggtagattataagtattctcacacacaaaaaagttaactgtgtcaggtgatgtatgttaattagcttgctagtagtaactgtctcacagtggattcgtatatcaaaacatcaacttgtacaccttggatatattccatttttgtttttcaattatacctcaacaaagctggacatattttaatttaaaaataaataaaaaacttgtccaagatcataagtggcagagttgaaatctgcactcacagagtttgattccagggtctccgctcctaaacacgaacctacactactctgatgtgaggttgttgtcatagaccggtgtggtgatgcatgcctgcacacaggagtcagaaaaacaaaggttgaggctgggtgcggcggctcacaccggtcatcccagcactttgggaggccaaggtgggaggatcgcttgagcccaggaaggcgaggctgcagtgagctatgatcactgtacactagcctgggtgacagagtgagaccttgtctcaaaaaaagacagagagagaaagcaaaagaaaggaagtaaggaagataaaaatataagctgcctaataattatggcattcactcaacaagaagaaaaagaaagaaagaggaaggaagggagggagggaggaaggaaggaaggaaatatataagctgcctgataactgtaacattcactcagcaatattttctcttaattttcacttaagcaactattatgtgtctgtctgtattctttttttgttgtttcatttgttttgttttgttttgttttgttttgagacggagtctcgctctgtcacccaggctggagtgcaatggcatatatatatatatatatatatatatatatatatatatatatatatatatatatatatattttttttttttttttttttttttttttttttgggaaacagaatctcactctgttgcccaggctggagtgcagtggcatgatcccagctcactgcaacctccacctcctgggttcaagcgattctcctgcctcagcctcccgagtagctgggactacaggcatgcaccaccatgcccagttaattttgtatgtttagtagagacagggtttcaccatgttagccaggctgatctcgaactcctgacctcaggtgatccgtccacctcggcctcccaaagtgctggcattacaggcgtgagccaccgtgcccgaccaggaattaaaaatagacaaccaccaccaagataaaaaaaggtatacttcacataccagatagtgaggagggccactttgactagggtggtgggggatatacttagcgagaagagagtatttgagtctgaccctgaaagaagtaatgaggcagccaggctggtccattctagtagcagagaggaggccagtgatgctgtggaggggagtgaggcagggaagaggggagggaggcaggatttataacgcggaatagaccacagtgcagctggccaggaattagggtggcgtgagtgaggcactctcctgggatgtaaaatttaattattcccaaacaattaacatatttgaaaaaattattgaaaatttgaagagtaggtcgttaaaactcacattattctgtttgaatactttattcccctgaaagatttattagaattttacattctaggcttttgtggatgcaagcgcatcagtgctatttccaaaacctacttctagaaaataaccatttaaaagtgcactaactgggtgcacctatagtcccagctactagggaggaccacttgagcccagggatttgaggctaaagtgagctatgatcatgcctgtgaatacagcgagtgtactaaagcctgggcaacatagtaagacctcttctctttttttttttttcccaagacggagtcttgctctgtcgcccaggctggactgcagtggtgcaatctcggctcaccgcctcccaggtttaagcgattctcctgcctcagcctccggagtagctgggattacaggagtgcgccaccgcgcccagctaattattattattttttttagtagagacggggtttcaccatgttggccaggctggtctcaaactcctgaccttaagtgatccacccacctcagcctcccaaagtactgggattacaggcgtgagccgccgcgcccggcccaacctcttctcttaaaaaaaataaataaataagaaaagaaattagaatatttgcaccaatcaagagtctaaggagacataaatactaaatgcactgtggggccctggacggggtctgggaacagaaataggatattagtggaaagactggtgaaattcaaatagcctggagtttacttgatataatatagttgtgtctatggttagttttttgtttgttttttgatacagggtctcactctgtcacccaggctggagtgcagtggcgtgatcacagctccctgcagcctcggcctccctggctcaagcgatcctcctgcctcagcctcctgagtagctgggactataggtgtatgccaccatgccccactaatttttaattttgtttaaagatgaggtctcactatgttgcccaggctggtcttgaactcctgagctcaagcaatcctcccgcctcagcctcccaaagtgctgggattacaggtgtaaaccactgggaccagtgctacgtttattttttggttgtaacaaatgtaagatgttaacatgaggggatcctgggtgaaatatttccattaatattatctttggaacttttctgtcagtctaaaaattactccaaaacaaagttttaaaaagaatcccgagccaagcacggtggcccgtgaccgtagtccctgctactcatgaggctgaggcaggaggattgctcaaggcaaggagctccaggctgcagtgagctatgactgctcctatgaacagccactgcactccggcctgggcagtgtagcaagaccccatcgctaatttttttaagtgcattaaaacacagataaagggttgcctgtttttcgttttggcacagactctggtatgacttgacacaggcactggctgattctgcctttatttgaaattctggtttttttcattgtggatgtttttgcaatttattttgatttttttaaaaattgcatgaaaatgttattcacagccagatgcagtggctcacgcctgaaatcccaacactttgggaagccaaggtggaaggatagcttgagcccacaggagttcgagaccagcctgagcaacatagcgagaccctatctctctctcttttgtattttaatgccttttgtgaaaactgtcaagagaccccatctctataaaaacataaaaaatgagctgggcgtggtggtgcacacctgtaatcctagctacttggagggctgaggcgggagaatcgcttgagccctggaggtggaggctgcagtgagccaagatcgcgccactgctctccaccctgggtgacgcagcaagaccctgtgtccaaaaaacaaaatattattcacattgatccataaatgtcgtggcaccaccacccgctaggccagtgcctcgtttgcctcaccctaatccctgccctcaatgtcccccgtatttgtgtcctgaacggaggaccacgcagtcccaggctccgatcccccttcctttacccgtggcaacgagctccagctggtcgctgggcagggaccagaggcttccgttctggtaggagcagcggtagcgtccagccagacttctcttcatggccgggatgaagaggactgcctgatcctggtacctgctggaactcagcttctccaggcggtacaggtccacgcccggaggtccctggcaccggagggtcactggcttctccaggggcaccagggagctgggcagagcctggagggagggcttggggagcggtcctggaagaggagcagggctgggtcagcctccccgcagaccccgcctggaccccgctgctcccgcgctggcggatcccgcaggagggaaggggtctggggaaggactcaccactctgcgctggcacacgccccagacacagccctgaggaaagaagaaagggaccagatgccaggactcgcttttatggacattcctgcctgctgggcgcggtgataagacatttgcatgcatatgctttactctgtcctaataatttcttcaaaagacacacaggaatgtaatttaagtgagagaaaccggtcagaaaaagccacatagtttatgaggtcatttacatgaaatatccagaataggtaaatctataggagatggagaagaaagcagatccatggctgggggtggtgggagaggagggcaaggcatggtggcgtactgctctctgtggacttgttcgtgttagacacggtgggctcgttcgtgttagacacggtggactcgttcgtgttagacacggtgggctcgttcgtgttagacacggtgggctcgttcgtgttagacacggtggactcgttcgtgttgtgttagacacggtggactcgttcgtgttagacgcggtggactcgttcgtgttagacacggtggactcgttcgtgttgtgttagacacggtggactcgttcgtgttgtgttagacacggtggactcgttcgtgttagacacggtgggttcgttcgtgttagacacggtgggttcgttcgtgttagacgcggtgggttcgttcgtgttagacgcggtggactccttcgtgttgtgttagacacggtggactcgttcgtgttagacacggtggactcgttcgtgttagacacggtggactcgttcgtgttagacacggtggactcgttcgtgttgtgttagacacggtggactcgttcgtgttgtgttagacacggtgggctcgttcgtgttgtgttagacacggtggactcgttcgtgttgtgttagacacggtgggctcgttcgtgttagacgcggtgggctcgttcgtgttagacgcggtgggctcgttcgtgttgtgttagacacggtgggctcgttcgtgttgtgttagacacggtgggctcgtttgtgttgtgttagacacggtgggctcgttcgtgttagacattgcccattgacttcctcagtggatgtgaggaatgggacctgagacattgctgtcccttcgtttcctcccttcagtctcccaatattaaataatatccaagtacattacaatagtatgcaattgtatagacaagtattgtaaatactattgcatattgtatattattgtattttattgtctatgtaatatatgcgataaaaccccacactaatgggatgcattgggctccaaggatggagcaggatggagcctcagcgtgtaagtcaggacgtctcagcatgtgctggccatgggtttcccggtatttacaacatttgcttgaatcagtattccatgattacatgataggatataatatatataataatcgtttcaaatagcctgaaggaggatggggaaagttcccaacacagaaaggatgcatgtttgagaagatgggtgtgctacttaccctgatctgattactatatgtatatacacatatagtgcatatatgtaaacctacatctatacatacatgtgtatgtacatatacacgtgtgtacatacacacgtgtatatgtatgtatatgtatatatgtatgcatgtgtgtgtgtgtgtgtgtgtgtgtgtatacatatgtatacaaatacatgtacataagcgatcccctcctggaattgcttgagcccaggaggtcaagtctgctgtgaggtaagattgcaccactggccgggcacggtggctcatgcctataatcccagcactttgggaggccagggtgggcggatcacaaggtcaggagttcaagaccagcctggtcaacatggtgaaacaccatctctactaaaaataccagaaattagctgggcatggtggcacgtgcctgtaatcctagctactggggaggctgagtcaggagaatcacttgaacccgggaggcggaggttgcagtgagccaagatcacgccactacactccagcctgggcaacagagcaagactccatctcgaggaaaaaaaaaaatgatattgccccattgcactccagactgacaacagagcaagaccctgtctcagaaaacgaagaggaggaggaaaaaaaaagtactaattatctgaaattccaatttaaccaggcatccagtgttttatctggtaaccctcattcttacacacacacacacacacacacacacacaaaggcgggatagttgtcattcccactgtaaacataaggaaactgggcagaggccaagcaaccttgtgtagctcacatagcaagaagtgggtgaacccagctcatgtcttgactctgagctcagagagtgacaacttgtcaccagcgcccccatagccaccaccctttgtccaccccaggctccctctgcaccccaacgcaagctccggccgcttctctgtccccctcctcctgccgcatcacagcccacctcagcctctttgtaggtttccatgcgacgctgtaccatggctgggagtcttccaggcgccgtgctgagcgccttctgtgcatggactccaagtcgccataatcgtacgggttacccaccattatcagtcccctcttatacatcaggctagtgagacagtatcttatccacagtcctacagctggcaggagtagattcaaaccctagcagcaccaattagtggtaaagagtgtggacttgggaacttacaggagtagagagcacagtggtggttaccggggcggtggggtaaggtttggggagatgttggtcagaggaggacagtttcagttggacaagaggagtatgtcttggagatctactgcacatcatggtgactgtagttaataacaacatattgtacacttgcatatcaccgatagtagattttaaatgttctcaccggccgggcgcgctggctcacacctgtaatcccattttgggaggccaaggtgggcggatcacctgaagtcaggagttcgagagcagcctgaccaacatggtgaaaccctgtctctactaaaaatacaaaaattagcggggcgtagtggcaggagcctgtaatcccagctacttgggaggctgaggcaggagaatcgcttgaacctgggaggtggaggttgcagtgagccaacgtcatgccactgcgctccagtctgggcaacagagtgagactccatgtcaaaaaataaaaataaataaaaataaatgagcgtggaatactactcagccattaaaaggagtgaaataatgtcttttggccaggcacagtggctcacatctgtaatgccagcactctgggaggccgaggtgggtggatcacgaggtcaagagatcaagaccatcctgcccaacatggtgaaaccccatctctactaaaaatacaaaaattagccgggcatggtggcgggtgcctgtagtcccagctactcgggaggctgaggcaggagaatcacttaaacccgggaggtggagtttgcagtaagccgagatcacaccactgcactccagccttggtgagagagcgagattccgtctttaaaaaaaaaaaaaaaaagtcttttgcagcaacttggatggagctggaaggcattattctaagtaaagtaatacaggagtggaaaacaaaaatctgtatattctcacttataagtgagagctaagctgtgggtatgcaaaggcatgcagagtgatgtaatggacttcagagactcagaagggaagggcagaagtggggcagggatgaaaaactacacattaggtacaaggtacactagtcaggtgacaggtgcactaaaatctcagaattcaccagaatataattcatccatgtaaccaagaaccacttgtatcccaaaagctactgaagcaacaagccagatgcagtaacctgtacaggccacacctgtaaccccaacactttgggaggccgaggtgggtggatcgcttgagcccaggagttcaagaccagcctgggcaacatagcggacccccgtaactaaaaaaattacaaaaacaagccaggcatgatggtgtacaactgtagttccagatactcaggaggctgatggggaggcactggttgagcctgggaggttgaggctgcagtgagccatgatcatgccactgccctcctgcctgggtgacagaagtgaggccctatctcaaataaaattaaataaataaaagttaaaacaggctgggtgcggtggctcacgcctgtaatcccagcactttgggaggccgaggcgggtggaacctgaagtaaggagcttgagaccagcctggccaacatggtgaaaccccgcccctactaaaaatacaataattagccagacctggtggcagatgcctgtaatcccaactattcgggaggctgaggcaggagaatcacttggacccgggaggcagagtttgcagtgagctgagatcatgccattgcattccagcctgagcgaccgactgagcgagactccatctcaaaaaacaaacaaaaagaaaaaaagaatacatccatggatggataatgaatgagaggttgtttatattcacagttaaccctctcatctccagtaatgcaaccatcttcttcctgcttagccttttggagatgctgtccctttagtggtcaaattctgaagaaatcaggaaataatgcattcgacatgcccagcacaagtgaagatcaggcagcagaaatgcattcgacctgccacccatccatcaggagactatttactccactactgtaggggatactgacaaattaaatccatacctagtccagatatcaattccacaatttttttttttttttttttgagacggagtttcgctcttgttgcccaggccagagtgcaatggtgtgatcttggctcaccgcaacctccacctcccaggttcaagcgattctcctgccttagcctccagagtagctgggattacaggcatgtgccaccacacccggctaattttgtatttttagtagagatggggtttctccatgttggtcaggctggtctcaaactcccgacctcagatggcccacccgcctcggcctcccaaagtgtgtaagccatggcactcagcctttttttttttttttttttttttttttgagatggaggctctctctgttgcccaggctggagtgcaatgcctgacctcagctcactgcaacttctgcctcccagtttcaagcaattctcccacctcagcctcccacgtagctgggattacaagcacccgccatcacgcccggctaatttttgtagagatggggtttcaccatgttgaccaggctggtcttgaactcctgacctcaggtgatccacccacctcggcctcccaaggttgagattacaggcgtgagccactgtgcctggcccacattttttaaaaaaggggcaactgcagtgtagtagaacaaagttgtgaccaatgctaggatactctgttcatttcctgacccagccatgaatacactggaataactcatgcaaaatgccagctcgctggccccccgtttccccacccaacaaatgaaggggctcttacaggttcctttttgtcctgaaattcatcaccaatgcaaatttcttaaaaatcctttgtctggcagtccatgcctgtccttcagcatttcccagatctgaccctcaggactcaccaagacagaagagggcggtcggggatggagacatggttcctcagccctgtcctgagctctgtggccagggagggaagtggtgggagcctggggcacaggctcaggatgtgatgaggatgaagaatgctctcctcccttcctccaccagccccggcctttcctaattgagactcatcgagccgtagccggctcctcagtacagtgacttgcacacaagctccaaggagccgcgcttatctcctctggccagcctggcgttgcaccgtttgtccgcctgctggggcctggtctgtgttcccgtgctcccataaactccctgatgtcactaggaaaatacgcatcaaaaccacagtgagatatgacttcacaccttctggaatggctgtattttttttttttcttttgagacaaagtctcgttctttttgcccaggttggagtgcagtggcgccatctcggcccactacaacctccacctcccaggttcaagcgattctcctgcctcagcctcccaagtggctgggattataggtatgtaccacaccaggctaatttttgtatttttagtagagatggggtttcactgtgttggccaggctggtcttgaactcctgacctcagttgatccacctgcctcggtctcccaaagtgctgggattacaggcatgagccactgcacccgaccggctataattttttttaatggaaaacagcagatattggtgagtatgcagagaaattgaactgcgcgtgcattgctggcagggacgtaacatggcgcccctgctgtggaaaacagttccagcagctcctccagaagttaaacgtgggattgccataaaatccagcaattccacttcggggtacacacctaaaagaactgaaaacagggtctctaacatatttgtacacagtgttcatagcagctttattcacaatagccaaaaggtgaaaccacccacatgtccatcaacaacaatggataaacaacatgtggtatatacacacaaggtaatatcaaccagccttaactaaaagaataaaaatcagccaggcacagtggctcacgcctgtaatcccagcactttgggaggccgaggcgggcggatcacctgaggtcaggagtccgagaccagcctggttaacatggtgaaaccccatctctactaaaaatacaaaaattagctgggcgttaaattagccgggcatggtggcaggtgcctgtaatcccagctacttgggagacggaggcatgagaatcgcttgaacctgggaggcagagattgcggtaagccgagatcgcaccactgcactccagcctgggcggcagagtgagactgtctcaaaaataaaaataaggccgggcgtggtggcccatgcctgtaatcctagtactttaggaggctgaggcaggcagattgcctgagctcagcagttcaagaccagcctgggcaacacagtaaaacccccaaaaaatacaaaaaaaaaatagccgggcatggcggcaggcacctgtagtcccagctactccggaggctgagacaggagaatggcttgaacccgggacgcggaagttgcggtgagccgagatcgcgccattgcactccagcctgggtgacagagcgagattctgtctccaaaaaataaaaaatattataaaagaataaattcagatacatgctacaacgtgatggaccttgaagacattatgctaaaggaaatattccggacttgacagataaatactgcattgtgccgcttatctgaggtatcgagaggagtcaaattcatagagacagggattagaatggtggttgccaaggcctgggaaaagtggggagttactatttaatagggagcgcttaggttgaagatgatgacaaagtctgggggatccatagtggtgatggttacacaacactgtaaatgtatttatatttaatgccattgactgttttttgttttttggttttttgagacggagtctcactctgtcgccgaggctggagtgcagtggcgcgatcttggctcaccgcaacctccgcctcccaggttcaagcgattctcctgcctcagcctcctgagtagctgggactacaggtgcgtgccaccatgcctagttgattttttgtatttttagtagagacggggtttcaccgtgttagccaggatggtctcgatctcctgaccttgtgatttggcctcccaaagtgctgggaatacaggcatgagccaccgcgcccggccagtgccgttgacttgtatgtgcacttacaggtggttaaaatgagaactatcagggtgttgatatctaaaaacctccctgccatcatcttccctacatctctcattcagtgaccatggttgaatgcctgccacctttcaaatattatgtcaggcactcagtattggcagttttatccattataaatgctttaagctgcatagaattttaaacgtgttaataaaagtagttataaatctttaatacataagctggctttaaaattattggtaaaataagattagaaatgtcttaagaattgttggcgtttttgtttgcacttattgaacgagtggtttcatgcttatccctgcagaatactatgagatttgtcataagggttataaaactataaacccggctgggcgtggtggctcacgcctgtaatcccaacactctgggaggccgaggcaggcagatcacctgaggtcgggagtttgagaccagcctgaccaacatggagaaacgccatctctactaaaaatacaaaattagctgggtgtggtggcgcatgcctgtaatcccagatactcaggaggctgaggcaggagaatcgcttgaacccgggaggcagaagttgcagtgagccgagattgcgccactgcactccagcctgggcaacaagagtgaaactccatctaaaataaataaaaataaaacatttgttttttgtagagttggggtttcactatgttgcccaggctggtcttgaactcctcctgggctcaagcaatccaccgacctcagcctcccaaagtgctgggattacaagtgtgagccactgtgcctggccctattgggtccttttaaaagatacataaaaaatcaaatgcaacagtgaagtcaatcacccgatggcagaaattggggtgctcctggcatgtggtcggtcgaagccaaggacactgctcagcattctgcagtgcacaggacggccccgcccaggcggagaatgatccggtgacacatataggtgggaaggatgcacgaatgatggcgtttaggaagaatattatcacttctttcccgtaagagcaacttagagcaagaaaatggtattattcttagggccttctctcttatggaggctccaagccagggttgccatggcagaagatgctgggcttgctttttccttgagagaactgtactcaagatgatgtaactgtcaccccgggtgccacttgggtgctttggagaagcgctcagacgcgacacgccgtgacgactccgcggcaggcagccggacctgtcctctggcgtgcggttcacgggctgtgtttatccccctggttccttcacagccaccttgggaaatacgttgcctctgaatcacgccaggcaggctctcactgtgtgtgctgcggggctggaaatcagggtgacactccgctaccgaacagcctgactaggaagccagaaagacgctgccggctttagtttgtcctttgactttccttgatatgaatgaagatagagcacttccacactgcacaacaggaaaagcccagaacgcttcctggagatagcgagggggtgatgcagcggacagctatggctgatgaccccctcacctctgactccccctccctccctgctttctgaacgcacatccatcaccaaccataggttcctgtttggggtttgctggctggaaaaaaaaaaaaaaaaaaaaggaaagctggctttctagtaaaaaccacttcctttgctcatttatcaaactcaaacgctaggagggccacctaacatcctccgtcccacgcaatggggtgtttctggagcactccggtttatcagggaccctgtcagttgccatcgcacatgtatatggggccagcccctgtgccaccgaagaggggggatattgaaaacatgttacagccaggagcggtgcccccttggttcaagcagttcttctgcctcagcctccctaatagctgggattacaggcgtgcaccatcacgcctggccactgttatgtagtttttaccacaatttaaaaaaggaaagagtgcctgggtgagtcctacgcacctattcggagaaccaaaggctttgaggttatcctcggcccacccatctgatgggagtgtttctcaaacttgcttttccgtgatctcccagtaagaaatacctactacacacacacagtctccggtcggcatgcttagggtagtcttccaattccccctcctggtatttacaccctggagtggtccgctcctcttgggctgaacctgtaacttgctcccaagcaagagcacacagcaagctcacgcacgtggttgttggtgtgattctgtttctccagattgtctccattcctccctggcttctccacagggccgctcaccatggcagccggctccatcaccaccagccagcgagagggcaagacaagagggctgacgagggacgctaccatcacagaggtcagttttgtaacctaaccacaagactaacctactgtcacttctgccctatcctactgctagaagccagtcgctacatctcccccacactcaaagggaggtggtcgcaccgtggggtccactggaagttgcctaccagactcaggtcatcccaaacacaccctctagccatttggtgtggcatcggaaagaaaactaaggccaggtacggtggctcatgcctgtaatcccaacaatttgggaggccatggcggaagggtcacttgagcccaggagtttgagaccagcctgggcaacatagcaaatgttatgttgccacctctacaaataattagccaagtgtggtggcatgcacctgtagtcccagatactcaggaggctgaggcaggagaatcacaggtcgaggttgtagtgagctgtgacggcactgcactccagccttggcaacacagtaagacctcgtctctaaaaaagcaaaaagggctgggtgcactggctcacacctataatcccagcactttgggaggccaagacgggtggatcacctgaggtcaggagttcaagataagcctggccaacatggtgataccgtctttaattagccaggtgtggtggtgggcgcctgtaatcccagctactcgggaggctgaggcatgagaatcgcttgaacatgggagacacaggttgcagtgagctgagatcatgccattgcactccagcctgggcaacagagcgagactaggtggctgttctgtgtactgtgggatattgagtagcatccctggcctccccagtatctcaaatatgaaaacatgttttctatctcgattactgagcttttcggtgcctccttcggttctgcacctaagctaagagccccttcatctcaccctgatctctatccagtttctaacacagcagtcttgtaagatgcccggacttaaacggttatttcctgtgaaacaggtgaaaggggctttcatctctaaaaagtcggaacttttttttttttttgagacggaatcttgctctgtcacccaggctggagggcagtggcatgatctcggctcactgcaatctccgcctcccagcttcacaccattctcctgcctcagcctcccgagtagctgggactacaggcgcccaccaccatgcccagctaattttttgtatttttttagtagaaacagggtttcattgtgttagccaggatggtctcgatctcctgacctcgtgatccaccgcgcccggccaagtctgaacttttgcatggcctgttgccctggtgataaactgatgccttgtttcctaaaaggaataaagccatgagttgcctttgttcagctcatgggcattcacccatgcacagaggaaaaataaaatctacgactcgggtacattttcttcttttttttttcttttaaatgagcaagtttgagagtctgcagtttggactaccatgagaattgataggaaggtgggagtcccaggcaatcccaggtcctgtagcagcagctggtggggttcccactccatgccgtgcagagcctgaactcaggatgacacctgcacctgctctctggctgggctctggcacaggaagccctcagcaaacacccccggcacagccatgccatagccagacaacagctcgctgtaccacaccatcatgggagacagcagttattctgagcatctcactgctgaagaaaccaaggctcagagaggaccatgcatgcacaaggtcccacagggacccaagaatccaccaagtgtcagacaacttgcccatgctcttcacggagcaccttggaaccctccccgacaggcaccgctggctctcctgacgtggcctgcaagtgcacggagccccttcctcctcggccattcccagtttagattcccaggggaagcatcagatggcccctctcccctgctggcagcagagcagacggaaccagccagagcccagggcagtgctcacctgcaggccagtccactgcggccagcaccgccccctagaacctactgcgggcatggcggccgccagtcctgggtctcccggctcaggtagtgccaggaagctgcgggcatggcggacagctgtcctcggtctggaggcgccatcctggctttcaaatctgctccagaggttatctggggaggggctgctccctcacagagggagcctctaagcccaccaggcgggcactttcagcccaaagcctccgggccacctcctcatcctcagcctcgggggccggggccttctgtttgagtccatcgaagtactttccggaaacatccgccagttcctccgccacggccaggtatgtgctgggctgggcggccagctcggggctcttgaccagcagccagaagatgggccctgcaatcagcccacagggcatttagtccacactcgctcagagagaaggaaggaagccccgctccccggtcagggagctccgggtccctggagtcccacagagccctcctctagccctttccccttggctgcctccatctgcagttcccttccctggcactgcccaggcaaatcccaccagaccagggatcagaccaaaagctgcctcccccaaggagccttcctggctttgtccaggaaaatggaagctctcttcctcttggtcagccccagtcctcaccctaccccatttctcctttaataacatcttattaaatgcacctggcaccagcctcaggttaaggatctttttttggccaggcgaggtggctcaggcctgtaatcccagcactttgggaggccgaggcgggcggattacctggggtcgggagttccagaccagcctggccaacatggtgaaaccccatttctactaaaaatacaaaaattaactgggtgtggtggcgggtgcctgtaatcccagctgctcgggaggctggggcaggagaatcccttgaacctgggaggcggaggttgcagtgagctaagatcacaccattgcactccagcctgggtgacaatagcaagacttcgtctcaaaaaaaaaaaaaaaaaagggctgggcgtggtgactcacgcctgtaatcccagcactttgggaggctgaggcaggtggatcacctgaggtcaggagttcaagaccagcctggccaacgtgtgaaaccctgtctcaactaaaaataaaaacttagctgggtgtggtggtgggcgcctgcaatctcagctactttgggaggctgagacaggagaatcacttgaaccgaggaggcagaggttggagtgagccaagattgtgccactgcactccagcctgggtgacgagcaaaactccgtctcaaaaaaaaaaagacatttatttatttatttattgagacctggtgtcttgctctgtcacccaggctggagtgcagtggtgtgatctcagctcactgcaacctctgcctcccgggttcaagcgattctcctgcctcagcctcctgagtagctgggactacaggtgcacaccaccacacctggctaatttttgtatttttagtagagacggggtttcaccatggtggccaggctggtctcgaactcctgacctgaggtaatccgcccaccacagcctcccaaagtgctgggattacaggcgtggctattagcctcgccaagttaagattcttgatgccaaccaatcacccactccatgtttttcaggattataaacactagtcataaagcatgaactgcctgggggtggtggctcacacctgtaatcccagcactttgggaggcagttggatcacctgaggtcaggagtttgagactagcctgaccaatatggtgaaaccccacctctagctgggtgtggtggtgtgcacctgtaatcccagctacttggagacaggagaatcgcttgaacctgggaggtggaagttgcagtgagtggagatcatgccattgtactccagcctgggcgacagagcaagacttcatctcaaaaataagtaagtaaagctccaactgtttgttccacctattctctgggcggggtcctgtgctggccctttcaaggaaggtctcgtataacccccccagtgactgtgaggtgagtcctattaaggcctgcactctgcagatgaagaaacaggctcagaggggtaacagctcttccccaggaggtgcagctggtttggggtgaagctggagttaccctgagtacagcctgactccaggcgtcagctccacggcctcttcctctgagacacggttttctcatccgccagcagggctctgcctgcttcccggggctgttagaggctggcaggccaggtcaacggaggaaagggacctgtgctctgtgcctcagaagacgtaggcgaggagcaggcatgaggcctcagggacggtctctgagggagggtcctgggccctgggctgagaaagcaggggtggagggctccacgtggagaccccaggctgggaggggactcaccgagtgtggtgctggagaaggtggagccatggatgcccgtgtgtctgcccagctctgtcctggccacgccggggtgcagggcgttgacagtcacaccagagcctggggaagaaagaaagagaagactgagggaggggtccagcctcacctgggaggctgtggcagcccacacccagctgtggggcttccgggcaccaggctgcttcctgcactcaaaccccatcgtccctcttgctctggaatcttagtgaagtggtcttatcttgcggagcggctctgccacatggctgctgggagccgagctttcctggagggcttcataaacccagaacgctgagcttaccccgggagcctgcatcggtgcgtggcggtgggacctaagatactgtaactctgaccagctcccagtggggctggcaccgctggtccacagaccgtctttcagaagcaaaggcctagcacagatttctcaatctcagcactgtggatgctgtgggttgggaggagtgaggggccatcccgtgcgctgtaggacattgagagcatctgggcctttaccctccagatgcccagagcaatctctccccaagccagctgtgatcactgtgtttccaggcattgacaactgcgggtcaaaactgcccctggttgagactcactggctggagccaaaaggctgagctgcctgcccaacagcagcagggaaggacatctgatccaggcagactagaccacctgggatgaacagacaatcctcagaagaacgatcgattagtgatgtctgcttcaggcaccagaagcgggcagcgtggtccacatgctctacttttgctgactctgttctggatccaccgtttggcctcccatcagcctaggat

SEQ ID NO: 436 - DNA, 26992 bp, Homo sapiens
accatatttaaagacaccatattttaaatctgcaagcaaaattaaattagcctggtacaggcagaggattggattgaggggtcagaatacctgggtcccagccaatgtctgccacctattttctgtgactttacggtatcaggccccagaagggatggggtggtcatcaggcgctggccaggtctgctagtccctaaatctgaattcaagcctgagagttactagcagggaccttaatagaacaaagagcctcaccccagaattgtattctccgagacaagcggcagagcccgaattgtctctatcacataagtctctggagggagcacacacgtagctgggatggccgtttttctcagacctattccctttactccacttcattcccagacttcggctccgggaagactccaggctccaggtggggccagccaggcggaggggaccccagcaaaggcaggaagcagcacagcaggtgtccagcacaggtgagggtgggaatggtgcagcagagatgcatgcgccctctgcagggtgttgggggctgtcgcagtggggtaggaccccatgtgtatccccaggaaggaggggactggtgtcgctctgccaagctgtgccctggttccttgcccctacagatcttccagtgggtgggaagatgaagagtttgaggagggccaccagaagaaaaaagaggagaggtcggcaaacgttccggtgagggctgggccgggaagaccagagcgtgagttgatgtagagtattcctggcggtgcctctccttactgcaaatatggcactcccacccccacccgcctgcctccgcttcttatgcccatcccaccatcccgccttcctgttgtcatttctttgaggcctggcacaacctcgcgccacccctgaccctggctgtcccagttcgcaagtccccaacagccctcccatgatttctgcttgtctctcaaggccctggaccattttccctgaacccttctagaactccctcttccttcctgctctcatggctttcctaacttctagaactttgcatcttggaccccagggttttgctgaaagcctactctgtgcccaacacagcgctgggtgctgttggtaaaccccagctcactactcaatagcatctcccacaaagacttgcaactcagggagcagagttctttgctacttgttgagctgacctgaatttaccgatgtctccttttcagtgtgtttccttccaggcacagtgaatcattcgcaccatctagcttctagttgccccacgtttaccaagcacacgccctgcagagggacagtcctcggcaaagcctccatctatagtgagcagtgcatcccctgacaccgccccaactcgtggttcttctctcagagcttttttccaccatgatagttcttggtgcagagaggcacgtgatgaatgtgtctgtccttctccatctaggtccaggacccagggcccatcttccatttgtaggtccaggccctcccagagcggagtaccctagcatcttggtacccaatggccctcaagccaataggtgggtccttgggggaaagaaggaggcctggagaatagcaaaaaaagtagaatgtgtggcttgggatgattttaatgaaacacgactgctgttgaagttgggggaagctgggatctcatgcttgggatatagggccccgagccccactttgtctttgccctttagcaatgtgaacaaccctcacccggctctggaagcccagggtatgccctgcttcctaaatggcctgatggtaggcctcagtgaaagacagggtgctgcaggatggggggatatgaagcttaagccaactccctccttctctggagcccaccagcagaggtaagggccaaatagggcagagggaagctgaggccaaggcaggctgcctcctgctgtctccccagtcacccccactggcaagcccctccctgcctctttcaggtcatccaggtggcccagggaaagcctcagcaggagccgccagaggagacccatggagtcgggcatctgcactattgtgtgacctccccctgccagcctcagccctcatccctgaagcacctgtccaacacgcacacactagggggtcctggggaccaagcctcttcccagttgctcagccctgcagggatgtggaacacagtgcagccagtggactcctgaggaggctggccaagggctttgcaggctcggccctgagaggttctgtttgttcctccttgggatttttggactcagtaggtaaaagaaaaaaggaaaatggatggcaaattccctgtctttctgaatccaaatcttacgattgctaggggcctggcagttctaaaaactgacttcgtggtcaagtagctttggagtcactgactgtctccagacgtccatttttgcacatgagaaatgaggatataatactacagaagaggcatcttacccaaccaatgcaccttacttctctgtgaaacacaggggatgctgggcgcaggcctaggctgtggcctgtagcctgtaggacagctcctgccagcagccacaggaacagtgatgtgatgtaacatttcccaagtacttagctcatgccccaccctattctaggtgcttagctcaggccccaccctattctaggtgcttagctcaggccccaccctattctaggtgcttagctcatgccccaccctattctaggtgcttagctcatgccccaccctattctaggtgcttcacaagtgtattctcctctaatcctcacaacaaatatatgaggtgctattatcccctttcgcaaatgaggaaaataaggcacaaagcttcagtaatctgaattcccaggtcacataactagtatgtagagaagctgggaatcaaacccaggcagtgagcactttctagaatgctgtgcagttccacttccccagctaagcccttgcttacccagagtccattgtgatttaatatcaagtgtgtctatgcccgttgtatgtgttattgtaattcataatgtaattaaatactatacacattgatgaacaggccaggtgagatggctcacccttgtaatcctagcactttgcgaggccaaggtgggaggattgcttgagcccaggagtttgagaccaccctgggcaacatagtgagaccccatgtcaatgtaaaagaaaatttatctttaaaaaaaaataaattgatgaactgagagtgggaaaagcagcactgtttctataaaaactaagttggatccttagaagactcgactaaggtaagttactttttctttattattcttatgctttatcttccagtgatggaggaaagagtgagtttatttatttattgagacagggtcttgctctgttgctcaggctggagtgcagtggcacgatcacatcttactgcagcctcaaccccctgggctcaagcgatcttcccacctcagcctcccactaggagtacaggtgcaccaccatgccaggctaattaaaaaaaatatatagagagagagacagggtctcactatgttgcccagactggtctcaaactcctgggctcaagccatcttcccgccttggtgtcccaaagtgttaggattacagatgtgagtcactgcacccagcctgtgagtcactttatttttttgtttgtttgtttatttatttattgagagggagtctcgctctgtctcccaggctggagtgcaatggcgtgatctcggctcactgcaacctccaccttccgggttcaagtggttctcctacctcagcctcccgagtagctgggattacaggtgcaagccaccaagcccggctaatttttgtattttcagtagagatagggtttcgccatgttggccaggctggtctcaaactcctggcctcaggtgatccgcctgcctcggtcttccaaagtgttagggttacaggtgtgagccactgcggctggcctctgtgagttactttaaaaagctaccgtgggctgggcacagtagcttatgcctgtaatcccagcactttgggaggccaaggtggatggatcacttgaggccaggagtttgagaccggcctggccaacatggcgaaaccctgtctgtactaaaaatacaaaaaatcagtggggcatggtggtgcatgcctgtaatctcagctacttgggagcctgaggcaggataattcacttgaaactggaaggtggaggttgcagtgagccaagatcatgccactgcactccagcctaggcaacagagtgagactctgcctcaaaagaaaagataaaagctgctatgcaattagatgtgagcaacaagattattacaaattgggggaataataataaaaatataaattctgcactcaagattgcttcaaacatgccattaactgtttcactttaaggaagcaaactggaaattgcgggtgatacataactggtgaggtttatgtaagaaagaagatgaggaatctaatcacaggctccatcctcaaagaaaagaccctggccacactttgacagatggaaaattaatgtattttttaaagttgaaataaaataatccactcctgatcatgtcagataagagaaagtagggaaggcaaaactttacctccactctcttagggtctctagctgggacagagaattaaattgacataaaacagattaacaagagaaaagcatacagatttacttaatataaattttatgtgacacaggagccctcataaagcaatgaagacccaaagaaggaaaacctaaatgttttgtactaggtcgaacaaagagccaattgtggaaaagcagctaaaatatatggggaggccagtcgcaggggctcacacctgtaatcccagcactttgggaggccaaggtgggtggatcagttgagcccaggagtttgagaccaacctgggcaacatggtgagaccccatctctacaaaaactacaaaaattagccaggtgtggtggtgtatgcctgtagtcccagctactagggaagctgaggcaggagaatcgctcgaacccaggagtcagaggttgcagtgagccgagatcatgccactgcactgcagcctgggtgaccgagtgagactctatctccaaaaaaataataaaaataaaatatatggggaggctaaaggaagataagagatattttaacaaggtctgtttgtacagaattctctcagcttcgactccctgtctctggtgataagaatgtttctttcctcctggaggaaggcattcattgttcacatgggagttttgtttcctgctttcaggaagaaaaggggaggttagagcactcttcttatacttaccgtttttctttttcttttcttttttttttgggggggggggatggagtctggctctgtcgcccagactggagtgcagtggcatgatcttggcacactgcaacctcctcttcccagattcaagcgattctcctgcctcagcctcctgagtagctggggttacaggcgctcgccacccacgccctgctaattttttttgtatttttagtagagatggggtttcaccatgttggccaggctggtctcgaactcctgacatcaggtgatccacctgccttggcctcccaaagtgttgggattacaggtgtgagccagtgcatccagccctaatttttgtatttttagtagaggtggtgtttcaccatgttggccaggctggtctcgaactcctgacatcaggtgatccacctgccttggcctcccaaagtgttgggattacaggtgtgagccagtgcatccagccctaatttttgtatttttagtagaggtggtgtttcaccatgttggccaggctggtcttgaactcctgacctcaaatgatccactcaccttggcctcccaaactgctgggattacaggcgtgagccactgtgccctgccaagacctcgcttctacaaaaaatatgaaaattagtcgggtgtggtggcacgtgcctgtagtcccagttactggggaggctgaggctggaggatcacttgatcccagaggtccaggctgcagtgagccatgatcaggcggctgcactgcagcctgagtgacagagcgagaccctgtctaaaaaacaaaaaaaaaccttccctttacctgtgtcttagcttgggctatcataataaaatatcatagattggatgctcaagcaacaaattaatttcctgacagttatggggactggaagtcagattagggttccagtatggtgacagagaggaggggcagtgagaggaagaaagtcttataagggcactaattctaccagttcagggactacctcttatatcccaactaatgctaatcccaaccaccctgtctccgaataccattacactgggggttagggcttcaacatatgaatttgtgagggaggaagggaagggaacacaaacattgaatccatagcagtctggataattatctttatcttagtgccttgatggtaactggtttgttactctccaaccttttcccctaaccacgcaagagagtgtgtttgcattctcaaaaccactagcctaaactctactcctcctctcaagacttctagtgaaacatcatcgtgacctggagcctatggtttcaattacgttttaaaccatagcttacccaaactatttaaggataattttatatttccatagctattatctcagtaaaggggttaagcatgactcgggaagtacagcatgataccctggtaaaacagaggtaggggaagctaatgtagtgtagagggggcctaagttacataggcttggtggtgtaaataagaacagtagcttaatttctataccacgccctctgcgacggtttgcaggcattagcacctatggaagtatgtactcgtttccctgttgtataggcgaaaaactgacaccagcagttcccacattcactcagccactaagcagtggggcaggaatcaaggctaactgctatgccatccatacacctttctgaaagagttacaaaatcagcacttattatcaaagggccgttgggagcaaggcatttcggcgtatctggaaatgtgtggcgatctgtaaacgctcctgaggagagctggaatcccaagtggaagggaagctggaccgggtgggaactgctccccagcccaagggctgctagaaccccaagactccagccccgagcggcttccggaatccgcgcgtgctggcccggcctcttcgggggcggggcgagcgccgcacatgcgccggggccgggccgggccgggggcgcgcgctctgcgagctggatgtccaggctgcgggcgctgctgggcctcgggctgctggttgcgggctcgcgcgtgccgcggatcaaaagccagaccatcgcctgtcgctcgggacccacctggtggggaccgcagcggctgaactcgggtggccgctgggactcagaggtcatggcgagcacggtggtgaagtacctgaggtaggcacgggtctcgggtggcctgctctgccccggggcggggcctgggacggccgggccacctgcgcgacagagaacacgaggggcgggactcaggccgcgggttttcctcagccaggaggaggcccaggccgtggaccaggagctatttaacgaataccagttcagcgtggaccaacttatggaactggccgggctgagctgtgctacagccatcgccaaggtcagtggcacaactctcgacctttgggagcagccagggaggagtcactgtcccagccccctggcctaggcacaaaggggtgggagagacagctgggccaatatggtctattaccgcctgaaaccccgccgaaccacccttgactctgccttcaggcatatccccccacgtccatgtccaggagcccccctactgtcctggtcatctgtggcccggggaataatggaggagatggtctggtctgtgctcgacacctcaaactctttgtgagtatgtggggaggggctgtgggggaggagggcgtgagggctctgggatctggggttgaattaccactttcttcctagggctacgagccaaccatctattaccccaaaaggcctaacaagcccctcttcactgcattggtgacccagtgtcagaaaatggacatccctttccttggggaaatgcccgcagaggtaggtggctccagttgaatacctccatcctacagtaaccactgcctgtgctctgctcttccttcgtgtttccaggctgagctcattttagtgcctggtacggaaggtgcctaacggatggtattcgaataagtgtgcaagagccttctcctccttcataaagtgtgctccatgagtcccacacaccaccttctctaaagcttccttgccctttcatctccctggtccctccttccactctgtagtcagatcctcttgccctagcatgcagtaaacacatgatctacccctcaggggccggagtggctgccctatctgaaacccttcctgcagatgcatggattaagggatgggaaattgggtaatttttttccttaacccattttacagatgaagatactgaggtgcagagaagtggtttgcttaaagtcactaaattgtatcatggcagagctgaaaccagaatctggctctcctgactcgtctcaggctatctcagcctgtagcctccccagtggtgggcaggcaggcaggcaccgagaacaaaaactgtctggtctcaatttggcctgaatcagtgaccaactcacactttctctaggcctcaggctgccctctgaatgagacacaatacttgtgcctctgagaatggtctgcaggtgcagaggacagccctctccagttaaggctgtttgtgcagctgctggctctgacatccttttcctgctccaccacagcccatgacgattgatgaactgtatgagctggtggtggatgccatctttggcttcagcttcaagggcgatgttcgggaaccgttccacagcatcctgagtgtcctgaagggactcactgtgcccattgccagcatcgacattccctcaggtgctgggatccagaaggtggggtgggggagattggggccctaccctcctgactcttgcccacaccaggtctaaaataattttagtctagaggggcagaacacagctttctggacccccatcagggctggggaacagtgttcagaagtcccctttacatgttggccccatgaagagaccacggcccaagggtacgtggagctcgttggacgagagttcctcaggtgggaactgaggggacttcccactcctctgggactagggtaaactaaggtgtagaaggggacgagacatctggcctcttcctgaacaccaccctcttttcaggatgggacgtggagaagggaaatgctggagggatccagccagacttgctcatatccctcacagcccccaaaaaatctgcaacccagtttaccggtcgctaccattacctggggggtcgttttgtgccacctgctctggagaagaagtaccagctgaacctgccaccctaccctgacaccgagtgtgtctatcgtctgcagtgagggaaggtgggtgggtattcttcccaataaagacttagagcccctctcttccagaactgtggattcctgggagctcctctggcaataaaagtcagtgaatggtggaagtcagagaccaaccctggggattgggtgccatctctctaggggtaacacaaagggcaagaggttgctatggtatttggaaacaatgaaaatggactgttagatgccaagtgagttgtgctgtcctttacacaattcttattcatttgggacacagacagggagctacttctacttatcagtgtagcaagactacaaagaggttaaccgaaggaatttcttcaaaggcctccaaggaatatcttctaatttgtattcaggaccttcccaggctgggaacagagatgccagtcaggatttatctctaggctaggagcgcaagctcatgtttattcattcatttggtagcgctagaaactggcaactgtgggctaaatctagcccatagacctaaatttatgtttttcttaaccttcacaatatttagaaatcagagcacttcacataggtctacattttcagcttcttttagcaggaatgctccttcaaagggtatctgcattcctgttcccacagcccccagcattccttgtcctttagctgcctggcttctctaggcacctgagttcatggtcctgggttagaagctgcagaaaggactgtgctgactccctcaactaaggggtggtactaccgcttgctcctctcagcagctgacgtcccagagatcagtttcctttctgggagggactcctcattgaggggggtgcagaagacctgcagacctgcatcaaccctggtctttgaggcttcaactcctgaaaatcaatcaattgagccctacctttaccagacctttagtctctcttcttctgtttctttttggctttctggacagtgctgactccagctctttccttcttgggatgctgctgcctcttcctcttacctctgctgcttgagccagtgtgtgctctgctctctgcttccctagccccgccatccttctcatcccttacatccaagatgtcctcctcctcttgatgctgctgtcttttcttcttgcttttcctgcttcttccatcactgcatgctctgctctctgcttccctggttccaccacctaaaagtttcctcacctctatcttctaggttcaagtcctcctcctcctgttgctgcctcttctttcttcggctgcatgggtcagcatatgccctgctctctacctcctctgtcctgacactgcctgcagcctccttgccttttcctccttcctccaagacccccatcttctcctcttcatggtgccacctcttctttttcttccctttcctgagggactgattggtttgctctctgctattcaattccccaagcccacttgttcctgcagcgtcctccttctcattccctttagttgtaccctctctttcatctgagacctttccttcttgatgtcgccttttcttcttcttgctttttctgatgttctgctcagcatgttctgggtgcttctcatctgcatcattcctttcagatgctgtagcttcttcctcctctttctgcctccttttctttttcttttttttggggggcttgctctctgactgcagttgaggggccccagggtcctggcctttgagacgagccaggaaggcctgctcctgggcctctaggcgagcaagcttggccttcattgtgatcccaagacgggcagccctgaaacagacagggtccaagtcaaagcgagggtatcgggggaaatgggcctagtccttaagcctgcagggaaagttggtggagggtaggagtggggagctgcctatcttcaggcaatagatgggtaggtaataggaatcatttccctggggtaaaaagaaccaagaggtggcacaggccatggtcaaaggtggggagaaaagggagctcaaggagctgaccactacttacttgtgtgctgttcgcccctcacaggcttggagcagcatctcatcagtcagactgttaggggagatcagcagttacaaacagacctggtggaaaggcttgacctctcctccttctaaaacattccttcaacactgaattcttgttcaggacctggcactttttgaggtactagggatacaaagattagtacaacacagttccacccacccccaagaagcccccagtcaagcattagatttagccctttctcttgccatctgaagacatctcttcccacattccccaagagctaaaatgaagtctcacatctttggggacttggacccctggttgtcgtcatcactgcagctctccaagtctttgtttggcttctctccacctgaagtcaatgtagccatctaggaggggtcatgggggtagataaggccttctcaacaccatcaccatccctattcccttgtggaagccccctaagaatttatagctccaggcagtggtttgccagcccccaccattgctccttgaggagccacagggaggtgtgccatcctgcatactcgaacttggataggagatgggctgctgctgctgggatgtgcagcagctttggcctctctcacccacagctggctggtgagcagaacaagaagaggaaatgctctggttcatcaggtcttcacagtggacaagtgccagtgactgacagtaaagatgccccgctccaccccgaccatagtacctgttcacagtaccttcatttaatcagattaattgagagtctactatgggccaaggagttggggattcagagtggaataagaatgagatgggcccagcccagatggaatctacataggcaattatgatggaagtgttgcctgtgatagaggaagggtactcaactcagacttcagagaatggcttctaaaagtaactgatgtataagctgagctctggaggataagagaaactcagaaggtaaagggggaaagggagaagaatgtcccaagcagagggagcaacatgtgcaataacctgaagatggaagactgtcgtaccttcaaagaaaagaaacagattggaatctgttatgctaatggttaggctaaagtagtggtcctggagaaaagtgaagagatgaggctggagatggcaggaacaggcatgcagagccatataagccagtccgataaatctggattgtgtcatcctaggtcaaacaagacccagtgacatgatgacatttatgttttagagagaacactggatgctttgtggagaagtccatcctccacaaaggttggggtggggagtgagactacaggtgttcttaggaggctgctggagaaagaaattaggcaagagatgatgatggcccgaagtggggtagtagatggtaacagagatgtagagaaatgggaaagatttgctaggtaacatgtatagcccttagcacataatgaccattacatgttagcttcctcctattggtacagtagaaagtggaggcctgaagtcctgggttccagtcctgtttgccattactagccagctgtgggctcttcagcaaaccacttttcacccttttagccacatctgcaaagcagggatggtccagataatctctcaggtctcctctggcttctaagtcctttgaattagatgtcccctggcccccccaaaatttggcagctcctgacttaagagactgtaccctacctcccacgccctattgctgctcccttaacagatggcaggatccacggaacctgaagatctcaattcctgctgagggtctgggcagtctaagtaagcaacagcaaggctggtcacaggatcccactatgttaggaaagttctgagaattgataaggcatacaaggcaactgttcaggccccagggaaaccagggaagagaaaaaggatggactctgttacccacagcctctaataccttcacaaacttctgatacagcaagttgggcttgggatgattataacgggtggtctccttagaaaggctccttatctgtactccatcctgtagagaattatcagtaccagtgaatgggtgacatatcatgactgcctacgccacaggtcccaggccctctgtttcatgtgcccatctatcaagagctcatacctgcccagtttccactaccaagttggccgcagtcttgttgaagagctcattccaccagtggtttgtgaactccttggcagggtcatgtcctacctgccaggggaataaatatgagctctgagtgcctgcctcacctgccctcaagggtcccctctcccacacatgctaaccttcctcagtccacccagtcttaccccatgagtgtcttgcttcagtgtcaccctgagagcctgagtgataccattctccttccggccgaggcctttgcctgcagaggacagtgagcgatttggcttattctcctgcctgctgtgagacctcacaaggcaccccccacacaggcctcttgccattccacacacctgacattggggtatactctgtacctctcagaagacctcctagcgcacttctttctagtaccactccatatagtcccctgcctttgtgtgagcctgaactatctcttccttcaaattcttttggtagagagcccatatctctttttccctcccctagtcctcccaaccaccacttcttcattatccactgtcaaatttcttcctttcttcccttttctgggaaagttagaaattttcttctgcaaatttccctttaaactagcttttcctcctttaattaaatggactacatgggggggtaatccaggatgatggctttcccctgggcagatggtaggcagggagctgggggatgtggaagaggccccatggggatcaccttgagtccatccatgctttagcagctgctcctcagcaaacttcatcccacgactcttgacctctggggtgacattcatggtgagaaaaaagtctctatcctcagactctcaccagagaagaagaggtgatatcatccttttaagaagaaagtagaaagtgcccaaacagccatcagttccatcctgactgcttgttaagaattctctgctagttgggtgcagtggcacacacctgtagtcccagctacatgggaggctgaggcgggattgcttgagtccagcctgggcagtatagcaagaccctctctcataaaaagaataaagcggccaggcacagtggttcacatttgtaatcccagcactttggaaggccaaggtagaagaatcacttgagcccaggagttccagaccagtgtgggcaacgtagtgaaaccctgcctctagaaaaaataaaaaattaaaaagaaagaaaaaagaattctctttcctgagccagagacagaggaaggaggtggcctggtctttggggagctccctatctggctacagaaagagcatatagagaagtcaaggaggaatggtgtcaattctgatacctaagtttatggtgtgctcaccacatgccaggatgtgctaagactttacaaagattatttcatttaatcttcccagcccattcagggaaatattagcctattttacaaatgagtaaagtaaggcctaaaaaggttaagtgacttcaaggtcacacaggtaacatgtagaattcaagcccaggcagcttgtctgcagaatctgtactgtaccactacatagtatctcccaaaatatattaccttgtaaacacaaagctaatgaggtgcttattaacctgagtcataagataatggtactcggtagagaccagatcctgtacttatgcttcagcatttacactgtcctcttggtgtgggggctacacacttctcccacaccactgcagtatttcagtctggctggagttccccttttgaaagtgtccaacttaggaagggcactcctattgagcacttaatgcataacaggtggattacacatattgccacactgtcatattaactcagtcaatcttttttttttttttttttttgagacagggttgctctgtcgcccaggctggatggagtggagtgcagtggcacgatcatggctcattgcagcctcaaacttccaggctcaagcaatcctcccacctcagcctcccaagtagctaggaccacaggcacatgccaccacgcctggctaatttttgtatttttttttgtacagacagggttttgccatgttgcccaggctggtctctaactcctgggctcaagcgatctgcctacctctgctttccaaaatgctgggattacaggcgtgagccactatgtgtgggcttaactcatttaatcttgatagtcctgtgagatagatattattcttattttacaaatgaagaaaacaaggcctgggtttcttgcctaaggttacatggctagtaaatgatggagctggaattacatgatggaggtggaatgagcccaagtcgcctgactccaaagtggtcctctgtctttcttttttttttcttttttgatacggagtctcactctgtcacccagtctggagtacagtggtgcgatcttggctcactgcaacctccacctcccagcttcaagcgattctcctgtctcagcctccgagtagctgggactacaaggctcatgccaccatgcccggctaatttttgtatttttagtagagatagggtttccccatattggccaggggctggtctcgaactcctgacctctggtgatccacctgactcgacctaccaaagtgctgggattacaggcgtgagccaaggcacccggccaaaaactgatgttcttcatcactacactcttcagtctcttacagctctttgtgctttctcctgtaagaccacacacagcctaacccttgtcgcaataattgaaaactacatgccctggaagttaagagaccggctttattccgccactccagagcacgtaacgcggcgccagaactcaagaatacattcagtcgttatttgttgaactgaatggcatagttaggaatggctttaccggattttcagtggataactgggtagaagctgtgcgccccagtctttctgaaacctgtgatcacacttcgggcactgtcccctctacagtcaatctgtgttttcagaagtggccccaggttcactcgtcttacagcagtcctaaagagccggctgccctttccctaggcttccttgctcttgagggctaaattccagccctcctaccccagtgccacttgggtaaaaatactctgctcctctcacgtttgctaataagcccgggctccgactaccaccgttcgggggaagggagccccttaccgtcattgctgggtccgctccgcggaaacatgtgccggacctgacttgtgcgccgccatcttcccggaaatgccgttttgttccttctaggctgtcgaaaccatagagacgtccgcgggaaccaaaatcacggtttttccaggagaaaccattgcggagcccaatttgccggtatggttgccatagaaactgggacctggagcgtgcccattttcggaggttccgaggctgttccacttgcctcatccctgcaatccttgagcagccaagggacttcagtactaactggccctctcaggatgccaagaacggctccgcgtcctacactgagctagtcccgggcgcaaatacgaggaaggaaaactccagggaagcattgagagtagcctgagaaattcgtggaggcagagtaggtgatagctgtgtcctgatttttcagggttgaatactcatgaatactcagccttcacaggaacagttatttatgaaagcctagagactagacatctcaataggttcatcaagcactttttttttttttctgagacagggtctcgctctgttgcccagacttgagggcagtggcgcgatatcgactcactcactgtaacctccgcctcctgggctcaagtgatcctcccatctcagcctcgtgagtatctggtaccacagtcatgcaccgccacgcctggctaatttctgtattttttttgtagagaaggggtcttgccatgttgtacaggctggtctccaatccctggccttaagtgatatgcacacctcggcttcccaaagtgttgggattacaggcgtaagccaccgtgaccggcctcatcaaacactttttgactcaccattgtgtgccagaacttgtccctttggtactgggggataaaaagacgcataagacacaggtcttgatttaggggaacacccagtctagcctgggaaacttgggaccttgagtgggattagatggaggacatgccagtgggacttggagaaagatacaggatgggtgagacgcggtggctcatgcctgtaatcccagcactttgggaggccaagacaggcagatagcttgagcccagaagttcaagaccagcctgggcaaaatggcgagacaccgactaaaaataccaaaaaaaaaaaaaaaaaaaaaaaaaagccgggcatggtggtgcacgcctgtgggtcccagctactgaggtgggaggatcccttcagcccgctgtgggagtgaggggagggcggaggttgcagtgagccagaaaaaaaaaaagcaggatcccagaatgcatgccaggctgaggagtttggacttgccctgtcggtatgaggatgtattgagcaaaggagggaaagaagatacagcaaaagggactgcacatgcccctacccctgcaagctgttccttggcctcactgagccacccaagaactaaaacccgagaaaagtatccttttctgcctccccatatcggtatttccgttgacttagcgccccctagaaacttccaaacagaaaaatcgccatttcacaggagagccttgtcataattgccctgtatgtcatacccattcatccccataattttttccataaaattaattttactttcaaaacatgctacatggggacaatactttaaacgatcgatcttaattactggaattttagacacttgcagaagggatgtgggatgcttcaaaggcattccttagagatggattcaacagagaaacattttgtggagagacatctgactccttttcccattctgccactcattgtgtgaccttgaacaattttttttttttttgagatggggtttccctgtgtttcccaggctggccttggactcctgggctcaaatgatcctcctgcctcagcctcccaagtagctgggagtacgggtgcatgccactgtgccggggcaaacttgagtttcgctgcagtgtcctgcagccactgagaaaattccacagacagggcttcaatttccacccacccccacctctccatctcttctaccccttctatctaaaatatatgtgtgtgtgtattatatacaaaattgtatgttatatagaatatttcatatatgtgtgtatgtatgtacatatacatatacaggtatatatatgaaatatataagaagttttaaaattccgaatgaggtaaccctcaaggaccctttccaacttagagttttagtgtgatgcactttgccagccactcccaaaacttaatggccataaatctttgaatcaagattcctagtctggcctaagtctttgagctcactgttgtgcctgattcactcattcaataaatatttattaaaggtctcctatatactaagggctagaggtataaaaaggtccatctcttgtcctgttaggcctcacgatcttgtgggggtttaaactagttaccaggcatttatatcattgagtaataagagttatggcaaggtcaggacacagtgctatggggataagatgagaagcatctgacccagtctgagacccctgggagcttcttgaagaagtcactgaggctgcagcctgtccctgggggctatgagagatcacaagagaaatgggtctcaaggagttcgcagtttaatggggtctcatacctcctcacaagggtagaaacaaaggccattatgagagaaaaagaatacatgaatacttataaggaaatggcctgaaatgcagataacaagatgcatagaaatatttattacagtaatatttataaaatggaaaaattggaaagaatcaaaatatctcacaacaggagaaagtctacataaattacagtgtaaacatacaatggactaatgtgtagtcttcaacaatgatgttgaagaattcttttttttttctttttttttttgagacagagtctctatcgccaggctggagtgcagtggcacgatcttggttcactgcaacctccacctcctaggttcaagcgattctgcctcagccacctgagtagctgggactacaggtgcgtgccaccacgcccagctaatttttgtattttcagtagagatggggtttcaccatgttggccaggatggtctcgatctcttgacctcatgatctgcctgccttggcctcccaaagtactgggattaaaggcggagccaccgtgcccggccaaagaattcttaatagcttgggtacatgtctgtgatataattgaaatgaaaaaagaagatacaaaatgttacctacagtaagaacctatctatgttaaaaattcataggcaataggatcaaaagtaataaaatacttaggaatacatttaacaaaagatgtgcaagctttatacattgaagctacaaaacctcattgaaagaaattaggaagagctaaataaatggaaagataccctgtgttcatggaatagaagacaatattgttaagatgacaatactctccaaattgatctataaattcaacacaatctctataaaaaatcccagctggcttttttttttttttgcataaatcaacaagtccatcctagaagtcatatagaaatgcaaaggaccagctgggagcagtggctcacacctgtaatcccagcactttgggaggccgaggtgggaggatcatttgaggtcaggagttcgagaccagcctggccaatatggtgaaaccccgtctctactaaaactacaaaaattaaccaggtgtggtagcacgaatctgtaataccagctatttgggaggctgaggcacgaggatcgcttgaacctgggaagtggaggttgcagtgagccgagatcacaccactgcactccagcctgtacgatagggtgagactccgtctgaaaaagaaaaaaaaagagagagaaaagaaaagaatagaaatgtaggccgggcatggtggctcacgcctgtaatcctagcactttgcgaggccgacatggtcagattacctgaggttgggagttcaagaccagcctggctaacatggtgaaaccctgtctctaataaaaaaaaaaaatacaaaaaattagccgggtgcagtgacgtgcacctgtaatcccagctactctggaggctgggcaggagaatctcttgaacccgggaggcagagtttttggtgagctgagatcatgccactgcactccagcctgggctacagagcgagacttggtctcaaaaaaaaaaaaaaaaaaaaaaagcaaagggcccagaatagccataacaatctttaaaaggaagaaagttgtaggacttacacttcctgatttcaaaacttactacaaagctacagactgtggggttttcaaagaggatagacatatagatcaatgtaatggaattgagaatccagaaataaacccatacgcttatgggcaattgattttgcacgagagtgccaaaacagttcaatggagaaagaatagtcttttcaacaaatggtgttggccgggcatggtggctcaagcctataatcccagcattttgggaggccaaggcaggaggatcacttgagctcaggagtttgagactagcctgggcaacatagtgagacatcgtctctactaaaaataaaaattaggctgggcatggtggctcacgcctgtaatcctaacacttcgggaggccaaggtgggtggatcacctgaggtcaggagttcgagaccagcctggccaacatggcgaaatcccgtcttagccagcatggtggcaggcgcctataatcccagctactcaggaggcagaggccagagaatcgcttgaacccgggaggcggaggttgcagtgagccaagactgcgccacttcactccagcctgggcaaaacagcgaaactccatctcaaaaaaaaaattaaaaattaaaattaaaaattaactgaatgtggcggcccacgcccatagtcccagctacttgggaggctgaggtgggagaattgcttggagcctgagctgtggttgtgccactgtgcttcagcttgggtgacagagtgagactctgtctaaaaaaaaaaaaaaaaaaaaaaaaggaaagaatcctgtgaagtcaatttagcatgaagccctccactttttttttttttgacagagtttttctgtgttgctcaggctggagtgcagtggcgtgatcatggctccctgaagcctcaatctcctggactcaagcaatcctctcacctcagcctcccaagtagctggggccacaggagtggcacaccatacctggctaatttttgtattttttgtagagacagggtttcaccatgttgcccagactggcctccaactcctgggctcaagcattcctcctgcctcggcctcccaaagtgctgggattacaggagtgagccaccgcgcccagcctaagcccccttctcttgatacctgatcacccttgatatctgatcaggttcctcatccttcaccatccatcaggtgatatctgattacctcagcctgtctttggcaagaatcttgtaaggttttaatgcaaatcccctttacccctggtgttttttcataataatttcccatctcctaacccccaccctgcacctcagttataaattcctcagttatacttcccatgctgtattgagagttgagcccaatttctctttctcccccactgcaaaatcccattgtcatggtccctatacctatcacaatggtcctgaataaagtctgccttaccatgctttgacaagtgtcatcgaataatttttttctttaacaagatattttcccttcatttaaaattgtctacaattaatgtattattttttcaggaaagtgattttaaaataacaaatggttttgggaggccgaggtgggtgaaagacctgaggtcaggagttcaagaccagcctggccaacatggcaaaaccccatctctactaaaaatacaaaaattagccaggcatggtggcacgcacctgtaatcccagccactcgggaggctgaggcaggggaatcgcttgaactcaggaggtggaggttgtagtgagccgagattgtgacactgcactccagtctgggtgacagagcaagactctgtctcaaaaaaaaaagagaaatggttacaaatgagagcccctgagtgctgagggaggtggggcagaggtgaggtgcatatgactggccccaggggaagaccttcaggaggaagtatgtgtggtccctgagactgactaccaaaccttgaatgcctctctaaattcctggagcagaattgaatcctaaaaattaaggcactgtgttatttttctatactgggtttaaatctacacatagtgttataaaagtcaggccaagccagcatctccccatgattcataaactagtacacaatttatcttcctccacttcttcccagttattttttctgtcagtaaaccctgagactgaggaaagagaaaatatgttgtggttgcaatgagtgtgggatttttaaaaaaaatctatatagcaaatactggcaatgcttacctattcgaatattattcacttttctttctgttgaggaaaaaaaaaaggtgagcctgtgtctcacaggattcaatccttagcctaggcaggttctaattttctgacttcattaaccctttgagttcatgataataaagatattatgatcccttgccaacagtactttactatttaaaataattttcacacggtggtttacagtttagaatatcatgttcacaaacattaccatatttgagtctcactgtaatattgcccagatttgtgcttacctacaaataggggccgacagagcacagagagagatggaatgagacgtgctctcagcactatcactgctgctctctgatgccatctagtgcaggttcagctgaacacttatttctatttaaagccctattgccatctgccccttggtgtcatcattctctccgatctggatgaagccctgtctctgacctgcatccctgtccctctgggtcttgtctctgcctttccctggcctcattgtctcctttaaaaccttcagtgtgtgtaaatgctggtcatggtgtaggtgaaggatgccaagaagggaggcagggtatagcagggcccttttcttttcttttctttcctttctttcttccttcctttccttacttttttttttaaagacagagtcgcactctgtcacccaggctggagtgcagtgacatgatcttagctcactgcaacctccgctacccaggttcaagtgattcttctgcctcagcctcccgagcagctgggattataggtgtctaccaccacacttggctaatttttgtgtttttagtagagacggggtttcaccatcttggccaggctgatcttgaactcttgacctcgtgatccacccgccctctttcttttgcagtgcttgctgcgcttctagagttctcctagagggtgcaggtttcaaggtagcagacacacccatttgggttgcttttttatgtttttcatacgacatatttccagatacatcagtaaagatgctgtggaaaaatttctgaaaggggcagtatagaaaacaccaacaccagtgggagtagagctgggaaggaggaccgtgatggtaagaacaccaaggaatcccagccttattcattctcccttcgaacaagagcttagctgaacacaggaaaaacagaggtctgaagcgctgagtctgaaggatgcccccagagctttgagggctctgctgtagcatctttatctttgagcatcctccaccacggacacctggtgatcccctaaacatgcacaggacctgagccaggtgcagcgcccagaacgctgcaggggccctcagcactggggatacagccttcctgccccacctgctggctctctgccttattacatgttaccatttcaatcatggctaaatatattcatacacatcttatatgaatgtatataaatgccttgaaagattgcaaagacaacaaaagattaaaagtcattttctctatgtggtaggattaagggggcttttcactttttaatgttgttatgtttgttaaattatctacaattaagtgcatcattgtgtaatcagtaaaaaattaatccaagtagtcttccaattaaaaaattattattctatgattcatcctggcattttgatggccttatttttacatttatatttttgagccttctggattttagtttaaggacagttatagatctgctgttttctttttccagataactagttgttgcgacctttagcaacctaaatgtccatcaataggcatctcattaaataaattatgctccatacggacacaaataaaggaacaatagacaccaggcctacttgagggaggagggtgggaggagggtgaggattgaaaacctacctatcaggtactacgcttactacctgggtgacaaaataatctatacaccaaacccccacaacatgcaattttcctatagaacaaacctgcacatgtacccctgaacataaaataaaagttaaaaaacaaatacaggctgggcgcagtggctcacgcctgtaatcccagcactttgggaggtcgaggtgggcggatcatgaggtcaggagatggagaccgtcttgaccaacatggtgaaaccccgtctctactaaaatataaaaaattagctgggtgtggtggcacgtgcctgtaatcccaggtccttgggaggctgaggcagtgaaatcgcttgaacccaggaggtggaggttccaatgagctgaggtcgcaccactgcacttcagcctggtgacagagcaagactccatctcaaaaaaacaaaaacaaacaaacaaataatgctacagccacccactgaaatactatgcagacatgaaaaatgagagaatttgatgtcatgtgctgataggacaaatgctcacatcatattattcggtggaaaagcaaagtaggaggccaggcgcggtggcttacgcctgtaatcccagcactttgggaggccaaggcagacggatcacctgaggccaggagttcaagaccagcttgaccaacatggagaaaccccgtgtctactaaaaatacaaaaaaattagccaggcatggtggcgggagactgtaatcccagctactcgggaggctaaggcaggagaatcgcttgaaccaggaaggcggaggttgcagtgagccgagatcgcgccattgcactccagcctgggcaacaagagcaaaactccgtctcaaaaaaaaaaaagaaaagaaaaaaagaaaagtaggaaacggtttgtatatcatgatctcaggttagaatatatgtatgatgtatgtttccatttatctaccttcctgtagattcttaaatatttttctggaaagatacagcagaaggctaataatggttcagttgttcctgggggcggtgagaagaaagaaagaaaaaaggaaaggaaaattttacttttcattttattcctttgatagtggttgaattatttttcaatatgtaatgatattacttttgtttcataacaaacataaaaatcataagtggaacatgactttcatgtgtgtatggattttatgtcctcttaaaaattaggtggccaaacatggtggctcacacctgtaatcccagcactttgggaggccaaggtgggtgggtcccttgagcctaggagtttgagagcagcctgggcaacctggtgaatccccatctctacagaaaaatacaaaaatcagctaggcatggtggtacacgcctgtaatcctagcgactcaggaggctaaggcgggaggatcagagaggtcgaggctgcagtgagctatgatcgcaccactgccctccagcctgggccagagtgagaccctaaaaaaaaaaaaaaaaggccaggggcagtggctcacgtctgtaatcccagcactttgggaggccgaggcaggcagatcccttgaggtcaggagttcaagaccagcctggccaacatggggaaaccctgtctctactaaaaatacaaaaaatagccaggcgtggtcatgcgcgcctgtaatcccagctacttgggaggctgaggcactagaat

SEQ ID NO: 437 - DNA, 113611 bp, Homo sapiens
ggccacctccccagacacctcctgagtgcagtcttgaggttctctccacaccattcacctttgaactttgctgcactcatcacaatatttaattaatctagaaaacctatttgtggtttacaatttattttcttcactagattatgaactcttcaaggacagggactgtctgcctcattcccagttgactagaacagtgtttggcacaaggcagatgcttggtaaatattctcaaacaattaaataaattatttcatcacagcacttttatttgttggggtgtttgcccatgtgcagtctctatgctatgcctttaaaattcttaggtcctggttatgttggaggaaacctctcgtatgatgctaatgtttccttccctgaaagggtctcctgagctggcattggctttccggttagcccagttccactaatacccactgactgtggagctttggtgtgtaggctttggagtcagaaagacctgggtttgaatcctggcctggccatttgctagccatgacttcaggcaagttattaaccttcccaaaccttagtttcctcatctgtaaaacaaggacaataacatctacttcatagggtattctggttgcacagagtaaaagtgatactatgtgtaaaacagcatactggctgacatactgtaaatgctacaattgttaatattatttcctcaggtcctgctgagcacctggttctataataaccactacacaaagaagaacaagataatcccctgatctagataagaaatggcttaagcaccagacctgggtgtgagggtgaggaaacctggccttcagacctcaaatcttggagcagagtctcttggtaagagcaagagtctaaaaactggggatccaggctacaggcaggggaggctggagcagcccctgagctgcagattcctttaataaattcttgagacagatatagtgggagggcggtgtggagacctggtcagatgctattctcaaggagttcgggatcttttaaaggagactaacatgtaagcaaacaataacataaacagggataggcgtatgggcagagtacagaggaagcacagagaagagaatgactaattgccaggggctgggtggagggtgtggtaggtgtggaggaaccaaggaaaacttcagagaagaaaagcccaggatgatttgggaggatgagatggaatttagtgggggtggagactgggggaaggtgaggtgggggtggagggttgggacataaaatgaagaaatgaaacagaatggtatgtttgggtgtctttaaggttctgtaatgattagggttttatctggactgtctgggtggatgggctaagctggaggggcattttggaatactcctccagtggcccagtccttcaacagccctggcccatatttctttgcagagcatgggtcccactctgcagcatgaagcaggcgaccatggtctctgggccccccaccactccccattctcctcgtctggatgggctctgtagggatgctggttttggagtcttccagacctccactatttgccagttgtggggtactgagaaaataatctgaattttctaaatctcagcttcctgatttgtaagacaggggtaaaacttgtgcacaccctgaaagggctgttgtaataaggaaattaaataattcatataaaagatctagtgcagagactgctacataacatagagccaatgtacatttgcaagcatctcttattcatttgttcattcattcattcatttgcacatgccttagttcgccatttctccagtgcctatgatgtgtcagaccttggggacgcaggggtgaacaagacccagcccccatctatgagaagcctgtattgagtgtgtaggggagagcagatgaagaggtggtcactgtactgtgtgacaggctatggcagaggcatgcacagcactggtgggagctcagaggaagggcacaaccatgatgatgactaaatgttgaggagtgaccccagttcccagaagacaaatcaggaccagctctaaaagtcaagtcaagaccattagtccttaccctaaaggccatagaaaactattgaaaactctcaagcagtggagagacctggtcctgtctgcaatcggtaaggtcattctagcaccagtcagagcagtagagaagccacagggctccaggtggggaataacaagttactatcaagggactagggaccctagtgaggtttgagagccatgatttactgtagcagggcagggagagtgctgggctgatggaagcttgcagtcacggtttgggatatcagaagtcttttaaggagaattcaatgtatttctcaaaaaaggaaaacattaaagaatgggagaatcaattttgtccctcccattttacttatttttaaaaatgacacttcagctaaggctaggtagaatattattcatctgaattgacttctcccagatctagctaagataattttttatttaaatagcctgtatataaataaattggggaaatgacaccctatccattcaatggtgctgggaaaactggaaagccacatgtagaagaatgaaactggatcttcatctctcaccttatataaaaatcaactcaagatggatcaaagacttaaatctaagacctgaaaccataaaaattctagaagataacattggaaaaactcttctagacattggcttaggcaaagaattcatgaataagaccccaaaagcaagagcaacgaaaacaaaagtaaacaaatgggacctaatgaaactaaaaaacttctgcacaaaaaagtaaataatcagcagaataaacagacaacccacagaatgggagaaaatatttttaatctatgcatctgtcaaaggactaatgtctagaatctacaaggaagtcaaacaaatcagcaaggtaaaaccaaataatcctatcaaaaagagggcaaagaacatgaatagataattctgaaaagaagagatacagacagccaacaaacatatgaaaaagtgctctacctcactaattaccagggaaatgcaaattaaaaccacagtgagataccaccttactcctgcaagaatggccataattaaaaagttaaaaaaaaaagatgctggtgtgaatgtggtaaaagaacatttatacactgctgataggaatgtaaattagtacaacctctacggaaaacagaaaggaaattccttaaagaactaaaagcagagccaccatttgatccagcaatctcactactgggtatctacccagaggaaaagaaatcattatgtgaaaaagacacaggtgtatgcatatttagagcagtgcaattcacaattgcaaagatatggaaccaacctaagtgtgcatcaactgagtggttaaagaaagtgtggtgtatatacaccatggaatactactcagccataaaaaggaatgaagtaatgtcttttgcagcaacttgggtagcgctggaggccattattctcagtgaagtaactcaggaatggaaaaccaaatacagtgtgttctcacttataagtgggagctagcctatgagatgcaaaaacataagaatgatataatggacttagggaattggggccagaaggttgggaggaaggtgagaaataaaagactacatattcagtacagtgtgcactgcttgggtgatgggtgcagtaaaatctcagaaatcaccactaaaaacatatccttgtaaccaaaaaacacctgtacccccaaaactgttgaaataaaaatagaagttaattaaaaaatatagcccatacaggcccaccttgtcctatcaacattaacaggagtttggaagaagttgattcaaaccctcatggatgactttgagaggttcaagacttcaatggtggaagtaactgcagatgtggtggaaatagcaagtgaacttcatgtcattgcacttcacagatactgggccttttggaaattgaaggtttgaggcaaccctgcatcaagcatgagctgacagaagtttgcagtcagagttggggatctctcaaaatgtatttctcagtctatttgtgccatatttccaacagcatgtgcttacttcatatctctgtgtcacattttggtaattctcataatattttaaacttttcattactattatatctgttatggtgatctgtgatcagtaatcttcgatgttaccactgtaattgtttgggggcaccacaagccatgctcatatacaacagcaaacttaattgataaatgcgtgtgtgatgactgctccactattgggaacaggcccccaaatctggccataaactggccccaaaactgcccataaataaaatctttgcagcactgtgacatgttcgtgatggccatgatgcccatgctggaaggttgtgggtttaccagaatgagggcaaggaacacctggcccacccagggcagaaagctgcttaaaggcattcttaaaccacaaataatagcatgagtgatctgtgccttaaggacatgctcctgctgcagataactagccagacccatccctttactttggcccatccctctatttcccataaggaatacttttagttaacctataatctatagaaacaatgcttatcactggcttgctatcaataaatatgtgggtaaatctctgttcaaggctctcagctctgaaagttatgagacccctgatttcccactccacactctatatttctgtgtgtgtgcctttaattcctctagcaccactgagttagcatctccacgaccgagctggtcttggcactccactgactgccattctcccatcactttctctccttgggcgtctctattcccagagacacaacaatgtcgaaattaggccaatttaataactctacaaagccctctacctgttcaagagaaagagtcacacatctcttattttaaatcaaaagctagaaatgattaaacatcgtgagaaagtcatggtgaaagttgagacaggctgaaagctaggcctcttgtgcccaacagttagcaaagttgcaaatgcaagaaatgttcttgaaggaaattaaaagtgctacttcagtgaacacacggatgctaagaaagtgaaatagccttattgatgatatggagaaagttttagctatctgggtagaagaccaaatcagccacaacattcctttaagccaaagcccaattcagagtgaggccctaactcttttcaattctttgaagactgagagagatgaagaagtagtagaagaaaagtctgaagctagcagaggttgattcatgagggttaaggaaagaagccatctccataacacagaagtgaagatgaggcagtgagtgctgatggagaagcggcagtaagttttctgaaaggtctagctaagataactgatgaaggtgactacactaaacaatacatttttttttctttcttttcttttcttttttttttttctttctttgagacagggtctcactctgcctcccaggctgggtgcagtggcaggatctcagcttactgcaatctcagcctcctgggttcaagtgattctcccagctcagcctctggagtagctgagattataggcatgtgccaccacgcttggcgaatttttgtattttttggtagagatgggtttcactgtgttggccaggctggtctcaaactcctgacttcaagtgatctgcctaccttggcttccgaaagtgctgagattataggcatgagccaccacactaggccaataaattttcaatgtagaccaaacatccttatagtagaagaggacaagtcgatgcctggctttaaagcttcaaaggataggctcactcttgtttttgtttgtttttacaagatggggtcttgccgtcttgcccaggctggtctcaaactcctgcactcaagtgatcctcccacctcagcctcccaaggtgctgggattacaggcatgagccattgtgcctggcccaaggataggctaactatcctagcagatgctaatgcagctggtgactttaagttgaagccagtgctcatttaccattccaaatgtcccaggacccttaagaattatgcacagtctactctgtctatactccctagatggaataataatgtctggacaacagtacatctgtttgcagcatggtttactgaatattttaagtccagggctgagacttactgctaagaaaaaaaaattctttcaaaatattactgctcattaacaacgcacctagtgacccaagagctctgacggaaatgtataatgaaatgaatgttgttttcatgtctgctaacacaacatccattccgtatgtcatagatcaaggagtaactgaatttcaatcttattacttgagaaatacctttcttgaggctataggtgccatagatagtgattcctctgatgaatctgggcaaagtaaattgaaaaccttctggaaataattcaccattctaaatgctgttaagaatatttgtgattcatgagagaaggtcaaaatatcaacattgacaggagtttggaagaagctgattcaaaccctcatggatgactttgagaggttcaagacttcaatggaggaagtaactgcagatgtggtggaagcagcaagtgaactacaattagaagtggagcctgaagatgtgactgaattgttgcaatctcataataaaatttacatgaataaggtgttgcttcttatggatgaacaaagcaagtggtttcttgaaatggaatttactggtgaagatgctgtgaatattgtagaaatgacaacaaaggattcagcatattacataaacttagttgataaagcaggagcagggttgggaaaatttattccaattttgaaagaagttcttttattggtaaaatactattaaacagcatcatgggttatagagtaatctttcatgaaaggaaaccaaatgatgtgtcaaactattgttcttattttaagaagttgccacagccacctcaaccttcagtgaccaccatcctgattagtcagcagccatccacattgaggcaagaccctccacagcaaaaagactgactcactgaagactcaggtgattgttagcatttttaaacaataaggtatttttaaattaaggtgtgtacattttttagacataatgcaattgcacacacacttatagactgtaatattgtgtaaacataacttttttttttttttagatagggtctccttctgtcagtgaggctggagtgcagtggcatgatcttaacatactacagcctcgacctcttgggctcaaatgatccccccacctcagcctcctgagtagcggggactataggtgcaccccaccatgcttggctaatttttttgtattttttatggtgacaagttttgccatgttgcccaggctggtctcaaacttctggcctcaagtgatcctctcaccttggcctcccaaagtgctgggattacaggtgtgagccactgtacatggcctaagcataagttttatacgcactggaaaaccaaaaaatccatgtgattcgctttattttgatattcactttatcatggtggtctggaaccacacctgcaatatcttcaaggtgtgcctgtaccataatttcaataaaatgtgatttaacccagcattatctttctctgctattgatgcatgatgtcaaatttaccttatctgaaacctggtgaatgttttgaggaatggagtgaatatttagaactggccatctcacataataaatgcttgataaatgggtttcttgactttaaaaaaatgtctgactagtgttcaatggagttggaagtatttgctaacattattacttacacaggttacttaatcaaattttaaacattgtcaaacatatcttgtatgtaactgtgggtttttaaaaatgagtgttgatatgataattcacaggtttcctaataaaatttagacactgtcaaacacattgggcgtggaactgtcgcttttctgaaatgagtgtcacaggaacactgcattgtctcataccagtttattttctttagctcctatggcattccaatgctctttgagtaacacctttattgtcctaggataaggaagaatttaagagagctttccagaaccctatttcattgtttttaataaattctttcccacttttggccctctgtaagcaagttctctgctacaaatagattaaatgcgttgacttcatctgctatagtgactcagatttcttgacctgatctattctgcagatctagtttttgaatcagaagttaggtaatgccttctcctgggttttaattatatgcgttcagtatcttgggtaagaaagttaactcttttgtctttttgagctgtatcacttatacctttttttttctcctgtccaaaaaggggggaatatgtcctaataacgtctttgatacgcccaaaatagccagcttctctgggatgtaagcaacaagatatttggtttgggacatttccaaattccacaaccttttttttttttttttttttttttttttttttttttgtgagacagagtctcgctctatcatccaggctagagtgcagttgtgagatcttggctcactgcaacctttgcctccagggttcaagagattctcctgccccagcctccctagtagctgggactacaggcatgcaccaacatgcccgggttatttttgtatttttagtagagacagggtttcaccatattcggcaggctggtctcgaactcctgacctcaggtgatccacccacctcggcctcccaaagtgctgagattataggcattagccactgcgcctggccagattccccatactttgaactccctacttcttctgaggccaacctcaggcctaccacgtaagtcctcctctatagtgtccgttgaagtgccagactcatacgaagctcccaaactcatgttgaagaggagattttagctaaatggaaatgtgctgtggcaattattctaccagtgtccttgatacaacaaacaaatcagtaaatcaaagttgtaaagagcctggctatgaaacaggatactcagtatgtattttattatttatttatttatttatttacttattttgagaaggaatcttgctcttgttgcccaggctggagtgcagtggcacaatcttggctcactgcaacctccacctcccaggttcaagcgattcttctgcctaagcctcccaagtaactgggattacaggcgcctgccactacgcccggctaatttttgtatttttagtacagacagggtttcaccatgttggccaggctggtctcaaactcgtgaccacaggtgatctgactgccttggcctcccaaattgctgggattacagacctgagccaccgtgcctggccttttattaattaagatgaatgctaatacaaactgtgctatgggacatttatagggtagctaccatttaaagaaaaagaattctcttacttgagactggtggaaggcatggcagataggactttggcaaagaatagtggaaagaaagttgaagactgcggggaaacacaagtctgtggatacacaggttgatacagtctctcttagagggcatgaatgggcaggaaggactttaacacttacttagtacctaccctatgctaggggctggggtaagcactttgcagacatcatcttttaaaaagttccttaagaatccctcaatccttcttctatagtctccagctcaatgatgttaagtgattcctccatgccactaaattggaaagtggtgggaactcacattcaaacccaggtctgaccaacttcaaaggccaggaggctgtttccttcattccatggctgctccctcaagagtaactgtgcatggggataagagtaactcttttccaaggttgatcaaggtctctttcaataccgagattctgggacacagattagaagacacagaagaatggcccagccttttccacccaaagacctgttactgaattttgtctccatgtgtctgaagggtacttccccatcatcattttcattcatcctaagaaaggcggctccctgtgtggaggtggtggccgcgaacattttggctgaactgagcagtcaaccttctcatttttgctggaaggatttgagagaatatgggggagatggtacacgagccagtggaggattagtggggttttatgttgttgtgatgaactttatgatgttagtttgtggtttcacatagcctcataaaacaagctggatggtgattatgtcacttcctctgccctcccgacagagaggaggccttctttagtgcctggagtgtttcctgatgctccactcaggccagctcacttttcagattttaatgtaagaggtgtggagaagaaaagaagaagaaggggtgggggaaagccatcggctcaagtagtcacactgtcatcctggctgacaaatgactgatgtcagagcatggtaccgaaacgtatagaaacaggcctgttggcttgggcaatacataaatgagccagtcacacatttctcggatggctggcaaaagttttgttgtcaaagcaacgcccccatcgagcttgctttgcttacgcaaggcctcagcctttgcctcttccccaaacccaagctacctgaggaggaggagctgagtgagggggagggaccaacagatttgtcccctgtgcaggctgcctgcctgcttgagttacatccacaaatgcctcggaagcagccagctggctgcatctttctcctcacattcctgggtctgtctgggctggttggcacagttaccagaacgtactacattgggattgtggaagaatactggaactatgtaccccaagggaagaatgttattactgggaaaagtttcacagaagacaagtgagtgaacttagggtcctcattgactcccaggtttggcctctttttgactttgtgtggggaaggttgtatttcttgggtacttacaatgggggtgagttgatctagaccaagagaaggtgttttgttttttgcttgaagagccctagtatggatgggtgtgtaatctggaagagatattcatagctccatgtatttgttgagccacctattaatagccttgcctgtgaagggacatatacacaaccaggtgtttgacaatttccaccaggtactactagtaacttctgggggattctgtttgtttgtttgtttttaaatgacaacacttgggatgaagatttgagaaatttcaagaattccttatggttaaaacacagtgttttcttagtttgtatttctggaatgaaacatcataatgggagataagtatgctaagtcatgtttttcaacgtttaaaagagggggaagtcacaggagatttgcctgctattttcagggtttccttgagtctacttagaattagcgctttcactggtaaaaagtttattccagctccaagtcattcttgctgagggcaatatcttatcccagaacctatagcatagctaggtgagatggcgccacggtgttctatgttcctgatttttaatttggggcagaaaataaccctttctccctgccccctccagggcctagtatcttaaccatctaatttgtttcatggatctccctctgaagtcacctcctgactccagaagatgtcatgctattttcaactttgtggttattagaacatcttttcagatgttttggcaacctctgttggatatttgaatgcttgcttcttttctgacaggcagaaccagttgcattctgcatccatgttccatttcctaaagatgagtttagttgataaaattcaggaacagcacagggcctaccagcaagtctttaagagccagggccccttgtctttgaggaaagaccaaagatccagttggcttggaaatacagcttccaagttttctaacaaaacaaaggtggtatagtcatgttttgtttaccaaagatgaagcctgtgccagacaagctgccaaggcagacttttccttaagctttgtacctggaaatgtaatgtctgcagggctatttccaaaggaaactcttgattgctttcaatcccacatctgctgaccattggtggtagtgtctttactgtgatgaatagctatgggattgaaagggtaccaaaaatgccaggagccttctctacaaatagagctctgctattctcagagagggctcagtaggaaacagtcaatgtgagcagctactggggataagaatgttgaaagtgtgtacactgagtgtaatgaatatagcgtttaagctaaatgtgatactggattgcctttccataagattaacacccacagaaattcttcttcctaaaatgcccacgtcactatagctgtgtatgggcatttattctgacccaaaaattctatgagggatttttcaattcattactgcttgcagatattattattctcattttatgaaccaggaaccaaggctctgaggttaaatacttgccggagtttataagtaagtggtagcaccaaactcattgctttggttccacagcccatatttcttttcaccacacaatctgtttcttggtaaaggtgatccttctccagtgaattaaaacaactttgagggaagccaaggatcacagtaataagaactttctagaaagtcctaatttttgccaaaggcatgtttagtctcttttgtcactcttcctagaagcatattgaaagggatcactggtggtcagtgaccaaacaagttatctgggttaattcaaaacctcaaagaatcataaatactcaagtactacaatgctgttttcacaaagtggggtgctggaagaagttggggtctctgttgatcatttcaaccagaagatggtgctttgatgaaagtacaataaaacatataaaaattgctatggtgaaaaagaaaataggcatgatgaaaacagttggtttggcatcagatttgagtgagatggtttcaaaatgcatggtcccatatgatagtgcgtttgttcttagaagcagctggcatgctaaggtgtcatacctagaacgccaaggtccccaaacatttctttctggtatgcgaagggacagagtttgtgtcagacagactgctacctcttggaagggaaatccaggtgagtatgcagtggacgttggcttttatcagtgatcccatcagaatactggtttttatcagtgatcccatcagtgctagtagttgtggtaggtggctcagacaagttcctaaaaaggtagggctgtcgtaggtggctgacattgcttgtggaccacaagatatccatcctgggtgtatgtgaagatgctgtgactgggacataagtggagttcagtgtgtgtactctgtgttgtgccatttccccaggagcaggaaggagccatcgtggatgatgtaatcatgcccctctctcagcctcctggagggtgaataggctgcctttctgaggacagtctgttgttttggatattcacacttgggcaaatgtctgatatttaaaggaccaggagagccaggtgctcagaattccaccatgaatggaaagaacctgaaatagaaatccagagacctaacttctaatgcttgctctgcccaacttgctgtgtaatcttgaacatgtcatataatctctctgaatatcactttccttaatttgtgtaagaagggagttgaaatgtaatccctagagtcacttgagaagtgtaatgccaaagcattagaaataattttgaaactgaatgaaaaatatctttcctgacttgccagttctagaaagatttttgcaatggtgaaagaaaggagagagatgatttgcaaatgttcagtcctagaaattagagttggagaagacctgggactgatcgtgggcatatgtgacaacttttgaagtagtctttatttttctttctccattttttcccctgtcctttaagaattatctccaattcctcacttcatacatgaagctttcccccatgaccctggcttgtactgatctgtttccttcctaaccactcatggagcttggggtctttatcatgaacttggacactgcattttcttccctctgcattgccctctaattgcttgatgtacattagtcatgtctgcaactgcagtaaaacaccctgatgatagataagaagttttggcgtatattcaataatcccccttccctgcacggaactttgtcattgacaatatcctatggaggatccagtacagggcaggcattcaaaatcattgaagtaaaagctaatcaccttatcaactgagttgttctggttgttttatctttgaataaggggaatgggcaaaaatctggggaacaagatggtgggtgccaaagtttcagtaatgtgaaaacatttggaaaccaaagttaggcacatccttatgcacaaggacgagatcgaaaatgaattgaaatcattttgctgagactctatagccctcagatggtgcaaattaacttttatgcttggtacctatgcttgattatagggttcaaaaatataattgagtctataatcactaatgtttcctagaaagtataggatttaggagttagattctatttagaaatactttctccagataaatatacttctcctcctccttggagtaaatggggacactgggctcctttgagttgcctggggatggtgtcagtattttgatctatttataccagtcctgctcaggctcataaagtccttaattaaggtgtgtgtttggtggtaaagcctgatccttaatggaagtagggtggggtcatcttatttaaagccacagttctcaccatagacctcattaggccatcaacacacattcagcctttttcttcccagtgaaatgcagggttttcatggacgctaactcatgggtggaactgcgcttgaacataagtgaggctagccactgctcaaaccccatttttgtagagtctgttagttgacccagccacatcactgcatcagcccagtgtatggcaaggggctttgagtattctaagaagcaggccctaggataggtgtgagagagaactcacacatctatctgaaagaaggaccaactgaggggaagcagggaggagacagaggtttttgtgagctttgaaataaagaaaagaatatcatctggtaagtgcatggtctaaacaaatggtaactttcaaatctcaacttctgtcttatcagcaccaaaaatattttgtttggactgatgccatatgaatctctgggaactgctgttctaccctatatcagtaagtgattgtttctggctgccactagagactggagtataatgtctttaacaaattaggattttgtattcatttgtagaagaatccagaagtgggcagtccaaggctggtgggatagatggtataacaagatatcaggggctttctgtatttctgatccaccatccttagcctatgtgctttaaaccctttgtggtttccctcctcaagcacattcatggtcacaagattgctgttggatctccagccatcgtgtctacattccaggaagaaagagagaaaggcaaaaggtagaagcagaacaatttttgctgcatcagcctttcaaagggttctcattgaaaccctacccaaccaattttacttaaatctcattggatactcatagccacaaagaggacttgaaaaaatataacgtttcagctgtgtacttttctgcctgaataaagatagaatttacctctgacactaagaaagaaggggagcatgaatattgcaaggcagctggcagtccctgctcccctcccctacctcagttctctcctgttttccatgattcacaggcatcctcttagtccccatcttgcttttcccacctccatatgatggacccccaaggcctggttagcaggatctgaaagataactcattgacagtataataagttagctaagtgtcactgagtatttactatgctccaggcattgctttaaaaggttagcacaccatgaagtggggtgaccaatcttctgtctctgggagggagatcaggtggcatcgggaggatttctccagccaagtgtagcccagccttggtcttagggagatgccaaggcagtccagtttgctggtaaagtatggggctctggcatcaactgtcacatttagaattcttgccccactttatgggcaagtaattcaatctctctttgcctcagttttctcatcagtaaaatagggatagtgacagtacttgctttgagggtgtatcagttttctgtggctgctgtaacaagttacaaactaggtggcttcaaacaacagcaatttattctcccccagttttggaggccagatgtctgaactgcatgtgttgtcagggccacaatgcctctggaggttctaagggaggggccattccttgactcttccaggttctggtatctgccagcattccttggctgtggctgcatcactctgatctctgcctccattttcatatcgtcgtcttctctctgtgtgtctagcctatctttgcctcttacttataaggatgcttttgatggtgtttagggcccacccagctaatccaggatgatctccccatctcaagatccttaacttaatcacatctgcaaagacccatttttccaataagtttctgtggatgaggactgcggagttatctttgggacttaggatctgcacatactcagacacagtgcctgccacttgagagcacttgatcagctctcgtggtagctctgccgtctcacggggttctttggagagcaggagccctgggggaaagaccttggctggtcacattttcctcttttctaacaaagctttacgctttaccagaaataatcataactgtcattgattcagcaccactctcccagttgctgtgtgtgtggctctacacctcttctcattgaatccttatgatagctctaccatggtcactgctttacagcagaggaaactggttcagagaggttaagtctcttccccatttcacaaccagcaagtgagagagttgggattcaagctcattttcattccccctcatcatgccatttgttttgaacacaccttgtatatgaagggcttctgtggaaatgaagagtgaaaaggaaggacccaagacataggtggtgccagggacccagagtgaaagaatgtatatagaagcacatccagatggtattaaaaattattaatctaatagggagggtgcagcttcaccaaactgaatgtgcaatctccgtctccacccttcctttttccaagtgacatttgtctcaatctcatctttttttctccttggtgaagaacgttccttctcaagctcaaacaatatttcttgtccttattgtgactcttatgatctcacatgttggatctgaccacactctctgctaacattattttgcagtttatcttcatcttatatttccctgccctctacacagacatgtgggctctggacagtagagttggcagttaacattgtaaaactgtgtttactgtcaaatgcatgttttgcttcccaactagatggtaaaactcttgcatgcagggactgagattaatacatcttggccccagtttctagttttatgtcccagacatagtagatgatcagcaattgctccaaggaagctatcagaaaacatccctctaaaagatgcagaggtcatgggattgctgggtggtttatatccctgcaagctacgaactcctgagaatctaacctggaagtccaactctgtactgtgtaggggattcccaagggcaggtttgttctgataatgattaatctcctctgcttttggaagatatctccatccacaggattggccccaggcactggcaatgtaatgttccaagtccccatcttgtctttaaggcagttgttaatgttaaccttcctggccccactggattcttttgcagcaggaagtagacacctccttagcttgagtcaagatgttagaatgcagattgaaaatgttcttgaggaatagtgattgctcagcccctcgccatggctacgtgataaacaacagatggctcaccaatgcaacattctaacaaatatactccatttaaattggaggttgcttcatggggatggctcccttgaagttacttccttactttgtttcttgggcaaatttgcattttatagaactcaaaggagctggagtttctgttctactattacaaatgcataatatgttctcaatgggtggtttgctgtgtagacactaaaacaaactactttctcttatttctatcccttcccacttctttttttactttcaagctttttttcctattagttaaaaaagtataggatctcactgtattgcccaggctagtcttaaactcctagcctcaagtgatcctcccaccttggcctcccaaaatgctgggattaggcatgagccaccacacccagcctcaacaaatttttatcaaatagttactatagtttttgttttgtgtgaagtatcttcctagggcaccttcatgggtcaaccctgtcctactcttgatgtggagtcagtgcaggggaagaagtcctgggacaaggaggaagctatgggttctcttcactgtctgagcaggaggctcctcctgcagcagaggaagagagggtcttgcaataataattaaatgcccccacccagaagtgacacgtggcatttccactcacagccaatttgccagaacactatggcccatctaacttgcaaaagcagaatcactgtggtcttctttggttaggaggaaagaaaaattagaatacgcaagccctaaaaagctctactacaggaatcatttggtgatcttaggaaaaaatacagataccatggtcttgccagtagaaagtctgattccattgccctgaagtggggcctgagaataaaaatttggcaaatgttccaaatgattctgatgcaagtggtacatgggtggacatttgggaaccactgctttagaaaacccaatccccccttggggtgactattggctgtataggtgataagactgatatgtgtccaggaatatgaaaaacagtcaatgtataactcagtgccaaaatatgaagcataccataagtgctccagtccctacagggactcagcaaacacttcactgcccctcctgatacttattttgcctcttatttagtgcctttgccagacaactcatggtaagacctggtcttgtggaggtgatggagaaaggtcttgggcagaggtggggtcaggacctcttagcagattaaaagcaggagtacatatgtgaagatgtgagcatgtgtgctccacatgcatctgcatgtgtgtatacttttgtgtcttcatgtgtgcagtgggagaacagggtagagaagtagagtccaatgtccatccttccctatagggcctgttggaatgataaggtcctatgaataatagttttgtattatagtttttacccatcaggctgaacccagagagcataccagggattctgaatctaatccttgctgtgccaccttactgggtgacccattgtcagctataaaactgggcaactctgaggcttattagcaagcttggggatgactcagttcttcctctgcctcttcctcttccttctccttttgcacagcctgttcaatcaggagttgtattcagctactctttaacagaatcctgaaaaacagaagtggtttaaatcgattaaagatttattattattgcttacataaaagagagccagaggttggcaatcatctgggtcccaggttccttttggctctcacttgaccattcctagggtgtgaccctcttcctcgttatctcaagatggctgctggagctccagtcatcatgtctacatttcaggcatgaataaagggaagagaagaggagaaaaatggtgtcttccagctacacctggagaagtatcattgagtgacttctgcttacatctgattggctagaattatgtcacatgactattccaagttgcaagcaagtctgagaaatgtaacagcctctattataaaggtccaggggtcaggcatcccaacttttatatcccattctcttgcacagggaaatgtaagtctttgccttatagagtgggagagggctaactcttgctcctgggtagacacatgcaggcttagtggatgcttggatacaagagacccagaatgttcatacacagtcccaagacttcagcctcaatgcctgagaggagagttggcaagccagaggttgagcagggatagtgagcagatgccatgctctctgctccagaggccaatccccttgcagagcagaactcaatccaacaacaccctttgttgtggcagctttgtttttagaaatagaaggcatgcaagagaattttggccccttggaggccaaacagcatgggtcttctttttttttcaataaaacgtgagcttgtttttagtattgaatttgtaggtacagagtaaccgcccctccccctacaacagtataaaagaggatgagtgaaagtaaacttctcctccgtcctccctcccacctgtggcttcagtctcatagtctggaggctacactttgtttccctggtcactttccagatgtattctttgcatatgggtaaatgtgcattgttacacacacacacacacacacacacacacacacacacacaaatgggataatactttacatacggctctgcaatttgctttttttttattagtatcttggtgatcacgccatatcagcacctgtagaccaccttattcttttcttatgggtatgtggcatgaatgccatcatttatttacccagctgccagttgaagaacattttggtctttccaggcttttgctatcaaaatcattctctaattttttaaacaggattcctctcttgatcacattgtttggattggaagctgaacctagtaattgggggacagagaacattgctgcctctgggaggtcttgtcctgtgattcctggggttcttctctagtcaggcccatctctggcttctccatcgggggtctaaacccatgggttccttcttgtcccaggacctcctccctaccacggactccacctcaagggtgggatagggttaaccctgggaaggttaataatcagatgctctgggcagataaatagcacggatctccttcatctataggagaggctgagtactgaggagaggagaaagtggtctggtgatggccattcttacctccctttggctgcaagccaaaagcagtctactctacagttcactgcaccaattctccttggaatagatttttgtggccacctgttagtattcgagcataacctttggggtctcttcactcacctcccaaaccccatctcaaacagctaatcaaagcctcctttccaatgacatacagtgcttaccccacagaagttccacaggttgcaattttctccaacttcaatgtcatttccagtgaattttatccaccctgaaatgcttccagctccccagtgatgttccagtggcctttagatctgagacccagctgctctaccccttaatctggctcagctgaaaaccgtgggggattctccagcctccgaggccaaggcctgcttcatttaaaagaggctttgttgctggtgggtttgacctggcttatgattttattacgtggtctggggcaggctggatacctcagctggctagacagcgggagtgataatcactttttagcttgacttttaaaccttgctgcgctctctttaaattattttctttttaattttgctatgctgtaagcttcagtttacaaattagaaaatgtcaaggtggctgtaaaccccatttgttagcaggtcccaacagtctttgggaggcatacccagcaaactgaagcctataaggttgttatagtaggtagctagtcaggcatgagcagggcaggagaggggtccgcctgaccaggaatgtcaggtaaccaccaggtgatggtcaggcggttgttaactgtctctctaaagtaataattggtcacagtcagtgccagggaaaggcagtctccctatagatagaaaaaacctgaaactggtgatcagcagcttcctgataagatctcaggagttgggcaaatgggctcaagcaagtgcattgaggggcaaaacggcggagtttaactggtatatgaccttccagggacattccactggtaagggaagaatgcctcacgtgagcatgcgtacagctccagtaaacacaccgcacctgctcatctcccaagtgctaggaggccactgcacatatggacaacccatgccaagggaagaatcaggggagaagtgacacaagagcccagaagtatgccaatgtataaaaccccaagtcaaaaggtcaaactgcgcacttgtttttcaagtcgcccgcttggccctcttccaagggtgctttccttccttttgttcctactctaaagctttttaataaactttcattcctgctctaaaacttgcctcagtctctccttttgccttatgccccttagttgaattgaattctttcttctgaggaggcagggattgaggttgctgcaggcccatatgaatttgctgctggtaacaaggtcatatgttgaatttctgagagcagctgggtctcagatctaaacaactcaagtgtgttttctcccagtagtaagatatgatgtcatccaggtgtagagaggacccgaagactctggagcactgtgtggcctggccatttgtgtagggtaagaagagcaactatgtgcttggagtgcccccaccctcatatccacagcggacatctagtgtggatcatggtgttcttctctcattgaactcaaccttgacttcttttctaagcaattaccaccaattagatttggtgcacaagataaaatctattggctgtcctggacctagagggtattcaaatatggtaacctatgcttttcagcaaatagagtttgcaacaccatcccagctttagcttgccaatatggggacaaactcacacttgtttgtttgtttttaagtgccaaagccattaaacaccaactcttccaggcgagttgctggggcttaggaataaaaaggatgtttaaaggggtattgtcttcaatgagctcacaaaccagagatgtgcatatctcactgtaacacgctttggtgagtaccattattagcacatgaacagagcactgtgtatgtagagaggaggaaaagaggaagagtgtgagtctacctcaaagggtgcttggcaggtagagaatgaggaagaccactgaggcccaggaaaaagaatgtgctgaagtcttaaaatgctgaaaggacatggtgtgtaccaagaagagagtgtctgatctggcagaagcatggggacctgggagttggggcaaagagggaggaaatgaggttggagagaaaagctgttgcttcaaagaggactttttctgctttgatttgaacctgtggatccttcttcccagcttgactcagatgtcctttcctccatctgcctaagtgattcttctaccttctaaggtggttcccatcttctgctccatgcgggatggattccaggctgctcaatatgttgatctctagctccatcatcctgaaaagtctgcagggtgggcaaagccaccatttattattaagactgcttaggagctttgaagtaggagctgctttgaagtaggagtgcctgagtcactgtatactaatgtgatcatctctttgaggaaatgaagatgaagccctgaaaatatctctttatctttttgatctatagtgtttttcccaaccttaatgaagctaacaaagattcattatttaatacaaaggctatcagacctggtgtgactccatcaacaaaggaatgtggctgtaaaccctatttgtcagcaggtctgccccttgtcagaaagaagggagagcaatgcagaaaagatgacatttaagtaaagaaagataataaaacttcacaaagaaagtcccagactagacaggcaagcagatgccaccctgggccactgggagtaggagggccagctgaatccgataccaaggaataacatcccccaaatcaggcatgaagttaaacagagccctggtgagcatacagttgtaatgactcagtattcagaggtggaaggtaaggaaggggcttgatccagtgagcagaagcagatgagaaaaatcatgtgggcaggtatgatgaaaaggaatcagatataggatccttccaaaattgtcttccctagacacagatctggtcaaatacatctgtttaagaatcttcagtggctcttagttgaagatacaattacatctaaatgccttagccaagcactcaaatttctccacagtttcactcttatcaaattttctggtcctataaagctgcctgtgatttcctgaactgacctctaattctctcacctggatacctttctcaagctcttccttctatttgagtaaggtattgaggtgtctctccctctgtcctaaattcccataacacgttcttttcctacaattcttagcagtttcctttgtgcaggtaacaatggctttgttccttcctcttgactacaaacgtacttatttagagattgtaccttttttattattgtactcaaaacaacatctagcccagtactttgcatgctataaatccttaatctgtacttgttggaagtcagcagaatggctttcaagcttacccaagactgaaacagaggcgatgcctgtgggatcttctgggagagttcctttttttaaaaaatcttttattatactttaagttctagggttcatgtgcacaacgtgcaggtttgttacacatgtatacatgtgccatgttggtgtgctgcacccattaactcgtcatttacattaggtatatcctgggagagttcttaaaggggtcatgcggggtgataggggcagccagagcctatgacaaaggcaggcagaggcttcctgttggtccccctccagagtggtcatgaaagtctcttttattttattttattttttgagacggagtctcactctgtcacccaggctggagtgcagtggcgcgatctcggctcactgcaagctccgcctcctgggttcacgccattctcctgactcagcctcctgagtagctgggactacaggcgcccgttaccacgcccggctaattttttgtatttttagtagagacggggtttcaccgtgttagccaggatggtctcgatctcctgacctcgtgatccgcccgcctcggcctcccaaagtgctgggattacaggcgtgagccaacgcgcccagcctgaaagtctcttttaaatttaattttatttattactttccttttataccaccactgaaatgcctgaagttcatggaagcccttaagggcgtatttcattagggtgacacagtcatacatgagtagaaactttatatattctggtccaggaaatatgtccacctcagaaggagcactgtccctgggtctgtctctggacagaataggaattcaaatgaggtacagttaaaggctgaaccccaagggtctatgagtttatagctccacctgctgatgtctgaggctggggcttgggactagacaagggtgcctgaccaaggtatctgcctaggattctgacttggagaagggagagaagaatcaaagaggatcgctgtgccctatgctgagaggggtgagggatgggaagagttggtgcaggacactctagaggaatttttgagacttgagtcatctcacaacttttcaggctccaatgccatagaacagagcttctagagtcttctagatccaactggtctacccatcttagaattaccctgacactcactgtggatctggaatgaacaaaactgcatgaattggaggtcaggagattgagaccatcctggctaacatggtgaaaccccatctctactaaacaaaatacaaaaaattagcccggcgtggtggcaggcgcctgtagtcccagctagtctggaggctgaggcaggagaacggtgtgaacccggaaggcggaggttgcagtgagcctagatcgtgccattgcactccagcctgggcaacagagcaagactccgtctcaaaaaaaaaaaaaaaaaaagggaggagccaagatggccgaataggaacagctctggtctacagctcccagcgtgagcgacacagaagacgggtgatttctgcatttccatctgaggtacagggttcatctcactagggagtgccagacagtgggcgcaggccagtgggtgcgcgcaccgtgcacgagccgaagcagggcaaggcattgcctcacctgggaagcgcaaggggtcagggagttccctttccgagtcaaagaaaggggtgacggacgcacctggaaaatcgggtcactcccacccgaatattgcgcttttcagaccggcttaaaaaacggcgcaccacgagattatatcccgcacctggctcagagggtcctacgcccacggagtctcgctgattgctagcacagcagtctgagatcaaactgcaaggcggcagcgaggctgggggaggggcgcccgccattgcccaggcttgcttaggtaaacaaagcagccagaaagcttgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcatgcagctggagatctgagaacgggcagactgcctcctcaagtgggtccctgacccctgacccccaagcagcctaactgggaggcacccccccaacaggggcatactgacacctcacacagcagggtattccaacagacctgcagctgagggtcctgtctgttagaaggaaaaataacaaacagaaaggacatccacaccgaatacccatctgtacatcaccatcatcaaagacgaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgccgagctgacagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactatgtgaagaatgcagaagcctcaggagccgatgcgatcgactggaagaaagggtatcagcaatggaagatgaaatgaatgaaatgaagtgagaagggaagtttagagaaaaaagaataaaaagaaatgagcaaagcctccaagaaatatgggactatgtgaaaagaccaaatttacgtccgattggtgtacctgaaagtgatggggagaatggaaccaagttggaaaacactctgcaggatattatccaggagaacttccccaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcatgccaaaatgtaaagacaatcgagactaggaagaaactgcatcaactaacgagcaaaataaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacatacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacacctcactgtcaacattagacagatcaacgagacagaaagtcaacaaggatacccaggaattgaactcagctctgcaccaagcagatctaattgacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactacaactcaggattaagaatctcactcaaagccgctcaactacatggaaactgaacaacctgctcctgaatgacaactgggtacataacgaaatgaaggcagaaataaagatgttctttgaaaccaacgagaacaaagacacaacataccagaatctctgggacacattcaaagcagtgtgtagagggaaatttagagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaagaattaatgaatccaggagctggttttttgaaaggatcaacaaaattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagattaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagggacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacagacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacaacatgattgtttatctagaaaaccccatcgtctcagcccaaaatctccttaagctgataagcaacttcagcaaactctcaggatacaaaatcaatgtacaaaaatcacaagcattcttatagaccaacaacagacaaacagagagccaaatcatgagtgaactcccattcacaattgcttcaaagagaataaaatacctaggaatccaacttacaagggatgtgaaggacctcttcaaggagaactacaagccactgctcaaggaaataaaagaggatacaaacaaatggaagaacattccatgctcatgggtaggaagaatcaatatcgtgaaaatggccatactgcccaaggtaatttacagattcaatgccgtccccatcaagctaccaatgactttcttcacagaattggaaaaaactactttaaagttcatatggaaccaaaaaagagcccgcatcgccaagtcaatcctaagccaaaagaacaaagctggaggcatcacactacctgccttcaaactatactacaaggctacagtaaccaaaacagcatggtactggtaccaaaacagagatatagatcaatggaacagaacagagccctcagaaataacgccacatacctacaactatctgatctttgacaaacctgagaaaaacaagcaatggggaaaggattccctatttaataaatggtgctgggaaaactggatagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaataggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagtgatctagaactagaaataccatttgacccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccatacaaaatgatgagttcatgtcctttgtagggacatggatgaaattggaaaccatcattctcagtaaactatcgcgagaacaaaaaatcaaacaccgcatattctcactcataggtgggaattgaacaatgagatcacatggacacaggaaggggaatatcacactttggggactgtggtggggtggggggagggggtagggatagcattgggagatatacctaatgctagatgacgagttagtgggtgcagcgcaccagcatggcacatgtatacatatgtaactaacctgcacattgtgcacatgtaccctaaaacttaaagtataataaaaaaaaaaaaaaaaaactgcatgaattgctcattctggcccagagtgggtggattgaatactctgttagacattaattcctttgggaaaggctgggataggtttcctttggaaaggattgggaaagaaaagaaaaacagaaaaaattattagggccacagaaaagtagaacagagaagtgctccatgatacctgacacgtgcttaacacattttttaaataaattatatgaatgattgaattcttggaactgagtaaaagaatagaaagtacaataaaataaaaacagaaaaaatgaaaagaaatagtcttacgatgatgaaaacaagtaggagttgattagaggggaaaaagtcaatagccaaatttaagagattagaggaacaaacaactctcagacagacttcctcctgtggttacctgaagctccagactcatgtaccagtcccaagtacacaagaaagagatccttcacaagtccctggattttctcagatttaaccaacgagacactctgtggctgtccctgaactaatcatggtggcccagggtaggctggctgggggatgaatgatatcaattggccaggtctggatcacaagtcctgccctaacaacagcttattagagaaatttggcgtgcttataggctaggctgaggcacttgctccattagtggggctgggggatggaaccccatccgaagcacagagaatgagagtgggacaggtgtgctctcccactctgggcacactcctcactcctcaaagagtggagtgtgtgtgccgagttgccaaaacttaaaaatgtcttctacatcaactttttctattttttttttcttgagtaactcttcattgttcgagagtatactgaagcattacttccttaaggaaacttcccctgacttatctttgactccagattagatgccccagaacataatgtgtgttctcataactctcccttccagaataggggctccttcaaggcaggggctttgtcttttttcctccatatccctggtactgatggcagggcttggtataattaatatttgttggataactgagagagaataaatgcacggacacttgcaggagtgtgtctcagagtaagatgtggcctcttacccccaaaagggacacagctacattgggatggctgcacccaggagtggtggagcttttgctcaagcagaagccagtatttatggagctggagctaggatgggagctccaagccaagcaaatagaccgagaatggggaagggggcttcacctctccaggagaagattgtcaggcacctcccaagtggtgctattgtttcaggcttccagacaccagggactgagtctgccctacgtctaggtccccaggaaggcatctggtcatctcaagtcttagaattctgtttttctcatgtccaccccttttcttctattgcaccacccacttctggtctcataacagtgtctctgcccctcaactttgctctgccttttcctcaactcctttaaaacttgcacaccactgccatagaagggtccttgaacacatgattattatgtcacccattttgtgaaaaacctcagtgagtctcagtgcttccaagataaattttaaattctccaacccggaattaaacttgtcagtctatctccggaacttacctgcatccttatctctcactcctcacttcctagacctgtgcaccagcctataacctgcacttcccattccatctgcactgcttcctcctcactgtacatcagttgtcccacttagtgtcctcacttttcccttttgttatccaatcctacttctccttaattcttgcaattgtctgacctcttgtaaccacagcaatcttttcattctccaaacctttttttttttttttttgagacaggatcttgctctgtcatccaggctagagtgcagtggtgcgatcttggctcaccagagccttaacttcccaggctcaagtgatcctcccaccttagcctcccaaagtgggattacaggcatgagccactatgcctggctattttttttaagacggaatcttgatctgtcacccaggctggcatgatcatggctcactgcagccttgatttcccaggcttgagtgatcctcctgcctcagcatatcaggtagctaggactacaggcggcccaccaccatgctcggcttttttgtttgtttgtttgcagaaacagggtctcactatgttgcccaggctggtctcaaactcctaggctcaagagatctgcctgccttggcctcccattgctgggattacaggtgtggaccactatgcctggcctccctgaactattacgttcctagaaatgttgagcctgtatctgttgtatcaatcattcacttgacacttaattatctaagcccattatttgattacaaacttttgtacaccatctagtcacaggctgagaatgcagtaaatgtgcaatgagtgttagttaaatgaaaaagcaaaggggaacatgttgagtggaaaggggcaaatttgtagtgtggctttagagttctttggatttgttttagtttgattgtgaatactgcttgtgccctttggcttgccacttcattgctgaatctcatttccacattagtaaattgaggataatcttccgagccctacagaggttgcagcttatagtgaacaccaaatgagaggtcatacatgcaatactttataaactcctagtggtaagctattaggtcttctcttttcatttcaattaaaaatgtttttcttcttacttttagacttgcaaccttatttctcgaaagagggcccaacaggataggcagtatttacaaaaaggctgtttacagacgcttcacggatggaacctactccatagagatccccaaacctccctggcttggattcctgggccccatcttgagggccgaagtgggtgatgtgattgtcattcatttaaagaactttgcttctcgaccttactctctgcatccacatggcgttttctacaacaaagattcagaaggtaaatatcaatcctttattactggggtcttgtctctatttcataagtaaggtaactgtcagagttaaagagattttaggagcacattgattacatggatatatttatcttctctctgtctgcttctccatccatctccatctatctattctgtctctctcttccctttcttgctttttttttttttttttttttgagaggtagtctcactctgttgcccaggctggaatgcagtggcatgatatcagctcactgcaacctccgtctccctggttcaggatattctcctgcctcagcctctctagtgctgggattacagatgtgcaccatcacgcccagctaattttttgtatttttagtagagaaaatatggtttcaccacgttggccaagctggtctcaacctcctgacctcaaatgatccgcccgcctcagcctctcaaagtgctgggattacaggcgtgagccaccatgcccggctccccttcatgctttttctttcccttatttcctacctctcctctttcttgctcttctttatgttgacacagaactcctcagtacctgctccaccacgcaccaggaacacactagctttcttccttgtcacttagttgtgcctgatttgcacactagataaagggcaacatgctcctatctccggtagcagccttggctgtgggtacatttttatcaacagaagctgatccccactccttgcttcaggcggctgtttttggtgctgcctttgtgaagcagccctgtcttccttcttgtgtgtatgttaggagtttcattagggcagtttctggattcctccctaattgaaaaatattaaacaactttcttagacttttgagacagaagtatttctccaacatcaaaaatattttttttgaatcctgtatttcattcttgctcatgacctggtggaataggttgaaaggtgctgtacctgctaggtgactgcttctaggaaatgtgccagcacagtgccattaactctgatgcaactcacattatcatcaaggaggagtttctgggcattaacaaatatcccaaggcagcctaacttgtgaggcagctgctccagccatgtctctataagcagcgagaggagagaactctgatggtgaacacacaactgggattgccctttgttctgggctcttttcctccacctggagtgcagccaagatttggtagttcttagttgttgaggatgagcacaaaaattgtgccaggtaaactttaaggtgtaactatgaatgcattttctttaatatagtttttttaacttttattttaagttcagggatataagtgcaggttcgttacataggtaaacttgtgtcatggggatttgttgtaaagattatttcatcacccaggaattaagcctagtccccattagttatttttcctgatcctctccctcctccaaccctccaccctctgctaggccccagtgtgtgttgttcccctctatgtttccatgtgttctcataatttagctcccacttataagtgagaatatgcgatatttggttttctcttcctgtgttagtttgctaaggataatggcctccagctttatccatgtccctgcaaaggacatcatctcattcttcttatggctgcatagtattccaaggtgtatatgcatgtcattttctttatccagtttatcactgatgggagttcaggttgactccatgtgtcttatttatgctgcacgtagcaagtaaagatgtaccaagatagttgtgcctgccttttcaaatatggagaaaataggggcatttttaagtgtaatttttgtcttcaatcctccatctgtttctggaaagcataccttaatagagttaatggtgtcctgaaaaatcatttaggccagtgattctaaagctttatagggctacaaattcttttttcaaaaaaattgtggtaaaacatatgaacataaaatttaccattttaaccattttcaagtgttcaattcggtggcattaattacatccacaaggttgtacaatcatcaccattatctatttccacaaccttttcatcatcccaaaccgaaactatatagccattaatcaatacctctccattcctcccttttgctgccccactggtaacttctattctattttctatgtctatgaatgtgccttttgtgtctggcttatttcacttagcataatattttcaatgcttatgtatattttagtatgcatcataatgtaattccttttaaggctgaatactattcaattgcatgtatataccacactttgtttatccgttcatctgttgatgaatgctttggttgtttccacatcttggctattgtgaataatactgctataaacattggtgcaccacagatctttctgagcatctgtgagagccatgagcccttgcaccagaaaaatatgtatgtgcataatttttttttgagatggggtctcgctctgtcactcaggctggagtgcagtagtacagtcatggttcattgcagccttgaactcctgtgctcaagtgatcctcctgcctcaccctcccaagtagctgggaccacaggcatctgccactacacctggctaatttttaaaattttttcatagagataggatcttgctgtgttgtcctggctggcctcaaactcctggcctcaagcagtcctccttccttggcctctcaaagtgcagggataacagtaatgagccactgtgcccagcctgtggacaaaattttgaacccacttttaagaggttctcagagtccctgaaaacattcataggtccttaaattaagaacatttcaaatgttgtttacccaggaaaccttctctctatcctgtctgcaggactgtcccatttcagaagtgtgttggtttatctcataacacttaatactggctggacatggtggctcatgcctataatcccagcactttgggaggccgaggtgggtggatcacctgaggtcgggcatttgagaccagcctggccaacaggcgaaaccccatctctactaaaaatacaaaaaattagccaggagttgtggcacatgcctataaccccagctacttgggaggctgaggcaggatagtcgcttgaacctgggaggtggaggctgcagtgagccgagatcatgccattgcactccagcctgggcaacagagcaagactccatctcaaaagaaacaaaaaaaaacaaaacaaaaacaaaaacaaaccacacttaatactggtatagtagacatacaaatggccaacaggtatattaaaaaaatgctcaacatcactaatcattggggaaatgcaaatcagaactacaatgagatctcatcttaccccagctaaaatggctattatcaaaaagacaaaaagtaccccctccaaacccaaaaaacaaaaacaaccagatactggcaaagacacaaagaaaagagaatacttatacactcttggtggcaatgtaaattagtacagccactacggaaaacagtatggagattcttcaaaaaatgaaaactagaactcccatatgacccagcagtcccactactgggcatttatccaaaggaataaacctttcattgagcacccaccaggtgccagacactgactcccaggtgccagacattgactctgggtcctgagaataaaagatgaatgaatcataggatgtagtaaaaaaaaaaaaaaaatcaatgaccataagtataaggagttaatttcagtgctcttaattctgctccattgatctatatacttatccttggaccaatgccacagtgtcttgattactgtgaaattctagtaagttttgaaatggagtcacataaatccttcaactttgttattcttttcaaggctttttggctatttaggttctttccctccatatatatatttgatcagcttattaatttttaccaaaaaacatcagctaggattttgatagcagtcgctttgcgttaatttggttgataaattgtaggaaaattccatgtgcatttaaaaacaaatggccatcttaccaacattgagtctttcaatccatgaacatggaatttaggtctttaatttctctcagtaatgttttagtttttagtatacaagatttgcatttcttttgttaaatttattccaaagtattttattttttctgttgatgttatgaatggaatagttttcttaatttcatttttggattgtttggtgctagtgcatagaaagaattaatttttgtatgttgaagttatattctacttccttgctaaacttgtttgttagtagatgtttagtggatttcttggaattttctacatacggacttaagccattgtgaatgaagagagttttaattcttccttaccagtctgtatacctttacgttttttcttttgacttattacacagctataacctttaggaaaatatgtaatattagtagtgagaccagatattcttacctttttcccaatcttaggaagaaagcattttgtcttcctccgttaggcatgaggctagctgtacatttttttctagatggctttttatcagattgagaaagtttctttcttttttttaattttgaatttttgtgggaacatagtagatgtatatgtttatgggttgcatgagatattttgatacaagcatgcaatgcataataataacatcatagtacatggagtatccatcacctcaagcatttatcctttgtgtttcagacaatccaattatactcttttcgttattctaaaatgcacaattaaattatttttgactattgtcaccctgttgtgctagcaaataataggtcttattaattctttctaactatttttttgtatccattaatcatccccacttcctcccacctttccactacccttcctggcttctggtatccatccttctattctgtatgagttcaattgttttaatttttagttcccacaaacaagtgagaacatgtgaagtttgtctttctgtgcctggcttatttcacttaacataatgacctccggttcaatccacattgttgcaaattctttcttgtggctgaatagtactccattgtgtatatgtaccacatctttatccatttggctgcttattgacacagtttgcttccaaaccttggctactgtgaatagtgctgcaataaacatgggagtacagatatctgatttcctttttggggggtacattaaaatggggtatgtacccataccagtgggatttctggatcacatgatagctctgtttttagttttctgtggaaatttcaaactgctctccctagtggttgtactaatttacattcccaccaacaatgtacaagggttccattttctccacatcctcactagcattttttattgcctgtctgttgaataaaagtcattttaactgggttgggagaatatcatgttgtagttttgatttatatttctctgatgaccaataatgttaagcaccttttcatacacctgtttaccatttgtatgtcttcttttgagaaatagctattcaggtcttttgcccattttttaatctggtaattagattttttcctatagtgttccttatatattctggttattaatcccagataggtagtttgcaaatattttctcccattctatggattgtctcttcactttgttgattgtttcctttgctgtgtagaagtgttttaacttaatgtgatcccatttgtccacttgtgccttggttgcctggcttgtggggtattactcaagaaatctttgcccagactaatgtcctggagagtttgcccagtattttcttgtagcagttttatagtttaaggtcttaaagtttttaatccattttgatttgatttgatttttgtctatggtgagagataggagtctagttttattcttctgcatatgggtatccagttttcccagtaccatttattgaagagactgtcttttccccagtgtgtgttcttggcacctttgtcaaaagttagttcactgtagatgtatggatttatttccaggttctctattctgttccatttgtctgtgtgtctgtttttatgccagtaccatgccatttgggttactatagctctgtagtataatttgaagtcaggtaatgtgattcctccagttttgtcctttttacttaggatggctttggctattctggtttttttgtggttccatataattttaggaatgttttttcaatctctgtgaagactgtcattggtattttgatagggattgctttgggcagtatgaacattttaacaatattgattcttccaatccatgaacatgaaatgtttttccatttttttgtcctcttcaatttctttcatcagtgttttatagttttcattataaagatccttcatttccttagttacgttaacttctaggtatttaattttatttgtagctactgtaaatgggattactttcttgatttctttttcagattattcactgttggcatatcgaaatgctactgattttgtatgttgattttgtatcctgcaactttactaaatttgtaagttataatagtttttggtggagccgttaggtttttccaaatgtaagattatatcatctgcaaataaggataatctgactttttcctttccagtttggatgtccttatttcttcctcttgtctgattgttttagctgggactggaggaaattcctttgtattcctagtttgttgagagtttttcactaagtaagtactggatttttttcaatacttttctgtatccattgagatggtcatgtggcttttctatatctattgagatatattgatatatattgcattaactaatttttggatgttaagccaacctggcaatcatgggataaatcccatttggccatggcatagaatcctttttatatgctgatggatgcaatttgctaatattttgttaagaatttttgtgtctaagtcatgaaggatattggtctgtagttttcttgtgatgtttgtatctgattttgttgtcaaggtaatacttgcctcatagaaggaattggaaagtctccactcttctgttttctgaaagattttgtaaaggattggcatggattttttttttagtatttgttagaatttttatataaaaccactggacctgaatttactttcagggaggatctttagttactaattcaatttcttgttataggtatattccaattttttatttttatattttagtcagttttggtaacttgtgtcttcctagaaattcgtgtgtttcatctcagttgtctattattttggcagaaagttgcctataatatttccttataatccttttaatttctgtatggtcagtgatgttgcctctttcattcctgactttggcaattagtgttctctttctctcttggccagtctaaatgaagttgtctcaattttgttgatcttttctaagtaccaacttttggtttcatctattttgtattttttttctgttttctctttcactgatttctgttccaatctttatttcttctttctacttgctttgggtttgtttttctcttccttttctagtttcttaagatgaaagcttaggttattgatttgagagttttttttaacttctgagatagatgacttaaaatctaaatttcctttttaagcatggctttacctgtatctcataaattttgatatttttgtcttcattttaattcagttcaaaatattttacaatttcccttgtgatttcttctttgacctgtgggttacttagaagtgtatcattttatttccaaatatttagatgatttcaaagatttctttctgtagatatttaatttaattccattgtgattgaaaaatatgctttgtatgatagtaatccttttcaatgtattgaaacttattttatgcctagtatgtgctccattctggagaatcatccatgtgctctgtaaagagggtatattctacagttattgggtgcaatgttccagagacatcatttaggtataattggttcatagtattgttcaagtctcctatatccttgctgattttctgtttaggtgttctatcagttattgagagttgagtattgaaatcttcaacaattattgttgagttgtctatttgttctttttttggggaaggtctgagtgtcatttattaacaacagtttatacagatctattttcaaagcacaggcacagagccctggagaagagcagtctctgaacaaggaagccaggaacacaggatgtacacatctttggcaggcatgtttagccccagaaggattcaatacttcaagttggaattccattggatatttgagagggaccaaaattgagggtagaaagaagtcttcaacaggactcagatctcagtctagggctcctcttgcactatctaagtccatccgggtattaggaccctggggggcaacaatcaggcctacccatttcaacagaagcagattcttcaatctacactcagttagttcacacttgtttccactggtcacacagttaaagagaatcagccttatagtaagagacagaccactttctctctgaccctctccagcacctctcttcagcttcatctgtgcaggaactgctgggaaaattgaggcctaccttttcaattcagctgcatgtgcttttaccctcaaatcttcaatcaacgataggatggaggctacatgtgtactcaggctgacaactgttcttcccagtccatcacacacattgccctaccttagttctgccaattgcagtacctaggctggagctacagtagacctcaaattgggacctaaagccagtctgcataggcacttgggaatttttcgtaggggagtagataaaaaagtctttgaatatgcgaagaaagaaagagcttcatttgataattagacatctgaagtgattttacttttattttcttcactttaagccaatcatgaaatttcacagtgatttctcaggtaggagcagaaggaagacactgttactcattggggctgtggcccagttggcttgaggaagtacaggcagggtgggtccttactggggcagctggaggggcacagactgctctgccggaaggtaggtgatgatatgagagcataagaactggtatgtaatatcatctgcagcttccagcttgtgtagctcaatctggccatcacctgtggtggccagtgaattggcactcagctcagctgccttggagactcccttggcagagatgatggccacctttttctgctgctcagattttccaccatgaatctggccctctctgattcctgttgagccacctgtttcactcccaccacttctgtgaactccttcccaaaggtcagatgtgtcaaggacacatcatccaagatgagctcaaaggtggctacttagtctgcaaggtcgttgctaacctgcctggagaccagctctctctgggtgatcagttctccatcatcaaagtaagccatcagtaacatgaggatcttttcacatcatccaggatgagctcaaaggtggctgcttgctccgtaaggtcgttgttaaccggcttggagaccagctctctctgggtgatcagttctccagtatcaaagtaagcaatcggtaacatgaggatctcttagtgatgtacagcagcacacgctcatcatagtcctttccaatgctggtgaagatgtgaggaagctggctagtgacaggctggaagacaatgcactctgtgatcttgacattctgtaaatcttcactaccagtgatgactggtgtgttatgtgatcaagagtagcagtcaacgataattggtttctgtacccataggatgagaaaatgagttcctttccatactgcaatgtcctgtactccatggaatctgccaaagatttagctctgtgctcagcatccacataatataaggcagagcctaccgtgcctcctgtaacagctaaggccaggccaaacttgccagtggactctaacactttggcagccatgtttccttctgctggaccctttcgcagccagcttccattctctgttctttaaattaagtcagtttttccttcctgtattttgatgcatttttgttagatatgaatacatttataatgttatattttcctgatatattgacccttttatcgcgacaaaatatctttgtctctaatagcatttcttgtcttaaaatctattttgtctgttattgatatagcctcttacttttgctatttgaattattttactttcaacttatttgtgtctttcaatgtaagacacaatacaaacagcatataatagaattttgctttttttcccccagtttgacaatctctacattttgattgtggtgttagaccattcacagttaatgtaattatttattagtttgatttatatttgtcattttgctaattattttctatatgtcttctgtattttttgttcctctggtcctcttttactgccttcttttgtgttaaacaaatatttcttagaataatgttttaatttctgtttattttttagcctatatatcattgagttattttcttattggtttgcctcgggattgtaatatgcaccctagtttattacatttaccaactaaattctggtaaaatgtagaagctttgctccataaagctccattctctccccctcctttgtgctattattgattatctatctatctatctatctatctatctatctatctatctatctatctataatgcccttctctaaataaacccagcaatacgttgttatatacttggtgctttatattactttatgacttttaaaaaataaaataaaggaaaatatatttatagaaccttttatattaagtcatatatttcccatttctggtgcttttcatttcttcctgtgaattcaagttactctttggtgtcatttccatttattatgaagtttgattgtcctttagtattccttgtaaggcagttctgctagtaacaaactcactcagtctttatttatctagaacatcttgcctttagttttgagggatcgttttgctggatatagcattcttggctaatatttcctccctggcactttaggtatatcatctcattgtcttctgggttcgaatgttcagataagaagtcaaccattaatcatattgatgctcccttgtacgtgataggtcatttttgtctatctgatttcaatattatctttttgtcttcctttcctctttccacagtttagcaatgatgtatctatttgtggacctctttgtatttatcaaattttggctcattaggcttctttgatgtgtaggttaatgtttttcatcaaatttgggaaatttttggccattatttcttcaaatatttatcccacactttctttttgttgttctcccctctttctgcagacaactgttatacacatgttagtaaatacattgtcccactggtctctgaggttctgtccattttcttctatttcccccacctctctttttcagataggataatttctattgatctagctttaagttcactgatactttcttttgctttcttgaatatattgttgagctcctctagtattttatttaatttattgtacttttcaatgccaaaattccaattggattctttttaatatttctatttgcttattaagattctctatttgttgagttgtttttcccacttttcttcagccctttacacataattccttttagttgtttgaacatatttattatagctgctttgaagtctttctctgctaaattcaacctataaggacatatagagagatagtttccactggctgcctttttttctctattaatcacacttgcctgtttctttgtgtttctcatatttttgttgttcttgaaaactggatatttttaagaatataatgtagcatatctggattctcattccttcatcaactctaggttattttttttgcttgcttctttgtttagtaacctgtgggctaaatctgtggattatctttcctatagtgtgtggccactgagatgtctgctttttttattatttatttttatttttaagcctggcttctgagaggtcattcctatgtctgcttagctcagtggtcagcaaatgatttgaagaagttgtgcctaagcatcttgagccaataaatcttatattctctgctagtggatctgtgagtggttagaaaaccagtgctgtagaatcctactcctcttagctgatgttcagcagtttcaagcataaacattgctatatgtttttattcaatttctagataccaaaatggtttgttattttttttaaatcaattttgtctaactttatagttgcttttttgggaagagaatttgctgacttctttgctctcctttaataaggttttgtctttgctacagctgtaagcttaaaagtcttgaagtctctgcttaattcaacttagtgtttgctgtgagccagacacaatactgggttgcaaagaagagtaaatatacagttgttgcttccaaaatatcatccaggggaggggtagagaatggaacttagaagtgggttgagcgggtggggctaacattaattgagcagctattttatgctaatgcctgagccagacctcttatatacattccttcatttaatgatagaatgaactagtgctttcttgacctacatctgaaatatgcttaagtattaggactatttaaaaataaattttattgttttttaaattttatttttattttatttgttttatttctatagagatggggtctcgctatgttgcctagactagactcaaactcctggcctctagcaatcctcacatcttggcatctcaaagtgctcatattacaagtgtgagtcactgcctcacctggcctggtttttgctttaatataaaaaagtataaagaagaggaaaattgcacacaatctgattctttacatattcactaaattagttcaaaatagaaaattaaagtgccaaatgaacatggttagaagttcttaagagtaaagaggtataagaagaaaagttaaagccctgctcacttgtctttcactccaaaggcaataatcttaaacaatttctatgaatttttcacagacttttttctatacatatattagcatgtatgtatgtgtatatccttgctcatttgtataaaagggattatgctataatgctttctgtttttcactttttactttgtcttggagattttctcatattagtacatatagtgagacttgcatttaacaattgtgcaatatcccaccatatgaacatatcagttcagtgctgataattatttaggttgcttccagttcatgtaatttgaaaaatagtttcaagtatgtttgtacaatacattattacaaataaaattgctggttgtatatactttctttgaataggaattggcaagctgtcttctgaaaaactgcaaattttactctctgccatttgtttatgaatgagcttaattctcccatgaccccatcaatcctcaaaattctcaaatctgatgggtaaaaaaattgtgtaagttttaaaagctcacacagcctagaacatatataagcaaataaatagtgttttatactttcatattgttaatgacaccattgatcaaaagccttaataaattcttttgaaaatgactttcagaacaacttaataaattacctatctccaagtcacgtcttcctttatatttatactttatttttgattcccagtgatattcttcaacttgagtggtggcacaaaggctctgttaggggattctctctcctcatttcagtaatagccttcaataactcctaataataataaaaacaaggcccattaagtaaattgtgaacataagaatttctagaacaattgttatttgtagtgatttgtatcatataatcaattcaaaataagtgatctcaatcgaaacttcgagacaagtccactgcttacccactctcactcaactcctgaacctctgtatataaatctctccatatagaaaagaatcttccaagccatgcattttattcagagggctttggacaaaggcagtgtaaggtaataccactcagtcatattttattatatatatatatatatatatatatatatatatatatatatatatatatatatatatacacgcactggggtagatcttgaagatacgatcatgagcaaaaagaagcctggtatttgctttaatgcagcttacagtctaacatgagaaagagacattagtgaagcaatcatacatacacacatatgcacacatgatatatatatgtgtgtgtatatgtatacacatatacatactatatatgtgtgtaaatatatatatggtgtgtgtgtatatatacacttacatatacacacatataattaaaaacttaggcacatgttataaatgaataagatagtttactgaaaggctactatataccaggcactgtgataagtgctttatagatatcatatcctacaagtctcaacaactcttaagaggtaggcatttatgattatcaccacctaacagataagaagctaagagtcatagaagagaaggaaattgcccaagctgcatacctaacaagtgatggaggtaagattcctttccaggcagtctaatttcagtggctgtgagcttaaccagtggctctactgcccttctctcagtgtgaatgcattttagataactgacccagtccagggagttcaggattgcctgagccagaccatgctggaccttctaatctatattaaacacatttgaccttcatcccaacactgatgggaagcaatgaaatgattttaaacagggaacaatagaattatatttaagatttgaaaagatcactcttgtggtagcttggaaaatggattagaaaggctagaggaagggaagccaactaggaggttactacaaagtccaggtgagagatgatggtagttcagactagggatgtgatgttggagatcaacataaataaatggatgcatttgagaagaagcggagataggaccctgtggtattttggaaatggaaagagaggaaaaggaagaaaaatgcttcctttgtttctggcttgtggctgaatattggtagtgccttttactgggagtagtggcagtggctgaggaccaagcttggtagaggagagctaatgatccctggaaaaggttgcatttgcaatcttcttgagatttacaagtagggatgtcaagcagacagttgaatatcagtgtaaagtgcagaggtaaggtcctggctggagataaacatgggggtcactggtgtgtggctgatgggtggcactgtggggatgagtgctatcagctgaggagaaagcacaaggcatggaaggaagaagccagcgttatactttgaggatttctgacaaaaaaatggcagatacaagagaatgaactggaaaagtggactgaaaaagagtggtcaaagagtatgatgtgatgtcctatgagtcaaggagggagggagctgacaatagtatcaaatgctgctgagataacatagtttttttaaatgtcatttggatttaatggatgaggggcagctctctggattttttcctatgtcctgttcctctatcacgttagataagtatcaagtgagaaagcggcaaatacattaatttaactttgagtacaaatgattctgtcaaaatactattgagtattatattctcacctcgtattgagagaaaatgtaagaaattgttttaaaaagaatgtttttgcatcttttggaaagcattcttgaaaacattgaagacataattcattacattactgaataatttatatataataattttcttgaaaatactctctcagaatctagtactagcaaaaagttcctttctcttaatgaactagtaagtttccctttactggacaatgaaagagtataagctaattatattgacctaatatatattaactctatatctaacaatataacctaaatataatcaggaaattcagagctacagttaatatgaatgggctgtaactaattatgtagcatataggtttatttgtaaagtggctcatattctttttagaataaaagtaattaaaagtatgtaaaggaaagttaagtgaataaataagtagaaaatagtttgtacattatattgccagtaactttgatgggaagtcaggtataaatagattcaaatttgactcaagaacatgctaggagtgttaccttaacttaataaaaaatgaatattaatacttttcatatgggattgctttgaaaagtaactgtgataatgtatacaaagtatccactatagttggcacataataagggcttaactgttgttgctttctcatgacatctttctccaaacatcaaaccacgctttcatggtagaatttgttaaatggtaacattagattttttagttttatctttgctttggtttgtcttggccacactggctcttgctgtgttatttgaatttgtattcctaatgcctagcacattggtagcatgtgttcaatattgaattcacattcttgaatgactgtgtaaatgaatgaatggcaaatggatgtggaatgtgtgcacttccatctccttctctgtcccttaccatccagctttttttttttttcagtaccagtctagctcctcccgtcctttaaggccccttaaatctcacctctgttgtagagcttctgataactataatgtgcacagactggtctctgtccttttagccaggtggtttttatcctatttttagcagtcggctttccttaattgaaaaatcatgtgccatcttggtttatgaaacagagagtaaggggctgttctgcccctgcccactctgtggtggaccctctaccttgtatagcacaggcatcctctggggtatgccatatattttgacccaaaatgacattcaacacattcactttgctttattctccagttgtcccatgtgtttaatacgtattctagtctgcccaacagaactatatgatccccagaggcaggaagaatgtcttacacttccttcctatctctcatgagacctacacaggtggtgaatctgaaataagtccccaagaagtgtttattcattatttcttcttaggcttctccttcccttcttgagtcgatgtcaactgaggggaattgaaatcttcctggttgatatggtagcctcatcagaaagagtccttattatgaacatttattaagttcctagttctgttcaaaacactctgtatacattgcctcatttagttcttatatccctgtaggatagatatcaacatttcagttttactgatagagaacagagacattgagaatttaagtaacttgcctcaagtcccatagcaaataaattttaattcagttatgtttgattccaaagctctggccctctctactatagcatgtgatctctctgttttaactatgttttacctttttttttaattttattttttggaaggagccctatacccagatggaacatctggaaggaacaaaaatgatgacatggttcctcctgggaaaaactacacctacgtctggccggtgagagaagaatatgcacctactccagccgatgccaactgcctgacctgggtgtaccattcgcacatcgacgccccaaaggacatctgctctgggctaattgggcccctgctggtctgcaaggaaggtaaggagctttgtttccaggtaactagggagttgaaatgtgaataagattcaggtcttattttgcctacctcctttgctccacacagaatgtgcctcttccaaatttctttagaaattctgacatggaagatcaatctgacaccatagcagagggcaataattcagatttttgtctaagaatcatcacagcattctgagactttattgttattttaaaaaatgatatttcataacacaatgtatagaaaagtgagaaatttagtcaaatgaccagtaatgccttctgcttcattatttcacccaaataatcatttgctattttatcccttattagttgacttagcatgtctgtagtttgtcaataaaatggactccctttagagacagccagtcttccaagtatgtgattatgaagatttctgttttatgacttttctcttctatggctctgtcatctccattaaagccttttgctgattttatatggtgggttatccttgtaggtataggtcttcaccaaacttcacacttgcctgacactattggaaggaagcaaagctcatcttgatttagttctttctctctactcttttgaatgtgcctgacaggtatcctgaatagatattcagggacacggaatgatgtggatcgagagtttgttataatgtttactcttgtggatgagaatcaaagctggtacctcaatgaaaatatcaaacatttctgcaccaaccctgattcagttgacaagaaagatgctgttttccagaggagtaacaaaatgcatggtgagtacctcccatgttcccaaacgtataccaggccttttatactataaggtactacaagggataaaaaatacacagaaatgttgatctgagtttggcatgatttataactcagggatgaccatggttagaaagtgatacaatacatgacacatgtttgaacctgaaacaatctgagggggacagagcagtggatgcatgctaaattgggcatgcagtgtggacaaagccacagggctttgggaaaatggagggatcgatgttatattgtaattggaaaagaatcggtgcctgaggtgagcccagagcatgggtgggcttagactgactggaaggagaaaggagaatgaaatcatcgttctataataatcctgtgttttgcaacattttgcttcatccagtaaccattttctgagccgctgataaattttaagaactgagttatgcatggggtttaaataagcacttgtgaattcattatatttcccaggcattctttacatcaacaaaatttactgagcatgcactatacatcagactccatatttgttcaaaatagtgaacttctatagttacttcattagttgagatggggcacttactcatgcctgttttgcaaagcagtagcttaatgtagcattttaggattttcttagagagttctagtgaacataaaggaaatagtcaacctacatatcccaccttattcattgacatatcttctccttctattgcttctctgtctctcagaattgttctaaccaaggtatcctcaatatagtcataaaatcataagaggaatagaaggagctgaagatcatctaacgtctccattttacagaagagaaactgaggtcaagagactatcaatgacttgcctaaggtcaaagtgataattaatgccagagagtttcctgagagaagtcccatagcaaataaatgtaaatttggctgtgtttgattcctaggcacatcaaggcatgattgtcagtacattgattatttccattgtattgcatgccttcttttttccttctagtggtattttggcaaccttatgtgtagtgattcttggaaaatattttaggaggaaaggaagtaagggagagaaggaaaggggaaggcagggaggcagagaaaacaatgaaggatggagtcaatgaagacataaattcaaatcattgctgtgaccagttgtaatgcatatcctttacaaaatgggagtgatgatctcaaatattgcagaaaactactaattgtgattacttaagactcacctgcccaaataattcctcttactctgtatttattcttttgaagtgaaaatgtccaacaaaatgaaatgaattacataagcaaacatagattacatgtatcataaaaagaagcctgtccaggcacaatggctcatgcctataatcccagcactttgagaagcaggtgtgggaggattgcttgaggccagaagttcaaaaccagcctgggcaacataggtagatccgttatctacaaaaaattcaaacaaacaacaaaaaaaatcagctgggcatagtggcacatgcctgtggtcccacctacttgtgatgctgaggtcagaggattgcattagcccgggagtttgaggctgcagtgaactaagtgccactgcaccccagcctgggtgacagagcaagaccctgtctcaaaaaacaaaaacaaaaaaccctagcctgtatgctgaagtagatgtgtgtttgcaaacaatccttcaagactggaaaagggtggggtattgtggcacacgcctgtaatcccagcactttgggaggccaaggtgggaggatcacttgaggccaggagttcaagaccagcctggccaacatggcaaaacctgtctctactaaaaatacaaaaattagctggtcatggtggtgggcacctgtaatctcagctactggggaggctgaggcacaagaatcttttgaacccaggagacagaggttgcagtgagctgagattgtgccactgcacttcagcctgggtgtgacagagcgagactccatctcaaaagaaaaaaaagagagagagactggaaaaagagacctaatcaagtaaaggaaaaaatttaattaaaaaaatctagactatggaagataattaatatgtacaagttttattgatcaatttatttaaatttactaaaataatttagaattaattgtgctgcctaagtcatcaggcatttcagcaacaattgcttttaactcagttcgaacttaagaagggatattgtgactttttaaagccctgaatcaagttcttttctgaacttggtcaactcccagctgccatttagatggttttaaagtattcggtcctggatttacgccataaacttaataagattctgctccagcaacatgtagtaaaaactgtttttctcttggctttttaaagtaaacaaacaaacaaacaaaacagttctcataaattccttttaatcaattccttttctttccatcttactacatgcttttgtcacttcattaagtagatactatgtgccagtttttctgctaggtcctgataactgttaagatgaacaagacagggtttctagttccaaggagcacagaatctggtgaagacagcagatatgccagtgaaggattatgacagaaggtgactgagcctcctgtaaatatgagcagcactctgttttctcctgacctcatattgcgttcccacagcagctccgaggctgttctcagtgtatgctgatcttcacttttattgagtgttttctctggaaaaaggccaataaaaacatttcatttctcttttggacaatatatatttctaagagccaggtttttctgcaccaaaaccttacaaccaatggtctgcactggttttccagccatgcttaagcccgtattaccaacatttctggtcccagtcgcctctgcaggggagtctcttccactagcgtgtttctgtttccagccctcaatggatacctcttcggaaacttcccggagcctgatatgtgtgttggagaatctgtgtcctggcacctatttggaatggggaatgaaatagacatccattctatctatttctatggtaacaccttcatcagcagagggcatcggactgatgtcgtcaacctgttcccagccaccttccttacaacagaaatgatagccgagaatcctgggaagtggatgataacctgccaggtcagcgaccacctacaaggtaaaaaggataaagaccagagttgatatgtttagaatggtacaatcaaaccacacagtcactagtgctcatccagtacctactgttagatagagccttgtatgtactatatttaattaggtaataaatatacaggaaaatataacgctcatctctttgatattctatcaacagatatttattgaccacttctgtatgaaaaaagtggggaagtgattaaaaattgatgagaccttcgaggaacctgtagtatagttgttagacatagttagacattcacaaaatgaatacgatttaaggcagaatgagataaatgctctttgggtgttgcagtcactactctggagcaatcagaggggcttcctgaggagctggctcctaacatgagccttgaaatatgagtaggaactgaatagatgaagaaggaaagaaagacttttgaggaagcagcatgaactgggaaaaacacatgttctttttgagcaactgtaagtagagtaataaggttttagcactggaaaggactttctggataataaggaccaatcccccctcgaattatttaatttcgttttgaacatctcttgtgagtagttatagcagctcatctcatctctggactgctctattggaatgttcttcctcaaattgagacaaaatccattgacctatagcttccttcatgtcctatgataggtgcatgataaacatttgttggcttaaatgcctgttgaatgacctggtcctggtttcttcagacatcatacactatgtcctttcttagctggaccataatgttccttacagagaagtgatgacagaagagcctgggaggctcatcaggccccttagcaaagctaaggaggtggggctgtgtgatccttagctcttttggcacactagtgacataatcggtgcagttatttaagaagataaatgtatgcatgcaagaaggacttgatggaggaattctgaccactggatgctagttaagaagcatttgacagtgttagaggtctaacacctaaacgtctgccctaagatgatgaaaccaagacagaaaaaatatgttaatggaatagacacagaagaaataatgtctgatatttggatactaacttcccatagtcactaataggtgcaaagatccagctgctcagggctgcttttgtaacacattcttgttcctgtccaccttccacagtgagtcatagcattagtcaactgcagtatcccaattacattcaactgaaaaattaatcagttaatatgtactagatgctcttctgggaaaacaaagattaacaagagaaggtttctattctcaaagagtcttatgctgttaaatctgggaagaaactgtagatttaaaatcaagatattagctgccatttgagactagtaagatcgctaaattagcccgatagttgtggacataagctagtatttatacgttccctgaaatacagtatttctaaattgtccatgccttcagaaaaaagttattgtaaaaaaattagaaaatacatataattggaggttttttaacaaatagagacagggtcttgctatgttgcccaggctggtctcaaactcctgggcccaagcaatcctcccaccttagcctttcaaagtgctgggattataggcatgagccactggatctggcccctataaattggttttaaaatcagtagttccataatagaaatattttatattcacattttggtgaatatcttccctattttctatttcttaatatgtaaatatatatgtattttaaaaaatgaaatcagtctattaatgctgcactgtagctaatttttctcatttacaaatatatcagaaacacattttcatgtcggtgaatatagagcttacttcatcatggttaatacttccagtgtccattataaggagattacatcttgcttaatcaatactctattgcttaatgcttatgtttcccaccaatttttttgctattataaacagcactgatgactattatttatagatgtttgcacttttgtctgaacattttcttagaaaaactcctagatttagaatttctgggtcaaagagtatgatttttttaaaaaagctatggacatacattgccacattctcttttggaaattgttattcttctacacgaagtgtatgagtatggctctttccccattcatctaccaacactgagaattattagtctttctaatctttactaatctgatcaatgaacaatagtatcatttgaaaactgttaaggtttgagtactatttgagtactgttaaggttgaacctctttttcatttgtttattggccaatattatttattttgtgaataaactatttctgttccttgctcattttctattggagatttacttgttttcatctttatctgtaaaagtgatttacgtattaatcttttgtcatatgtgtcacaaatatccctcctgttgccatttatcctttttaaaaaaactttctttatggtccaattttctgtacagaagcctaaatgttcaagagccaaatctatcagtcttttcctatatgattccttttgtgatcatttatgcctcagctcgtggttttcctctgttctgcagctggtatgctggggcaatacaatgttgataactgcaaaagtgatattttctaccccaagatgaagggtcaacagaggcgctactttatagcagctgaaaaaattctttgggattatgctcctcaaggctataacaaattcagtggtcttcctctaaacgcctctggcaggtaagcaccctttgttggtgtttctaagcctctcgtcagagaagcatgtgttaggctttctctgtgatctaatttgtattccaaccactgctctgatgagcttatactgcatagatggcataatgtagctgcttaaggtgttcttaatactgcaaaagcactgctgagaactggtagaatattttttgttttgtgacttgacggctgaatcaaaacactagatcattcactcattgatcaaacatttcttgagtaggcactatgtgcaaactatagtgcaaagtgccattagaaatactaagctgacaaagaatagagtaaggcctttacacatatggagcagacagtcttgaagagggaatgacaggagatggagatgacctggcctaagagggttaccctttttggttcaaggatatcctgatttaagttgtgtcccctttatgtcctacaaatattcttttcctttctattcagtaaaatgccatttttctttcaaagccttactctaatgtcacctctgaagtgaaacctttgactcttgatataaatgaattatgttctctctgcgctcccatagaatatactatttaaaaaattaatctagcaatttattaggtggatctggactcctgtgacttgttagtatataatcatatgcaaagttgtctgtgaagatactaaaaaatgtacagtgtgatatcaagaatccttttttatatttaagggaatgttttaaaaattctctttgtgatcaataaaacatcatttgtttctttaattgtacattttattcattcattcattcattcattcatactttcactcattattctaccaaacggatgcacttgaaccctgtctaaagaatttgtgtgaaccatatgtgaaagactctgatatcaacattctctattgactagtatttctccataaacagaataatgagaattagcattcaaaattgtcttaggagccttctagaattctgaagtgccttctgaaataggaaagattaaactatattcaatcaatgtttaatgtgatatatgaaagcacaaagtgcaagatgacatgagggatgcaaggatatctaaagcaataaaatgcagaggaagaagctgggttcacaagagtagagaagtaactgcaagttacaaataaaagtgaggtgagttgtcctggtagtgagttatctggatgctcagagagagctaagctggccagggaacacattatagaggaagtgagacttaagcaaaatcttaaggagtgatagaatttatttaactgaatagggaagagaggaattttagatggaggggttgatgcaaagcacctgtggcatgggaggaatgaacagatgagactgcagtaacaatttgcatagaagaatgggcactggcatggagaaatagagaattggggtaaacgggatatcaattgcagaggtcctttaatctttttgaacattatttgattggcaattggaagcaattgaagattttggagcaggtaaatagcaataacaattgccattttggagattaatgtattaagtgaaaaaataagcacagtcttggccattgaaagtaatttgtaatcacggtcttggccattatgaccattatggcttacttttgcaccaatctaatagttgtgtgtctatgctgagaagaaaagtgaatgagccagtatcagatagaggatgcagttcagaggttcatataatgggctccacccagtgtgattagggcatgaactggggtcgtggtagtgggaagaaaggaaaagaaaagatgcacaaggaggatagaaaaggaagagtgccaaaaaattttacaaagtaaggatgaatgagttaagggaatgaagcagaaaaagaaaatctacgtggctgcaagagtgatggcaccattgatggaaataagatagtatagagacagtattagtcagaatttatattatcatattcacgacttggaaattttgcatttcatgcatatggtttatatggtagccctccaataattacactatttgattaactagacactccattccttaataatgccagaaatcaaagagcttactagatgcagagaatattcatattaatatcagcaagagagagagggatgcttattctgcagagaaaccagttagctctttgttactttgtagaacaccattctggaactctactattggtaaataaggagtttacttgtgactggttcagtgctggacctcttgggaagaaagtacaatggctgagagaaatgagcttgagtatcacccagcctctgaagacttttagggctggttaactattcctgggaactctgtcaaggcctgtgctgtcttttctggggacatgggtgggcgagtggactaaaagtgatagaatgaagttctataattaaagtatttggtggatatgttgagaagtgtcctcaatcacattcctatgtcttttcagtgactctgatctctacttcacacaaggggacaacagaataggaggaaaatactggaaggttcggtatactgaatttgttgatgcaacttttactaaaagaaagagactctctgctgaagaagcccatcttggaattcttggtacagtaaaaccatcccccatgcattgaacccagggagatgttttagctgggcatgtacatctgcacagaatgactcttctgctttacttctttctgtctcttttcattctcttctctctcttcttctggatattttttcaggcccagtcatcaaggcagaggtgggtgataccctgttagtgacctttgccaacaaagccgacaaggtctatagcattttaccccatggtgtgatctatgacaaggcatctgatgcagccccaaacctagatggtaagtctcactctgggcttagggaggaaacaggacgggtgagcaaagcacttagaaataaacagtcctggttcaaatcctggtcctttccattacctgccctgagagcttgggcaatcacttaaactttctgaacctgattctctcctgtcaaatgcagataacaatactcacctcacagggctttggaaagggatggagagaatttaggacaaggtctggcccatggtaggttcttaggaaatgttcatttctttctttttttctcagcaatatagtaaatctcaaaagtaagctactttcacagtcacttctttttctctaagatggagagcttttcagttgcaggttgcataggattctgcaggtgaaggctgaagggaaaatttgatttctaatggtttgttgacatcgaaatcttacacatggtctttgctctgtatcaaatcaacaaatatatttataaaaaacagtaatgtgtgcttatcatctgatatggcctctccccatcacagagtacatggcataggttctctaaatgtaagaaaggtagctgttgcccagtggctgtgggaactctaatccattcatgatactgctcttgggaaacttctagttccttggtactcatccctattactgcagcagacaccctggcttcctgggatactcttcacactcgagtgtgatgccaggcccagttgagaacaggttttgtggtgatagtgaggggacagaagagaaaggaatggaagagaattccctctccctggacccatcctcaccctctcttgctgcggtaacaattcctaaaaccatcctctcctctttggtcaaaataccaaaatggctgcgtgcagtgggtcatgcctgtaagcccagcaatttggaaggctgaggcaagaggatctcttgagggaattcaagattacagttataatcatgccactgtactacagcctgggtgacatagcaagaccttgtctcttaaaaaaataaaagaaaaaaatgctcagaatgactgtgtgtgtgtgtgcagaaagaacactagaactgacaaaatgtttgttaactcagcaaacatactgggcacctttttgcagagcactggataaaatgcagaatgagcctctggccttgtctagtaggaaagaatcaatgtgttttttggcagtacggtgtaagggttaagtgcacagtctttggaatcagacaaaaactgagtttgaatcccagatttgctatatatcaatgtcataaccttgggcattcactaaactcctctatcttgtagttatttggatgatttccaagttcagtctcctatatttcaaactctttaaagataggtttcttgcttaattcttttgggtatcttctgcaagaccaagtgtaatatattctacatagaaagcattccaatgatattttatgaattttcacttaactgttgaatgggccactatcagtcttttaatatttgctaaggctggcatttgagcaagaaattgtatgggatttatgaagaagataatcctttgatttaaacttttatctcataagccagcagattgtggcagtggcctcttctggtaggatacataagagaaaaccactctcctggtacaaaattcttcatcatcagagggaggcacccagggctggaagacccagtctgaccaatgtaatgttcttgcctgttgttttgaataattgttttgtttatatcctcaggatttgtgaaaccaggggcgcatgttaaaccaggtgaaaccttcacatacaagtggacagtgcctgagagcgtaagcccaactgctggtgatcctccctgtctgacctatctttacttctcagcagttgatccaattaaggacaccagctctggcctggtagggcctttgctagtctgtaaaaagggcgtcctcaatgctgatgggacacaggtaggccattgagtgtcaccagttcttctcagggttgtatgtgggagagatccgcaagagccagagacgagacaggaatagtcagttacaaaaagcaatttgtctttcttcctcttgaagtagatttctacataatggagattttatttgattttctggtgaaaatgtaagatctaaatttatagttacaaatgcccactcaggaacctagaatctctgcttgttgtggttaggatttggcaggcctctttttctgtgtgctgcttttattacagaatctttagagatccacatggaatgctaattggaattattcttcttggacaaggtttctcaaatcaaaattacttggggaccatttaaacatccattattcagatactacagactaattaaatcagaatctccagatgattccaatgtgcagccaacgttgagaaccactgtgacccacaactgtaaaatgaaagttaatcactatggctgaaggaaaaagaaagcatttagataacttcttgcaagtcccaacttagagatttgaattgttcaactgattagtgtagcgaagcatagcctttcaagctatgtctacatgatattaaacatattaatgaaaagagaaaaacagtcatttaagcatctattttaccaatcagaaatagcaaggacatttatttaaatggtatattttataatttttggcattgtgtggctccacttctggactcaaaggaatttccagatttaaaaaacacaaaatatcttgatcctatttggattttcctttctctacatgaaggaacaatcccggaaatgtctattgcatgtgttataagactgaatgtttatgctgtgcctcaacaagcacacaaggcaaagcggaatgattattcatattttaaagctgaagaaactaaggctcagagacattgagtagaattccaggaaatacacctagtaagtagtgaaagttggcagtaaaacacaggaccttgaacatccaactttgtccttttccaatgcatcctcttgcttcctcgcagctaaatacctaagccaaggagatgtagtgccagaaaatgtttgaaaggtagtgctaattttgcccccgctgtgtccgtttaatggtacctttgaggtttgctagaagcacctcatagtctgtgggaattgttgcctaagccaaatactattcatggtcagtccacttacacaaaattcatgaaaaaaaaaaagtaccctgaaacatcctatacctataacttggctgagagagaaaaccatttggccagatggaaaggtatgttcaattcaagagttacttatgaaatacctgctatgtgccaggccctctataagcaaaatggtcagtcttcttctaggcaggtggagagatgaaaatgggaataagtgtttgcgtctctttccagtaaattgtcataaattctcccagtggtgaatggtcaggtacagaatgtcatttactaacacccctagtcctccacactaaccattcagtcaaactccctactcccattctgtttctctctttgaatccacctctctatagatctcacacttttttggaaataatctgacttatgaaaaagtagaaaaaatttacaaagaatcttcatgtacccttcacccagattcatcaacatttgatctcatttgctttattattatctctctttgtttttatgggttatttttctgaactgtttgagagtaggttgtagacataatgtctttcagtgtgtgtttcctaaaaacaaggaccctctctgacataaacaaagtaaaattatctgagtcagaaaattaacgttgacattatcaaatctacatacattttaaaattttgccgattgtctcattgatgttctttatagcaaaagaaaaacatgtttttcctggtcctgggtctgatctaggatcatgcattgcattgagctgtctcctctttcccccatgattaatttctttaaattttttttatttttaatttttgtgggtacatagaacttgtatatatttatggagtacacgagatgttttggtacaggcatgcaatgcataataaccacatcatggagaatggggtattcatcccctcaagcatttatcctttgtgttacaaataatccatttatattcttttagttattttcaaatgtacaattaaggtgactatagtcaccctccccatgattaattttatcacagggcaccaggcatgatttttctaaagtgcaaatgagatcaagtcactttcctgttcaacacttccagtggtttcctgtcacacttaaaacaaaaatcaacactatttagacatgccccagcctcttgttcccacaagtgggcaccacgctccctcatgcccacttatgctccatccacattctgttcctctctcaggccaagcttgtctttggctttgggcctctgtaccaggctccttatgcctggaatgtcatcccctgacctttgcgtggctagttcttcttgtcactcctcagagaagccttctctgatcaccaggctaaggtcactttcttttatatcacctgattttactatcacttaccaccataagacagtttccttgtttatttatttgcttatgtgtatagtatgtttcctcctacaagaagataagtgcaatggagcaaggaccttgcctatcttatcttcctttcccagaacaatgcatggcacattgttgacatgcaacaaatatttctggttggataaatgcaatacagggtaagtactcttatccccaaggttaagaagtttagttagcagaaaatgccatattacacacatcttaaacattgtgtggcctgcaaacaaacactgaaaattccagtgcaacctcatttagaaaactcattttccttatccacatttcaatactcagagttgtgtaatgggttatggtttagacctctcacctttcttccctgctgctgtgggagcctactatgtactaacatatactgttcacaaaatagctgtgtgctgcagacaccagccactactcagatgttccatatatatatatatatatatatatatatatggagaaagagacacacagagagatatttattatgaggaattggctcatatgattatggagactgatagatctcagcacctgcaggctgagtcaacaggcagaagacccaggagagccaatggggtggctccagttagaaagctgacaggctcgagaaccaggaagagccaacattttagtttaagcatgaaggcaaaaagaagccaatgtcctagttcaaggacagtcaggtgggagaaattccctcttatttagaggaaggtgagccttttggttctttctattcaggccttcaaccaattggatggggtacactcatgtcgggaagtacaatcagttttattcagtctactgattcaattgttaatctcatccaaaaacatcctttcagaaacatccaggataatgtgtgagcaaaaatctgggcacactgtggcccagttaagttattcataaattcaccatcactcagggttctgtcaccttccttctaatgttttcttgggctaacttcccaccctcattaaacccagttaccctccaaatacctgtcaagcaatgaggttcttcaatgcaactcctttcaattgttcattcttctactatggatgattgcagtctcacctaataataacagcactgagtgcttaatatttgtcagttgttgcgttgagtgctttagctaagtcatctcatttaatcttcacaaaaaacatgatgtggggactcctattaccctcacgttgcaagtgagggaattagggcttagagaggataaatcacttgctccaggcttcacagtgggtgaacagaagaatagcattagaacctaggtttttctgttcacatagcccatgatcttttaaaatatattttgatcctttatgttcttccaatttttaatattttattctgaaaaatttcaagtcttcattgttttcttctgtagctcaagcttttataccactgccttctaaagcatcatgtaattaaggaaataactatatataaggaatagtaggcgcaaggagtactcacctcgttgatgaggagttaggaaagcatcacagaagtgggcagctaagcagaaccatgaggttgcttagtggtttgcaagagaaaagagtggcagactatcaaagctgagggaatacatgcatgaaggacagagggatgcagaacacagcaagtgcagagggtgacaaggagcttggccttgcttcaaagtgccaggaggaaagagtcaagagatgaggctgaacaggtaggcaggaaccggaataccattagatgagactgtattgtccaacataaggagagagatatggtcagatgacattgctgagggtccctccagagcatgcagcaggatgaaggtggcttgggtggggagcatgttagagacaggaaagcattgagggatagaaaggatggtcacctccattcttcacagaattagaaacaacaactttaaaattcatatggaaccaaaaaggagcccatatagccaaggcaatcctaagcaaaaggaacaaagctagaagcatcatactacccgacttcaaactatacaacaaggctacagtaaccaaaacagcattgtactgatacaaagtcagacacatagagcaattgagcaaaatagagaactcagaaataagacagcacatctacaaccatctgatctttgacaaacctgacaaaaacaaacagtggggaaaggattccctatttaataagtgatgctgggagaactggctagccatatgcagaaaattgaaactggacccccttccttacaccttatacaaaaattaactcaagatggattaaagacttatgtgtaaaacccaaaactataaaaaccctagaagaaaatctaggcaataccattcaggccataggcacaggcaaagatttcatgatgaaaatgtcaaaagcaattgcaacaaaagcaaagtgtgacaaatgggttctaattaaactaaagagcttctgcacagcaaaataaaccatcatcagagtgaacagacaacctggagagttggaggacatctttgcaatctatccatctgatgaaggtctaatatccagaatctacaaggaacttaaacaaatttaaaagaagaaaaactcattaaaaagtgggcaaaagacgtgaacagacacttctcaaaagaagacatctatgcagccaataaacctatgaaaagaagctcaacttaactgatcattagagaaatgcaaatgaaaaccacaatgagataccatctcacgctattcagaatggcaattattaaaaagtcgagaaatggcagatgctggcaaggctgtggagaaataggaacacttttacactgttggtgggaatgtaaattagttcaaccattgtggaagacagtatggtgattcctcaaagacctagaaccagaaataccatttgacccagcagttccattactgggcatataccaaaaggaatataaatcattctatcacaaagatacatgcatgtatgtgttcattgcagcactactcacaacagcaaagacatggaatcaactgaaaagcccatgtcttttgacaggctggataaacaaattgtggtacacgtacaccatggaatatcatgcagccataaaaacgaatgagatcatgtcctttgcagggacatggatggcacttgaagccattatcttcggcaaactaaagcaggaacaggaaaccaaacaatgcatgttctcacttataagtgggagctgaacaatgagaacacatggacacagggaggggaacaacacacactgcggcttgtggtggtaggggtggagggaggaagagcatcaagataaatagctaatgcatgctgtgcttaatacctaggtgacaggttgataggtgtagcaaaccaccatggcacatgtttacctatgtaacaaatctgcgcagactgcacctgtatcccaaaattttaaattaaattgaaaagaaaacatagtcatctctctggtcagttctaaaggaaagcatactgcagcgatctgtgatgctgtgtgatcagataggctcaaatagactgattaggaatacatgctgtgggaagtcatatccattgtcccctcactatccactcaagttaacataatttagctaagtctcgtcagttatatgaattcattatttcactcaaaaatgtatacttgatgcctgcttttccaggcatttttcttggtgatgcaggtacagagaggaatccaaagtgttcctatcctcatgaaactcacattgcagtaggaaaaagttaaaaaaaataacttcataaataaaatagtttcaggtggagataagtgctgtgaagaataaaatagggtaaagtgagtgagtttctgggcagaagatggagataagtttagaaggatggttagggaagaccactctgaggaaatgacatgcagaaaagtgaattgaggaagggagttcttcaattcatgttccacaacacatggaaagaccctgaggcaggaatgaggttggtgtgttcgtggaagggcaaaaggccagggtgtctggagcaagctaggaggtgagtacagggaaatgaagtcagagagagaagctgggccagggctggcaggtcagggtaaggagaaaaagtccttgaggaccagcctggcaacagaggccaaaagagtagaaagccttctaagcaggggctgatttccttggaggacggatgtaacaagaaagacaaattttctgagtggggaataaattcatcagagcaacattcagtatctttatttaaaaatgacctgcgaactcttgggctgatgttgatctgccctgacttattaatattttgtgtgaactttgaaggaaagcaattctgtgaattcctccaagctgtaccttttatgtattcatttctttcttctctgtagaaaggaatagacaaggagttttacctactgttcacagtctttgatgagaatctgagcagatattttgatgaaaacattcagaagtttatctggcatcccttcagcattgacaaagaagataaagagtttgtgaaatccaaccgaatgcatggtatgacaaatgacattcccgcctgtaaatgaaaggctgacttgcattagaagtgaaaatgattggtgtgtttgaattatattaattttggtttcttggatattgttcttggtcatgagtaagttatttcatgccttcagctttagatggtatggtgaaacctccctatctctcagagatgtgaaatttaatacttctagagcactttatcagccttagatgaaggaacacaaattttaaactagcggccaggcacagtggctaacacctgtaatcccagcactttgggaggctgaggtgggcagatcacgaggtcaggagaccagcctggccaatatggtgaaaccccgtctctactaaaaatacaaaacttagctgggcatggtggtgcgtgcctatattcccagctactcaggaggctgaggcaggagaattgcttgaacccggaggtggaggttgcagtgagccaagttcgtgccactgcacagcctgggcgacagagtgagactccgtctaaaaaaaaaaaaaaaaatttaaactagccaagttcacagtatatcataaatgtagaaaattactgacaaactactctcccttgggttcacaataacattaagtctgaaaaccaaagtgacaataggagataatcattacatagcaaagtgtctataattaagtagtatgaatgatttaattaagtagtatgagtgactggtgaatgttaatttgtgaaacactagctgttcctatcccagatcttcatttgagaggaattacttaattctctctccctgtctctttgtatcaagtgttacaatagcaaaccacctgctaattgcttgtgagtaacacaggatgtcattactcttaggcatattacctaaggtagcagagtaatgagagtccaaactcaatgcctgcaagagtgtgcagtcaataaaagtgcccgaagcaagtaacgtaagacaacaggtgctaacctgcttgttttaggacccagcataaaatctatttattgccttttaaagcattatggaagaataacaaaatagcccttaacctcccttccttgcatggaagtaaaaaatagtccaaggttacaagtgccccatggcaaccaggtcacagaccctatggtcccagatgctcatttccaacagagtcccctcttgtgccaatggaaagcatggagtagtacatttcagtgtcatcttctacaaaaggttttgctgtaactgaatatgaatattgtttccaaacttcttagtagacaatataaaggggaaattaaggtggaaataaggaaatatagcagtttcttggtggagaaactaaattgtaaaagaaatttatcatcaaagaggttggtcttcatttaaaaagataataaacaactgaatgaactacatcaaatccagccccaccctattttggcaatgtgaaactactttcatatttagaaatacaatatatagtccaggcactgtggctcatgcctgtaatcccagcactttgggaggtcaaggtgggaggatcacttgcatccaggagttcaagaccagcctgggcaacttagtgagaccccatctctacagaaaatacaaaattagccaggtatggtggtgtgcacctgtagtcccagctgctactcaggaggctgaggtaggaggtaggaggatctcttcagcccgggaggttgaggctgaagtaagcataatggctccactgcactccagcctgggcaacagggtaagaccctctctctgtttaaataaataaataaataaataaataaataaataaataaatatataaatacaggatatatcattgttaaaacaaagttcaaggcaaataatgcatcttaattcaaatgtcacattaattataaactaagttctagcttcagtcttgcttgcagggagtggaaggaagacagcaacaaagccaaaaagaaagggcctgacatggtgcacaatgctttgtgttgtgtttattatatagtctgtattcaaaatatgtttattgaaagaaagaatggatgagtgactgttgtagaaagagaggctttaaacaagcattccaaggcaagagaagattctctaccagccagccaaggactgaatttattagcaccttgatttatactcagatttcattaacatttgatggacaagatttagatcatttatttgcaaagacattatcaaagatttttttttcataaaatgtggtgtccttctcagaagtgccagaatttcttggaatttctaccaataatcccagatctgagtacaattaccaagcaccactggttttgcagacacagaaatattaggatagtacaaaagtaattgcggtttttgcaattactttcaatggcaaaaactgcaatcacttttgcaccaacctaacaaaaagtaattttatttgacaatgggattataacagaaggtcactcatgtgcatgataatagttccttcctgctataggcttagtagagagcaggaggggggtagaaatatttatttctccaagaaacatcaagcatgagacacaattatgtgcatttaccagtcagacattgcgttatatcatggctttcatccccatggggtgagaatgcggtttctaaattcttgtcaaggcactttttcagatagccactatcaatggattggggttgatgtcaaagataaaaacaatttgccactctggaagcacagagggtcttcatatctaactaatcattatttattaataaagtccctccagtaattgtactggggtaaggaagtacgagttatcataaagcaaatttatttactcaaagactaacctcatataagcttaagtaccccctaaaaaacaatccttctccactaactgcatatgcacatatactgtcaattgatttaaaaatctttcaaataatgctgaatccatgtaatcagtaaaagcatgtctgataacttctagaatcaaatgcaaagcccactggcaaatgagggtcttgtagaattcaatgaattaataactgaggaagagacatttaacaagggagatcataggaaaataaccacaaaagaaaaagattttcatatcgagagccttagagaagagtatggggaaattatttcataaacaatctgatttatcccttagtcattcttagaattagtgtccttgcatatgtgttgttaaagataacatttaaataatttccttatattttcattattcattgttaattttggtctccattttaagtggattcaccatgtggcttttccctggtactgtttattctctgaaaacaaggatcttttgtaaacagtttacatatttgaagctcccctgccccatacacactgataatttttcaccgtctttcttcttccatttagctgttaacggctacatgtatggcaaccagccaggcttaaacatgtgtaaaagggatagagtttcctggcatctgattggattgggcactgacactgacatgcatggaattgtttttcaagggaacaccatccacctacgagggactcaccgagactccctggccctgtttccccacatggccacaacagcattcatgcagccagaccatgcaggtaaacttgctgggtccatctcaggtgaccagatttctaccttcaggctcatcctcttagagttctcccacagaagaaattggtagactttgtgcacttcaagtggtgtagaaatagatatagtcttgattagaatcagagaatcctgacttattagtccaaacacatagtataagggacaaaggggaaatatctaaaatagcatccacaaaacagaagtgggagccttctaaagtctttggtgcataaatcctaggagaatgtttttgattcacagtccataaaaattcagccctgataaagtggatatgttttgctctcattgagcatgaacataatttcagttgcttctctgaagcatctaccaggcatggacatcccagtggatgcttccagattacagatgtagccataactgcagcctggtctctcttctgtaggtactgataacagccttttgattgggggaattctctgttttcattctgttgggcacccttggtttcccaacagggcaagctgcattggatctggaatttatggagacccctgtataatgccagtacctggaacttcttctcttagagattccaagctaatgagataattggggcgttttcataaaagatctagagcaacacgtggtagcacatgctaatcactgcatgaaaagtgaggagaacaagccctatagacattgaacatgtttttccaaaccaattttttcatcagtcttaacaagaaaccaatatgctacctaagatgagtacttgctgtttactaatggatgttctacttctttgctttccactggaactgcagtttagatgtctctgtgtcatcaattaagaacttgaggcttgggcttcaaaatctttgcctaaggactgcctgagactaggagctccatagtcttttctatgtgaacttttcctagtgtccagtctctgtacattagtatagttgatcaattatgaattactcaaatcaagagatgccttggacacaacttttttttttaatacgctcttcaagaccaaagagaggaggggattgggaaatagccaaatcattttaattcatagaaataggcactcaaagttagagctgcccagaataattttagaaatggagctacttattctagtgctttgatcattactccatgtgtcctatacatttctaaagagcttcacaacagtgttttccagtttatgtttggtgataagcataaatctgtgactgcttaaaagcttagtcatttcaccaattcctgtcccttacctataagtcaagaaggagggtgctcaagagtgggtagagtagactatatgctgcaactcaaacatttccatgttcttctattattattatcattattattagttttgttttcttcttcatgctaccttgtctaagatcctctttgttcttagaggagacaattcctcaactattgaagtgccatgatcaatacataaaaaataggcttcctggaaaaaacaaatgtaggggacagtctttccaagtctgtcttcaaaggtatcttctctgtggtttcatataaagacccttcctcatgtgtcctcatcagtgcctgggtgtgcttggtacccattgaatcaacccattgaatttttgctcatctaaaaggagtaactaggcgatgtttagacaacagagttacatgtatagcaagatagaggatacctctgtacattgtagaaggttaatgaaaggtacactcatccctcacctctaaaaacagaggctactagagaaaggggagaaagatttattgatccaatattttcattgagagttaatatcttcaataattttatctgtcttatgtgattttatggtgagttaagaaatatctatctgatgccaatgcatctagaaaattcaatctaaaaattacataatttttgacagacaggattgtcagtattatgtagaaaaatctaattgattgtttttctgttttctgtttccttttcatttagcataatgtagacctatcattggaaatgagaaacttctttgctcaagggcttaatgaagtaatacatttggctttaataataataacacttacatatttattgcactttagaatttatgaaatcctttagggcaaaatactcatcagaaatatggcttaatttgaaccttgtctaggataatcatcttacaggtaattagttctttttaaactgggctggactaagacagtcattggtgattttccaggacagactgtcttctaataggtgtgaattatatgggagacccagaaaagtcatttcttggtagcaatattgtaagtttctttttttataacaaatgaattttggacagtatctttctctccacagaagtaaatatattcaaagtaatctataccccctggggtctgattttaaactactagacaactggtattttaaaaatccacctaactggttattttgtaataaaatatgcaggtttgctaaaaacagaccatcaccaacaaaaataccgagcaccacactcaatgccgagccatttctcttgcaggtatttttagggtgttttgtgccaccatgccccacctctcgagaggcatgggtcagatctatgaggtcagcagctgtgacaacagggacccttctgagcagcggtacgggatgataagaactttttacatcgccgctgaagaagtagaatgggattatgcccctaacaaaaactgggagttcgaaaagcagcacgtggacgcaagaggggaaaggtaccacaggcgccgccgctagggctcctcggtgggatcgcgcatgctccgtaggtctttagtaagtgtggctccctgcaaattcccaggttgtgtctccacagttccggccgacagagacttttacttatgtgcacagattagggaagctgcccacctcggcctccggaaggcagcgtgcggtgtctcgcaggccctcggcgggctctgctgggtggtcatgggatgcagggcgtgcctgggagtgcgtgtgcagggtgaaaaggctgagggaaagaggcagatcacatggttatagtggggctgggaagacaaaaagggccagagaaggcagagagggtgtatgatgtggggtgagaggatgggctgctgtggatgcaggacctcaggaaaggttgaggctgagccactggcagagcgctgctctaagtgggggaccaccaaggagggacaggaggccattgccttgtaagagactccgggatcggggtaggaagaacaggtttctctactaggccctgtgcccagaaagtctgcaagactggccctcccttaacagtgctgttggccagtgatgcatgcccaagactcagcagctctcaggccgccagcagccttgtaagcattgctcctccagggcgctaagcccagagtccaggaaccaagatccctagggtgcactgggatggagttaaacaagggagaaggcaggcgcagaccacagacctcctcccccagggctaatcccctccctccacagcaacccactgcctggtattactgttctgatatgcagatgaggaaacttggacgcaaagagttaaggcgcccaactagacattggcagagttagaactgaacatagatcttttgaaagacaaataaatccacgttctctccggcacactacattgtccctcctggcccagttcctctttgttctttattgccacctaccctcgccccctgccaccatactcccctcccctcacctcatagacatcctccgtggctgcgagacaaacacgacatgctactgttcctatcttaacacaagtatttcttttcttatttattggcctttgttttgaggggctgtacttatggaaaagagattataatggttctaccttctggatacttttttttttaagatttcccttaagaacaggagaattttaaatccattcaattactcactaacctatttgttaggccaaacacctgtattctgcaaaactagtgctgccaatacaagctgaagactggtgctggtacagtggaaaatgaaatgaattccaatctggccctttctaaaatgattatttcattaaaaggctaccataactaaagaaataattgtataataactttgtcatgtgtacaatcttagcccatgaatgtataaaaatatagcctttatgatgttcatacaactaatatgaactcctactttaagtctccatcccacggggctagcaggaaggtctagcttcagtcttctgagactccctcccaagtgacataaggagataaaatgtgctggtggggaagggggtgcaatgccataattacaccttcccctgtcactctgattcttgcccatacatagatgaaagcaaagtgagataaggacaagttcacatgttcaaagtttaacaaatgctgtagataacaattcagtatggaattgaaatggcagttctcttagggcacatctgaggcatgtctgtagataagagcccagtgacacataccccttctgcaccctagtttctatgtgtctgccctttgtcccatggccatggtaggagcccatctggtttttgaaccatttgtgggtacaggctatccctgagacatttattatcctggtcagcacaggccctctgccccaccttgggacctagaagtctttctttggggcttcctaaaacatgctgggaaggtctcagcatcccagaaagccaacaaatgggaccatcggtacaatgtccaggggaagtttatgcagtgggaggaaatttgaaaacagaaattaagttgctatgaaaaaataaagttgtattcctagtactcctgagcttgtagactgataggtgtgtgatttagtcatcctgagattctccacaataaaccactgcctattgagcagctactgtggaccaggcattctgctagggattttacaaaccttatctgacataacccttacaacacacctgacctactccaccagtttttgctcagcatctcttgcaccattctcacaagatgatgaaaaagcaagtgcttatatagtgctgaacatgggcctgacatgtgctttacagatactgactcacatgaccctcatatcaattccatgaggtagaggaattattatcagcctggtttgcagtggagaaagctgggaaacggtggaatgtggctacaggttctgcactggtcactaccacatgtaactgggtctcctgaaaaatgaaagtagaagaaaagttctcttcccttggaaatcatacagtctagggtggaagtatacatgcatttattaaatacctactatatgctagacattgtgcaatgtgctggtgaaacagtatggaggatagacaaggtcctttcccacacagaattcctggtccatggtaagactttagaacaagtatgttctatgagaggggaagggtagagtgcaacaggagatatggcagaagcacacagccctgtcttgaggaaaggtagggagaaggttggtagtcggcgggggcttctgggaggaagtagtctttgagttgggacatgaagagtagtccacttgaagaggaaggaagcatgttcgtggcagagggaacaacctgtgtaaaggcctggaggtgagggagagcacatcatgttcaagagagtgaatgtttagaatgaccagaacatagagcctaggggctagtgatgggaaatgaggctcaggaggtggcaaaagcagacagtgaggcttgagagccaaattgaggagtttggcagtgggaaatcataaaaaggcttaacatcaacgttgttaaatgtatagcttaggatccctctgcctgcagtgtgtgaatagagggcaaagaggagtacaggtggcagggaaaatgattaggaacaattccacccaacctaggtaagtattacaagtggctgagataagaatgaaagctccctcaatggaaggggtgggtctcactgtattttagagataaaattaaaagattttaaaaatctgtcttttgtgatgatctgccttggtaatagatgaaatgtactatacatgtaaggtacgtatacagtctatcctcgttatttgtagattctgcttttgcaaatttgcctacttgctaaaatttatttttaaccccaaaatcaattcctgtgacatttttgtggtcatttgcaggtacatgtagagtggcaaaaaatttacgttgcttgatgcacacattttcagctgaggtcaaacaaggagtctctctgccttcttgtttcagctctcatactgtaaacaaatgtccttgttttcagattatttagtgccatcgtttttgcacttgtgtgctttatgttggtgctttcactgtttaaaatgcccccttaaacagagttttgaagcagtgtcctcagtgtaagaagcctctgatgtgccttatacatgtgagaggggctttgttcctgcatgagttacagtgctgttggctgttgagctcagtgttaatgagctcaacagtgttaatgctgttgagctcagcaatatatattaaataaagtgtgtttaaaaagaaacagacataaaacaaggttatatattgatctgttgatgaaaatattgtgaccagaggtttgcaggaacctaaccctatattttccctaggaacaatggttcagtctttattagtccagttatcacaatgactttctagaacataactagggtgaataacaagtatcaactgtatctatctatatttgtatatggatgtatacacaatacatgactatggtccttcttgagatccttcaaagtggaaaagcattaccatgtacagaaagatgcatatgaaatctggagaaactcagggtggtagagggtggacgtgtatgtgtgtgtgtgtgtgtgtgtgtgtgtgtgatgacacacacatgaagatgcaagtgtgtaaggttagatggtcccagaagagaggcgcaacctcaaaggatacttaggagtctctgaggttggccctactcagtgcttagcagaagattacaaccgtgatttccaagggtgggccatggactggtgctgggctgcccatatcagaactgaaggagctttaaagtgcagatgcctggcctcactcccagaaagtatggtgcaaaaggcctgctccccagggagcacttgatcacagccaggtttggggagcacttctccagaatacccctgaatcacttagaagcgctcaaagcttttctgctttctgacaactttaatttctgatgcttctgatttgcagacatggagatatatttatgaaccgcactgaaaattggattggctctcagtacaagaaggtggtttacagggaatatacggatggagaatttgtggagatcaaagcccgaccaccacgagaggagcacttagaactcctgggtatggcacagatttcaggcgtgcactgtcagccccaagcatgtgcatgcacacatactcatgtgttctgttacacttgtggctaagaaaggatagaagaaacagagtagcttgactgcattcctccaagtgtaatatcttcctgctctaccattatcagggagtgtgctgagtgctcaactcatacaaaaactagtcataataggactaccagataatacacaaataggaatccatgacatcagggcagtctaactggtgtatgataccctaaagcttctttccaacccctatactgagccaggaaattttcttttaaatcctccagcagatatatatatatatatatatatatatatatatatatatatataaaactttaagttctagggtacatgtgcaccacctgcaggtttgttacatatgtatacatgtgccatgttggtgtgctgcacccattaactcatcatttacattaggtatatctcctaatgctatccctcacccctgcccctaccccacgacaggccctggtgtgtgatgttccccttcctgtgtccaaatgttctcattgttcaatttccatctatgagtgagaacatgtggtgtttggttttttgtccttgcgatagtttgctgagaatgatggtttccagcttcatctatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttataaccctttgggtatatatccagtaatgggatagctgggtcaaatggtatttctagttctagatccttgaggaattgccacactgtcttccacaatggtttaactagtttacagtcccaccaacagtgtaaaagtgttcctatttctccacatcctctccagcacctgttgtttcctgactttttaatgatcgccattgtaactggtatgagatggtatctcactgtggttttgatttgcatttctctgatggccagtgatgatgagcattttttcatgtgtctgttggctgcataaatgtcttcttttgagaagcatctgttcatatccttcacccacttgttgatagggttgtttttttcttgtaaatttgtttgagttctttgtagattctggatattagccctttgccagatgattagattgcaaaaatattctaccattctgtagattacctgttcactctgatggtagtttcttttgctgtgcaggagctctttagtttaattagatacgatttgtcaattttggcttttgttgccattgcttttggtgttttagacatgaagtccttgcccatacctatgtcctgagtagtattgcctaggttttcttctagggtttttatggttttaggtctaacatttaagtctttaatcaatcttgaattaatttttgtataaggtgtaaggaagggatccagtttcagctttctacatatggctagccagttttcccagcaccatttattaaatagggaatctttcctcatttcttgtttttgtcaggtttgtcaaagatcagatggttgtagatgtgtggtattatttctgagggctctgttctgttccattggtctatatctttgttttggtaccagtaccatgctgttttggctactacagccttgtagtacagtttgaagtcaggtagcatgatgcctccagcttagttcttttggcttaggattgacttggcaatgtgggctcttttttggttccatatgaactttaaagtagttttttccaattctgtgaagaaagtcattggtagcttgatggggatggcattgaatctataaattaccttgggcaatggcagtatggccattgggaaatggcagtatggccattttcatgatattgattcttcctatccatgagcatggaatattcttctgtttgtttgtgtcctcttttattttgttgagcagtggtttgtagttctccttgaagaggtccttcacatcccttgtaagttggattcctaggtattttattgtctttgaagcaattgtgaatgggagttcatgatttagctctctgtttgtctgttattggtgtataagaatgcttgtgatttttgcacattgattttgtatcctgagactttgctgaagttgcttatcagcttaaggagattttgggctgagacaatggggttttctaaatatacaaccatgtcatctgcaaacagggacaatttgacttcctctattcctaattgaataccctttatttctttctcctgcctaattgacctggccagaacttccaacactatgttgaacagaagtggtgagagagggcatccctgtcttgtgccagttttcaaagggaatgcttccagtttttgcccattcagtatgatattggctgtcggtttgtcatagatagctcttattattttgagatacatcccatgaatacctaatttattgagagtttttagcatgaagcgctgttgaattttttctaaggtctgttctgcagctattgagataatcacgtggtttttgtctttggttctgtttatgtgatggattacgtttattgatttgcattatgttgaaccagtcttgcatcccagggatgaagcccacttgatcatggtggataaactttttgatgtgctgctggattcgtttgccagtattttattgaggatttttgcatcaatgttcattagggatattggtctaaaagtctcttttttggttgtgtctgccaggctttggtatcaggatgatgctggcctcataaaatgagttagggaggattccctctttttctattgattggaatagtttcagaaggaatggtaccagctcctccttgtacctctggtagaattcggctgtaaatatgtctggtcctggactttttttgtttggtaggctattaattattgcctcaatttcagaacacgttattggtctattcagtaattcaacttcttcctggtttagtcttgggagggtgtatgtgtcgaggaatttatccatttcttctagattttctagtttatttgcatagaggtgtttatagtattctctgatggtagtttgtatttctgtgggatcagtgatgatatcccctttatcattttttattgcgcctatttgattcttctctctcttcttctttgatagtcttgctggcagtctgtcaattttgttgatcttttcaaaaaaccagctcctggattcattgattttttgaagggttttttgtgtctctctctccttcagttctgctctgatcttagttatttcttgccttctgctagcttttgaatgtgtttgctcttgcttatcttgttattttaattgtgctgttagtgtgtcaattttagatctttcctgctttctcttgtgggcatttagtgctataaatttccctctacacactgctttaaatgtgtcccagagattctggtatgttgtgtctttgttctcattggtttcaaagaacatcgatttctgccttcattttgttatgtacccagtagtcattcaggagcaggttgttcagtttccatgcagttgagtgattttgagtgagttccttaatcctgagttctagtttgattgcactgtggtctgagagacagtttgttataatttctgttcttttacatttgctcagtagtgctttacttccaactatgtggtcagttttggaataagtgcgatgtggtgctgagaagaatgtttattctgctgatttggggtagagagttctgtaggtgtctatcagctctgcttggtgcagagctgagttcaattcctggatatccttgttaactttctgtctcattgatctgtctaatgttgacagtggggtgttaaagtctcccattattattgtgtgggagtctaaatctctttgtaggtctctaaggacttgctttatgaatctgggtgctcctgtattgggtgtatatatatttaggttagttagctcttcttgttgaattgatccctttaccagtatgtaatggccttctttgtctcttctgacctttgttggtttaaagtctgttttatcagagactaggattgcaacccctgcctttttgttttccatttgcttagtagatcttccttcatccctttattctgagcctgtgtgtgtctctgcacgtgagatgggcctcctgaatacagcacactgatgggtcttgactctttatccaatttgccagtctttgtcttttaattggaacatttcacccatttacatttaaggttaatattgttatgtgtgaatttgatcctgtcattatgatgttagctggttatttcactcattagttgatgcagtttcttcctagcatcgatgatctttacaatttggcatgtttttgcagtggctggtactgattgttcctttccatgtttagtgcttccttcaggagctcttgtaatgcaggcctggtggtgacaaaatctctcagcatttgcttgtctgtaaaggattttatttctccacttatgaagcttagtttggctggatatgaaattctgagttgaaaattcttttctttaagtatgttgaatattggcccccactctcttctggcttgtagagtttctgctgagagatccgctgttagtctgatgggcttccctttgtgggtaacccgacctttctctctggctgcccataacattttttccttcatttcagctttggtgaatctgacaattatgtgtcttgtagttgctcttctcgaggagtatctttgtggcattctctgtatttcctgaatctgaatgttggcctgccttgctaggttggggaagttctcctggataatatcctgcagagtgttttccaacttgattccattctcctcgtcactttcaggtacaccagtcagacgcagatttggtcttttcacatagtcctatatttcttggaggctttgttcgtttctttttactcttttttctctaaacttctcttctcacttcatttcattcatttgatcttcaatcactgataccctttcttccagttgatcgaatcggctactgaagcttgtgcattcattatgtagttctcgtgccatggttttcagctctatcaggtcatttaaggacttctctacactggttattctagttagccattcatctaatcttttttcaaggtttttagcttctttgcgatgggttcgaacatcctcctttagcttggagaagtctgatcgtctgaagccttcttctctcaactcgtcaaagtcattctccatccagctttgttctgttgctggctaggagctgcgttcctttggtgggggagaggcactctgatttttagaattttcagcttttctgctctgttttttccccatctttgtggttttatctacctttggtctttgatgatggtgatgtacagatggggttttggtgtggatttgctctctgtttgttagttttccttctaacagtcagggccctcagctgcaggtctgttggagtttgctggaggtccactctggaccctgtttgcctggatatcagcagcggaggctgcagaacagcgaatatttctgaacagcaaatgttgctgcctgatccttcttctggaagcttcatctcagaggggtgcctggccgtgtgaggtgtcagtctgcccctactggagggtgactcccagttaggctacttgggtgtcagggacccacttgaggaggcagtctgaccattctcagatctcaaactctgtgctgggagaaccactactctcttcaaagctgtcagacagggacatttacgtctgcagaggtttctgctgccttttgttcggctatgccttgcccccaggggtggagtctacagaggcaggcaggcctcctcgagctgcggtgggctccacccagttcgagcttcccagccgctttgtttacctactcaagccttagcaatggtgggcgcccctcccccagcctcactgccaccttgcagtttgatctcagactgctgtgctagcaatgagtgaggctccttgggtgtgggtccatctgagccaggcaccggctataatctcctggtgtgccgtttgctaagaccattggaaaagcgcagtattagggtaggagtgacccgattttccaggtgccatctgtcacagcttcccttggtcggaaagggaattccctgaccccttgtgcttcccaggtaaggcgatgcctctccctgcttcggctcacgctcggtgggctgcacccactgtcctgcccccactgtctgacaagccgcagtgagatgaacccggtacctcagttggaaatgcagaaatcacctgtcttctgcgtcgctcacactgggagctgtagactggagctgttcctattcatccatcttggaactaccccctaagaatattttaagaaattgagagaaaattgaaaataataaccgtccaacaaattttagatttatatatacctttctcagaaaagcaattaaaaccatggcttgaatcagcaaggaattgatatgtgtggccagaccaccaactgtcagtgtatctccctgtgaatgtagaatgcaccagatacccaagagagagccatagggatcaggcacttctgaaatgggagtctactgaccatgaagcagtgcacaagtcatgctgccacaggccctctgagccaggtgtgggctcatctccattggcacccagcctggttgcttccaacagaaatgcacacaccagaggggctgaagagtgcttgtctccttgggtaaacaaatattgagaaacagagttagatgtgcatttgtgaagtcactatattaatcataaattaatacataaatgattttatttccctctactctttcagattccttttacacacattatttcattggatcttcattattattgtcatccatttaccagataatgaataatttcagacttatcaaaggttatacacagggggattacaactgaaagtcaccatatcatgtggatatggcttttcctggagatgatttctcagtagtaaaaaagcatttaccaagtacttatggtgtatcagtgcactgaagtaaacacttttagatacattatcttattcaacccttactataatcccacataaaagttattactaaactgatgttacagatgaggaaactgaaactcagacagattacatcacttacccaaggcccctctaataaatgaaggaagcagaatttaaacccattgctaaagactacatgatatttaatactacacaatgttgctctctaaagtggagtagagttatatatgcctttctcggaaaaacaactaaagccaaactattttatttgactaactactgcctatatttaaattacactaatgttgaaagagcaataataatgcacacaggcctgtgttttgcctttaggcccaatgattcatgctgaggtgggcaacaccgtcctgatcatatttaagaacaaagccagtaggccctactccatctcagcccagggtgtggaggagatggatagtggaaagcaattccaagtgcccatgacaaaaccaggtaagttgtgtcagaggtctgctccatcttgaagaagaacattggcgtcaactcttttctggtctcagaggtgtcttaaagagctcatcttaatgtcaatgtgtttcagccatcatctagtcactctggtatgagatcatcattcatccaatgaccaaatgtttaggaatttctagggttccattagaaacctccattagggaccccattgtcaacatcccccaccagagtagtacatttgttgtaattgatgaacctacattgatacatcattatcccctaaagcccataatttacattagggttcagtattggtgtgtatactctaagggttttgacaaatgcacaacaacatgtatccaccattttagtcctataaagaatagtttcactgccctaaaaattctccgtgctctggtgtttattttttcctcttccttaacccctggcaaccactgatctttttactgtctccatagctgttcttacagtagctcccccttatcacggttttgctttccttagttttagttacctgaatcaatcttggtctgaaaatattaagaaattttgagataacttcaattagagacaataaaaagatattttgagagtgagagtctacattcacatagcttttattatagtgtactgttataattgtcatattttattattagtaattattgtcaatctcttactgtgcctaatttataaattaattataggtatgtctgtataggaaaacacatagtatatataggtatggcactgtctgtggtttcaagcatcccctgggggtcttggaatgtatctctcctggacaaagggggactactgtagtaaacataaaaattaacacattaactgccttcaaaatgaagcattatcctgtgtatttaatgacattatttcatttaatcctcacaacaattagaaaactatgatgaccaacccactttacagataaggatactaaaggttagtgacattaggtagctggtcaaatgtgggataaataggaagtcatagggttgagatttggaactaggtctctctgattctggttctcaccagatctcacctgcccacttgagaagcttttaaaaaacactggcaccagagtcctagaccctagactctctgatttcactgtctggggtgaggcctgagcagcaagggcttacaaagctccctggtgactcccataagaggccaaagcagaggtccttgatgacaaagatgtgctcaaggacagctcttgggaaggagataaaacatttaaggaggaaaaacagtgaggtataaaatgtttttatttcctgaatacacaccagttgacaatagaaaaatgcaaactagagggaaggctggagcctgaaatgacaaatctgccatttcattttgaaatagtagaaatcaagatgggagtttaataagaacatttgtaatgaatgagtaattctctccagcaataaacattaatgaaaatatataaagacctgcttatatttcttcagataaatcatctgaaacacagataattctaataaattttttccatttcatttattacaggagaagtaaaaacttatagatggaatatccctaaaagatccggtccagggccttctgatcccaattgtattccatgggtttactattcaacagtaaactttgtgaaggtaaggtggagaaagcaaccaaaaggcttaaaataatttggatgaaagttgactacttgggtcatcacaatttgggttggtatatgtgaaagcgtataatgatttagagcaagggtctcatactatggcccatttacgaaatctagacatgctggacgtttacattgtcaatggttgacttgagtagctgcaacagagactatatggcccacaaagtcaaaaatatttactatctggtgattttttttttcccaaaaaaaaaaaaaaaaaaaaaaagtttggtgacccttgacttaaagtatggggaataaaaacaaaatcccaatgtttcaattaccaaatttagaacttaaaaagataaaaggtttgaagcaaaagaggatatgtaaatatacaacaataaaataaatataacttagagtacaatttatgtatggttttggatgtgtgaaatctgtttattttaaatgcattattatcagggctactagggctcaggagaagaaagttcactctaaacatagtaactgaaactacaaaattgtttgaatgattaatgatctaactttgaaataaaaggcaaagattcaacattgaatttgagccaggtatgtgtatgtaaaacaaccacagtctttaattacatgccataaaccaaagtccaatctaaagtcgttatttgatgtaaaatgtaagcattgcctattaaagaaaaaaagggagggattatcataaccttcctcttaggtattagatggcttgtattaatgtctttgagttatactggacagttctagagttcaggagatagaaatacaaggcacttgaataaataaacttacatatgagaattatgggaaaatccaaatttatttatgcatcacaacaaatacttattgagcacttgtgatgtgcaaatgaccccaccaaatactatgagagatgcagatactcttgtcttaaagaaacttataactttgtgggaaaataatatgtccacacttgtaactgtaatagagctctgaatctggtgaattctataggagtggcaggctaactaaagtactatagaaggttttggagggagagtctaggaagaaagagcattatgagcacagctgaaaatagggaagtagagggagtgtttgggacatgttgagagtcccatttggctatcatatggggtccagtagtaaatcaaggggtagcctaagtcagaaaatttcattaggggagcacatggagggctcacagacctgcaagggtttgtatttaattctgtaggccacggaaaatcactgaagacttctagatacgggagtataaagattactgtgatggtggtcaacaggatgggctggaggtggggtgaatcagagctgagagaagaatcaatttctagtccagggtgaggtattatgaccctacactagaatggtggcaggtggaatgaaatattattaaattacttaatggctcttttaactcagtttattttttcttccaggatacgtatagtggtttgatgggtcctctgattacatgccgaaaaggagtcttgaatgaaaagggaagaagaagtgacgttgattatgaatttgctctcttgtttttggtatttaatgagaatgaatcctggtatctggatgacaatattaagaagtatctcaacaaagatccacgagattttaagcgcactgatgattttgaggaaagcaacagaatgcatggtatatccaaagtttaaaaagaagcctatgttgagataagctcataggaattcctgtaaatgtaggaggctcccagcatccttctctgagcctttcctccttcccaggggcacctggactgaagaaagtcctctaatgctttccttcagactgaaccagcctagccactgattggctggcagcaaagtcattgaggctttgtactaacttgtagggacatgtatttctgaatcctgggatctctaagctctaagactgtaaagtaattctttaaaaacaaatcatcatttattgtcatatttttataagaatatgccataacttctatttgtttaaatttaagggccaggtttaattgtctctgggatatgaaacactaccatcaaatttctgttttaatgtatctgtgttacttctacataatttaaggtagtttgttggtgggagtaatgtgttcacattgacacatccacagtttctcaccaacagctatttttgaccaaaagtgcacaaaaaggccttgcccaaggtcacaaagctacttgttaatatagattagaatatagtagcctgattccccattcagctactctttcccctaccagttttgctttcttctcctaaagatgtcttagtatgctctccatttttaatgaatgcaggtcatttggttgcaccacaatgcacagaatcaaaagtcagtagacagtggaggagtgggagtcaccatcatgtaaactcagtttgctttggtcattgttaggtcatgagctcagcccgtgtgaagctctcttttatttttggagattcagccaggcttaaactattctcaacaagtgaaatattaagaaaataccttctaagtcactcaatttttatttacataaacttgtttatgccttgatttgttctctgtagagtggtataaatctgactacctctccaatgagactgtatttcccttcataaagagattatgctgaataaacaaacaaaacactgccaccaagatacggctttaaaactgctatttctctgttctcgctctctttgtagaaggatttctcagttatctgaattttgggtctagaatggtaggacactgctaggggtgagtgagattgttgcatgtttactagacagatgaaaatatcagtgacctaaagatcttctggaaacatttaaaaaatcagcttatcttttaactaaccaaaggttattttcttatcaccttttaaagccattaatggaaagatttttgggaatctccatggcctcataatgaacgaagatacaatgacaaactggtatttgttagggataggaagtgaagtggacatacataccatccattatcatgctgagagctttcttttcaaagtaagtataaggaaagtgctttgggaaagacgtttttgaactaacaaattcaatgtatttccagtggaaaataagagttacttggcaataatgcttgtgaggataggtgagaatggaacagaataatgtgattgtaccgtttccctggtggatatttcttttctttttttttttttttttgagacggagtcttgctctgttgcccagggcggagtgcagtggcacaatctcagctcactgcaagctccacctcccgggttcatgtcattctcctgcctcagcctcccgagtagctgggactacaggtgtgtcccaccacgcctggctaattttttttgtattttttagtagagacggggtttcaccatgttagccaggatggtctcaatctcctgacctcgtgatctgcccgcctcggcctcccacagtgctgagattacaggcgtgagccaccacgccaggcctggctatttcttaatatgtatatgtatattattgtgcttataaaaatctctccaagcctcaggtgagagttttctcattagtgatctggggataactctgaccaccctggaatatgctgttaatattgtatatgaaaccacggacactgacagcattcgtcccttttcctcacccttccttttttctttccctttccttctccccacccttttctttttctgtgtgattagctaacagaatagctctatccagtaaaggagctattttgagctctggcctaagccctgaaactttatcttgacttttgccctagtgagctgggctggaccatgtgtgactttctaccctctagcatcaagctgtaccatatgggtggtgctcactgtacagcagagccatctggggaactatgtaaaaacccaactgccaggcccgacccagacctgctgaatcagaatctccatggaaaggtccaaatagtctgtcatccgaagttctcagtgctttctacaaggaagtggaatagaaaagaacaatcatatccaatgtgtggagaaaactggaattgatcttttctagttagacacgaataaacggtaactttaataaaacatttaatatcctttctcctttgtatatttcaacgttgtttacgacaccaagtattagcctgctatgattagagtttcacatattaaatggctatgctgcttttcagaatttggcttttttaaactcacattttaaaaattatattaaaaatttataaaatttaatacacaaaattataaaaatttacatatacactttaaaaataagatataatttacattgaatacaattcaccatatttagtgtacagttctcttttgataagcacatacagtagtgtaacgaacaacaatcacaatatagaatacttttatttcccccacaaattttaccattgcaccctctagtgtcaactacttccccatacttaacacttgtcaaccactgtctctatagttttgccttttttgaaaggttatgtggaaatcataggttgtagcatcttgaatctggcttgtttgatttaacataggcattcaaattgtatccatcttgttatgtgtatcagtggtttgtttcttgtgactgttgagtagtattccattgtaaggatataatgcagtttgtttatctattctcctgttgaggaacatttgagttattttcaagtttgtttattacaaatcaagtcattacaaacatttgtgcacatgtttttgtgtgaacatatgttttcattttccttgagaaaatacctagaagtaggattgctaagccatgtgataagtgtatgtttgatttcataagaaaccaccaaactgttttccaaaaaggcagtatcattttgcatttccaaggaaatatacgagaactccatatgttgcacatccacatatgcagttggtatttttagtttttatttcatttttttcccttaggcattccctccttggggaggggatatagtggtatctcattgtttttcatttacattttcccagtggctaatgatattgagcatcttttcatgtgtttgtttaccatctgtcatctgtaaatctttggtgaagtgtccaaattgtaagcccatttaaaaaaattgggttacttgtttccttattgtagagtttgagggctttatatattctggatacaaatcctttttcagtgatgtgactcacaaatatttgcttccagtttgtggcttatcttttcattctcttaacagctttcaaatagaagttcttaatttttgatgaagtaaaatgaagtacaatttttcttttttctcttttatagatcatacttttggtgtcatgtataaaaaattttggccttactgaaggtcccaaaaaaggtctctgttttcttttagaagtggtatagttttagatttagggctctgatacattttaattttcatatgtggttcaagatatgaaataaggttcatttttttttcatatatatgtccaaatgttccatcaccactcattgaaaagatcatctttttttcccacagaattgactctttacttttgtgaaaatcatattgaccacatatatgtgggtctatgtctgggcggtctcttctgttacactggtttatactctgccctttcttgaatgccacaatgttttgattactttagtattatagtaagtctcaaaatcagatggtgattgttttagctattctagatgtttgccttcccagataaattttagaaataatttgttgattttgatttttaaaatcctgttgggattttgattggtattgcactgaagctatacaatgggttggacagaactgacataacaatattgaggcttccaatccatgaacatggtatatctatcgtttagctcttctttgatttctttcatcagcattttgtagttttcaatatagagatcttgcatatactttgttttatttatttataactaagtatataaaaggctttggtaatagtgtaaatgatagtgtttttattttgatttatagttgtttattgccaatatttagaaatataattgatatttgcatgttgaccttgcatcctgcatctttgctaaactcactttagttccaatagttttcctatagattttagggggattttctatgcagacaatcatgttgtctgtgaatagacatggcttcatttattttcaatctgtatgtcttttatttcttttgtcttactgcaatggctaggacctgtagtgcaattttgaatatgagtggtgaaagtggacatcctcagtttgttcttaatcttacaaggggagcatttagtcattcacctttgaatataaagttagctgcagcttttttgtggatcccattatgaggttgaggaaatttccttctaaatttgctcagagttttgatcatcaacaaatgttaaattctatcaaatggtttttctgcatctattgagatgatcagatgctttttcttctttaatctgttgctgaattacatttattgattgtggagtttttaaacactttttcattcccaggataaaccttacttggtcatgatgtattattcctttttgtggaattgatttgctagtattttgttatggatgatggtatctatgttcatgaggagtattgattgtagctttttttcctcacaaagcatttgtttagttttggtatcacagtaatgctggcctcataaaatgagttggaactgttctttcctcttctattttccagaacagtttgtttacaattggtattatttctccattaaatgtttggtagaatttgccaataaagccatctggagtttaatttgttggaatatcttgaagcaattacagtttctttaatagatatagtgctatccaggttatcaatgtattcttgagtaatcttcaggagtttgtgtcttttaagggatttgttcataccatctaagttgtacaatttttggataagaggtgtttgtccagtatttcctttttaatatttgtaagattttagtgatgtcctcactttcattctcagtatttttaatgtgtccttttcccttttcccttggttagtctgtccagagatttgtattagttatctattgctgcataacaaattactctaaacttagagtaattcttggatcaggaatttgggattagtttaactagttggttgattcagaatctttcatgaggaggcaatcaagatgtcgactggagctgcagttttcaaaggtttgactggagctggaggatccacttccaaacttactgatatggttgttaactagagggttcagctcctgatcatgtggataagacatgaaaactggcttcctccagtgagtaatccaagagaagagggtgacagagtatctaacacagaagtaatgataacctaatcttggaattggaatgccagcacttcttccacatgctattgatttcgcataccaacccttatacaatgtaggtaggaaccacaaaggttatgaataccaggaggtggggatcattgtgggccatcatggaagctggctactacagaatttattgattttattgatctgttcaaagaatcagttttagatttctttgacttatctctattgtacttctattcttgattcctgctctttcttatgtccttccttttgcttactgtgggttttatttgtttttgctcttctttctgttcttgctgttctgagcaaagaaggctactagctgttgttttttaaaacgtttttgcagatagataaatcttaccgagaagatgtgtatgatctctttcctgggacattccaaaccattgaactgtttgcagatcacccagggacatggctgctacactgtcatgtgtctgaccacatccatgctggcatggagacaacctacacggtccttcgtaacataggtacggttgtctgtcagtgatgccagatgatggcaccgagcttcctgtagacccccaaaacaggaggcatgacaaaaacccagatatagccctcaacaagctcagagtcaagtaagagagacatatatgtaaatatgtaactataatcaagtatgctatgtgccgtagcagaatgcagagtacagggcttaatagcagcagtaggagtgaatgggtaacagttggaggatatgagccaaagtttcacagaggccatgatgctccagatagactcagtgggtgagcagaagtgggaaagacagctggggcaggaaagcatgtacatgggaatgaagtagcacagtaagaatccagaaatgattggcagatactgatgggataagtcctcgctggtgaaatgaaatgactagtgtcatgaaaagaatccccttctgttgttaataaaacaatgaacttgttttctttgtgcagacaacaggattccttactccaccacatctcctggagtggcatctcacccagccacggtgccatctaacggtaatgataccctctccccatgtaaatgagtcaacatttcacccctcaaaaatgtcaggggcctgacaagtttatctttttcacagaacgacctggcaaagagcagctctatttctttggcaagaatctgggtccaacaggagccaaggcagccttggtcatccttttcatcattggactcctccttctaatcaccacggtgattctctccctcagactctgctctgcaatgaagcagacagattaccagcaagtccagtcctgtgctctccccacggatgctctgtgaaccatctggtctccctcaacaggaaagggtgatgtcccacagctggccagatggcagccaacagggaaactggaccaaggcatcactcaccaaggaaggttgacactgtatcctggatcagccttctgatcctctcaaacatcatccaaagcaatttgcttttatttatttatttttaaatgggctgcgaataatcctcaggtataaaacacagaaaaaggagaatgggcatggctgagaatgtcaactcttagtctattctttggttggattcactgaataggagacactctgaaagatatctttatattccatcttttataattcttgaacagtgctttcttagctaaccaccaaagtttctaggtgaacagcttctagaaaaagttagagtgcctcagacatttaactggaagggcactactttttcaacattgttgcataacatgcatcccttggttctgtggaaaatatctttcttaggagttcttggcaatgtctaagtcagtgtctgctgatagaattagaccaaataaattttttggaggctttaaccagctctcctggccttttcctctttgatataaatagcctgtgcagtgcttgttttaaaaagcaaagttatacgttttttaaaaaattgctgctgtttttattcaaacctgtagaaatacttgaatgtttacaactcacttcatgttacatgtttttacaatatgtttctgtggcaatgtttgtactttcaaaaatcaagtagagaaattgtatttctactgcagactgtgggagggctgaaatctgtaaaagaacatgttaggctctccctttatgaatcagggactccctgagagtttagagcaagctttctatcagggagggaagctttgcaggaggcaagtctgggcttgaatttggagtctgatttttcattcagttagagggaatctttacaagtcctcatcttctatgaaattataacattctcattgtatgagaaacatcaggaggaatttatcaatgtaggtgactagataggagaagggacctctaaatatcctagattctatggcttttaaagacatacctcttcatggaaggagaaaaaaggaaaaggaaaggtgagaaaaagataatcttggtggcagattctcttaaaccattaaaccagctttgaaaattaataaataatttccaaggttcaaatgcaaaaaaattattgaacaactaaactcaacccattatgaggcaatctacactgtccatacctatgcttagacagtaggtgtaagattgataaaagtaacattgtttattacaagactgagaaattgcttttagctctgggcgagatgccctgagattccaatgccaatgctagatgagtgatactggtatgcctgccttagcagtgggtaatttgaatgtcaaagtgagtgacaaggacctaagaaatattctggtggagggacctttcacactgtctcatcttcatcttcatgaggggaaatgggtaattggatagaagctatagtcttaacataaaaggggatgcaaatgctaatagttctgttcatagtttgcttgaatgtcatatcaaacagcatacacaaaagattttgaatttcaatctgctaaccattgacaatgtgatttcatagtacatgttctacagttttcatacatgtgtaggctgcataatttcataattatggtaaatgccttatttattacccaccttagtaagacaagttgttcagttgtttttttttcttttcagtttatttttttaatgaaaacaaaaccacaaagtagtttgattgcatcatttatcattttaataaagtgtcacataaggtggctatttgcatggttattttcacttaaaattatctatcactgaactaggggaggtggttaaagtggaattaatttttagatatttaggggctatgactatgccaatgacacttgttagaggaaatgaaacaaaatagtgtatctccacaaataatatgacttctcaaacattgtttcctcaaacataactacactccttgttctcagcctcactcttgagaaaatcaactctgccttcacttacacacatatttcttcctattacaatacacgtgtccctgctcctagcaggacagtctcttcatttgactttgggtctcattgcttcttgctttctcaagacttcattcccttgggtatccatttttcctcctgcatctttctatgaaaccatcagcaatgtccgccattaaaaacagaaagcaatgtgctgtcttatttaactctataaccccctccgacacagtttctctcttcctttgatagcagaacatagaggtattcacacttggtgcctgtactacctcaccccatgcattcctcagcccattctgatggctttcaatccagcgtgcccagcccccacaccccaatctgctgtggtagagatcaccaatcatgatgccatttccagtggcttcttctccatctttatcttactcaacctctcagcaacaagaaacagctccttccttctgaacactcggagtctctagtcccttggctctgcaacatgactctctgccagccttccttcttcctcaatgactattccttctcaatctctttttctagttccttctcttctgtctgacctaaatgttagcatgcctcagaacttgacactgggtcctttttcgctttttaccctctgtggtaggctgaatattgccccaaagatgtcatgtcctaatccctgaacctgtgaatgtcaccctatgtggcaaaagggactttgcaggtatgattaaggatcttgaagataggaaatttatactggattatccataatggccctatatgtaatcatgagtgtccttatgaaagagaggcagtgggagatttggctacagaagaaggcaatatgacaaccaagacaagatgccatgctgctggctttggagatggaggaaagggccatgggccagggaatgcaaggaatgcatctccagaagctgggaaaggtaagggaaaggattttcctctagagcctccagagagaggttggccttgcagatatcttgaaactgattttggacttcagaggtccagaactgtaagagaagaaatgtgtgccaacaagtttgtggtaatgtgttaccagccactccatagtttattttatccatccttatgatcggaaaaccatttttatgcaaacaaattcaaaatgtatttctctaaccctgaccttgggctgcagattcacacaaatcctgcttgagtagggccactgcagcagtccccaaaccagcctctccatcatcactactgctcctttccaccactgtccacacattgcctcacgtttttccaaatttcatcactttcctggttactaccctttactgtcttcccatttcacttttaataacatccaaactctttaccttggtctttaagacccagcttgacttggcccatgcccactcctccaacttcttgaactctgctccagctttcatccgctcctatactctgctagttctttcttgcctcagggcctttgcacatgctgctttctatgcctggaatgctctccctccctagcttcctcattccctctctgtattagtcggggttctcttagagggacagaacatatatatatatatatatatatatatatatatatatatatatatatatatatgtaagaggataataataccggtcttgtgctttaagatgattaatctgccagtcatgtgtagaatagatcattttatatatatatatataatatataatgatatataaactcattttatatgtatataatgatataaaaactcattttatatatatatataagttcattaagtattaacttacatgatcacagggtcccacaataggctatctgcaagctgaggagaaaggagagccagtccaagtcccaaatctggagaacttggaatctgatgttcgagggcagggagcatccagcatgggagaaagatgtacgctgagaggctaagcccatctctccctctcacatttttctgcctgctttatattcactggcagctgattaaattgtgaccaatggattacgggtggatctgccttccccagcccactgactcaaatgttaatctcttttggcaacacccacacagacacacccaggattaatactttgtagccctcaatccaatcaagttgacactcagtattcaatatcatattctcctagcttttctagttcacatgtgggttcccctgacttccctctctaaagtgggtccttccctctgttatttactatcttcactgttttcctttgcagcacttattacaggacataatcattttatgtctgttggcttaagttttgtctgcctctttggctggaatgtagctctgtggaagcaaggatgcctgacctgtttggctcaatgttgcatccccagcagagatcatagtacaaatacataatagtttatcagcaaatattcattgaatgaatgaatatataaagagattaggcagtctactgaacttcactattttgacttagactattttggttgcaaaactctcatattcaaatgtcaaggttctcaaacaagtaaaacagagttctgagagactgcctatgagtttcacaacctaccttggcttcttttttgtttgtttaagacagagtcttgctctgtttcccaggctggagtgcaatggcacaatcttggctcactgccatctccacctcctggtttcaagcgattctcttgcctcggcctcctgagtagctgggattacaggcatgtgccaccatgcctggctaacgcctggctagcttttgtatttttagtagagacatggtcagccaggctggtcatgttggccaggctggtctcgaactcctggcttcaagtcatccactggcctcggcttcttaaagttttgggactgcagacatgagccaccacacctggcctccaccttggcttccttctaacaaatgacactgggacaaggggagaggcaggtggacatgggaggaggatgtgtgatttaatccctaaatgtataattattaaaaagtgatgtcatcaaaaacaaagcatgagaaacagccaggaggagctaagaagacatgctgatgaaagaaacatactgtggtaccctagatgggctcctggaacaaaaggatattagggggaaactaaggaaatatgaataaactatggactttaattaatgtaccaatattgtctcatttgttgtaagaaatataccacactaatgtaagataataataataggggtcttgtgttttaagatgattaatctgccagtcatgtgtagaatggatgcaggaatggggtatatgggaactctctgggatgtgtgtgtgtgtgtgtatgtgtgtgtgtagagatagagtctggctgtgtcactcaacctggagtacagtggtgcaatcacagctcactgcggcctcagactcctgggctcaagcaatcttcctgccttatcatccagagtagctaggactacaggcacacaccaccacacctggctattttttaaataaaactttttgtagagatggagtctttctatgttgcccaggtttgtcttgaacttctggcctcaagtgataaagtctatgttttaaaaaaacaatgttatctacactctcatttgacatgttaaagtcctgtggttggtaatgacagctatcaaatgctaaatgccaccaatgtggcaggcactgttacatacattatcacatttgatcctcagaacaacccatgaggtcagaagcattatccctatttggagaatagggaaattgaggcttagagatttccagcgacacagccttagtcatgtatcaagtaagtgacaaacccaggagttgaacccagggtcttctcattaccctgaaagaatgctggcacatgtcagattgtctgatttgatttttacagtaggaaaaaatggttcccttagctaccacacccttctgtgctacccatttctatcctccagaccacagcaccagtttgggcctttgttacttctcctttgccaaactttgacagcctcttacccagcctctccatctccactctctgcattccagtctattgtatacatggctggcagattaatcatcttaaagcacaacatcctttatattcctcccttccaaaaaccccctaatgcctactgaaaaaaatctgaactacctcctctgccccaacctttccatctttgacttggccctataccagtgtccagtggctctacatcctaatgagaggtgaagccagctgggcttctgggtcaggtggggacttggagaacttttctgtctagctagaggactgtaaacacaccagtcagtgctctgtgtctagctaaaagtttgtaaacgcaccaatcagtactctgtaaaaaagcaccaatcagcgctgtgtgtctagctaaaggtttgtaaatgcaccaatcagcactctataaaaatggaccaatcagcactctgtaaaatagaccaatcagcaggacgtgggtggggccagataagggcataaaagctggccacccgagccagcagtggcaacccactcaggtcccctgccacactgtggaagctttgttctttcgttcttcacaataaatcttgccactgctcactcttagggtccgcactacctttaagaactgtaacactcacagtgagagtctgcggcttcattcttgaagtcagtgagaccaagaacccaccggaaggaaccagttccagacacattttggtgaccatgaagggactattgcctattgccaagtggtgagtaccatcggacccctttcccttgctattctgtcctatttttccttagaatttgggggctaaatactgggcacctattggccagttaaaagtgactagtgcggccactggactaaagacacaggtcaggctttctgggaaagggctctctaacaactcccgactcttcggagttgggaggggtggtttgcctggaaccagcttctgcttttcctgtacttctgggctgagccaagtgtcaacagagaggaaagtcattcagctctggggtcctgacaacaagttggttgaccctgcggccatgagcagaactctcaaagtcatgtcacccaagcgagactcgcccatctatcctatctatcctgacccttgcctactgggtcctaatgcctgtcagacaaacttcctctcctctctcttctccaaggctagtcctgcttctaaaaaccactccttgcctctggtgcttttctagtttctcctataagaatgatttctagtataaacttcaggactctattcccttctttaggcacccagactcaccaaccagaaagacataatttttgcccaaagctccatcatagcggggactacctggaattttaggatccctcctcagacaagcaggcctaacaaaagctattcctgaagctaggatatggggagcctcagaaattttatccttcctattcatataagtgaggacaaaaggcatcactcttccaactctggagttcctgtccctccctcagggtatggccctccacttcatttttggggaaaaacatctttataggacacaagtaaagtcccaatactaacaggagaatgcttaggactctaacagtttttcgagaatgcatcggtaagggccactaaatctgatttttctcggtcctctttgtggtctaggaggacaggcaagggtgcgggttttcgagaatgtgtctgcaagggccactaaatctgaccttccttggtcctccttgtggtctaggaggaaaattagtgtttctgctgctgcatcagtgagtgcaactattctgatcagcagggtccagggactgttgcgggttcttgggcagggggagaaacaaataacccgtgggtggtttttgtctttcagatgggaaacactcaggcatcaacaggcttacccttgaaatgcatcctaagccattgggagcaatttgacctgcaaagcctgaaaaagaggcagctcattttttttctgtactacggtctggccccaatattctctctctggtggggaaaactggccacctgagggaagtataaattacaatactatcctgcagcttagccttttctgtaagagggaaagcaaatggagtgaaataccttatatccaaggtttcttttcattgaaggagaacacacaactatgcaaagcttgcaatttacatctcataggaggacctctcagcttacccccatatcctatcctccctatagctccccttcgtattaatgataagcctcttctaatctcccccacccagaaggaaacaagcaaagaaatctccaaaggaccacaaaaacccctgggctatcagttatgtccccttcaagttgtagggggagaggaatttggcccaacctgggtacatgtccccttctccctctctgatttaaagcagatcaaggcagacctggagaagttttcagatgatcctgataggtacacagatgtcctacagggtctagggcaaacctttaatctcacttggagagatgtcatgctactgttagatcaaaccctggcctttaatgaaaagaatgtggctttagctgcagcctgagagtttggagataactggtaccttagtcaagtaaatgacagaatgacagctgaagaaaggaacaaattccctactggtcagcaagccatccccagtatggatccccactgggatcgtgactcacatcatggggactggagttgtaaacatctgttgacctgtgttctagaaggactaaggagaattaagaaaaagcccatgaattattcaatgatgtccaccataactcaggcaaaggaagaaaatccttctgccttcctcgagtggctatgggagaccttaggaaaatatactcccctgtcacctgactcactagagggtcaattgatcctaaaagataagtttattacccaatcagctgcagatatcaggggaaagctccaaaagtgagccctgggctctgaacaaaatctggagacattattaaacctggcaacctcagtgttctataataggaaccaagaggaacaggctcaaaaggaaaagcgagaccagagaaaggccgcaggcttagtcatggccatcggacaaataaaccttggtgattcagacaggacagaaaatggagcaggccaatcacccagtagggcttgttatctttgtggtttacaggaacactttaaaaaagattgtccaacaaaaaagaagccatcccctcgtccacgtctgctatgtcgaggcaatcactggaaagtgcactgctccagggtgcaatggttctctgggccagaagcccccaaccagatgatccaacaacaggactgagggtgcccggagcaagcaccagctcatgtcatcaccctcactgaggcccgggtatgtttaaccattgagtgccaggaaattaacttcttcctggacactagcgcggccttctcagtgttaatctcctgtcctggacaactgtcttcaaggtccgttaccatccgaggaatcctgggacagtctgtaaccaggtatttcttgcacctcctcagttgtaattgggagactttgctcttttcacatgcctttcttgttatgcctgaaagtcccacgcccttattaggaagggatatattagccaaagctggagctatcatctacatgaatatggggaacaagttacccatttgttgtcctctacttgaggacggaatcaaccctgaagtctgggcattggaaggacaatttggaagggcaaaaaatgcctgcccagtccaaatcaagctagaagatcccaccacttttcctaatcaaaggcaatatcccttaaagcctgaagctcataaaggattacaggatattgttaaacatttaaaagttcaagtcttagtaaggaaatgcagcagtccctgcaacatcccaattctaggagtacaaaaactgaatggtcagtggagactagtgcaagatcttagactcatcaatgaggcagtaattcctctatacccagttgtacccaacccctataccctgctctctcaaataccagaggaagcagaatggttcacagttctggacctcaaggatgccttcttctctattcccctgcactctgactcccagtttctctttgaggatcccacagaccacacatcccaacttacgtggactgtcttgccccaagggtttagggatagccctcatctgtttggtcaggcattggcccaagatctaggccacttctcaagttcaggcactcggtccttcaggatgtggatgatttacttttggctaccggttcagaagcctcatgccagcaggctactctagatctcttgaactttctagctaatcaagggtaaaaggcgtttaggtcgaaggcccagctttgcctacagcaggtcaaatatctaggcctaatcttagccagaggaaccagggccctcagcaaggaacaaatacagcctatactggcttatccttgccctaagacattaaaacagttgcgggggttccttggaagcaccagcttttgccgactatggatccctggatacagcgagatagccaggcccctctatactctaatcaaggagacccagaggacaaatactcatctagtagaatgggaagcaggggcagaaacaggcttcaaaaccttaaggctggccctagtacaagctccagctttaagccttgccacaggacaaaacttctctttatacgtcatggagagagcagggatagctcttggagtccttactcagactcgtgggacaaccccacaaccagtggcatacctaagtaaggaaattgatgtagtagcaaaaggctggcctcaccatttacaggtagttgtggcagtggccgtctcagtgtcagaggctatcaaaataatacaaggaaaagatctcactgtctggactactcatgatgtaaatggcatactaggtgccaaaggaagtttatggctatcagacaaccgtctacttagataccacctgctactccttgagggactggtgcttcaaatatgtacgtgcatggccctcaaccctgccacttttctcccagatgatggggaaccaattgagcatgattgccaacaaattatagtccagacttatgctgcccgagatgatctcttagaagtccccttagctaatcctgaccttaacctatatactgatagaagttcatttgtagaaaatgggatatgaagggcacgttatgccatagttagtgatgtaaccagagttgaaagtaagcctcttcccccaaggaccagcgcccagttagcagaactagtagcacttacctgagccttagaactgggaaagggaaaaagaataaatgtgtatacaaatagcaagtatgcttatctaatcctacatgctcatgctgcaatatggaaagaaagggagttcctaacctctgggggaacccccattaaataccaccaggaaattatggagttattacacgcagtgcaaaaccccaaggaagtggcagtcttacactgccaaagccatcagaaagatgagggagaagaggcagaaggaaaccgtcgggcagatgctaaggccaaaattgctgccaggcagaacctcccattcctgcaaaaaactgggtctttaccaacttaacataccaccctcgttttgaaggaaaagaccctttccgacttctaaatatgcaatcattagccaacttccccatctctgataggaccaagaataccctaacaggacatgcgatacaacttttgcgttcttacatttccaacctcacctattacacaagcaatgaaaagcccatacacagccctgtaactacaaataccatcttaactttccaagcccctttatgcatccaatgcaacctgttatcaggtctgctcctggggcacctactaccacatcagtgtaattacaccatacaacttcaagccccaactgatcatagtaacttccaagtcactcaaacagctccattcagacggcttgtccacgtctcaggggcccccaaaatcatcacctcctccctgcttaacaaacagtccaggttttgtaatggcaaacatactctctgcatgaccattcacccctggaccccctgcagcagtatccccaccactagtgaatgccatctcatcccctctttcaatcgctctctcg

SEQ ID NO: 438 - DNA, 116897 bp, Homo sapiens
ctatcttcttcctcctctctgtagcgaacattctttaaatagtcatccgcactcactatctctacatcctcacttcctgtttagcattcaacctcaggcaatctggcttctgtcaccactgctcttctactaaaactcattttgccaaggattgcaatgaatgcaccaccatccaagggatacttcttattacttgtctcaggtgatagttcagtatgtggccctgctaatgctctgtcatgaagcatttccttaatttggctcccataaaaccacacacatctggatttctcctttaggggctcctcctctttctctcgaacctcgagagtggtgttcctccgtttctcttctggagttccacttttcttctccctcagtgtatgagattattttcctcaactgccatctttatgctgatgattcacaaatttctaactccagtctggatcttttttctgaatttcgggctcagatacccagctactcactgtgtatctcataatggatgtccttccagtgcctgaaacttaacttgttcatcgtgatttcttcttcccacaacccccaaactcctactcccaggtccttctatcttctttttatctccagtgaaagccactaccaaccattttgtcggccaggtcagaaacctggctgacatcctcaatcctgcctctgcctcaccctgctccaaggtagttactgtgctccattcctgctacttctgttaatacctctggatctacccatttctatcttctctattattgcctaatttctcatctagaccactctaatttttctactctctcctcataggtgtcctagcctctgttattgtgttctctcaatccattttccccacagcaactacaaaaatattttcaaagcccaaatctaatcattttcttctcttttcaaatcgattattgatttctcagtccacttaagccacattccaaaacccttaccatgatttaaagtaaccctcataatctgatccctgcaaactgctgcatcccaatagtatgaactcttcctctttactttctgtaaggcttttggaattaattttatttcatcaaacatgtcatgctctcttatgtctctaatatagatacagtcgtttatctaaagcaagcacttttctctgacttaccacttggcctgaataattcctattcatcctttagatctcagttcaaatgttacttccatggaaagatctccctgaacctacaaggatgaatattaagcacccttcctattgcatcctggcatacttttattcacataactcaaaatatagaacaaggctgggaaaatagagcatgagaaatgccactactaatgtgaaacaagaatgaagaacaaatatgtgtcattctttttttttttttttagaaaaagacatttattcagcgtcacgatctgactattacatttagcaatcaaagcatgggtgcaaaaaaaaatctacattaaaaccctttgttggaatgctttacactttccacagaacaggaactaaaataccctgttacacaattagtcacaaatacagtcctcgagttttttgcccatacacatgagtatttgtctaaaacatgtcttctttgtagcagctaggccctgccaccactgtgcttggctgagttcacaaatctgttgtaacctgtagcttccctgtcattcttataacacagttgtgagagacgttctatgacattatttccatctacttctgatccttctgtattttggggatttcctgggcagatctccatgatgacacagtttactctgtttgattttggtcacggactgattaaactgtctctctagaatgtagaaatcaaaacacaaatgacacattagtctcttaatgtatcaccataaactatgataaattagaaattcacatttgagcaaccatttatgtaatggaaatgagaataacaagccttcatttctacagttttttttaacaaaaaaaattctgtaaatgtgtcctgactaggttagattttattcatctcaaattctttggtaagctcctccctcctctcaattcatggcacatacctttcaggagcaaagcaattcaaaagtcccaactaaaagtgggaactataactatttccttggtcaccccacagctatgattttgaattttataaattactacaaaaattcacatctttcccattggctcccatcaataagtctctcaaaagtaaaaatgtatgctaccaagtaaagtaattattgtttcaaaaagctaatgattctataataaatacattctacatttgccctttttctaaagatattggatatgcaataagcattattgctcggtaagcagccttgttggagaacattattatttaccagaattatatgaaatttttcttttcatgaaatagtttagagcaaaatgtttcactcattccagattgtatgcatcaagtttcattctgagtttttgtttcattagaaaatatgtgaatttgaaactctaaactaaatccaccaagccccatccctccagccttaatcaataaaaaggggaattgtttcaataaatttcaaaatttaaaaaaaaaacttttcataaaactttcagtttataaacttctggtctaatgattttttctcattacttacacacacacacacacacacacacacacacacacacacacacacacaaacttctctccctctagctctttctctctcctctctctccccttcatccaaacatctttctcagttgctttgaaggggagacagcaagtaagagctccaaacattttgtctttcatgcctttgaataacttattctttcccttagaaatgcttttagggaacagattaactttcatctcacatttggaataaacagaattactatcacagtggatggcctacttaaaaaaaatacacaaagcactctcttcctaaatgtttcctttactgtagcattctcctctatctgtgtgagcacaggcaaggaatgaaaatgtatcaacctatgatacaatgtcacaagttggtaagagcttcttttctgccttcaggaaagaattaaagttggctatttccctttagtttgtggaaagaatactgaagaaaacttgaatttgagaatttatcacctgctgtgtcaccatgggcaagttcttaatctctctgacacgttccttcatgtattaaacacatgttccctggtgttaaaaaagtaaaattcaataaaatggaaattataatggtcttacctgttttcaagattactgtaaatactaaatgacataatgcattttaaaggttttttgtaggttttcagtagtggaggctagactacaatcttggatcctatcatatacttattgcctaagtttaacacttccaataagtgtgtttttggagtttctctttctaaattttttgaatatctatttttgacctcacactacctttacctttaacagcaattctcacttatcaaaattatgactttactgtttcaccaaatttaaatttagagactctctcattcttgttcactagtagacagtgcctattgacattgtgttactaaaggggtttcagaaaattttcttcattaaaatttatcatcatcaccctaggatcagcatgcacctgaccactaatccatgctaaagaaacccttcttcaatagttctcactgtcttgcatcttcctatccagtcaaactagggccagtgttcataagatttcagagaacctcaatgaaatgctcctttgggatttgtttttgctattctgatgtgtgtgtgtgtgtgtctgtgtgtgtgtgttttcaccttctaccctagcctgtcagaaacccctgttttgtggtccctgcttggatataatttattctcttgagtatacaagtcattgtgaaatgcagaacaattgcctggcaaccaacccatgttcactttagtggtatgcctaattactaacagatcaaggttttctgccaaatcataataatattgtactctgagatataacataagaaaacaaattaaacagaggttggtagtgcagagcttcgcaggaaactacttagcctctcatgcttgcacaggctttgagttggatctgagtcagagctcaattttcccacacatctccagaaaatatgaaaacacactttagaagatttgaagaaaattggatatcaactaatagctaccttacttcctttttaatttgccttctccatatagggtgtctgtcggaaagggaataatttaacttactggggcctaaacattgtttaatctctataggtcttccttccaggaagaattgcactaactgttagcatgatgccagataataacactcataaactattgcatgactattattttggaaaaagaaaaaaaatcatattcaactggtctaattgccaagattataggaatggcttaaaaactttaaaatttttgacacaactctatcagtagaattttcccatgagaataacaacaacaacaaaacagaatattcttcacacatggaactcaggcaatgttcagtacttctttctccccactgcttcagggcattgttcctgtcacttacatttccccctaatcattcttattcactactgatgatctgagtcattcttcagctgctaattatgtcttcctcaattttttgacctatcacaagagaattcagaaatatttaatcaatatgaaatatcaaaagagttaaaggcagctttgcaggatctttgcaaaggaaagagttccactatactatagagagatatataaagtctgttctttgtcataggatgttctatgaatgataatattgtgtgcctgttaactattcataataggtgtaaacactaaatgtttttattgcgttctcacacattaagccatcccagtgattttcaagcacagtttgtacatctcattgtgaatcattcaaaaagtattgttactcctgccccatcccagacctccttaatcagaatctccaaaaggcctgcgggggtagaggagggtaacctagtcatgcatatttttcaaaagctccctaaattagattttgttttcccaattgaaaggtttggtgctatcccattctgagcattttattaatatcaccaaagacccatgtccgattaatgatttcagtagatggcgctctttccacctgccagcttccttgcttggcggaatgaaccctaagccattcataaaagtcaagggcaggtcaaaggtgcaattcccaccaatattgaaaacatacactagaacttacctttgcaaaccaattgttagtcggttaagacacacgttaaagtggtggtggggaaggggtacagtatcacatttgcttattacatgaatgtaattattcttctgaagagttcaagaatgtcaactccctggcacaaaattggaaactaaagaaacagagtagaaagcagtgattttttttataaagtagagatttggacaaaagaggtttttttaaaaatatgagaaagatataggaaatactgatgttactgctatacaacatactgtgtgaaaaacttatgatggggcaaacatagatgtctgtatctgctaaattgggagacagcaccaggtagcctgcaagatcatcagctttagagtcagctaaccctgattgagacaattcttcccgctattttatagcaaccaagttacttagcccttaattctcaacaagatattacctactttacttggttataataagcattaaattaaaagagataatgaatgtaaaacaattatttcaatgcttggtgcacagccagtatttaaccaataaacttacttttggagtgctaagtaaatgtaggtgctgagtttttaattttttaagtagcaaaggataatagaaaattaacatgaggttttgaagggaagattcctttaccagtcagtactaataatggtgagaaaaaaattagaggaggataagcaggaaaaaaacagaaggttagctttggtataataaaaaaggcctaaaccttaattcacaaaatttagatttgtaaggtgctctctatttacaggatgtctgaccctaagtaaatcaattaatctcatctttaatatttatatgatggaaattacattaaataaatcacttaacctcacctttaatatttatatgatggaaattacattaaatgccatttttaatatgacatcattttgcatattaagtcataatacacataaaatgccaaaaaactatagagtcctataaaatggtgctgaggtaattattaatagttaaattttattgattactgaaattcatcaataaagttaaaaattattctttcaaaataaaatgagatactaagtgagttagtaaatttggatgaggacaaaaagagtagttactggattgtgaagtcagaatttatgaaaagaaaaagtattccctaaaattgtaagagattggtattagcaatatttgcaataattgtggaggaatttccatgatgttgtcccactaatgattctaatattctttcattttctttttgagacagagtcttgcactatcacccaggctggagttcagtggtacaatcatggctcacgtggctcacagtcttgaattcctgggcttaagtgatcctcctcagtaatattctttctataatgcctttgccaatacttttcagtttatcttatattctactttgcccccattaaattagtacacacattggatagttcctgatttcattaatttaatattatataatttgtattttttccttaaaattttcaaattatataaagaaaaattaaccaaataaaatcagattaggaaaaaagtaactagaaatcataagagattctatcgagattctcatcatattataatccctgggtttagacaataatttttattaataataatttatattaataagctaaaatattatatctcaatatgtcatctattggagactgttgaaacttagtattctgtgttaaatacgtacctacatataatgtgcagtaatgtaaccaaacaaaataaataagaaagctttttaaccgcagtgactgctatgctgtttgatggtcaattgtcttttaagcatacagagaatctttatcatgttatacttcagaaacatgtttttggagatgggaaacaacaggccatgattttatgtttttgttaaaccagtataattctttcaaagcagtgtatatcacaactatttctctgtgttgaagagagtatcaagttcttaaagaaaaatgtaatcccagcactttgggaggctgaggtaggaggagcacgaggtcaggagttggagagcagacaggagaattgcttgaatccgggaggtggaggttgcggtgagcagagatcgcgccactcactccgtcctgggtgacagagtgagactccgtttcaaaaaaaaaaaaaaagaaagaaagaaagaacattttctattctgcaggtgggaggaaatgaagaatgcacctattatttttgtgttagtacaacataaaaaaaatttgcattgtaaagcaaactaccatcatcagctctttaatggacagcagcagacaggaaactgcctccaccctgagacttaaagactgagcaactgagttagatagcaggtgcgcaggccaatcaagtcaattttctaacacagagtagcatgttgtggaacttgttctattagtcttttttctctgttaaggaagcaaggatctctctgtatggaagcagtgctgctatttctagtttgaggaaaaaaatggtaaagaatttgataattaattgttgttaaaacagcaaattatattttaaacacagattgtccacacctgtaggaggaggaatctcaagaatgcacacaattaataaaagctggttctgaattacccatacaagtgcgcactgcgttcagtaaacaactgatttgcaaactatatcctttctttcccagaaatagcaggaggaagtttttcaaatcaaaaaaaaaatctaactaaaatattttatacgtgaaggcctgcagaattttacttccttttgctgttgaaaaatcacaatagccaagaggagtaatgtattttattttaacttttaaaaagtcatgatggttaagggtagagtggaggtgcagagaaagaagttggcaagaaaatgttcagggcctgttgtaaaaccaactgcaacccaaacatgattccaaataggtaagaacaccctgttacaacagagagcagttttcaaagaagaaatgagagggaggtgacctgaaagatcatttcccagttataactaaaggaacctacggatacttttatattaaacacatgctaatataatattttccacatattattaaatgtaagaagatatataattatatacttctatagtcagaaacaaaataactcctagaagtaaatggtttgttactgtagtagtagtaactacctgggcacttacctagtgctcttattaaaaactcaccacaactctgctgtcttacaggttgttgaacagattgaaagaaaccgataccgagagagttaagtaaaatgcacaaggtcacactggaaaagatagagttaagagtcactcagctctgtaaaactccaaagcccatgtttcaacaactctgcaatactgtgcactgtataaatgtatgttgtggtcttgagagaactttatttcctggacttgaaaaatacatcacaagccgggcgcggtggctcacgcctgtaatcccagcactctgggaggtcaggagttccagaccagcctggccaatatggtgaaaccccgtctctattaaaaatacaaaaaatagctgggcgtggtggcgcacgcctgtagtcccagctactccggaggctgaggcagaagaatcgcttgaacccggaaggccgaggttgcagtgagccgagatcgcgccactgcactccagcctgggtgacagagagaggctgtctcaagaaagaaagaaaaggaaagaaaagaaagaaagaaataaagatcacaaagaactttcaaacagcttagattttaaagtgcattaacaatttccaagacctaagtgacgctttagtgtacagctagaaaacatggaatgtcattcccacctgaaatgtttaagggaaaatgtactatttccttagtttgtgcaaaatctgaaatctgagtcaactttgtttcaaaatggaataaacaaagtttgattggacccactaaacattcttcttagcaacaatgcgacacttgcaaggagttccctttttcacactcttcaaagaggaaatattccgatttcgtaaaattagggcttcgcttttaaaaaaaattacagaccaaaaaaagtgtggttacacaatataactagtattgacttaagggtactgtgatcaccatgcagtgatcccataaaagatgtgaccaaaatacccacttaaaatttgaacgtcagtcatgtaagaacatgtaaaagatgaagggaatatttcaaaaacgactatctgacgtaatatgatacttactatgactcatatgggctttgttcttcatctcatcttcaaataaaaagttgatgattagaaaaaggagcattagaagggggaagtaacactactcggcaatagagaaaaactccggtcaaaggaagagcatagttacagagctccgaatgtcagggaaaatcaagcatccgtcattcggaattagctctgtatcggtcggtttcttcattacttaattgtacggggggaaactacttcaaagtaagggctcttacgagaggcaacttaagcatttgaaagtgcaggtttatttcctcctagcgagaagtagggggtcactagtgagaaacctatttcaatctgtgagacgcccccttctactcagcccacgtggctaaagtaaacagaaggtgggccggggcggggagaaacagaactcggtcaatttcccagtttgtcgggtctttaaaaatacaggcccctaaagcactaagggcatgccctcggtgaaacaggggagcgcttctgctgaatgagattaaagcgacagaaaagggaaaggagagcgcgggcaacgggatctaaagggagatagagacgcgggcctctgagggtaaggtgggcgcaagcggaggtgtggtgcggggagaggtgccagtgggtggaggcgggggccagagcgagggcacgtgcgggtacactccggaggaggtgggtgcgcgcgggggcgtgtgcgcgggacctcgaagtggtggtggagtgcagaccagcaaaaagtttcaaagggaaatcttagatgtcacgtctttgtccaggcacccgtgccatcccaacctcccacctcgcccccaaccttcgcgcttgctctgcttcttctcccaggggtggagacccgccgaggtccccggggttcccgagggctgcacccttccccgcgctcgccagccctggcccctactccgcgctggtccgggcgcaccactccccccgcgccactgcacggcgtgagggcagcccaggtctccactgcgcgccccgctgtacggccccaggtgccgccggcctttgtgctggacgcccggtgcggggggctaattccctgggagccggggctgagggccccagggcggcggcgcaggccggggcggagcgggaggaggccggggcggagcaggaggaggcccgggcggaggaggagagccggcggtagcggcagtggcagcggcgagagcttgggcggccgccgccgcctcctcgcgagcgccgcgcgcccgggtcccgctcgcatgcaagtcacgtccgccccctcggcgcggccgccccgagacgccggccccgctgagtgatgagaacagacgtcaaactgccttatgaatattgatgcggaggctaggctgctttcgtagagaagcagaaggaagcaagatggctgccctttaggatttgttagaaaggagacccgactgcaactgctggattgctgcaaggctgagggacgagaacgaggtcagagcgcttctcttatgccgcgaaactctccctttcttctccccttcgctttttctcgggcttccagggactggggagcaaaccctgtagtgtcacccacaaataccaagagggaagagggaagcttcacaaattactggagcctcttcaacatggctgacaaatatagttttaattccctctaccccttttaaacctgtagttctgtgttctcttctctcctcctaatgctcgtcccctcatctcccagaaaacttacctttgtgcctccgacgagccggtttcccggccttttttaatcctcagaaaagtgatttttaaatttgctttcctttctaaaatagttcagctttgggggcactacttttccctttaatcctcttcccctgtttctttcgtgtaagtgaaacgagtctcccgtttatcctgaacaacctcagagagaacactgatagggtgtttttcgacccttttatcagctgtagggtctgggtctgggtttgtgtctgcctcctcctaccttcttatccccctttagggggctgtacgaagtgaatgtcacagggagtggaattggagtacactgagtgggttttttttttccttaagtccgcgcgttttgttagcggcgctgagtgaaagaggaaagaatagtttctctggttccccaaacaagaccagaactcacttttctcaaggtacataagtcagcgctgggctgagccttccagcctggggaatgtatgtaagagaatttatggacaaatctgtgtcccggctttgtgcttctcccgaatcagcttcgtttggttccttggtaagtgacaggcagacacaaaggcaggcgcaggcccggggagggggcgggagggggtggggagcgcagcgttggagttgcaagactgcaaggtcaggggcgcctaaagaaatgaaacccaatcccagcaaagaagtgaagagcagatttataacagtcccatccaaatttctctttggcttctctctttggtctttcatctctctgcctttctctctgtgtctcctctctactctttcttctctctctctcatacacatacacacacacacacacacacacacctcactcgcatcttgctgaatcttttcactgggactgcttgtctagttttattaagctaatagggtttgtatggagagttttctacctatgacataatgaagtgtggcctggatagactcctggaaaggccgaaaatgaaatataagtgttatttgctggttattcccctcatgatatacttttaattacattgagggagttctcccttcttcatctaatgtttaagaattgagaaaaggcttattttccagcggtaaaatttagtgcataaaatttagtgaaatatttatatatttacgtgtctagggagtggaatacattcatgaatttaatatctcaaatcacacattgtgctttttccccttcagtcagggattataatgggaaacccaaattcaaagatattcatcaacaaatgatccatcataggaataagattgtatcttaagggaagttgggattcacagagaaaagacattggtttggtttggtgtgatactgtgggtattgttgcctggctaatgaaatcattacatttgcattttaatggaaagttgaaatactaaggggagttatgttcttttacatgtttgtatgtgtgcttaataatgtttggaatagaatataaatttaaacacaataaatattgatttttttaaatgttaataagcagagaacggttaatgaagtgttggataatcaaactgaagtttagaagacaatttataggattaaaaaatggatagaaggaaaaacacaataatagatatttctccataagtcgaatttccaaaactatttgtcctcgatagttcactttgtaactttctattttgatctttgttaatttaatgtagtttgctttaatcattgatacgtggggttctttcacatgattacaagggagaagcattactcatctctgtggaatagaaacggttcattggttagttcttatttgccctaaaattaaaacaaaaattaggattttaccattaatgctgttcatggtaaactatcgagaaaactatggttaattattccagcaattcagaattaaaaacaattccttttgctaacaaactaatatttactttttggggacaacttttcaaatgttgtggtatatactgtcttcaggctactcaactaataatagatacaacattttccactcaataaataagaataactacattggttaataattttgaatacaactatgaaggcttgttttttcctgtcatcaaatttagattcttgttattttgtgcatcctacttttatactgaaaatagctgctaattaatactgtataaagtatttcagtgattataaggaagagatgtgtatgttagtcactttatcctttgttggaaaagagaaattattttaataagtatggggtagtttacaataaaagacataacctcagttctttctttaccatatatgtgatcatactacctaggtgctccaaaaattccataggactgtcttgggttattgaattttaggaacatgataatggacaataacaagatagatagcttttcttaactatgacattgttttgcttattttcttattgaactaatcatcaatgagaaattaagttgcagtgagagaaatcccttgctttgtttaaattgtcatatttgccaaactcttcttaaggctttaattaggtctgatgtgccagtttatgccagaagccggaggaattgatatgattttgaggcagtggcacatggtcctactagacattggcaagtgaatatcacttccagaacaagtgaagtgcacctgccaaggagttgttatgaaagaattccaaagtccttattgggcactggtcttgtattaggtaacaacaactggagttaatgttttagtttcacttgttgaagttaaaagttccctatcaattcttctaagactccacccccaaacaatgttgtaagtcaaatgtcactattgaaatgtatttccttaattactgacctcattaagaagcccttcttatgattcataggcacacctcacagaaactctattttccatcctgcccaaagtctgagtaggtaaattcttatgaattcttatgaaattaccttgaaataaaatatcttcaaaagttacggatgctagacattgtataatgtcaatattttagaatatctaatatttagaaaatcttagatctactttttatgctttaattgcttctaatgcaagttaaattgtttttgttgttattgttttaatagaatttcatagtcttatctagcaatttcaaatcgctggaaagagtcatctttgttatataaataaccatgtagactgttttaatgttattgtttcctaccttgggaacaggctaaaactttggaccagctgtcagtatttgttcatcagaataacactttgtcaatgattattctaccattgcacagtagttcttaaggatagtaatggtaccaaagccagcagcaatagaatatctcccaagccaactttacaattggagccttcactgtgggaaagaccagttgccaagtagagctggtggttatctgggaaactgtgctgaagaacacaaccacaaatgattttgccaaatatacagtatttacttggtctagatctccaatttctatttctactcactgccaaaactgagtgaatactgtgacattattgaaggaggttatgcagtacatctgttggtttggtatatagtaggagagaagggttccaggagggaaaggggaaagtcagagcatgtgaatcactgtgactacaatccaaaaagaattatgtatgtctgctatttccagcattatttttgtcctatattgtacattgcagagacttgctgacttaaaatagatatataatctttttctcaaaagaatagatatttggttgtccattccaaataacaaattttggatgggcgtggtgactcatgcctgtaatcctagcactttgggaggccaaggtgagagatcacttgaggccaggagtttgaaaccaccctgggcaacacagtcaggccccagtctctacaaaaaatttaaaaagttagtggggcatggtggtacattcctgtagtcccagctactcaggagactgagataggaggatggattgagctcaagtgttctaacttatagtgagctctgatcacaccactgcgctccagcccaggcaagagggagagaccctatctcaaacagcgacaacaacaaaaccaaacaaacaaaaaagcacattctatcagctttgatttatgttttcttcatttgtaatgacatgtagttaaatgtgtcatacttcaaaaagaagaaacagatagtaggtggattttcaatataatatatattagatatagataatatatattttcaatatataatatatgtaaaaataaattcagtgataatatcatcctacctgcagttttaagaattcagaactcaggccaggtgtggtggctcattctgggaggggaaggcaggaggatcacttgaggccagaagttctagaccagcctgggcaacatagtgagatacctgtctctattcaataaaaataaaaataaaaataattcagaactcaatgctttatactcactgaaagttgttcctctaaactgacttgaaatcatgttccaaataaactgagaattaaagtaagagacgaggccggttgtggtggctcatgcctgtaatcccagcactttgggacgacaaggcaggtggatgacctgaggtcaggagtttgagaccagcctggccaacatggtgaaaccctgtctctactaaaaatacaaaaattagccgggcatggtggcacacaccagtaatcccagctactcaggaggctgaggcccgagaatcacttgagcctgggcatggtggctcatacctataatcccagcactttgggaggccgaggcaggtggatcacctgacgtcaggaattcgagaccagtctggccaacatggtgaaaccccatctccactaaacatacaaaattagctgggtgtggtggcacatgcctgtagtctcagctattctggaggctgatacaggagaattgcttgaaccctcccgggaggcagaggctgcggtgagccgagatggctctgctgcactccagcctgggcgaggcagagagactctgcctcaaaaaaagaaaaataataataataaataggagatgaataaattgggataaagtgtttttgaaggacagtctaggatataaaatgaactggttgtttgactaaaaatactacaaatgtttctttcaaattacatttcttttttgtctattggaaggtaggcactgatttctatgtctttctattccctaatagaacctactgttgacctctcagtcaatatttaatggatgatatagaactagtgaaaaaccatgcaatttaactagaaaaaaaaagtataatctattttcttttcctttttctttctttctttctttctttttttttttttttttgagacggtatcttgctctgtcacctaggctggagtgcagtggtgtgatctcggctcactgcaacctctgccttccaggttcaagtgattctctttctcagcccccagagtagctgggactaggagcgtgccccaccacacctggctaatttttctatttttattagagacagggtttcaccatgttggccaggctgatctcgtactcctggtctcaggtgatctgcctgcccgggtctcccaaagtgctgggattacaggcatgagccactgcacctggtctaatctattttcaatgtataagagaaaaatagtgttaagtgtcttggtgatggtgatgatggtaggagtaatggtgtgttttccttacatttaatttctacaggctatggcaattgccctataaaagccacccattttaagcacaaaagtgaatggtttttagtaaacttatatgggatcatatatttttaattgaaatattttttgagttaattatagattcatatgccattgtatgaaataatacagagagattccacgtatacttgctcaatttcccccagtggcaacactttgcaaaactataatatcatatcacatcacatgcaaaactataatatcatatcacaaccatgatactgacattgatgtggcctactaatcttattcagatgtcctcagtttaacttgtactcatttgtgtgtgttttgttttataccatttagtcacatgatcacatatttttaaacctttttttctcaaaacagagaagtttagcacaaaagtttagcaatttatcaatcttgtgattgtgctgttatgccatattaaaatgtgtgtcagaatgtaagtttttgttttcttaaaagtcctttttttgatagaatggcctttatgttaaaaatattttaagttgttttgtgacagtgtaagtcgatgtcatttaattctcatcacaaccctagagataggtattattcttatccctatttatgagtgaggaaactgaagcccagtgaggttaaataacttccttaagttcatacagcctatacatggcttaggcttagccagcatttgagttaagcagtctgtctctagtgccaaatcttttaatcactatattatacttcatcattatcattgatagctgtaaaagtgtataatgtggactatgtagagaaagtcataaaaggagatttaaaatgcatacagttgttcacatgaaaacttgtagccaaatgttcattacagcattattaataatggtaaaaaatggaaacaacccagatgtctatcatgtcatgagtgaataaacaaattgtggtatatccatacagtgaaatattattaagtagtataaaggaatggattattgataaatgctgtcacataggtgaatctgagaggcacaagaaaggccacatatgatatgctttcaattttaagtaacgtccagaataggcaaatctaaggagacagaaagttggctagttattactaggggctagggatgggagggaggtgactcctaataagtatgagatttcttttggtgatgatgaaaatgttctataattagatagtaatgattgcccaactctttgaatatgctgaaacccactgaattatatgctttaaaaggatgaatttattgtatgtgaattatatttcaaaaagctgttgttataaaaatgaatgtagttgagttatttggtttattttatgtcagaaaatgtcttacatctcatgcaaaagaaatgcaggaactatttggattgaatgaggctaagcatatctttctaggaagatggcatcaaggagttttattatgcctgtaatcctggcactttgggaggccaaggcgggagaccagaagtttgagattagtctgggcaacatcctcttatagatgagaaggatacttaatcactcaaaagttggcattgtgttttgtgataacaatagcctttagagctcatatgggaagattcaatagatagtgataggttatatgacttggtaaagagggcttaatgtataggtgcaagaaactttctcagatgtctttagttacctagccattcagttcaggagatgtaacccaagtgttaaaaggaatgtgactgggtgcggtggctcacacctgtaatcccagcactttgcgaggcggaagtgggtgggtctcttgagctcaggagttggagacaagcctgggcaacatggcaaaaccccatccctacaaaaaatgcacaaattagctgggtgtggtggcacatccctgtagttccaggtacttgtggggctgaggcgggaggatggctcgagcctgggaagttgaggctgcagtgagccatgttggtgcccccacacttcagcctgggtgacaaaatgagaccctctctctcaaaaaaaaactataaaaattgctgttcttgtttaaattactacaaagtgcagtttaatctagaaataataacaaattactagatttggggggttattaatgtcttatctatgtgaaaacagaagggcaatgcagggcagagaataaacttcaaaactttgagtttgttaactgtttatatctccacttgtcatgtttcagattttaaagttaaaatgacaaagtatctcatagggtttaaacaagtgactcttttcctgttaactgatactgtggcatgttgaagatgtaaaataaggttgaaaaggaaattgctttgcagcagtcttcataatgccaggacaaagtgagaaacagggtcagaatgatgatggctctccatctttgctacacatggctgcaagtatttacaaataccagcagaacttctacaaaccacttacaggtaaaatgagtgcagatttttaacactagtccctatggaactatgacttgtagttttggacacacagggtgaattacttggggttgattgtatttgaatttctaaccttatgtaattctagataccagacattcttgttgtgcaatgcttctctccctttttattctcatgagaatgctgggttgcagccggttggatcccataccttgggaccatgactgataactggagtggagaaaattcactgatctggaaaggttgagctttagggttcagagacttatttaaggtacacatgtgattgtacccaataaggaagtatattggctttatataattgttatgatcacttgttcaatgagtaactatagaattttactttttaagagtatgatcatagcatctacttgtaggtttgttgagtatgtttgacaagcccaagatagatgctcatgttagacccattaagaagttggtgtagtgatggttatggaaagcagtaagatagaatttaggttctgttctccttactggagaaatgactagcttacttgtcttcactctctcttgtttctctcaaaactttgtgaaccacctcagctgactataaatttttgtactagtatctccataattttaaaaaagttgttcacaagtttgagtgtagtacttcatctttgctttttaatgcacttccaaaaaatgtaaatctgttctcgcatattaggaacattttgatttgttgtttatttttagctttgctttttataagtaatttatacagaaggtacaccatattcaaaagaagaaaaatgggctgtgaatttttgctgatgtactactctcttcaaagggaattgcctatgttcaggcatagaaatgcaggcagtctgacatttaggtatgccatacagagtattgatatttttaatttgctacttttaacattttgagatttgtcacagtttgttctgtgggtgggtaaaagtaatggtaattttaattacagttgtcgtgcctcattagccattgctaaaacctgccttaccaaatcacttattttcttgatgcagtgttaaatctagcttctatgtccaggttatacattaatgagaacattcacccatctctcaaatgggttattatagtattttctcctgaaatagatgatgcataaaaaaaagtaaaaaagcttcaatagggataatgaaagccagataacatagcatggtatatgagttattcctcccgtttttcttacctgtctgcactaagaagggcacccattaaataccataattattagttgtgctgcctctgaagtagagcaccagaatgtgagagtaatacaatgagaccacacccagattctatccataacatactgtcctggtcttattaatttttttaacctgtttgttcttttagcacttttcctgcttttgtttgaagtctcttgctttgaagttatagaatttttatatttgccattggctgtaaagttatctcagctcttttataacttttcattatatttgcattaaaaggatcactttgagcaccctgtaattaattcagatgattattagcttttttgtttgttctactgtgcactctcctatatacattataacagaagaaaaaaccatttctacaaatacagtgtctgatagttcatcaaatcagaatgagcatcttaaaaagtgaattattaaaatattaattcatttacattcctattttaatgtaccaaatgtaactgatgaaaagaagaataccataaatgggtacctttcaaaaatgaaggaaaaaaaaatctcacaactaaagattcttaccatataaattatttattttagtaaataattattttagtacaaacagatacattttagcaggaaaaaacacactttaaaccttgttttatagattttatctttcttccaatctagccactgaaatggttttttctccagtgaagttatattatctacataagttgaatttaaaacaaggttgtattttaattttgcagttgtctgccacattacgcttgtggaaaaacactggcagaaagcaaagctaatagacattttgctgttggctcaccttattaatggctaagatttaattatgtatttctactgaaaagcaaacttgaaaaagacgtttggttactaactgtgggaactaaaaatttttatttatttttattttttattttttggtagagtctcactctcttgcccaggctggagtgcagtggcatgatcttggctcactgcagcctcctccttctgggttcaagcgattctcctgtctcagcctcccgagtagctgggattataggcaccagccaccatgcctggctaatttttgcatttttagtagaaacagcgtttcgccatgtaggctaggctggtctcgaactcctgacctctagtgatccacccccttctgcttcctaaagtgctgggattacaggcatgagccatcggcctggccaacttatttactgttacaacttacttactttgaaacaacttatttactgttaaaaaatgtggttcttatttcaaataagattttatggacatcaactaattttttaaacatatattgtaattttaaaacatttttaccaacatttttcaagagcatgggaaatctagggtatggcattttaaagtgactttaaagacacttcttgggttttgttgaagtcagaatatttttaaaaatacaatgagtttaatttactactgacagattttctttaattttttttgcattgttataattagtcatgccttaatcctcggggtttttgggaaactatatttaggggttaaaaacttagttattgacattgtaatttttctcagtattggtaagaattcaggtgtttaaggaatggagtttacttgttttctgttcacaaacccattgtaaaagatataatgaatgtagatgaaggtgaaatccgagataggaagagaggtaaaatgctacttttttttccttcacccaaggaaagccattgaatactgaatgggtcatgttgtaatttaattgggtgtaaattataactttgtaaatcatttgcctacttagtgtatatctctggtttttatgtaattcatctcccataatatctcagtttacactgaagtaaataagcaagcaggaataagtcctgcaaatagaggaagtagaaagtgcattcagaatgcattgctgaaattgtaaaactgatcctaaattgaattaggtagagcagttaatttagattacaagaaatgcaacaggaaaaaaatattacagttcttcctcttttttggaaaaaaaaaaagaaagaaaagacaaataaatcacccttagttagtgataattccttgacatctgtatgctcatttttagggccaaaaaatagtaggcttctctttggaaattgtagacgctttctctccttccagttacacgcggtcacatcaacatttgacacgtgggtaccgtgcacgtggcagcagtatttacaaacaccatcctaggattccagagactcttatgtaacagtggagagagtaagctttgagtgtctgtgggcggaggaatcaacacagtttaattcattgtccgggagcccttgtctggctctgatagggtcatgaaccaaagatcaaggtgtttaggtcaggatattccctaacgcatggttttcctaccaaagcctcaaaagctgtgcctaaatacaagattaatctttttctttctttctttcttttttttttttttttttgagacggagtttcgctcttgctgccaaggttggagtgcagtggcgccgcgatctcggctcactgcaacctccgcctcaccggttcaagcgattctccagcctcagacacccaagtagctgggattataggcatgcgccaccacgcccggctaattttgtatttttagtacagacggggtttctccatgttggtcagcctggtgttgaactcccgacttaaggtgatccgcttgcttcggccccccaaagtgctgggattacaggcttgagccaccgcgcccagctaagattaatctttttatgccctgcagcaaacaactagtcatgccaaaccatttttgtgatttggggaaacatgagcagatgatgctttggatctgattataattcacagtgctcttgtaatttacgtgagatttgcatacctgcctcccagcctcacaaaatgcctttaaaaaattacatcttggccaggatggctcacgcctgtaatcccggcattttgggaggccaaggcgggtggcaagagatcgagatcatcctggccaacacggtgaaaacccgtctctgctaaaaatacaaaaattagctgggcgtggtggcgggcgcctgtaatcccagctacttgggagactgtggcaggagaatcgcttgaccccgggaggcggaggttgcagtgagccgagatcgcgccactgcactccagcctggcgacagaacgagactccgtctcagaaaaaaaaaaaatcttgatatttgtatgcatcttaaaaagcaagagaattcatgattgacttcccaaactaaacggtctgaccagaaaacactcaagaaaactcttggttaatcatgctccttagtataccattatacctgcctctcccctttccccatcctctgtaaattctctcaaccttctctcatttttaatttcataccaagacctagagctaaaacaacaacaacaaagctttaagtctctatatttagggaatgtgcctcctatcccaaattgatttttagagcttttcatttatttttatcaatacaaagcaagttgaaataaaaaaaaaggcatcaaaaatttaaatgtctaaccacgtatatttggtatatgtatactggtgctatgtattagctgtaagcagactggtttgaatatttaaaatatgaacagaatttgagttctttttgtattgcatctaaggatcatttgagatggatgtcatcatttatcatccaaaatagaagccttcttgcctaacaaagaattgtaattagatcatcaaagatgaaatttatagtaattgaaaagttagctcatttgactgcttctttcatagactgtgtttttgtaattacactacctttctaaagataggaaaaatcagagtctctgaaatgtaatactataagtgaaatatgtattttttaaaataaaggatcttttcccaagagctaaaccaagcaccaaatctgttttttgggggttttttggtttgttggtttgtttgtttgtttgtttttgacagagtctccctctgtcgcccaggctggagtgaagcggagcgatctgggctcaccgcaacctccgcctcctgggttccagcaattctctgcctcaggcttcggagtagctgggattacaggcactcgccaccacgcccggctaatttttgtatttttagtagaggcggggttttaccatcttggtcaggctggttttgaactcctgacctggtgatccactcgcctcagcctcccaaagtgctgggattacaggtgtttttctttaagtaatacttggtataagagaactttatatctggaataatttaaatattatctgaccgaatctattattcacatatagaaactcaggttttagccatttaacatctaaagctgttctcatttagaggaaattaccaaaagagtgacttatttaactaacaataaaatctaaggatagatattttttcattctgttgcagagcaaaagcagccttctggatatgaaaagatattacttctttagtgtttattacttataatttattgtacatttctgatacactgaattaagatgcgatgagagtaggttgtagatttttaaaagttcttatttgcgtgatttatctacttgcttttttagtgtcggactataaatgatgtatttctctcaattatcctcggcctaaatagtaaaagcttgggtgaaattacttatgagtatacttttcctgcacagagcagagccattactgaacactctcgagctttaacaaaaatcatcctatcttatattagaatattaatattttccctctttctcggacctttgtttcacagtaaatcatatatggatataagctgcaagtgctcagaatttgattaaggctataagttaatttctactaaaaaagggattcaaatagaactttcatttggctgtactgtagtttcacttgaaggggcaagcatgcaataaacattgacttattcaatgcataggctgtcttcataaagatgagactgagtgacagttgtctgtgtattataaaatatcagaatggtagattgaatctgatgcataccaaggagcaatgtggaaattttaggctgttcgtcttttttcagttactactaagtgtgtgtatgtggtgtgtatgtgttttgaacttttcatatttaagctgaatcctctttggtagaaatggttaaatagactatagtaaaagtttctgtctataaatataaaatgaaaaaatactgatatcttgcattttccctaatatgttgaaagtgcacagaatccttggggtcttttgtataaactgtttttatatggttcctgtagaagacagctgaggcaccaaacacacacacaaaacaaacagcttgcttggtgatgataacattcgtgcaagggagttctctcttgcataggagtcccaggttaccctaatgccttcccacatggtcaaacacatggagctttcatatttacacacagctccagaattctgaagcctgcagttgtttatcagtgggatacagggagaaagagtggtgtctatcttactaactgtttaatgacctggatcatgaatactgatacagaataagaaagcactggcctgactgcaggggaaacatggtagatgcctaaaggaggcttttccctgccccacactgtttattttaaactatcattatcacctgaaaggagcttttcactttgaacttaaaatagtagcttttaaccctgacaagcaagtaggcactttagtattcaagaactgaaggtgacaagccctgaggagtgttactctctttcataaccaagctgactcaaactcttttagaagctagtgtagtaacttaaccatctctaataatgttgctgcatgccttcatagaaacagttggagcaagagctgcattttcttttttttaagtgtttattatttacattttatttttgaaaacatgccattcctattacatatagaaatacttcccaaaatcactgtttgtatagaactattttgcttaacattaggattctattgaagagcctatatctgcaataatacggggagaaaatccccttttgtgtgatagattaatgataaagagaaagaaaaggtgagaagtaattttgggaaatatgcaatgataaactagtggtatttattgaactaaacaccagcagctgtgcttagcatggataattgcctaaaaggatgagaaaaaaaagtaaaaatcaggagactataaatttttcagtgaagaataaattttctgtcacaaattatgaacattttaaatatgtattttaaactttttcctacttgtaacaaattatcagactttttaatctaccttttttgagcttttcatctttttccctgaattatagatttaattctgtgtatgtatgtgtgtgtttgaatatatttttatattttagatctagatttgtaaactagagctgtttctaactgcttataagacattgccacctggattgccaccactttcactccagtatttcaataaacacttcatcaaaaacatagtttattttcaaacatagaatcatggattgctacaagctgaaaggactttagagactcagtaaccccattccttgcatttacagatgagaaaatggaggcatgggaaagtaaagtcagttgcctcaaatagcgtaacaagctatgtatatttctaataatagctactattgattaagttcttatgttgggttaagtaccatgctaagcactttccaaagattatctaattcttatgtcatctatatttttgttggtgctattactctcctcactttactaaggaagaaaccaagacatggggttaaataacttccctataaattttgaattatctttggcatcatctccctatttgcaaatctccattgtctctttgttcgtaatcaatgtaaatcaactcttaaacagttggatgccaacaagcagtctggtgtttggagctcgaaagtttcgagagagagagagagagagagagagagagagagagagagagagagagagtgtgtgtgtgtgtgtgtgtgtgtgtgtgtgtgttccagctttgttgaggtataattgacaagtaaacagtccacaaaactgtacacatttaagagatacagtgtgatgttttaatatacattgtgaagtgattattactatcaggctaattcacatgtccatcacctctcagtcattttttgtgtttacggtgagaacacttaagagctactcaaatgtagtcaaggataccatacagtactaactgtagtcaccatgctgtacattagatctccagaatgtattaaatattcatctggcataactgaaactgtgtatcctttgacaaacctatttcccctactacccagcccatggcaaccaccatgttactctctgcgtttatgagttcgacttctttagattccacatataagtgagatcatgcaataggaagatctaatttagcatcctgactttcctttttattagctgtgtatgtcatattcaggttgccttagcatttgtgaatctgcttctctacctgtaaaatgagaacaactaataattcttatctcatggattactgagaggatcagatgaagtaacataaataaaacatccagcatgttacttggcaaaattgtagtgattgaataaatatttgtttattcttcaagcatgtgttgagcatctatgtatcaggcaagaagagagccatcatctttacccttctggaatatacaggctcataggaaataatcaatgctttgatctttttttaaagcataatgagatgaaaattataggactcatagactggtcagttgaggaatttcccaggatgcttccagcctctgctcaaaaggtgtgaattcccagttgcctgaataggcgccagagttggcatagctttctcagtattgggacctgacagggagattgcacaagtgtaacagcacagcctctgaagattggctcaagggggaagagatgaaggattacttccatcccttttattgtttcaatcaagatatatattatgagctcatagtaccatcctttcatgatcatcctttattgtctttattagatacaatgaaaagatacaaatttgtccatagaaatattaaatgatagcaggcatgatttaaaaagtactaaggactatagatattactgtttttcctctattttgtatcatattttcaggaagaagagacaacattttggcataccttgcttaaagatagatgatagccgggtgtggtggctcagacctgtaattccagcactttgggaggccgaggcgggcagatcacctgaggtcaggagtttgaaaccaacctggccaacgtagagaaaccccgtctgtaccaaaaaatacaaaaattagccaggcgtggtggtgggcgcctgtaattccagccactcaggagactgaggcacgagaatcacttgaacccaggaggcagaggttgcagtgagctgagatcgtgccattgcactccagcctgggtgacagagggagacttcgtctcccaaaaaataaaaataaaaaataattgtcttggtgtgctaatcaggagcttcctgtgagagtggaaattccttacatggcagtgtcatgaaattttaggcccatgtgaaagatgtttttgagtgtctcaaaatagttaacggtttaaaaatacattatttatgtgtcagaaactgctttcattgaaattgaagtttctttgagaactaggatcatatcatgtatatctattgaatttcccacaacaattatcacgcaagcaaatgaatagcagaccctcaataacacttactgatgattattgccatgtataagttgggatactcttgagtacctttctaagtctgcatttagggaaatacagaacacaaaatgaaatgtttgattggttgcttagtttccacagtgacttttcaaaatgtataggagcatggtaacaaaactattttaaatactacaatcttaagtatgcctttattattcttacccacaataatgcattgctttaaaaaattgtttatcagtgtcagaccatacctttctgagtctctactatgtaagatgtgaaagttaatattcttcaattccagctacttttcttttcctgccttctgtcaactcctgtattccatatcattacttcttattgctaaatttataatatttatattctggtttgcatctatagttaattctcttgtgcttcatttctcagtgctaattgaaaaagaaaacacatcacttacaatgccatgattgtaataaataaaattcactgtaacacctagcagtatggttgaacatgtagaaaaggaaaaagtgatcctgtgacactaaaatttagcttgttctaaggatgctactttaagcattagggtaaaatggattcccttttgctaaattctttcagttcctcaaaattatgccacatttttgtttctttcacatttggacttagattttcctgtaagcattcaatttttcttgaaaattttaattgcatttttttattcttgttgacagaagaaacattttcatcatatcacaattttttttcagatttcttaattataccatttgatgaatgaaatacactttcttcttgaagtctgatttttctgttctaatttagagtttcttctcatttttctcctggctatgtctattattgctttagtctcatgtctttgtatttgattattatttttctttttactactgtttttcttcttacagaaaaaaaaagaaaaaaaaacaggggtttttacaaatattgtgctgagtctttacatgtccaaaatgccttatatttttccttatagtacattcataaattattgtgattagaaccataaattcaaagtaattttctctcagagcttgggaaacattggtacgttgttacccttcatctaggattgcttatgagatagatatctgatgccagtctgattctgtcttttttagataacttttttccctattcatatgtttattaggatctttatcttttcacttctgaaattcctccagatatggctctgttaaaatgtattcttctcagcacttgatgattctgtacaatctggaaacaactgcctttatttagcttaaggtacttttcttccattgtacctttgattatttcttccttctttttttcaccctatctttatgaaactcatgttaatggtgcattagaacttgtgaactgatttttcttatttattaaattccatcacatatttttcatctgtttatctctgtatattttattttctcaacttttgatatttttgttaattgaaatttaatttccaagaagtccattttctattctctgattgattctttttaatggtagcctatttcgtggctcaaatcatataaaatgtattaaattttgtgggaaaattaggcaaacaaagaaaattaaattttacctaactatatctaaaaacaatacaactaaacttaagaaaagtgcgtatatgtgtacacatatacatatgcgtgtatatgtgtacacatatgctacatatacatgtatatgtagtatatgtacatgtagtatatgtgtgtatgtatgtatatacacatgtagtatatctatatacatgtatatgtacaaagaaaaaatatgtatataatagtttcactgtactttatttgctccccttttaaaaataacagtgctagagttcatgactgactaattttcagaacttggtgtgtatggttgtttattaagccctcaataataatgctttagtattacagtgcccaggcatagtcagtgactgtgctaatagtcctagcagtagcagttcatcctgtacagatctaaggtgtaactattttcatttctgggcccttggagattctttggttgtcttcatatcttttacctatcttgctgttcaataacaggtaatagaaaaggagataaaacttaaatgtcatcatttcccactgcttaacagtctttaaaaataaatgtgaaacccgtaaggacgtaatcttgcctagctttaaggaatgaaggaaacactagaaacaacagagagaaaaggaataactgatcctccaacatgttctgttgactctacctgtaaagtatattcaggatctgactacttcacaccatttcaccaatttccatctccattcaaaccaccttcatgtgttactttgaaaagtgcagtttccctgtcatgggtttccctgtttctagctttgctcccccttcttacctcaccgtgggtttttacccaaacaaaaattcaagtgatcatttaaaaattaagtcaggtcatgcctctcctctgcttaaaaccattaatgggtctctgtttcactcagaatataagccaaagcccttttcatgacccaccagtcctcaagtgaattggctgctatttgtgtttctgattccatttcttgccactattctccctcattctattctaatttccttggttttcttgctgtcctggcaacaagaagagcatcctttttcctccaggcctttgcacttgctgttccctcttcctggagcacccttccttcagagagccacaggtattgtttctatctttccttctaatctctccttgagtgttactttttcagagataaattccctaaccattctatctaacagaactctgactattgaccttgctttattttctctctttttttttaaaattttatttttttattcccataggttattggggaacaggtggtatttggttacatgggtaagttctttagtggtgatttgtgagatcttggtgcacctatcacccgagcagtatacacttcaccctattcgtagtcttttattcctcacccccttcccacccttttcccctgagtccctagagtccattgtgtcattcttatgcctttgcatcctcatagcgtagctcccacttatgagtgagaacatatgatgtttggttttccatccctgagttacttcacttagaataatagtctccagtcttatccaggtcactgcaaatgccattaattcattcctttttatggctgagtagtattccatcttataaatataccacagtttctttaactactcaccgattgacgagcatttgggttggttccacatttttgcaattgcaaattgtgctgctataaatgtgtgtgcaagtatctttttcatataatgacttttttcctctgggtagatacccagtagtgggattgctggatcaaatggtagttgtacttttagttatttaaggaatctccacactgttttccatagtggctgtactagtttacattcccaccagcagtgtagaagtgttctctgttcaccatatccatgccaacgtctactattttttgattttttattgccgttcttgcaggagtaaagtattgcattgtggttttgatttgcatttccctgatcattagtgatattgaacattttctcatatgtttgttggtcatttgtatatcttctttttaaaattgtctattcatgtccttagcccactttttgataggattgtttgtttttttccttgctaatttgttggagttccttgtagattctagatattagtcctttgccggatgcatagattgtgaagattttctcccactctgtgggttgtctgtttacgctgctgactgttcctattgctgtgcagaggctcttttgtttaattaagtctcacctatttatctttgtttttgttgcatttgcttttgggttcttggtcatgaagtctttacctaagccaatgtctagaagggtttttctgatgttatcttctagaatttttatagtttcagcacgtagatttaagtttttgatccatcttgagttgatttttatataaggtgagagatgaggatctagtttcattcttctatatgtggcttaccagctatcccagcaccatttgttgaatagggtgtcctttacctactaatttatgtttttgtttgctttgtcaaaggtcagttggctgtaagtatgtgggtttctttcttggttctctatccccccattggtctctgtacctatttttataccagtaccatgctgttttggtgtctatggccttctagtataaagtcaggtaatgtgattctgcccaatttgttctttgtgcttagttttgctttggctctgtgggttcttttttgttttcatatgaattttaaaattgtttttcctaattctgtgaagaatgatggtggtattttgatgggaattgcatagtttatcaacccttggcaaagtgtttctgcttttcttaaacaatttttattgtctgctttctccagtagatgtgagttctatgagatgaggaacattgtttgggtcactgacatgtattgtcagcataccaaacagtggctagcacatggtgagcactcaataaatatttggtgaaagttgcagtgaatgaaaatggtttctaaaatggcaatgactatagtcccagctactctgaaggctgaggcaggaagattgcctgagtctcaaaagtttggggttgtagtgcactatgattgtgcctgtgaatagctgctgcattgtagcctggtcaacacagtgagaacccatctctttaaaaaaatggcaatgaaataatcttatttttactgcttttctctttaaggctgccagtgttgtcttttctctgctgatttatcctcattggaaattgaagatagataaaatatccattgattatttataggtgaaattaggcttttggatccatgaggaatagctgagacaatcttccaggagcttctggagccgaggaaacattggtcactaaaataccatttatattggcaactgtactcttttccgatgctagtgtttcaattacattgtgcatttaaaaggctgttgcggctacctcaaaatataaacatgatgtgcgacactacttgttagttttgaacaactgatttataaatagacttagggtgctcaagcctcctgcaagatgagcactgcctgtgttcttccttctgcttcctttatttcagctgtgtgtctaccaacttcctcctccttctacactaggagaaattgcactgtttccaatatctttaacatctgctatcatgatgagaaaatatcttttctggatttgaaataccttcttcattctttttttttaaatggcggaaataaattcatagtgttttgagtgcagttttcttcctgctgttattgctggctcaaaatccaggagcatttcagtgttatttctgagctccatgatgggagttccatttctgttttattcaaagtgttatctccagtgtctagcacagtgcctggcacattataagcctataatgtttatctagtggatgtagaccaatactattaaagaattatcattgcaaagatttagtggcatgaaaaaatgataatgattaatgctctactccatgctaaggaaatgaagtgcaaatcgttctttatttttcttccaagtatagagaactttctgaaattaaagaagcattgattaataagttttaatatatgttattgatcataataatatgtaatcatataaccaaataagataacacaggccatcttttgttctttaaaaaatgacaggaagattagaataagagaaaaaattagaggtcaaaacagttttcttcaaaccagtagtgtaacttactgagatatcttctgtaatccttaaattctgtattgatgctaccaagatgcaactcttgagctacaactgcctcttgataaaggatgctggtccctgctgccagtgtaatgtttgctcatttacagtggaatgtacaatatagtacctgggatggtgaagaaggtgaagcaacaaatttaaaatagctgtgggtaaacctacagaaacagactattctctttcttccagattgcattattcattttcatatgcctgcctttatctgctttggaagcctatttcctaatcttccaagatttatcatcaccttcatatgtccatagcatgcatttctcagacaggtaagatagaattggtatatatttggtatagcaaaaagtcaaggttgtctttagattatatccttggtttttcatgtggtactggggagaaagcctactgtttcttcatctataaaatgaaggacctgggcaagataacattctgtgaaatttcactgaactttgagctcagcaaagtagggatgcgtgtgtgtgtgtctatttgcaatgcatcacagaccttaaataaatacagttgacccttgaataacatggaggttaagagcaccaaccccctgcactgtcaaaaatccacatgtaatttttgactccccaaaaacttaactactaatagcctgctgttgtctggaggccctgctgataacacacacagttgactaacacatattttctatgatatgtattgtgtactatattcttacaataaactaagctagagaaaagaaactgttattaagaaaatcgtaaggtaaagaaaatatatttactatttattaaatggaagtagatcatcataaagatcttcatcctttgttgtcttcaccttgagtatgctgaagaagaggaggaaaaggatgggttggtcttgctgttccaggggtggcagaagtggaagaaaattcacatataagcagtccatgcagttcaaacctgtattttaaggtcaacggtatttgttacattgcattttgtaagtgaccttgttaatttttttcaatgaaaaaaatagtgttccattcaaatgcctgtatgtttatgagaaacatttcagaactatgaaagttgaattcaaggtttcttgcagattgtttgtatactttctgtaatgtttgtcatataatgagaatactaatggtcttacaacttgaaactgattaactgattaactctttaagcaacttaaaaagaaaatctttcagtgaggaaagagtattcatcagaagtattctagtagatgacatatttttggtaatgaaattgatatgggcaattaacagctttttccaagttggctatgctgctactctcttattatacaatgatactatttttcagagcagaaagcaaattagttttatttttataaaccaaattttaaatatccctttagagaatagaaaatatgaaaaagtatttgcttctcagacctctcaacaatataaattttcttcttaagaggaaatttattcttgcatgccaacacaaaggataaaaagtttacctatccttagtttctaagaggaaaatgtgcataaaatttccatctgctgtgtgccagttaccaaaacgataagttccaactcaatcttggttgggtgtggtggctcacgcctgtgatcccggcactttgggaggccgaggtgggcagatcacgagctcaggagtttgagaccagcctggccaatatggtgaaaacccgtctctactaaaaatacaaaaaaaaaaaaaaacaaaactagcccggcatggtggtgtgctcccgtagtcccagctacttgggaggctgaggcaggagaatcgattgaacccaggaggtggaggttgcagtgagccaagattgcaccactgcactccagcctgggcaaaagagggagactctctctcaaacaaacaaaaaagactcaatcttactaaaaaactgcagagaagaatgagtcattttagtcaataaaggaaataaagaaattctagttttgaaaatgacataatttgctacaagaatgcaaaggtgatgacatgaggaaaaaaggggtttgctgatttgttttctctactactcagcaaatgcaggccaggaacccatttattcaaatatttattacatggtaaattaaaacatttataaaattaggctcatattcttagaattcctgttaacaaagtgacatataaacaagattataatctaatggagattaatattggttgagaaaaatcttgagacttctttaagacttcagtttaataaaatattgacttaggtagatatatgtgaggaaatatatattttacccatgcatgcaaaaatgatgtatgtatttcttaaaagagtaggtagcaatgacttcaaaggaccatagctgtccctatcaacatatatattaacaaaacaattagaaacatgagcttagtatgctaattatatttctacccaaagcctcaatttgttctatagctatactgttcatatataagtaaaattttaggggtatcagagagagttagaaaagagcaaatacatgtatgaatttgataagcctatcccttaatttgatagatcttaaaagatattttatcactgcattcttctaaagaaatgtatttgtacattgcaaaacaaccctttttgagaagtagactatgatcacagattttcttgccactagtatttcctaagatttatttggaatagaagatcgatatttttctgggatgacatatggttaaaaagtaaaaaacaaaacaaaacaaaaaactctttaaaaacacaacaagtaaaaagctgaatgaattggaaaattaacgaatcttcttagatctgtcagaaaaatgagattatagggcaaaccactgcatcaaatattagagaagcagacaggtagatagaaagaatcacaacttagtggggcaaaaacctacaaggaaaatttttgtgggaaccggtgccaggtaggaaaacatgaactgtaattgaaaaattgttcagtgtgggcggttgttcagtgtggcaagtctgagggttaaaaactccaggaggactcacttacggaagggcctgtacttttgtgagtttaacctccaggagtgttcacagtgactactggagaaaattccctaaggggagaagaaaaggaaccatcttgaaatatgtcagagcattttgttggactcaagcctgctctcaagtgaaactattttaccagagcctaaacttttgggattttataagagtgtaacctcccaaagggaagggaaatacctaagttcagcccccttttagctttccacatagggaaaggaaaatatataactctggacaactcaaaccatcctgtccacgttagggggcctaggggaactgagaaaactggtgaagttcatagtccatgggtacagtttcaccaaagagggagaccaaattataaggctacagaatgcttccctttcccacaccttttactatcatattactaaaagcctatttgcagcagtttcttttactgagtatatcatgtctgtcattcaaccaaaaaattataaggcatgctaaaaggcaggaaatgcagtttgaagacactgaataagcatcagaagcagagtcaaatatggcagtgacattggaattatcagaccagaaactttataaaaaactatggttaatatggtgagggattaaaaaaatgacatacaagaacagatggataatgtaaatatagagacggaaattttaggaaagaaccaaagagaaatgccaagtatcaagcatagtgtacagaaatgattaaaatgtctttgataggctcataagtagattgaacatagccgaggaaaaaatctttgaagttaaggatatgataataggaacttcaaaactaaaatgcaaagagaaaaaagactgtgaaaaaaacagaagagattattcaagaactgcaggagaactacaaaaggtataatgtacgtgcaatgggcatactagaaaaagaaagaaaggattagatgcaatatttgaagaaatagtgtgtgaaaatctcccccaattaatgtcagacaccaaactacttctccagagagctcaaagaacaccaagcaggataaatgtcccaaaactactcatgggcatattatattcaaacttcagaaaatcaaagattaaaaaaatatcgaaagaatccagaaggaaaaaacacctatagaggagcaaaaataataaattttatctgacatatcctcataaaccatacaaataagagagtagagtgagacatttaagatgttgaaagaaaaatccggcagtgtacgattctggaccttgcaaaattgtccttcagaagttaagaaataaagtctgtcttaaagaaacaaaaatttcaggaatttgttgccagtggaccacccttgcaaaaaatgtttaaagttctttagagagaggtaaaatgatacaggttagaaactcagatccacataaggaaaataaaattagggatatagtagtattccccaacttgataaagaaaatacacaaaaaacctacagtttacatcatacttaatttttagaaactcaaagctttcctgctaagatcaagaacaagacaaaggtgtctcctcttaccactttgtttcctactggaagtgctacctaatgcaataagacaaaggaaagaaaatgaaaagcatacagattccggaggaagaaatcaaactgtctttgttcacggatgacagttgtttatatggaatatccaaaggatcagaaaaaagaaaactggaactaataaatgattattgtaaggttacagaatacaaacttaatataaagaaagccaatcactttcctgtataccagcaataaacaagtgtaatttgaattaaaaacacattaccatttacattagcaccccaagaaatgaaatacttttgtataaatctaacagaatatgtacatgatctatatgaagaaaactacaaaagtgtaatgaaaaataccagtgaactaaataatgaagagatgttacatgttcattgtcaagatgtcagttcttcccaacttgatctatagattcagtgcaatgccattaaaaaacacagcacgatattttatggatatcaacaaaaggattctaaagtttatatggagaggcaaaagagcagaatagccaactcagtatttgaggagaacaacaaagtcagaggactgacactacctggctttaaagcttactataaagctcagataatcaatgtagtgggtactggtgaaagaatattcaaatagaccaatggaatagaataaagagcccaaacaaacccatgtaaatataatcaaatgatctttgacaagggagcaaaggcaatacaatggagcaaagatggtcttttcaacaaataatgctggaaaaactacacattaacatacaacaacaaaaattttttaaatccaaattgagtgtaaacacagatcttataccctttgcaaaaattaacttgaatcatagacctaaatgtaaaatgcagaactataaaactcccagaagataacacaggaaaaatcctagatgactttggtatggcagtggcattttttagatacagctccaaaggcacgatacatgaaggaaatgattgacaagctggacttaactaaaatttaaaacttctgctctgtgaaagacaatattaagagaatgagaagacaagccacagatggaaaaattatttgcaaaagatacttctcataaaggactattgttcacaatgtgcaaacaactcttacaactcaacagtttgaaaatgaacaactcaacttaaaaaatgagcaaaaaacctgaacagacaactcaccaaagaagatacacaagtgtcaagaaagcataggaaaagatgttaaacatcatagtcattagggtattgaaaattaaaacaacaatgagataccgctacatacctgttagaatggctgaagtcagaacactgatgaaaccaagtgctggtgagaatgtggagcaacaggaaccttcattcattgctggtaagaattcaaaatggcatagtcactttggaagacagtttggcagtttcttacaaaataaacatactcttcccatatgattcagcaatagcgctccttggtatggacttgaaaacttatgtcctggccgggcacagtagctcacgcctgtaattgcagcactttgggaggcccaggcaggtggatcatttgaggtcaggagttcaagaccagcctggtgaaatcccatggtgaaaccccagctctactaaagatacaaaaaagtagctgggtgtggcagtgtgcgcctgtaatctcagctactagggaggctgaggcaggagaatcacttgagcccaggaggcggaggttgcagtgagctgagatcatgccattgcactccagcctgagtgacagagcaaaactccatctcaaaaaaaaaagcaaaaacaaaaacaaacaaacaaaacttatctccacataaaaacctgcacacattgtttaacagctttacataattgccaaaacttgggtgcaatcaagatatcctttaatatttgagtggataaactgtggtacatccagatgtaagaatattattcagcactaagaaatgagctatcacatcataaaacgacatggatgaaacttaaatgcatattataaagtgaaagaagctaatccgaaaaggctaaatactgtatgattccaactatatgacattccggaaaagccaaaattatggagacagtaaaaagagcagtgttttccagagggaggaatgtataggcaaatttttagtgcagtgaaatgaatctatgtaatactatagtggtggatccatgtcattatacatttgtccaaacacgtaggatgtaaccaccaatagtgaaccctaatgtaaactatggggtttgggtatcaaaatgcatcaatgtaggtttatcagttgtaacaaatataccactctggtatgggatgttgataatggggaaggttgtgggtctgtggggacaggggtatatgggaactttctactgttttactgtgaatcaattttactgtaaagtttattaatgttaaaaaatttaatgcacatgtaccctaaaacttaaagtataataataataaaataaatttaggcaatctgaaaaaatgttaataaaaaagaaaataaactagttgaatgtatcagttcattttcatactgctataaagtactgcctgagactgagtaatttataaaggaaagagatttaattgactcacagtttagcatggctggggaggtctcaggaaacttaacagtcatggcaggtgacttcacaaagtggcaggaaggagaaatgaacgcagaagcaactaccaaacacttataaaaccatcagatctcatgagaactcactccctatgatgagaacagcatgggggcaactgcccccatgatccaattacttccacctggtctctgccttgacacatgggtattatggagattatggggattataattcaagatgagatttgggtggggacacaaagcctaaccatatcagtgataaaactatgtcttttcttttatggggtgctatagtgtttcatttcaagttgtctttttgacctccattttccaatttctggttaggaaaaataactttgtctcctccttaattgacccacaaccttgtttgcaatgaagaatcaacacaaatctttcattaaaagaaataggggaggtgatgggggatatccatgagtgtccatgggcataattcagttgccttcattcaatgccaatgatactgcaaagcctacaaggcaaattcatgtacctacagacagactccatcctttttctcaaactattcaagataaaaaatcttgtttcattttatgtgaggatttttttcaccatctatcctcaaaaaatgaaaaatatcctcttcatttgggaaatgagtgcttataatagaaagtaatttgtagtcagctgttacacttagatgatttgtgtcacctctgacctgctttctgataatgcatgacttcattcatggctctctaggtgacctgtgtaccctgacctggcataaaccactagagtattaagtcatttcagtggcacatgtttgagggaagattgacatcccactggaagactatctacagtgagatcctctaaagcagctgcattcctagtgaggcatgattaagtttatcccactattaggttctggagtattacttgtcatgcccaagaggaaagtttttctagcatgcagagtatctggtttttaatggctactgagctgaaataaaatgtgcctactaagggttgttcatttgtctgtctcccttctttcactgttttttttcttggaggttacagtagttatgcctttctggtcagctggctgttgacctatcatagaaatgacactttcacatcttcaagtgtaaggaattagatgttccagccttcactttgtttctcatccaaaatcaatgacaaaactttcagtattgatttctcatggcctatgaacctgagtcaacttggcataaaggacttttcagacaagcttctctaaatgcagagtcagtggcttctttttgccaaactccactttgctcagtgataacattaaaatggtgatttgattcattcctagtctaaaaatacttcctcatattccaaaatctcagtcattaatacatggaggaaaatacaaattattacatgcctgtgcttctcggctgttgtagatagataaaatatatacaattgtgttctataattattgagttcttttaagttttatctttttttgttttaccaggaagcaaaattatgtttatttcagagcttatttactgcatttagaatctcatgacacttaaaaaacctttctaaaacgtaaatattctccatgatctccatggtcacaaacagtatttcacgttctaattgatattgccattttatcatttttttttttttcttggagacagtctcactctgttgcccaggctgggatgcagaagcacgatcttgcctcactgcaacctccacctcctgagttcaagcgattctcctgcctcagcctgccgggtagctagaattacaggcatgtgccaccacacctggctaattctgtatttttagtagagacagggtttcacgatgttggccagactggtcttgaactcctgacctcaggtgatccacccaccgcagcctcccaaagtgctggaattacaggcgtgaggcactgcatctggcccttttatctttcttttaactcaaatcctcaaatatatccctccatgtgaagttgccttccctaattatgtactgtcctagtttaatcttcattccttgtttgcctctataaaaccaagtttaaaaatagtctctgattctgtaaatcatcactcttatgctcatttatatttctatctagaatattttaaatcctttgtaacaaagtttctactatgcagtctacctttctcagctacgatctatatactccttggccatgtcttttgttattgtgtgtgtttgtctttgtgtgtgtctgtatagtagtggtttgtaaattctccatttagtcacaatatgctttttgaggattttccttttcctgggaatttcttgatgatttttattttgtcatgtgatgaagaatgtatgtcaaagcaccactgcagaaatagtgcttttctatttacttgcactcttccatcttagaagagctggtgatagacaaccgactcttcttttatcttggtttctacaacacagaggttgctaagcgactttaatcccttttaacacaggacaatcaacaacaaattccttctttctttagattcagatatttcacttagaaaatctagcaaataaaaaatggtttaaaacttctttaaaatgtgtaattctgtacaatctcctacatctgtaacccctgccccaaatattttttacttatgctatttcttgagcattatgatatgcttattcataggcaatcaacttgtaagtagcaatagtgtagccccttctaggaaatcgaagatgtgaaaatccagtttaatgtgataatgagttactttgatgaaaaatactatgtcacaatttgttataaaaatactcatttggatttctgattcacttatattaccctccaaccttaagtatgattgaatttatagctttttatactactttctttatttagggaggagtgtatttaaattctgttatctcggttattacttgaaagttcaacctcatactttcatttttatataattttaatattatgaaaatattttatgtaattttatgtataattcgaaaacatttttaaatattgcatctttaaatttttatttcttttatcaaattttccctatcatttgttctctggctacaaccaaagttaatagttacatttttttccagtgacaaatggtaatttgcaaagacttgtaacagttgcttaatacttttttatcccttatttaagaatcatgcaaacaaccagagctgataggcagcaggtgcacatgagtgtggctgtgctgatggttactgaaagatttccaaggtagctagtaattctgctaccctaagccactatagctccttccccattactccctgggtctacccaccatcctgcagctagaataataaatggcatgtaggttcctctaggatcctcctccagcactatgtctcatgcctggacatatgagctgttaaatattttgattatcactcctgtgtggtaagggagacgtctacttgtcgtaacttgatgtttactaaactacttttaagattaccttatgataaaagtagacacttgcaattttgcagaatgcatagtttgtttttaacaaaccaggtaaacataactgcagagttttcctatacgttttgaaatctttaaaaaagtattttttatttgcctttctattagaaatagattagataaaaatttccttgtttcaatttttagaatgaacattagagaatattgttactgaaggaatttttttaaaaatagtgactgatcaaatgtcagcagctttatactatagtgtaaaattttattttgtagtttgccatcccattaagcattagaatttttataattgatcctttgatgtttatattcatgatattaatgtaatgtctttaaaccttagctcatataggtcatatgacttaaagcatccttagatgaagatatttgggctataaataatttatgacataagtgatttaaaaattcattctttccatccattttgaagaaattgtaaggtagggttcatgtatacctaatacttatccccccaaaatacgaaaaataaaatcatttttaaaatatctgggttaatgctatagattggaagcagtttttaaaaagcacttaaagtctaccagtttattgatcctcaatctgtggctgttttaaatggatgcaattagcagttcagtctaagagaaccatggtagtagactcattactccccagaaaccattacatcattttgtaatattaaattactaaatataaggaatagaatatatattgtaaaaattgctttggaatcaataataagtattgtggctatcaattatagttatatattacaatgtaagggatatccttttataaacttaatatcacacaagtagacttagaataattccattaatataattttgcttgtgtttttatacctattcatttcaataactctttttcctatatatattttttatctcaaattcgatagtatctaaatcatggaatcataaaaccttaaagctgggttggaacagaaataatacaatttaacatcttataggctctctagtcctcagtttccctaagtgatcggctcaagatcatgaatttatggaggattagagtcagaattagaacccaagattaatttatactttgttatctcttctacagcctacccccttagtttgcctgtgggtttatggaagttacaggagagacattctgagattcagctaaaaacctagctcccaatagaattattgccctgtagtcagccgcgcaaatacaatcacaaatacctgaagttccttgtgtgaagaaaaagaaaatgactattaaagcatcaaaatcaatgcaagttacctttctttgcccctttcttcccctttcactcctttcttctcctatactacttgaaatttctagcggggatctctaaaatgcctggatgttaggaatggtaagtctattgtagagaattatattttctattttagtggatgaaaaataaaccatacccttaagaggcttttcaaagttaagattttgagcacatccttcattggcccagtctctgaccagtgaggtcaagtattagccagtgtcagaatgtcgtgaaaagtttgtgtttcagatgcagaatttttttttgcattttctgtgtgatgtttatagggtattttcttctgaaatgttttccatcttggtttttaaaaatatctattattttaaaaaatattccctcataacttctttttattttcggaaactatataaattgatctgataatctatacacaatgccttgtgaatttatacctgtacctctcatgttccagtgtttggttcttaaataatcactttgtataatggaaatactatgttaaattgtttataactggtggttgatatttcagccttgtttggctatcgtagttatataaagactgttaattagaaacaacctcatatggtgtatgcttgtttttatcttcatggaatttgttctgcaaacactgagttctttactgggagtcaccactttgtctatgttaggaggagcaggaagtgaatacatttaaggtctttaattttcttcttaaaactttgactactgtagtggttttttaaagcattaacaggagaatagccatcactgccaagtagctgacattctgaaatagcacttccctttaggcactgtacagttggaatcatttacttgcagagaggtgtgtgtgtgtgtgtgtgtatttatgtgtgtactcatgtgtataagaataggagaaacactttgtgggcatatcctgctgaggtgagtaacgtgctgattagtgaactccagtctcatcccatttaaacctggaggagaaccacatcaagcacagaagcagccaaagcagcatttcaacaggaaggaaacatctattactggggctttgaagaaacatgccatgaaggtgtactaatatcacaaagggaagggaaggactaaattcagcatgataaacaaagtcccttttttgtaacggaagtgtttgatgatgtttgatcaatggtggatctatctcttgaaaggaaaatgcatttaaaccccaaatggaggattcttatataaggtgcctagcttgtaatgatatattcatgtttataggtagagtgactggtttttagagaagaggtttttttttttccttcatttttgaacgaaaacttgtctgtctctaggctttgaaatgtagaattatttacctttccccaaaatgaaatgtttcactgaatctcctacaagcttgtggaggccatgaagcatgttgaataagagcacaggctctggaggccctgccacccacaaagggtgtgctaaggtaaacaactgatagtattttgaaaattagatgacttagaatccattcaataaattttagctatttttattgtcttttttttctaaatctatttggaaaatattgcagataaagtagataatacctttctaaaacacagtgagaccaggcgcagtggctcatgcctgtaatcccagcactttcggaggccgaggtatgcggatcacgaggtcaggagatcgagaccatcctggctaacacggtgaaatcccgtctctactaaaaatacaaaaattagccaggcgtgggggcatgcgcctgtaatcccagctactcaggaggctgaggcaggagaatggcgtgaaccggggaggcggagcttgcagtgagccaagatcgcaccactgcactccagcctgggctacagagcaagactctgtctctaaaaaataaaaaataaaaatagaacagtgaatagtttataaagataaaatagaataggcttcaatttagggaacaaaggaaaatatgtttaggaatgatattatgctcaaaatgattgcaactttgatggtgaagtgtattttattcaattaaaaatgtagatatggctgggcgtggtggctcacacctgtaatcccagcactttggaaggttgacgcaggtggatcacttgaggttaggagtttgagacctgcctgggcaacatagtgagacctcatctctacaaaaaataaacaaaaaatgtgctgggtgtggtggtacatgcctgtagtcctagccacttgggagactgagatggaaggatagcttgagtctgggaggtcagtgctgcagtgagccgagatcgtgccactgcacttgagcctgggtgacagagcaagaccctgtctcaagaaaacaaacaaaaaaacaaaaacaacagtagatatgtgtgtgggaatgagaacatttaaatgtgctcatcggcttagatttttctttaacccccttcatggcccttatcttaacctctgtcttcagcactacccttcatatgtttgttccgttttatcttctaagtgatttttttataactctcaatgtatcatggcagaaggaaaactcagtgtataagctgactgtattttgcattttcttttttttttttttttttttgagatggagtctcactctgtcacccaggctggagtgcagtggtgcgatctcagcttattgcaacctccgcctcctggaggcgattctcccgcctcagcctccccagtagctgggactacaggcttgcaccaccatgcctggataatttttatatttttagtagagacggggtttcatcatgttgtctaggcaggtctcaaactcctgacctcaagtgatccacccaccttggcctcccaaagtgctgggattgcaggcatgagccaccgcggcctggcttcatgatccaaaatagcatcattaagcttctctttcaaaacatgtatataagcctgtgagtcatcactgtatttatcagaatattatcatattggagactttgcaaagctgaacaaagccagaattattggctactgaggaactatattctagcaagagactattctatttgttggggatcacctctttttactaaaggggactgttttgggcatataaaactagaattcatggtttctccttgatagtttgccagcttgattcccagtcaaccagataactgctggtagtgacactcatgtcctccaggactcccaatcttgtgccagctcagagagggaaatccccctagaactgctcacaccattccaagaaccacaagcaccaccttggtatagttaaaaatgtgataccaactcaaattctgataaaaacaagttctataaagcttaataaagttatattttttactttttaagttttgttttactattttaaacagaaaacagaaggtaaaaactcctctgccttcctcagtatttggtttgtcagttgctgaactcagatttaagagtctaatcatatacaggcaataaccctcttctaatcttaataatgtttctttgatcatttctttaaaaagaaaaatgaaatagcctattgactccaaccctgacctcctgtacttcacctgcctgatgaatatttatttggaatacataagttttttcaaatgcatcatgtcaagaatttgtcatttcagattcctttctagaattatctatttatctcattagtagcatcattctttcagacaaccaaactcaaaagctttatcactataattgaatttcttttttcttcttacatttaaaatgttactaaatgccattcatttctttatcagtaatatttctgtttgatcattttatttcatttattctgccaccctctcattccaactattgcttatacttgagtactgcaataagccaatatcttgcatatgattatttataacacctaaatcttctaccacttcacactcactgggatggatataatttttaaaacatacaataacaggtgttagtgcggatatggaaaaattggaaccctgacacattgctagtggaatgtaaaaaggtgcagccactttgcaaaacagtttggcagttcatcaaaagattaagcatggaactaccataagacccagtagtttcgctcttagggattccactctcaagagaattgaaaacatatgcccatacaaaaacttataaacattgtatatccatgtttgttgcagcattattcacaatagcctaaaggtagaagcaacccaaatgcctacagatggatgaatggataaacagaatgtggtatagacatacaatggactattattcaaccttaaagaggaagaaaattctgacacatgctagaaaataaatggatcttgtatacattctactaagtggaataagccaatcacacaaagaaaaatattatgattccacttacatgaggtacttagaatagtcaaattaatagaggcatacagtagaataatgattgccaggggctgggaggaggagcaaatgggaagttattgtttaatgagtatagaatttctgtttaggaagatgaaaaagttctggagatgggtggcagtgatggttgcacagcaatgtgaatgtacttaatgccacagaatagtatacttaaatatggtttgaatggcaaactttgttacatacattttatcacaattaaaaagtttgaaatgaatatccaaagaagcattatttatgaggctaaaagtggaagtaacccaaaagttcatcattgatagctaaaggaaacatggcatatcaaaacagtagaatattagtcatacaaaggaataaagtacagacacatgctgcaatacagatgcaccttaaaaacattacactaagtgaaagaaaccagacgtaaaaggccaaattttgtatggttttatatatataaagtcgttcaaaataggaaaacccataaagactgaaagttgattagtggtcaccaaggcccgggggaggaatgaatgaaaactggctcctaatgggtactgggttttttggggcgagggggacagagtgatgaaaatattgtagaatttgatagtaatgataggtgagagtggcataattttttttaatatactaaaacccactgactcatatactttacaaggatgtattttatggtatgtgaattatatctcaaaacaccccttaaattttaacgtatggcttttatgatgccatgtttctaaagaagcaacgtgtcccagtctcagcttactatttctaggcatgtgactttgagaaaaaattaagagacctcccttcttactctgtaaaatgggaataataataatgatgataatgataataataatgatcttaccagatttttttgagtgttaaatgaggtaacatatgtagtgcatctagcatagtgtctggcatttaccaagaaccccgggaacctgagcttcaactgcttctgatactattccagatactatttcaggatattccaatactgtttccatatattcaggacaatggaccaactcctttagccattttatcaaaactctttagattctgtttcaaatcggtctttccaaagtcttcttgtgctcctttgtagacactcttcagtcagagagagctttttaatctcctccaatttgctgcagctgtatctgtgcctcaaaacaacgctttctccccattcctcttttctctctgcccttggaactctgtggacttctctcatgtttttaacctactcccttttatcagtgcatgtcatctccacttatttgtagcacccaatatttttactacatctttgaccaattaagtcttacttgggttatgtttttaaagtaggtatcttattaggtggtccttttaaagtatatgtccagtctctccagctaaattaaaacccttgagcacagagaccacatgttataatgttttaccttttccatagcacttagcatgttaccttgacatggcatatactgaatgaatgcttgctatttatgagtttagttagtgccacatctcatgaagtacagggacttaatgattctcaatcctgacttcatcttacagtcacctggagaataaagtttcctcttagctcaacaagtcagaatctctgagcaaaatcctcaacttcttacctaggtgatactcttgtaagccacactgtgaaccactggattcaacagatgaagtaatataagccactggctcttaagcctcattgattattgcggtgaagatgtgaagactaaagatgctttgggcatggcaaagtgttctacagatattagaattgttattatggtacatttgagagtgtcattgctttgagaaagattctctaagttttttaacagccacactgtaatggaaatatccaattataggtatccaaaaccttttaaactctttatatcaggtgtatataccctgttcctttttgctaacttaaaaatgttcaaactctgtcttctctaggctggcaaacattcagcagcacaccctctcaagattgtttacttgcctttgctcctgttgagttacaacgcttggaagcaggagatgggctcagcagcagccaataggacatgatccaggaagagcagtaagggactgagctgctggtaagacagtggagacagttgacacttgtttgtcaagtatgaatttattcctaatgtaatggtaatctctctcccaaacttcaacttcaagttaccctgcaccctctcaaatacttttctttattgtctatgcttaggacacatggattagattgttaagatttgtgaatttactaaagttgtgtactgacttatgtatagctgtatttttctggagaaagatagatttttatcaattctcaatgtctatggagtttttaaaaagaggtaaggattattcaaatgtaactataaacataagaaaatgtgatatctataaccagttgttagagtatttatcgcctccattttgcttcacttgtagccacttcgtctcaatcttgttaaggaccaaataaatggtatttgtggttacttgctgatctgaaaagtgagtacctcctgcacctggctagtcagtcttgtgacaatttggtgccatagaactagcagagaactaaattatggaatggcagatctcaggagcagctatgtgattttacatacggtttgtttttaatggatagagacagagtctggctatgttgcccaggctgctctgaaactcctgggttcaagccatcatcctgccttagcctcttaaggagctgggattacaggtgcatgcccccaggcccagttcatatgattttctgaaaatacaaaagaaagagggagatacaaaatacttttttaatcatgttcttataattatcttaataaaaatcaatttgctctgaatgccatgacctgctgagtgtcccaacctaagggttgtcagaccattttctcatatatgcatgtatagaagtagggaactaatatatttttgtctaaaatgtttaagatgaagatgagaatgaattctacaatatataattttgcctgaactatataagacagttaaaattatagagacattgcaggagagactctggattagatagaaaaaaggaagaattaggctttttttttgtctataatccttttagtaggtaattcagcttcagtttcactaaatcttgtttatgcattcagcataacaaatcttctaataagcctgtatagctctaatctctgccttactgcagacacctgaggatataagtatccactctgccacttgatacttctcagagactgttctggtgctgagaaatcctttccagtgtgtcctcagttgaactcccatgattcctggatgttgccattttcaagacacagggcaagcgcatctgtctagattacctctctaccttgggaattttaagtcactctgtgagggaaagagaactcagtatagtagtaactctcagaatgaaaattttccccttgcatgttaatatttttagagtaatcattgtcactgaaaatagacttcctctttcccctctcatgctggaaaatcttaggtaattatgaataaagcattctttacttttcccctcctcccttgatgattgctttacctcactctgtgagaactgtgactactcattctgctcttgtcttttacatgagaactgagagcgcatttttaagatggaattttcctccttaatgaagtcataacattagtcagaagattttctcttcttgaacgttaagcctgggtaaggaataaagtgcagaagtttatggaaaattataagataacttaaaaaaaaaacgaagacaacaaattaaaatattagccattgagggaaaaggttttacaggtagctctctgaggagttcttccctcatatctcctcaaaaatcttgttttgcatttaattttttacagttggataagctcagcccttgacatattttcaatagcaaataagcctagagtttatttttagtacatttattaggaatgtgttcttgggaaaattatttaacctctgtaagccctgctttaaatggcaaagaagaaagtaggtaataatagataataacaggattattttatgcattacctgtacattgcccaacatatagtaagttctcaattttatattggtatttgttttattattaaccacttttattaatgttgcttttagtttttgaaatatgaattcattcaaaaatatttcttgagcacctgccaaataccaggcactcttctaggaactagagtggcattaatgagtaagaggcaaaaatctcttcccttgttgagcttagaatccattagagtaagagacagacacatacaaaataaaatgtataatatagtaaataccaagaagtgctaagttttaaaaatgtaaagcagaaaaaggaaattgagtggcagggttaggtagtaattgaagatatagtagtcaagtaaggcagcttcaagagaagattatgtcttaaataaaaatctgataaagatataaaaacaagccatgaagttatctgaaggaattgcaggtagtggagaacagccaaaagacctggagtagtaaaaggttttatgcagagtgatttaaaaagaatcacagtatcttatacatcagtaaatatttacacatacacttaagtaagtgatatggacaagaactttggaagttgaatagcaaggtccatctggactataacagaggaggcttcacaaaggaaggtgacagggcatggcctggatcctgaaggacaggaagaattgggatcgataacaaagaatgacatcccagtggagagaagtggaggggaaacagcatgaaatggagtgaaataagaatgttggcctttagggcaggaatgggccaggcagagggcaagtgggaagcaggaaaaaggcgaccttgtataaagttcatgttggcaaatagagagaagatgggaaagcagggtaaggccaaatttagtaaaatcctaaagtcaagctaaagattattgcatgctatcctgaaaatattggggaataattagagcagatgagtagaaaggtgaattcttgtatttagctatatcattatttttacaaatttaaacaaataaggaaatggaggcagtagttggagtaatttaggagataaattgaaaatggattttgttaagagagaagggaagatagattttatatattttaaggaaaaatcatgaggatttatttgctgactgcacgtaagagataaaagagaggagtcaaagatttctctaaaattttcaaaatgattaattacgtgttggtattaaaagaaatagggaagttgggacatatgagtttgaattcagcatgagtcagttaagacaatcagatgcagatattcttaaggcaactaaagttcatttgatatttgtcatataggctgaattaagtttctaagagctgtttttactatgcattaaatccgtgtaatactaacatagtacaaaagttgtttgctatccaaattttgtatttttataataagttggagagacagagaatcaaaaaattattgatttggaaccattagacatcagctagtccaattagttcattttgtggaaggaaaaaggatacccagagatgttacatgactttatagccatgcctctagctagtatctaacttggtctagcccaggtctccatactgagactctcctcctgctaataaaaaaataataaaaaagtattagtggtttgtattttgctggcttgcttgtggagaataggattagaaggtttgacttgcctgttagcactctcttgtagccatttttctaattaacatacacattttaccctttctcatgaaacagatctaacttgtttagaagcttcagtcttcttgatttaattaatcactttctcccacctttagtcattgttgaagtttcctgatttacaatgttatctttttatcttttcagtagtataaggaggaatgatatttctactgttgtactatttttctgtttatctttcagaagaaaaatagcttttcttattggcccaaaaaaccatcaccctacaggaaataaatcacactctttgcttgattttcctgatctggctactgatttctcttcaaatttaagccaatacttagactttaagacttcattgttacttccttacaggtcattcttatgaactaaaatccatagtcattgttctagcaagcctgagcagtttattctttgagtcacaggattataaaagaaaaaatagaccttagagatcataatacagtgctcttcaaactgtactcttcaatttttctactacttatcagttgttttttattctaataaaatataattacctagcaagtgagcagacatgtatttacagtagctttacaattctttatacacttctttactctctccattacacatgccacatggtatgatacaagtcataactcaactatgtgaaagcaaaaccactcttatacatggtgtcttgcatatatattaaggcccagagtggtatcagtagtctctgtgtcccaagagactgaattaaacaagactgttgaccttcttgtggcatttatctgacaaccttggcaatccctaaattcacaaatagctgtatagcattttttgcatttaatgcatatccacatatgatgtgtcctttgattttagaacaagtaaagcatgctaaaatagactgcaccttatgaaagtcattttcactattcttgtgtttcagtttcctcatcaaaaggtgaaatatcagctgcctctgttgatctcaggatcttttaagtagaaatggaagagtcttagtgaaaacagtttgtattctgaaagaaaattgcaatgtaaatacaggcactaaaaacgtttattcatctttacagatgttaatctgaccagacatttttctcaaaatgtgaaaatagtatggattttcttagctcatttaatattgaaagactagaaaaacaagtaatgatgttctagaagaatctatgatcatataattacagttgtccttcagtatctgtgggagattggttccaggaccccccatggatatcaaaatctgtggatcctcaagtctcttatataaaatagtgcagtatttgcacatgatttacatataccctcccatatacttcgaatcatctctcgattatttataatactacaatgtccatgctatgtaagtagttattacactgtattgtttagggaatagtgacaagaaaattaatctgtacatgttcattacaaacacagcaatccattttttttctgagtattttgatctgtgattgattgaatccacagatgctggaatccatgaatacccatggggggctgactataatgttgtctatgtgcgtagcaattttgtaattctcaaccaaggacacgtatagtccttgaatcttggtaggagtcttggggacttttcttaaaatattttgaccatcttctcaagatcttgactcctacccccacttgtacacgtgcacatacttgtgcacactcacacacaatacccttccttaagtcctgctcaccagcttgcttcctattgcattgagagcattcaacctgtagaccaagaacttctaccatatttttccacctctaccccaaaacacagtttagacatatccattcttttcattcttcagagtcatctcaccacttccataaattatttcctaattgttccctctgcctctgttcttttttttttttctgatgatcagttcaaagtacctctgtatgcccattcttaagtgcaaatctgaccatctataccccttcttaatatcctttcttttatggatacccatttcagactttattaaaggagtggaagcttccccctccccacctcaccacttgaagtttttgcaattagaatggagtttatttggttaatgcaaaaatagatgtgatgtagaattcttggggacacctacttatccccttttcagagtggccctgaatagctctgtgaacccaggaatctgaagaactcagtacagaaaaccatcagcctacagaaagtagatcaaactctatgcttgatattcctgatctggctcctggttactcttcaaattcctccttactatattgtcccttcagatttgtaaatctttaccgtgacatcgtattttacacactgaacctttgtaccgctgttcctctcctgatgaacttcccttttctcttaactacacagctcagatttctcataagggaagcttcatatttgttgtggcactgttgttcctcaaacatcctacttactgtagtcatttgtttatgcttgtctcctttgcagattctgaaattcctagggcaaaggctgcatcttgtcttcttattactaatattttacacagtatctggttacatagtaggcattcaatcatacaatttaaaagaagaggttgactttgtgatctttttcatatgttttatttccctctccccctactggcaacttcttcctacttcttaaaatagatacagcacttgcccactaagtggagggaagaggtgtgggagtcgagtagttggaacttcaagtgtcaaaacatgataatctcatttgcaaagttacattatatcggagcttgaacctcagagatacttaattataagcaacacttgtggaacatttgatacctacatttttttcactaaagtatcctatcaaaattaaatgtgttgcagttgagatttgtgaggttttagctatttagagactttagggatatgtttagtgttctaattctaatagtattgatgaatataaatgtttcactgtagaaagagaagtttgagagctgttgtgaatgatatttgatgtctattaggtgataatttctgatgactaaacatgctcaagaccttagtgagaaatacatgaatacagaaaatattttgaaaattatgagaagtttatcattgattatagattttcttatccagcagtttttggttgtgttctgtttttcactgtcagagaagcagaaagtggtcagtggactttagaatgtaggctcttgtaggaggccatatgtttgagagtgctgtccaggtgctttgtgatgtggctgagaatggatgcaggcttgcagggaaaaactaatactgtagatctctagagagcattttaggaaagacttctaagctttaggttccctgaccaaagagtaaaaagtgattcttaatatccatagctatagaggaaagtaaatacacttcccacatcaaatgtagaattaaatatttaggcatttcaagtgtatttcatttagaacaaaataaaatcatatattcactaatgaaatataaaaccagatggtctctgaaaggtttttccctttactcactttcagagtaaggcaaggaagagtagttttgttttttaatttatattttaattgtccctttctgtttttccaaaagttttattttttgaaagtgagtcaccttttagacatttgaaaaattagaattactatgatgtttattttattagtaagtcttcctagagtagcaacgtagaaaagcatctctgaatgcctacatagtaagtatttaataaatgttttttgggccaggtgaggtagctcactcctgtaatcccagcaatttgggaggccgaggcgggtggatcacctgaggtcaagagtttgagaccagcctgaccagtatggtgaaaccccatctctactaaaaatgcaaaattagctgggggtggtggtgcatgcctataataccagctactcgggaggctgaggcaggggaatcgcttgaactcaggaggtggaggttgcagtgagccgagatcgtgccgttgcactccagcctgagcaacaagagtgaaactctgtctcaataaataaataaataaataaaatacataaataaatgctttttgatttaacgaaggtgtcattgtcctatgaaaaggaaaactatcaaaatatattttttaaaacttagcttttgataatgatatggaagatatttctcttaattaacctaagtcagaaactaaaatatgttataaaatgctaacatcaaatatttgagaccagttaaaggagacagaaggaagttatggagaaagaagcagtagccagaaaataagggcaagaaaatgttttctaaatttatgagaatcagaatgtttacaaaattgctattattatcatctggaaaaaatatgccttgtaggctgaaaaaatgaacattccctttccataccatgcaggaaccttctttactgcattcctaagaggactagtctagcacctaattggatacttgtggtaatatttgggaactcactgatctggtacatcagtgtgggagtcgagtagtcagaacttcaagtgtcaaaacatgatagtctcatttgcgaagttacactatattagagcttgaacctcagagatacttaattataattaacacttgcagaacatttgatacttacatttttttttcactaaagtgtcctaccaaaattaaatgtgttgcagttgagagttgtgaggttttagctatttggaaactttagggatatgtttagtgttctaattccaatagtattgatgaacataaatgttttactgtagaaagagaagtttgagagcaagttgagcaagaatctgtcactctaggtcttctactctttattaaagaatgttggattcatttataacttactggtcccttaaatattaaagtttggtgtttggtatcttaaacatgattacatccttatagggctctcttctaattgcctggatactgcacatctattaatacagtctcaaagcacacttgcttttttgatagtaagagcgtacgatttaatcacattgaagttagtccgcaaaggtttttgtctttttttcaggcaagcagctgatgaatgaatctctactatccttcactttgtgactgtgattttctaaataaatgttggagattttaacttacaatttattaatttccatcttgtttcttcaagtccctcctttaaggaaatttatggaaatctttttccataccatcaagtggcttatttctttttaacttttttccttaagttcaggagtacacgtgcaggtttgttgcataggcaaccttgggtcatgggagtttgttgtacaggttatttcatcacccaggtattaagcctagtacccattagttatttttcctgatcctctccctcctcccaccctccaccctctgataggccccggtgtgtgttgttcccctctgtgtccatatgtcctcatcatttagctcccacttataagtgagaacatgcagtatttggttttctgttcctatgttagtttgctatggataatggcctccagctccatccatgtccatgcaaaaaacatgatcttattctcttatatggctgcatgttattccatggtgtatatataacacagtttttttttatccagtctattattggtgggcatttaggttgattccatgtctttgctattgtgaataggactgcagtgaaaatatgtgtgcatgtgtctttataatagaataatttttttttcctttggtatatacccagtagtggggttgctgggttgaatagtatttctgtcttgaggtctttgaggaatcgctacactgtcttccacaatggttgaactaatttacattcccaccaatagcatataagtgttcctttttctccgcaacctcactaacgtgttattttttgactttttaataatagccgtcctgactggtgtgagatggtatctcattgtggttttgatttgcatttctctaatgatcagtgatgttgagctttatttcatatgtttgttggccgcatgtatgtcttcttttgtaaagtgtctgttcatgtcctttgcccactttttcaatggggatgtttgtttgtttgtttgtttttcctgtaaatttaagatccttatagatgctggatactattgtcagatacataaattgcaaaatttttctcccattctgtaggttgtctgttttctctgttgatagtttattttgctatgaagaatgtctttagtttaattagatcccatttgtgaatttttgctatgaactggatctgatataagcatatgtttaattttaactcccaggtcacactgtttttttttgtttgttttgtttttgtttttgtttttgtttttgtttttttggagatggagtctcacgctgtcaccagtctggagtgtggtgatacaatcttggctcattgcaacctccacattccgggttcaagcaattcttctgcctcagcctcctgagtagctgggactacaggcacacaccaccatgcccagctaatttttgtatttttagtaaagatggggtttcaccatgttggccaggatggtctctatctcttgacttcatgatctgcccgcctcagcctcccaaagtgctgggattacaggcttgagccaccacacctggccccaggtcatacttttaatcaaaatgagaaaaaagattgacttcactggagtgcttatgtcttgttttatattcaagttttaaatttatgttcttgagattattacatcttgagttacttgataataccacggttgaaatccatgttgttgaatccttcaaccccttgaggactgagaattccctttaattatctgtctgaatcattaaatacttgtaaatcaagagttcaatttagaaatgttatacttgatacattttttaaagctggataaattaacctattaaacaaaattatctcttcttcaaaaaaaaggcatcacttcccccacaaatgtgtaatttaggaattgttttctattggagtggttcacgcttatatattttagttgctctaatgcaaggtgtttcctaaaaagtttaaggaaagtataactttattttcatgtatgatagtaaataatacaatagggggtgcatttgtgctatgcttgtttttgttcccatttcagtgctcaattactgtagcttctaataaataaaattatcagttgctaacatttaaatcaaacagttccacaagtggaagtattgcttatttgtgagagttgtgtttttttaaacttaaccttactgaggggttttaaggactgctaattatagattgtactaagcaaagtataaagtaatagaaggttaccaagttgaggctagaattcaattagtgccaatacagttaaaatggtatcattaacagaacatcttcatccaggaccttttttttttttttttttttttttttcagacagggtttcactcctgttgcccagactgcggtgcagtggcctgattgaggctcactgcagcctcaacttcccaggctcaggtgatcctcccacctcagcttccagagtagctgagaccacaggggcatgccaccacccctggctaattttttgtattttttgtagagacagggttttgccatgttgcccaggctgttcgcaaactcctggcctcaagcaatccacctgcctcggcttcccaaagtgctggaattatgggaatgagctgccacacccagcccctccggaatctttagattaccaacttctgtcttccaggtttttatgtccttggaaatttatgcatatttttagaggtaagacccatcctcatcttcttcctaatccttgacatattgtgaacacagatatatatacaattaagtagttccctgagttacaaatatacttaaatatactttaacttattatagaaggcttacaaaaactgtggataaataacatatatttatcttagttaatgaataactgatgctgaaaataatgtgaatgtcaaattagttctctttttttctagccctcacctttgaaaagcctgagcctctgagatgtgagatgactgctgtaaagtgaagcagcgaatttctagaggctgggttcacgcttcaggtcctctaaatcctaggtcgcttcccactactacatactaccctaaaaaatctgtaattcgcaaatttattttttgatctttttcataacttattaaatttttattgaacaaatacaggaaacagttttaaattactcattgctcttgaatacattggtgattatttttcttctctgaaattctgttttccttaaaggcagtcattttttggtctcttctaaatgacacttagtatttttagtaacatcataacttcagtggccacagtgagccctcattttgcaacatatgcctacttttcatatctggcttgccttttattatttataatttaatgaaaagaaagtaccactctttccatagttttgtaatagaattgctgtcaacaaagtagtggatgcactatgttataaagatttcattgtgaaaacatgaaatggctgttaactatacatcaggcaaaataaaaacaggaaatataaacatttcctggaacagggcagagtatgagtaataaggtatcaaatataattggatacctgaccaaatatttttaaatgtcttaagaaatgtcactggaaagactggagtacttggatttgtctcttattcttattttgattcctaacactgtgcttggcacatggtaggtaattaataaatgtgtgatggatgaataatgattgtcattcaattagtgactaagagagttggaaagggctatcaatttcaaattggttcctttaagacatttttacgtaagatttgggagaaaagtaaaagagcaccatatgattatgctttactaagagctgcttccattcctacattgaccatgtggactcatatttggcctatataattacattagaataaacaaagcaccaaaagttggaaaaggaagtagtagtaggagagggttttaagctatgtatttactgggaaaaaaagtcatgttttcttttttaaaaatgttctaaacagtactgtaatcacttgggaattgaatgtgctttgtgtcagacaaaggtctttgtatacaatacattacattttgtataccaatacattacattacacagaagggagtgcctggctttgtatacaatacattacattttgtataccaatacattacattacacagaagggagtgcctggctttgtatacaatacattacgttttgtataccaatacattacattacacagaagggagtgcctggctttgggaaacacatctacctaaactcttaacatagcacaatgctgccatacggtaggtaataccaagacaaatcagggccgttattaacaaccttgaggaaatgtcttgggaaatatttaaataatttttgtttaattataataaggaatctacagcctctgtgaagtcatcccaaactcttcgaggcaaatttagtctcctcccacccctgttttttaatgtttctaaaggatgttatgtataatctattagaaaactggccaagtgcagtggctcatgcctgtaatcgcagcactttgggaggccaaggcgggtagattacctgaggtcaggagtttgagaccagcctagccaatatggcgaaaccctctctactaaaaatacaaaaattagccaggcgtagtggcaagtgcctgtaatcccagctactcaggaggctgaggcaggagaatctcttgaacccgggaggcgaggttgcagtgagttgagttcgcgtcactgcattccagcctgggcgacggagtgagactccgtctcaaaaaacaaaaacaaaccaaaaaaaaaaaaaatatatacacacacacacacacacacacacacacacacacatacatacatacattagaaaactaattacattgttttcttaaaatgttttaagcatctctcttcctcaaggacaagaatcttgaatccttagtgcatatgaggtacttaatagatatttaaatgaatagtgagctactattgcctaaaaatattagacatcatgtaatatcaggcctacagttgatagaaaaagtattctcaactaagaataatttaccaatggagaaaactgttagttttcccttctttttctttgctttataaaatttaaatgacattaagagttacgtttcttggaaaattgaaaagaatatctgtggcacaatgggctctgggtataattgcaggataatttgaaaagtttaaagaatattttcaataggtataagtttatttaggctctgtgtctcctcttgagatgactttagcagtatatatttccctggaacaccatgcactctaggttttctaatttattggtttaaaatacatggcattttactacgtaaatattctctgtatctgtaggtacagcacctctgtgtacactaagttagtgtatgtatttttttaaaattgccttagttttgctattcactagattattttccaaggaacctactcttagatttattaagcctactatatatattttgttattaactaattctcttatttttaaaaattacttttcctttctttgcttaaatttgctttgttttcctaaattagtgatttggaatacttaattgtttttattttgttttgttttgtcaataaaagagttttaagactctagttatactatagctatagccaatgcattttgagaggtgcttacatattacaattattttcagaaattccttatttcaaagctttgctttctttgaacaaagagttatttaggaaaagaaaggaataaaaatctcaacttattctccacttgactagctttattatttgcagtattctgttttttacttgttctaatacttctttatattttgttgtggaattatgtcacctaacaatattttccttaacttcttaattttagcctgttttccaagttaatcatttatctgttgtttcaatgaatacctaagaaaattttctttgtcaggataaggcacatgaggtctaagatttatttctagaacagtaagcaaatcatttctgaaagtgtgttcttctactattaagtaacatgtttatttttgtcttttagttgaagtcccccccaacccaataggtactattctgatttgttctcctattcacacattcttgaaggagagctgatttatctgtacccacaaaattataatataattttctcagagtattcaaaacattgtcttttttatttttcttttttttgagtttttcactcttgttgcctaggctggagtgcaatggcaggatctcagctcactgcaacctccgcctcccggtttcaagagattctcctgcctcagcctcccgagtagctgggattataggcatgcaccaccactcctggctaatttttttctatttttagtagagacggagtttctccatgttggtcaggccggtctcaaactcccaacctcaggtgatccacctgcttcagcctcctaaagtgctaggattacaggcgtgagccaccacacccagccgaaaacattatcttaatggagcatttagaacgttatcactgacaaacttttttctattgaaaatactgcttaaaagatcaggtcatgcccaccccacaacccacaccctttgtatttctcttttacttgtcttggcctctagttcagatttatagtttggtaatgtctgattttctttgttagtgcttcagcccatctggttggggaacagctctatcccactgggacctctccctttcctcatgagtgacgccagggtcctgctgcccataagcattctgtttgctgagtttgtatatatttcctttccccagcttcgctgcctttggctgctttgtgattaagtaagacatacccatgtttcctaaagcctccttcgcctttagtccttgatgctggggaccttttggttgggaagacagcttccttatgtcagggtgagcctgctacacaggtatgtaactcagacagtgacctactgttgagtttctgtttagtgtttctttgtctccctcaaatggtacaaacgtggagggcttcaactgcagtctacctttgtcctgttagttttgtctatcacagcccatgccctccaaataagagatgatggagcagtctgcttattttctgtagcactccacaactgactttaaaagagggactgggattgggctcttagtgatgacttttaatgtggattcatctgcattttctctagaaattctttaaactctctgcctctcagctggcactattccatggtattttagtgctaatgggggatcttttctaatttttgtttttctttgactgtttaaatcatttactggaaagagggcttagatatctgctcatatgctcctgctagtctacaagtcctccagcctgattttgttcatgaacatgatggaaataagcttcttaaatgcctttaatattggatactgctttcaaggaaatttaaaatagcaagcaggctttcaagaagagagaataaattatcagccagtctcgcaagaacaaaaataagccaagtcatataaaacaagtttggagtaaacttgtttttacatttcaaattcgagttgaactcttcaagtgaagcttcagagatataaaaaactttaactgataaagattccaaacattaatatatggaaatgtatgagctcactgaaaattttacataaattttactagaagaggtgactgaccagttgcttttataagattctcaaaaagatctcaaatcttagggactaatattgtaagtatacggggaaattaagacaaagatttactatcttgtgagtttttagtttggataatgaacttaatttcacaagaaattgctttagcacaaacatgaaaaccttaagcatgagaactctccttttgaagtacaaagggagactaaagtgaataactcaaactggaaatgtagaaaattgaatttgctatgatttgaagtcctttcagaatagccaacagattttaaacaagagttttattgcatagtttctttgggatatacattgaaggagaaaggaggagggagttttaaaagacaagtggaaagccctttctgcttgttttggctatggcttccatttcagtgtctgtatttaagggatcataaaaggaactggaaagactggtcacaatggcagctctgtacctgtatgatttcggatgtgaaaagagtttagcgatttccttgttaacctatactgctgtggaagtcattcattatgcagttaggcattagcagaacaaataaagttcacagctctaggaaccaaatttaactttatcactcttctgatttagaatattttcatatgctttcatatgtcctacagacgataagaagatagaatcaatacttggtgattgataggttattttttaaaagggaagaaagaattaaacatccatggtttcttcttaagtaactggggggatgatagtatccctcacaccaatggggagtatagatgacaggtttggagtgaaagacagtgaattccattttggataagttgaatttgaagtgcctatgggacatacaggtacagatgactaggagacaattgaaaatccaaattgtgaactctgctgaagattagaagtacagatctgagattaaattgctacttgagttcatgggaataaaataggtcattctgcaaatggttatctcaatatcttcctggccatctcttgggtcaccttgccaacttttcattctctttacaatctctaaattctcatgtttttaaggctctcatcttaggccaacttatcttgggtcaccttgctaacttttcattctctttacagtctctaaatttgtgcttttaaggccccattctcaagctggcttctctgttttggtgggaactggtagcaaacattcatttgtaaacaacccaaatggctagcattgagcaggactccccaacatactcctctgaattacattttgagttatctgaaggatcaatatctcaaactaggaaactgtagctttctcatttattttcatcatctaattatttttcttgcctttaagtataagggatagagacttgattgatttttatgtacaacaagttaaaaaatttaattaggcgtctttgccatttaatcagtttatacttcttgaatcttttccagtcatcaaaaagttgctgagcatgcgcagctttacttactagcttatagcatgaagaagagtaaaataggagtggataaaggcacagtggtgagtagtcagtgtttccaattaatctcaaagtttaggattaatttagcgtgaattctgttcttttgtgtcttcctgctttttgacgtggtaacctgccataacaaaaggaaacagcaggaaacttggtaccaattaaaacagtcttcttcccccaaagaacgaactgtcagcaaacaatctcaaattcaaagtgataagtgttttagagtgaaacaaggataaagagacaaggctattaaattttaacatctgctggaacacaaagcgcatgccagtagaattaagtttggcatttaataagatacaatttgcacatcagaaatgaaatagatgcctcaaggcatggtatatatatatatatatatatatatatatatatatatatatatatatatgtttgagcgaggggcacttctagcaaaactgaatacactggtataaatgtctgcgtgaaaatttttttatccattcacttttggtgtgtattccagctgtgagttattcaaccaggctcactaagtttgagtctgattaataacgtttaaggtcacatctgattaacagtatttgaagtttgaatttgttctaagatgactcaagcgcaataacattttctatatcaaaatgaatttccatccaaatagggaggaaatctgaaatttcagttccagtgttgactgagatgctctggatgagcctggactcagagctcaccaactttggatctttatgttaagtagtcagtggggttgacttctagactagagatcaaaatgttctacacctcttgatataggtcagtggctgatgtaatgtgcttccaacaactttcttttaactaaaacagtacatataccaagttggtttgtcacaatgggaacaaaacagaaatctgacaacagatttctctaattttttgtgtgtatgtttctgaatgggctaaaatacataattttactcttccttggtgaagatgcttttataagaggacgtgtttaagaaaattaagaaatgttgtaggtagccatgaaagaattattttaaacagaattagtatagaggtgtgaagatctactgaagggtgataagtaagtgtggaagagatggtgttcagcattgggcttcagtatgaataggtagaagatgagcaaggcttagagacaagaagttcattcaataggctgttgcggttatccagcaatgagatggtgacagcatgagccatggtagtaaaagtaaggacatggataatttgtgggttctacagacaataagaacatagaaccgataggttattttttaaacgggaagaaagaattaaacatccatggtttcttcttaagtaactgcgtggatgatagtacccctcacactgatggggaatgtagatgacaggtttggagtgaaagaatgaattccattttggataagtagagtttgaagtgcctatgggacatacaggtacagatgactaggagacgattgaaaatccaaattgtgaactctgctgaaggttagaagtatagatctgagattgaattgctacttgagttcatgggaataaaataggtcattcagtaaattgttatctcaatatcttcctggccatctcttgggtcaccttgttgacttttcattctctttacaatgtcaaaattctggtgtttttaaggccccaatctcaggctggcttctccaactgtactcttacttgggatgatcttatctagtcatggggcattaaataccattggtaggttaacacagttcacaattttctccagcttagaccccttgctgatttcctgacttgtacactcaactgcctgcctaatatacccactttaatgataatgtacatctcaaactgagcttattcgaaatagaagccttaatttttctgtcagtcatattgttcccatttacccatcctaacaaatagcaccatcatcaaccttttagctcaagacaaaactctaggcattatcttgctttcattcctttcatgtactttctcacatctaatccattaccaagttgttctgtttctgccttcaaaatgtgtcctaaatttatccatttctctgccactgctattctctagttcaggacattctatcctttctcttgtattactgcggtctctaaacttcatgtatctatgttttatacttttaattcattgtctatacagctaccagagtgatcttttaaaggtctaaatcagttcatgtcactgctttatatataatgcacctatggcttcccactggatttaaataataatcttaacactttactcctccatggcctttacatacttctagccgcacctcaaaacactcctcttgttcactgagaactaactagaccagtttctcttctcctcagctatatcatgctaatttatgcttcagtgccttttgtacttttgttccctctagctgaatcattcttccaggtcattctatcattggctttttcattcagttcagatagatatcagcaaatcaagagagtctttccttacctgctctatctaaatagtcctgttttagtcctctttatctcatcactcagatttatttccctcatagcactcatcagtctgaaattgtttgtttatttggctacttgtttgtctagataaacttcactggtgaaggaatccagactatcttgttcatccctacatccctagaacctagaacaatatgttaaagataaataaataaatagatgaaagaatgttgaagagaagagggtccagtccagccccctgaggtgaccagcatttagggaataagccgaggcagaggagggccattaagaaggagcaatgagagatagaggaaaactaagaacaaggtgtccctaaagtgagagtgtcctaacacaggtctaaatgaaaggatagttcagaagagggcactgcagctggctgaaagagaacaagaaaggctgtaaggtggaggtgaatttttaattgagccgtgaaagatagggaaattctgtatgaaggagtaaatggaggcatagaggcatagaggcagaagatgcatgcctgtttggggaatagtcatcccatttgtctttcacatatctcatttaatacttctcatttaatccttttagtgttaatgttgtcactagattaaaaaacaaaggctccatcaggatcacacagtaaacagaagaatatggatttaaatggagatctatctgactgcaaagactacttactgtaacttaagtcattgagattccttatggccacctcatattcaccctgcatataacagtatgccaatgtaggaatgaggcgtgaataagcagggtaacaatagaaacatattctcaccttgattattcctttggtagcttcaagggaaattgagtttgaggataaagtaactcttcccatgtcagcactttatctgtcctgaaacatgagaaattccaaatgttcaagccatgcagtttttatctagtcagatggttgagaagtccaggttacccatagttgtaatgaatacctcctctttatcttcttaatgttctgctttgccaaatgatctataaagattactcagtgtacctttcagattgaggtccagcagactttcagaacactacatttaattacagaaacccaactaataaaataataagctcatgttagtttcaggtgttgatttgtttttaatgtagtcaataatatttacatataatgactggcaacttaacagagttataatagattattcacctgtatttgcctttatttgtgggtatacacacatatatacatgccttaaactagagtaaaatcatttatgcatactaaatcaaatttgagagtcccaaaattttcaaattgtgtatggctggtctatattttctaggactgtcctttctggtttaaatgaaattaaaaattgaattaatgatattagtctcttttaattttctatttttttcatgattaaaaaatattaatttccagccaggtgcggtagctcacgcctgtaatcccagcactttgggaggctgaggcgggtggatcacctgaagtcaggagttcaaaaccagcctggccaacatggtgaaaccctgtctctactaaaaatacaaaaactagccaggcatggtggcacgtgcctgtagtcccagatacttggatggctgaggcaggagaatcacttgaacccaggaggcggaggttgcagtgagctgagattgtgccactgcactctagcctggtcgacagagtgagaatctgtctcagaggaaaaaaaaaaattaattttccccattcccccacccacccaccaaaagactccattggagttttattttacaaatgcatctgctcatctacttctttttaagtgcataaactagttttacaagcttgagtttaaatcttaactcctcaattctttttctgacatagaaatatacaggtgcattatgaaatagctaatagtgactattttctagggctgtaactcaatatttataagcataatgatataacctgctgaagtttgacacgtcagtatagttcttttgttattctaagtcataaaggcagaatttggaaaaattcacagcttttcaaatatgcagaagaggaaaaattgagaggaagcatactaaaatttctttagccaattttaatcaaattgagtttgaaacttacaggattatgcttcaaagcttgtaatgatcgtcaaaagtagccttattcaaaatgacacactaatttctaccacatctgtattcttctcattgtaagatgttacatatacctatgcttgaccaaatggacttcctgctattttaagatatttttctgtgttttaagtctttctacaaattttctcaagcatttccctttacctaggatgttcttctttcactgcaagtgaagacattctaaaaattcctaaagcacactaccaaaagcccttcatttggatgacccaccttcctatgagtctccatagttgcatgtctgatggcatttattttaactctatgatctgcttctaaattagataaaagctctcagagagaactatgaccaattgtcattctgtttcccatggcacctagtacagtactctgctcacaggctcaataagtaatgagttgagctacgtttttttaaggcagagtctccctctgtcgcccagggtggagtacagtggtgcaatctctgctcactgcaacctctgctgctgggttcaagtgattctcctgtctcagactcccgagtagctgggactataccaccatgccaccatgcctggctaacttttagtagaaacaaggtttcaccatgttggccaggctggtctccaactcctggcctcaagtgatccacctgccttggcctcataaagtgctaggacaaaagtttgccattgtcatgttacgatatatattggtttttgtccatggtttctggttcatagctccaatatccctttttacagtcttttgttagaatgtggggtgtgttggacctcggggcaggccttagaaaacagaatctctcctgccttcctttcacttgtcccccgagggagatttttttttttttttttttttttgagacaagacttccctgtgtcacccaggctggagtgcagtggtgtgatcatagctcaccgcagcctcagcctcctaggttcaagcaatcctcccatctcagcctcccaagtacctgggactacaggcacatgccaccacacctggcatttttttttttttttttttttttgtagagaggtttcgccatgttgcccagtctggcctccagctcctgggctcaagtgatccacccaccttggctcaaaccaccacacccaaccctgagggagattctaatcttccccacccttctgattttgagtcttaaaaccccagagaaggtcccaccctttgcactggggaaaggaatgctgatgatcatgaagcctccataaaaactcaggaggattgagtctggggagcttctggatagctgaaccagtggaggttcctggaaggtggctcatccagggaggacttagaagctccgtgcactttccttatacttcaccctaagcatctcttcatctgtatcctttgataaaccagcaaatataagtaagtgtttcttgagttatgtgagctgcttgaccaaacgtattgaacccaaagagggtgttgtgggaaccccaactcgaagctggttggtcagaagttctggaggcctggatttgtgacttgtgtctgtggcaggagcatcttgggaactgagcgtttaatctacggggtctgacactgtctccgggaattaaattggaggacacccagctagtgtctgctgcttgttattggggagaaaccctcacacatttggtcacaagagagaagttttctgttttgaatattgttgtgatgtgagagcagaggaaaaatgcattttggagaggttttttcctacacagccataggcagtgataagaatatgatgcttttttccagaaaatgctacatgagacctttttataaaatctaattttcttcaactgagtagcatttaaactaaaaagaataggttatttcagtgtctctctgtaataacatcttacaatcacttgtcagaccatgaaataatgttctagaaaatcagtgaaagagctttttaaactttgtgacatttgacttatatttattaccaaaaagcctgaattattattcagcacattataattttatttaaaatttaaattagagatgaaatacttgtaaatgtttataagattggtagctgtgtgggcttccagagttagaaatgcctctgagaaaagatttagagttttgaaagtattttgaaaaaagaaacagaaaggaatacaacatttttcccagcactgcttcaataatgcagtcttcagcatcatctcaaagcaataactgcagtacagatgagatcagccagtttttttttcccccttatctgcagtgattttaccatctcttcatgctacatcttaccacaaagagaacattgaaacatgggaaagagtttgctttgatttcaaccagaatgccaactcatttctggggttctaaaccataaccttttttagcagagcagtgtagaatttttatacgataccataaatggtcggcctgagtaacattttaactgtaagtcaatacctttgaagagacatgtctgacaactcagagttctattttctccatgtgtgactaaagtaccttttctattaagagatcaaccaccatttccttctactctttgttctccccttaaataaagttaattcagcttcaaaatattttatgatcttgattactaactgtgggtctttagaagacaatgtaaaacatttccatgctgtgaatattagagctagtatacttggagtttggctagtatttctgggggaggtagaagaggagacatagagtacaaatgagtatttttaaagccacgctgactaaaacaaaaggaatgttttatacatgtttatttcatagtacttctttgaaacaggtcggggggaggagagttaaaatattgctttgaattttaatcaaagttctttcatggaattgttggtgcttctggtaataacagttctataatctttgtgagttaatctgaaatgctctttttcttcatcgtaattcagtgcttgtcttaactggtggacttattttatggtattatgtttataagatggcaactaaaatcagattttttatactcctaaaagatggatacgatagaggggaaagggggtaagctacaacttttaggttgttggtgatatttgaagtgtttattgcttctgatttacatttatatattatattcaaatataaactttaaaagtaatgatttgccacaggttaaagcagaacatttatatgatatttcctagatgttttcctctacaatcctgtttttgttctatgaaaaatgccataaacttggatcattcactaattaatttgaagctgttttcaaacaaaaagctaattcatcttttagcggatttagttataatcgtgataacagatgtatagctaagtctgttggacaaactgttggtcacatcaatcttaaatgcatcatacagcgtgatgtgaatttatgatatttcctaggtaatgttaaggttatatggaaatttctttgcaggtagttaagtcttattttgaattcaaatgttattttcaatacatacgtggaagtgtattttttgtttgtcctaaatgtttagattttttgagtttacaatttttttgtgtgttctttctttgttcttgcccctccctgcattctctatgaagatacatgtcagcactatgcaacactaaaataacaatcaaccaaattatatcctatgaacagacctttctcttcatttcaaaggcataacttggatggtctgtttagctcatggtgaaaaaaaaaagttatgattttgtatttgggcaaagtacaggtgaagagcgtgaatcattagaacagcaatataactggaagaagatagtttagtttttacaagttaaatttgaagctaaagcaaaacttgcataggtatgtgtcctttgctcttgaaaatgaactcagaactctacatctgagtggttttatgaatttatactctcctagtccacaggttctcatcagtgcctcaagatctatgcacagattaaaattacataagatatcatatactacatctgaattagggttttccaaagtatgctattccatggaaatactgtttattcagggtgctccataaacaatgatcctgtgtttcattatgtccaggaaatgccacacagcacctttccagacatcctatcatcatattaaagactttgaggccatgcattaaagaaagttttaaattagaaaaaaaataagttttcttgcttgagcacagaactttattttttctcaggctggttctccttttttaaaattacacgttaatatcccaaagaaccagtcccatagatagatatcacatatgataagaatctgtttcaatggtgttggtgtacatgtgtgttcaggtacctacacattaggacacatctctagtttattaatactgcacttataaagagacatggtagagacatcaagaagacatcattttagggtggacaccattgcctaggacctgcttcttaatgtcaaaaattcagaaacccaattttatctctcccgcagagttgactcgagtgaaggaaattgagttgttttaattaaactcacatgagattgatgtttaaacaaaattgtaagtttatcaattaataatcaagaattctgatttttaattttcaaaatattatttatgtccactgtccagggtacttgctttaagggcacccagtgattcttgaagatgaagagtcttaggaatatttattttctagacctcaatgaagaaagctttttaatcatcctgccccatagaagaatttatgttcctagtgatgtgatcatattggccaatccagtgtttcttttccaaggacagtactgataaggagcaccaaatctacctctttgtcctgaacagatcatctccatctattcatagtttggctcagaagttggacaaggctgcattttatatctacttcttcctcatgtcggctatgccatgccgtttcgttcttttagcttgtttacttatgtgtaaaatgaggtaaaaattacacccttcaaaccgaaagtggtcttcgtgatgagttatttaattgaagccccagtagatatttatcattgccagttttagagaatcatagcattttagaacacaagatgaccttagatgtaatcatgttcattcccctcgtattataaatttttaaaaattgagatgtggggtggttgtgacttgctcacaaacccacatttagaaccaaaactcagcattcttgttctgactgtgtctatgtcctgtaggtatatgtcttgtcttctcagttaaataattaaagattcttaaagatagagaccatattttatgcaacttctggatcccataaattatgtttccagaagaaccttttgtaatgaaaaaatatatataatgtctatattatatatatagtctattactattttgataatctaaaacatgctatataattttaggcgatcttaacctatttatcagagcttttcagatcaaagaaaattagagtaatcttcatcatgtatgggaacattgatgtatttttctgatgaacacatggttatatgatactcttttaaagcatctgtattactctttcttctgatagactggttattttgtttatgttatgaaataatgttggcagcttttcattagaactgatacatattgaaatttcttaaattgatagctcatggatgtgcagttggtttaatggcatctccattattaatctttaagaagatcttcatcttactctcaaaaataaccgtaatatcctacaaattaactaaaacatgatcattgctagttgttccaaaataggaagaataaaaatgaccagattgttatggtaaccagttgattaagactagatcaataggaaaacgaatttattcaagtctgtacaaaacttctccaaaacatagatggcatgccttttgaggcaatggtagggaacaaaatatttttgagaaggagcagattttagggatacagtacagtacataattgccaaaatgcttgtgttacaaggattcctggtacagagtttttaaataaaatgctaggtatgtcatgtttgtttcacattaatattgtagagtcccctggggatgtgacaatttagttgaccaactctaatatagttaatttctaccttttgatagctttgtggggttttgtttgtttgttttttgttttgccattcttgattttagggctgaagatatgagacaatgtatcaaacagtaaagaattatgcattgattaagatcatcttggtgaattagatgtttattatataactcgactttaagactttgttcagatctcactatcttaatgagatttaccctcattatatagtatttaatagggcaaccactccccgatactcttgattcctcgttagctgccctattatttctttgtttttcccttagcactcaacattttcttaccacaccacataatttactttcttattgtgtttattgtttttctcctcattagaatatcaggtccaagaagacaggagtatttatctcttttgttcagtggtgtgttactggtgactactagagtgcctgacacatagaatatgttcaataaatattcgttgcatgaaagaatgaataccttgacagattatttttataactctaccagtgtcattatataactacactgaatgattatgagccctcctagaaattacataaagttcttatatattattagaacccatttgttggccttatgtaatggttctattggaaaaatcatacctccgtatataaaaatgaaagtattttttttctacaattgcccctcatatatactattatagtctccttcaccccattcagccattaatgtcttcttgaccaggtaacataatttttacagcaccttttggttattagaacaattttatttgtctttcaaactcagtcctattcattttaaaactcccaactcaagcctgagtcagtgttcttctcccagcacaaacttaaacactggctccaacccttggagttgaaagtaggggagcctcactcctgatacctcccctccccctctaccgtgagcaccagtgcctaggagattgggcaggactgaggaaggatgaaaaggagctcagggctccttaagcacctgaacaagactggaggactttggatgttgctatttttctgcctggcattgactggctattggacgccctctgtgaggcaggcatccgaatactggctttcttgacatatatggagcgttctttagagaggcctacaagggctctcactgcacagtaccctgataggagagatctgtccttatttcttctatcaccatagctacttcagctttgcctgctgagtccaccccacagtctctttctgctggggcatccttgccctggacagattcttagagcatgaccaagcctaaacaacttctgcaatttttctaagtacacttttatttaattgaaagtttcaagcattggataatataaatgtatcctagacagtgttccagtaaggacaaccagctcacaattatccattctaataatgggagtcaactgaaatagaaaaatatagatttttaaaataatttatgagaaacaaatatttgtgacacagtacatttctaattatgtttatctttattattattattatcgtttccttcagtacacactagtttggtgagacttggagaaaggccaggaataagcccaaattcaaaaaacaattccaggattaacagataagtggataatagagaattgacaaaagatcatgctcattttaccaataagaaactggttggttaacttgggttgcaaactgaaagcagatttatactaaactggcaggtgtctccagatcttaaatgcagatctctatctctgagttaatctgcctctcatcttcaatggcattcctctgaatttttctccctcaaataatctatatattattaaattttgtttatactgccattttaagaaacagattttaaaactttaaacatgggaattaaataggccctactgaggattatgaaaaacctgacaaaacctcctatgcacatgatttagattaggagcagtgcacacgctgtatgtgtatgtgcagctacttgtccaattaacaccttttcagaaatggaggaactttctctgaggactttgacatatttgtgtgttcagcagtcctttttctttttttttattttttatttttttattattatactttaagttttagggtacatgggcacaatgtgcaggttagttacatatgtatacatgtgccatgctggtgcgctgcacccactaactcgtcatctagcattaggtgtatctcccaatgctatccctcccccgtccccccaccccacaacagtccccagagtgtgatgttccccttcctgtgtccatgtgttctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacattagggttggttccaagtctttgctattgtgaatagtgccgcaataaacatacgtgtgcatgtgtctttatagcagcatgatttatagtcctttgggtataaacccagtaatgggatggctcagtcaaatggtatttctagttctagatccctgaggaatcgccacactgacttccacaatggttgaactagtttacagtcccaccaacagcgtaaaagtgttcctatttctccacatcctctccagcacttgttgtgtcctcactttttaatgatcgccattctaactggtgtgagatgatatctcattgtggttttgattttcatttctctgatggccagtgatggtgagcattttttcatgtgtcttttggctgcataaatgtcttcttttgagaagtgtctgttcatgtgcttcgcccactttttgatgggattgtttgtttttttcttgtaaatttgtttgagttctttgtagattctggatattagccctttgtcagatgagtaggttgcgaaaattttctgccattttgtgggttgcctgttcactctgatggtagttccttttgctgtgcagaagctctttagtttaattagatcccatttgtcaattttggcttttgttgccattgcttttggtgttttagacatgaagtccttgcccgtgcctatgtcgtgaatggtgttgcctaggttttcttctagggtttttatggttttaggtctaacgtttaagtctttaatccatcttgaattgatttttgtataaggtgtaaggaagggatccagtttcagctttccacatatggctagccagttttcccagcaccatttattaaatagggaatcctttccccatttcttgtttttctcaggtttgtcaaagatcagatagttgtagatatgtggccttatttctgagggctctgttctgttccattgatctatatctctgttttggtaccagcaccaggaccatgctcagcagtcctttttcaagagatgtgaagtacatcttcacagatttttaaatatttagatagaaagttcttacagaatgagaaataaaaagttagctttgccttaaaaatattaattcaccttatattctccatacttaatccatataggaaacattatattccaggtctaacatgtggcttgcttacattaattttgctgttgaaaaatatatgttttggattatgtttttaaaattttagctttaatatttaaatattaaataatgttaactttaaattaacgaagaatagtttttaattttataagaaatgccctataaaaaacactttctttacctcaagagtgagacttggcaaccataccaatattacatagtaattttaaagtcaaacgaaatggagagaacttaatagatacagaagataagaatttaaactaacattttgctcgggattttagaacactatacagagggaaatttagtagacaataatgaagtccatagcattgcacacatcttgaaataagtgtataattgacacaagctatgtcccatgttgataggaagaatccaaaatagttttggagaataatgccatctatgcaggaggtgtggccatatacatcatctttactcagtgtttttcatgtcaataaatatttaattcctaacactctgaattactaatagaggtgaagcctgtcagtggaagtgacagagagatacacagtgattcccgtaagtttgatcctgaaacacagtgcctttagcagatatagttcccataagcaagcagtctgaagtatttaccctcagtaatctgaatgtataaataaacaggattcatgatggtagagtaatttatatatacttgtagtattaggacatgcaaaacttattttatggaaaaaaataatttactaccttatagtatggcaactatacaaatctataaattgactcttttgtccccttgaaaaaaagctgacataaaatttaaatgatgtgtattttttcttagagcaataaaagatatacccccacctagaaaagcaataaaccaaaaaataaaacaaaaacaaaatcaagccctcttcacaaatttgagcatatctacagctttatgtggtgagagatacagctaccattcttgagtaatccgaagagtcaaatggtatggagcaaaattacagtcctaaatgcatattggtgaaatgagatgctgatccatttgcacactaatgtgctatttttaagtcatgcatcatagcatcttcaaagaggcctgtcataattatgatggattagactgcagagtcagtcctagatgcagtaattgtttcacagatgctgccaatgcgactagaatttataataaattattttcagagaggcgggagaaggaacaaaatcaaaggaaaactgctgtggctaaaacctgttttggtcttaggaaaccaaaatgttagctagtagtcaaaaggccagtattttcaactgagataaacatgcttcattaatacatgcctctgacatagaagataaaggttaacataattgacatatcagccagtctctctctctctctctctctctctctctctctctctctctctgtctcgtagcttatgaaaatttattctggggcattagctgaaattattgagtggccatataattgttgcatgtttctatttatgttaaattgcctggttataatttgacctttagaatttctgaaaaaaatggtggtatttatagtaaatagaaatattctttttggttccttggaagcccatgcattacaaagaacattagattattggaataaaaggatagacatacataatatgactagtgggatctaaattataaccttttaaaattgtaatttaattagtctgtcatttaggcaaatgataatttctaaaactgcctttttagacttaaaaaaataccaaagttcttataactttagcattatgttttgttcattcttaaagtttaattcactttgttgcctttttggtaaacctatgaagaaatctcatgctgcaccatatagtaaaaaatcgtgtgtgtgtgtgtgtgtgtgtgtgatttgaataatgagctatgtgttatattttgataagcaaagataagtttatagtgaagcagataaacatgccatgtattttcctaggttaagggttcaataatcagaagagcttctacaactcatttgccttctcactagtttttttgaaattgcgctctatgagttttttatgtggtgttctctgtacttgctgactactgatgcacatttctccttaggtcactggttctcctccctcagcaatgttgtaggtagctttgatgaacattcgttgtcagccttttacctttgacttagtgtttttctctcatactacggcaagaagaaatgaagttaaattttacaagagtgacttgggtggctgatatgcccacattgacagggacaagagctctagtcttcccctctcctgtattcccatggcacttcagtagtctcattgcctcaacataaccacagttcagggcagtagaggatgtttgcatctttgtgttagctccatgccatggcaactgcactgagtgaggattcaactcagtgcagcaggactgaaaaaataaatgaactaatgtgtcttgagctccaattctctgagtgacattatcaggggagattcataaatcatcctcaaatattctagagaaaaatcatcagcagtccagcattgcaaagataatctgggaaggtggcaaagaagggatcagaataactctgtggcagcttcaaattccatgtcctaaaagtttacgttttcttttttattctatcccaaaccacataaagaaatgatttgttggcaaaagacatgcaaaatgcccttaatcatcttaataattacagacctacagatacgtagccaaaatacttgttttttaatcctaaaccttaaaaaaaaagcttaaattgttggctaaatgtgaatttaataacaaaacttactcctttaattatgcacttgtcttagtattgtgtggtgggaagagctttagagagctgccagagtgcttaggcctagtccctgtgggagcctctgttttggtgcttcaccatgggcagattcctcagttttcacatctttaaaatgagaaaatggtactagatccttgctgctactctgaaatgtttatacattgttaggaccattgttacatattattacttatatttgagtgtcaccttagaatttcttagccgtgtgatatggtttggttgttggctcctctaaatctcctgttgaaatataatccccagtgttggaggtgggggcctggtgggaagtgtttggattattggggcagatccctcatggcatggtgctgtcctcctgatagtgagttctcaagagatctggttaagggtgtgtggcacgtccccctccctgtctccttccctccctctctccttccctccctctgtccttccctccctcttcctccctcttcctctctctttttctcccactccagccatgttagatgcctgctccccttttgctttctgccatgattataagttttgtaaggcctcacccaaagcagatgccagtgctttgcctcctatacagcctgcagaaccatgagccaattaaacctattttcttataaattacccagacagctatttctttatagcaactcaaaaacagcctaacatacctttcaaaaggttaaaatgctatttagtcattccagaagcaagatctctttgtccagaattctggaaataaagatgccaaaataatatggcatgtatttgatctcagggaattttcattttttcaaaaggaggaaaaaagagtaatataattttttaatattttggtagctctaacagtgcttagaaccagttctcaagagcacattgtgaaactttcaggaattgcatgagctgtaggttgataacatgatgccagctataacccataagagcatctcctgaggaatatgttaaaaactgtattcattcttaaattttaactaaatgcaatgagtgaagtattgacatcatgaaaatcatccctgggtaaacaattagtcactccaggttttcccaaaggttcttctgtctctgttcttgtatataaacttcgtaaccagtttaacaaccccaaaaaaggccttaattttgattggccagcatcctcttaggaaagacattgccatcctcttgtaaagttgcttctcattctaaaataagaattgtttccatctagggaatgatttttataggtagaatcttatttggcatggactcttttgcatacagtgaattacaatgtgtagaccttcaatagcaaggtgtttgaatatttagttgcacaatagagcagtatcttaatattgtataccatattaattttgtgttctctggtgtaagaaaaaatagaaggatgtttaatttcaactaaaaaatcaatcatgataattcaaaatatttctgatgagtcatttataagagcagatatgaattaaaattatatttttgttcttagtctctgagaagcaaaaatcacacaaataatctccatagcaaaaatttatatttatctgaaaaacagtttaactttgaaaaacttttctttgcaatcatttaaattcataaaaaaaattcattaactctactttcactgaatagcaggtgaatagcaggtcaatatctacaaaaattcatctttgaagatttttttatcttacgcaaaaattattgacttcatgtagactttttatgcaagcttgaaaacactgtgtaaatgaccccataaaaactacagcatgaaagctttttcagtatttctacaatgagcaaaatgcataggtctcatttccttctcttttattaagcaaaataatactttatcaacatcagtatgcaagcactaagagcttgaaagagtactgtgcaagtgggttactggatcataatattccagggtatgtatataaaaagtgtgatttagcacatattaaagtaaaagaaaatattgcatttttctccttctaaaatggcagtttattagtttaaatttcctgaaataagatttaaagaccaataacaaattttcctcattctaacatataactttcctgcccttcttgtgaaaaagttaaccattaaacttttcacacaaatggttgtataaaggacttgctgtcacagacaaaatagttctgtataatgtttaaaaatggccattgtgtttaaaactccatattgaaatacatttcttttttagtcaccttcatttcttagtagctattattatactcaaaggatttgcccttgacactttaaagaatgtccaaaattatgtggaatggattataataaaagataatatattaaatgcttaaaatattttataccttagaaagtagaaaaacatgtattatgtacagatcctacaaattttatataatttatcataaatgtacacatgtatatacatgtaaataccttttgattgctctgtatatgaattggtgttttacagttaccaaaagaaaagtgcctttttttggtagtatctggacaggtaattgactttctttctgcaggatttatttagatttatgtctatgctccttaatttttgaaaagtgatagtgtcctgattttggagaagcctctcatatcaaagactacaaatcaattttcatgattttaaaacctaaagtttctttattaggtgttattgatgattaaaagccattgtctcacccaaattttctacttgttcaatagaaacataatgtaagccacatggaattttacattttctagtactcacattaaaacaagtgaaaaagaaacaaattgatgatacgtttgatttaacccaatacatttaaaatagttcaacatgtattaaatattttttgagtatttttgtgtttttttaacactaaatctttgaaatccaaactaaatgttttcatagataccacatctcaatttggactagacacattttaagggctcaatagctatatgtgactagtcactgttggatgatgtatatctagaccatctcttaatgtatggaaggaagtaaatctagcagaaataaaaacatcactttgttttctttgtccaatatgagttataactttatttttttgagacagagtctcgctctgttgccaggctggagtgcagtggcgcgatctcggctcactgcaacctccgcctcctgggttcaaatgattctcctgcctcagcctcccaagtaactgggactacaggcatgcgccaccatgcccagctactttttgtatttttagtagtggcggtgtttgaccacgttggccaagatggtctcgatctcttgacctcgtgatctgcctgcctcagcctcccaaagtgctgggactacaggcgtgagccaccgtgcctggccttttattttatttattaagtaatacacatgcttggaagttatttaaaaaaaaaaaaaaggaatagttaaaagtaatccccctcccagtgcttttctccagctgccccattccttttcctggaggcaaattattatggccagttcattatatattctccagagatgatttttttttattttacaaaggtataggttgtagcattcttatataaactgttgtgtagcttcctttattccatttaattactgggagatacttccatctgaaaatatagagatactaattttaatagctacatggtattatattgtgtggctgtaccataaattatttaacataacccttattgatgtaggttgtttctaaccttttattactgcaaaagattgtgcctacatcatttaatgtatatatgagcatatttgtcagatatatatatatatattttttgagacagtgtctcactctgtcacccaggctggagtgcagcatcacaatctcacctcactgcagtgtccacctcctgggttcaggtgattcttcttcctcagcctcccaagtaactgggattacaggtgcctaccaccatgccctgctaatttttgtatctttttaggagagacgggatttcaccatgttggccaggttggtctagaactcctggcctcaggtgatccactggccttagcttcccaaagtgctgggattataggcgtgagctaccacacccagcctgtcagataaattcttaaaagggtcaaggaaagtgtttctgaaattttatacatattgccaaattgtcatcctacatgatatttgtggcagttttgactctcaaaagccacatgagagagtatctgttttcccacatgcttgccaaacatagtatagtatcaagcttactgatcttcactaattggagaagagaaaaaaactgtaccttgttgcagttttaatttgcatttctttttatgagcaatagtagatatcttcttaaatacttaagagccattcacatttcattttctatgaactgtccatgtcccttgtccattttttagtatgtggttattcatttatttgtaggcgtcctatatgttaagaaaagttttatacaacttttaactctttttacatgtttattttggcacatataaattttagcaaactttcccatcttttatgacttctagattttgtttcacaaaaaaagagcttagccagtcattagatttttttaagttttctcagattgtttttaacttttgggggggttttatttcctgtattcaaatattaaattcatctagaatttatcttaaagtgtaagggaatgatcccactttatcattttttcaggagattacccagttgttctaatatcaagtatgtctttgaaatcccatccttatcttgtagcatatttctgtggtttgggtctatttttgaacattctgttttattccattgatcatattaatattatatgtgcaaacacaaactattttaagtatagtagctttgttgcttttaaatatcttttaatttggctactaggccccatacaattctttttcagaatattcctggctacccaatttgtttatttttccaaatgaactttggagtcaacttccttaattcctcaaaatattctgcaagtacttttagtaagagtatattaagtgaataatttgacaactatctaagaacatattatagcttttcccttgttttgtttttgtacttatatattagtatagttttaaagttatattaaaataggtcttccacattttaaaaacttattcctagtgtattaatttcttctattataactacagtattttattccagtaaaacttctgactggttgatgctcttataaatcaaggctataaatttttcttcagctactttgctgaattctcacaaactgtaaccattttttacttgattctctaggttgaccagtatataatctttttatctgtaaacaataactttagcgttgctttcaacatctatattcttattctatttcatttttcttgtttatcaagaaatagctgttttaatagagttgtttttcgcccaaaaagaaaatagtctttctttttctacttatatctttaaaataaatgtaatgagaaagactgtgggaaaataaagcagacaccttatacaatggattaatttttttagtgccatttcttctggctttctctattattgggactctgaaatcttcgttagtactactctcaaaaatgttcgaatgaatgcaatcagattcaagggtacaagtgcaggttatataggtgaattgcatgccttgggggtttggtgtacagactattttgtcacccaggtaataagcgtagtacttaataggtagttttttgatcctctcccttctcccatcctcaaagtatccctgctgtctgttgttccccctctttgtgtccatgtgttcttgctgtttagctgccacttaagagaacatgtggtatttttctgttcctttgttagtttgtttaggataatggcctccagctccatccatgttgctgcacagaacacgattttgtgtttctttatggctgtgtagtattccatggtgtatatgtaacactttctttatccagtctactacttacggacatttaggttgattccatgtcttcgctatcattaatagtgctgtgatgaacatacgtgtgcaatatgcctttatggtagaatgatttatatccctttgggtaatatgccgaataatgggattgctcggtcagatggcaattctaagtcctctgaaattaccgcactgctttccacaacagctgaactagtttacattcccacaagcaataaggggataagtgttcccttttctctgcaggaatgattaattcttttagagagtcaaagatggaatcctagggaagatgatatctgaggcaggtttagagtcattgggcaaataaggggattaagaaggcattctaggcagacagaaaaccaaaggcatgaagctctgaaacagcttactatgtttggatatttataagctgttgttattgttggagtataaactgtaagagagagtaggaggacagaaaaaacagcctgtatgcggggggaagaaaacatttaaacagaaattctcaaaagatttgggcagccagcccctctagagaaaaacatagaatcacctagaaagggtttttcataaagtacacttttcatcacccctattctgtcacctggaatattgataacactgaagggagtgtgccttatctctcaggtgtatttggatgaaatagtttgagaaccatgcaggcaagtttaagccagtgtgttaaagagaatatgacatcagatttgcattttacaatcttccttttgataacaaagggaaccttaaagggctggaggggaagggcagacggggctaggggaggagaacccttttaaaaagctactgcaggtggggtgcggtggctcacacctgtaatcccagcactttgggaggccaaggcaggcagatcacctgaggtcaggagttcaagaccagcctggccaacatagtaaaaccccatctctactaaaaatacaaaaattagctaggcatggtagcaggcacctgtaatctcagctacttgggaggctgaggcaggagaattgcttgaacctgggaggcagaggttgcagtgagccaagattgtgccgctgcactccagcctgggcaagagagtgagactccatctcaaaaaaaaaaaaaaaaaagctactgcagtagatcaggaggaggcacagtgataaagagaagatctgagctatgaagtggcagtcaagatgattaaaggaatatataggaagtacagttgatagaacttagcaagtgattaggtaaatgaagtgctagagaaaataaaggggatatttttcaattgtttttagcattttggcaaaaaattatttaggaatgaaattgatgctagtaactaagagtatgaacttcccacattagctggtaattttgatcacccttgttctccatgaccataaatattttagagttgctatgaagacaagaatgtttatttcctgagtagctgtcagttgtcactatgaaacatgaaaataaatatcagtttgctatgtctaggtattccgatatttatccacaattattccttaagatatattagtatttttatagatagatagatagatagatagaaataaacacattttaatttttgtttccatgctctttagaattcaactagagggcagccttgtggatggccccgaagcaagcctgatggaacaggatagaaccaaccatgttgagggcaacagactaagtccattcctgataccatcacctcccatttgccagacagaacctctggctacaaagctccagaatggaagcccactgcctgagagagctcatccagaagtaaatggagacaccaagtggcactctttcaaaagttattatggaataccctgtatgaagggaagccagaatagtcgtgtgagtcctgactttacacaagaaagtagagggtattccaagtgtttgcaaaatggaggaataaaacgcacagttagtgaaccttctctctctgggctccttcagatcaagaaattgaaacaagaccaaaaggctaatggagaaagacgtaacttcggggtaagccaagaaagaaatccaggtgaaagcagtcaaccaaatgtctccgatttgagtgataagaaagaatctgtgagttctgtagcccaagaaaatgcagttaaagatttcaccagtttttcaacacataactgcagtgggcctgaaaatccagagcttcagattctgaatgagcaggaggggaaaagtgctaattaccatgacaagaacattgtattacttaaaaacaaggcagtgctaatgcctaatggtgctacagtttctgcctcttccgtggaacacacacatggtgaactcctggaaaaaacactgtctcaatattatccagattgtgtttccattgcggtgcagaaaaccacatctcacataaatgccattaacagtcaggctactaatgagttgtcctgtgagatcactcacccatcgcatacctcagggcagatcaattccgcacagacctctaactctgagctgcctccaaagccagctgcagtggtgagtgaggcctgtgatgctgatgatgctgataatgccagtaaactagctgcaatgctaaatacctgttcctttcagaaaccagaacaactacaacaacaaaaatcagtttttgagatatgcccatctcctgcagaaaataacatccagggaaccacaaagctagcgtctggtgaagaattctgttcaggttccagcagcaatttgcaagctcctggtggcagctctgaacggtatttaaaacaaaatgaaatgaatggtgcttacttcaagcaaagctcagtgttcactaaggattccttttctgccactaccacaccaccaccaccatcacaattgcttctttctccccctcctcctcttccacaggttcctcagcttccttcagaaggaaaaagcactctgaatggtggagttttagaagaacaccaccactaccccaaccaaagtaacacaacacttttaagggaagtgaaaatagagggtaaacctgaggcaccaccttcccagagtcctaatccatctacacatgtatgcagcccttctccgatgctttctgaaaggcctcagaataattgtgtgaacaggaatgacatacagactgcagggacaatgactgttccattgtgttctgagaaaacaagaccaatgtcagaacacctcaagcataacccaccaatttttggtagcagtggagagctacaggacaactgccagcagttgatgagaaacaaagagcaagagattctgaagggtcgagacaaggagcaaacacgagatcttgtgcccccaacacagcactatctgaaaccaggatggattgaattgaaggcccctcgttttcaccaagcggaatcccatctaaaacgtaatgaggcatcactgccatcaattcttcagtatcaacccaatctctccaatcaaatgacctccaaacaatacactggaaattccaacatgcctggggggctcccaaggcaagcttacacccagaaaacaacacagctggagcacaagtcacaaatgtaccaagttgaaatgaatcaagggcagtcccaaggtacagtggaccaacatctccagttccaaaaaccctcacaccaggtgcacttctccaaaacagaccatttaccaaaagctcatgtgcagtcactgtgtggcactagatttcattttcaacaaagagcagattcccaaactgaaaaacttatgtccccagtgttgaaacagcacttgaatcaacaggcttcagagactgagccattttcaaactcacaccttttgcaacataagcctcataaacaggcagcacaaacacaaccatcccagagttcacatctccctcaaaaccagcaacagcagcaaaaattacaaataaagaataaagaggaaatactccagacttttcctcacccccaaagcaacaatgatcagcaaagagaaggatcattctttggccagactaaagtggaagaatgttttcatggtgaaaatcagtattcaaaatcaagcgagttcgagactcataatgtccaaatgggactggaggaagtacagaatataaatcgtagaaattccccttatagtcagaccatgaaatcaagtgcatgcaaaatacaggtttcttgttcaaacaatacacacctagtttcagagaataaagaacagactacacatcctgaactttttgcaggaaacaagacccaaaacttgcatcacatgcaatattttccaaataatgtgatcccaaagcaagatcttcttcacaggtgctttcaagaacaggagcagaagtcacaacaagcttcagttctacagggatataaaaatagaaaccaagatatgtctggtcaacaagctgcgcaacttgctcagcaaaggtacttgatacataaccatgcaaatgtttttcctgtgcctgaccagggaggaagtcacactcagacccctccccagaaggacactcaaaagcatgctgctctaaggtggcatctcttacagaagcaagaacagcagcaaacacagcaaccccaaactgagtcttgccatagtcagatgcacaggccaattaaggtggaacctggatgcaagccacatgcctgtatgcacacagcaccaccagaaaacaaaacatggaaaaaggtaactaagcaagagaatccacctgcaagctgtgataatgtgcagcaaaagagcatcattgagaccatggagcagcatctgaagcagtttcacgccaagtcgttatttgaccataaggctcttactctcaaatcacagaagcaagtaaaagttgaaatgtcagggccagtcacagttttgactagacaaaccactgctgcagaacttgatagccacaccccagctttagagcagcaaacaacttcttcagaaaagacaccaaccaaaagaacagctgcttctgttctcaataattttatagagtcaccttccaaattactagatactcctataaaaaatttattggatacacctgtcaagactcaatatgatttcccatcttgcagatgtgtaggtaagtgccagaaatgtactgagacacatggcgtttatccagaattagcaaatttatcttcagatatgggattttccttctttttttaaatcttgagtctggcagcaatttgtaaaggctcataaaaatctgaagcttacattttttgtcaagttaccgatgcttgtgtcttgtgaaagagaacttcacttacatgcagtttttccaaaagaattaaataatcgtgcatgtttatttttccctctcttcagatcctgtaaaatttgaatgtatctgttttagatcaattcgcctatttagctctttgtatattatctcctggagagacagctaggcagcaaaaaaacaatctattaaaatgagaaaataacgaccataggcagtctaatgtacgaactttaaatattttttaattcaaggtaaaatatattagtttcacaagatttctggctaatagggaaattattatcttcagtcttcatgagttgggggaaatgataatgctgacactcttagtgctcctaaagtttccttttctccatttatacatttggaatgttgtgatttatattcattttgattcccttttctctaaaatttcatctttttgattaaaaaatatgatacaggcatacctcagagatattgtgggtttggctccataccacaataaaatgaatattacaataaagcaagttgtaaggactttttggtttctcactgtatgtaaaagttatttatatactatactgtaacatactaagtgtgcaatagcattgtgtctaaaaaatatatactttaaaaataatttattgttaaaaaaatgccaacaattatctgggcctttagtgagtgctaatctttttgctggtggagggtcgtgcttcagtattgatcgctgtggactgatcatggtggtagttgctgaaggttgctgggatggctgtgtgtgtggcaatttcttaaaataagacaacagtgaagtgctgtatcaattgatttttccattcacaaaagatttctctgtagcatgcaatgctgtttgatagcatttaacccacagcagaatttctttgaaaattggactcagtcctctcaaactgtgctgctgctttatcaactaagtttttgtaattttctgaatcctttgttgtcatttcagcagtttacagcatcttcattggaagtatattccatctcaaacattctttgttcatccataagaagcaacttcttatcaagttttttcatgacattgcagtaactcagccccatcttcaggctctacttctaattctggttctcttgctacatctccctcatctgcagtgacctctccacggaagtcttgaactcctcaaagtaatccatgagggttggaatcaacttctaaactcctgttaatgttgatatattgaccccctcccatgaattatgaatgttcttaataacttctaaatggtgatacctttccagaaggctttcaatgtactttgcccggatccatcagaagactatcttggcagctgtagactaacaatatatttcttaaatgataagacttgaaagtcaaaagtactccttaatccataggctgcagaatcaatgttgtattaacaggcacgaaaacagcattaatcttgtgcatctccatcggagctcttgggtgactaggtgccttgagcagtaatattttgaaaggaggttttggttttgttttttgttttttttttttgttttttagcagtaagtctcaacactgggcttaaaatattcagtaaactatgttgtaaaaagatgtgttatcatccagactttgttgttccattactctacacaagcagggtacacttagcataattcttaagggccttggaattttcagaatggtaaatgagtatgggcttcaacttaaaatcatcaactgcattagcctgtaacaagagagtcagcctgtcctttgaagcaaggcattgacttctatctatgaaagtcttagatggcaccttgtttcaatagtaggctgtttagtacagccaccttcatcagtgatcttagctagatcttctgcataacttgctgcagcttctacatcagcacttgctgcctcaccttgtccttttatgttatagagacagctgcgcttcttaaactttataaaccaacttctgctagcttccaacttctcttctgcagcttcctcattctcttcatagaactgaagggagtcaaggccttgctctggattaagctttggcttaaggaatgttgtggctgacgtgatcttctatccagaccactaaagcgctctccatatcagcaataaggccgttttgctttcttacctttcatgtgttcactggagtaatttccttcaagaatttttcctttacattcacaacttggctaactggcatgcaaggcctagctttcagcctgtcttggcttttgacatgccttcctcacttagctcgtcatatctagcttttgatttaaagtggcaggcatacaactcttcctttcacttgaacacttagaggccactgtagggttattaattggcctaatttcaatattgttgtgttttagggaatagagaggcccagggagagggagagagcccaaacggctggttgatagagcaggcagaatgcacacaacatttatcagattatgtttgcaccatttaccagattatgggtacggtttgtggcaccccccaaaaattagaatagtaacatcaaagatcactgatcacagatcgccataacataaataataataaactttaaaatactgtgagaattaccaaaatgtgatacagagacatgaagtgagcacatgctgttgaaaaaaatgacactgatagacatacttaacacgtgggattgccacaaaccttcagtttgtaaaagtcacagtaactgtgactcacaaaagaacaaagcacaataaaacgaggtatgcctgtatttttaaaaaaagctttttgttaaaattcaggatatgtaataggtctgtaggaatagtgaaatatttttgctgatggatgtagatatatacgtggatagagatgaagatcttaattatagctatgcagcatagatttagtcaaagacatttgaaaagacaaatgttaaattagtgtggctaatgacctacccgtgccatgttttccctcttgcaatgagataccccacactgtgtagaaggatggagggaggactcctactgtccctctttgcgtgtggttattaagttgcctcactgggctaaaacaccacacatctcatagataatatttggtaagttgtaatcgtcttcactcttctcttatcacccacccctatcttcccacttttccatctttgttggtttgcaacagccccttctttttgcctgactctccaggattttctctcatcataaattgttctaaagtacatactaatatgggtctggattgactattcttatttgcaaaacagcaattaaatgttatagggaagtaggaagaaaaaggggtatccttgacaataaaccaagcaatattctgggggtgggatagagcaggaaattttatttttaatcttttaaaatccaagtaataggtaggcttccagttagctttaaatgttttttttttccagctcaaaaaattggattgtagttgatactacatataatacattctaattccctcactgtattctttgtttagtttcatttatttggtttaaaataattttttatcccatatctgaaatgtaatatatttttatccaacaaccagcatgtacatatacttaattatgtggcacattttctaatagatcagtccatcaatctactcattttaaagaaaaaaaaattttaaagtcacttttagagcccttaatgtgtagttgggggttaagctttgtggatgtagcctttatatttagtataattgaggtctaaaataataatcttctattatctcaacagagcaaattattgaaaaagatgaaggtcctttttatacccatctaggagcaggtcctaatgtggcagctattagagaaatcatggaagaaaggtaattaacgcaaaggcacagggcagattaacgtttatccttttgtatatgtcagaatttttccagccttcacacacaaagcagtaaacaattgtaaattgagtaattattagtaggcttagctattctagggttgccaacactacacactgtgctattcaccagagagtcacaatatttgacaggactaatagtctgctagctggcacaggctgcccactttgcgatggatgccagaaaacccaggcatgaacaggaatcggccagccaggctgccagccacaaggtactggcacaggctccaacgagaggtcccactctggctttcccacctgataataaagtgtcaaagcagaaagactggtaaagtgtggtataagaaaagaaccactgaattaaattcacctagtgttgcaaatgagtacttatctctaagttttcttttaccataaaaagagagcaagtgtgatatgttgaatagaaagagaaacatactatttacagctgcctttttttttttttttcgctatcaatcacaggtatacaagtacttgcctttactcctgcatgtagaagactcttatgagcgagataatgcagagaaggcctttcatataaatttatacagctctgagctgttcttcttctagggtgccttttcattaagaggtaggcagtattattattaaagtacttaggatacattggggcagctaggacatattcagtatcattcttgctccatttccaaattattcatttctaaattagcatgtagaagttcactaaataatcatctagtggcctggcagaaatagtgaatttccctaagtgccttttttttgttgtttttttgttttgttttttaaacaagcagtaggtggtgctttggtcataagggaagatatagtctatttctaggactattccatattttccatgtggctggatactaactatttgccagcctccttttctaaattgtgagacattcttggaggaacagttctaactaaaatctattatgactccccaagttttaaaatagctaaatttagtaagggaaaaaatagtttatgttttagaagactgaacttagcaaactaacctgaattttgtgctttgtgaaattttatatcgaaatgagctttcccattttcacccacatgtaatttacaaaatagttcattacaattatctgtacattttgatattgaggaaaaacaaggcttaaaaaccattatccagtttgcttggcgtagacctgtttaaaaaataataaaccgttcatttctcaggatgtggtcatagaataaagttatgctcaaatgttcaaatattttgattgcctcttgaattcatttgctaattgtatgtgtgtgtgtttctgtgggtttctttaaggtttggacagaagggtaaagctattaggattgaaagagtcatctatactggtaaagaaggcaaaagttctcagggatgtcctattgctaagtgggtaagtgtgacttgataaagcctttggtcttaaatcttgggcattttgatttgtaaatctgaccctgagaattgggttacccagatcaaagactcatgccagttaaaaagaacattacctgtattttttatcatgtgttatctcttaagaagaggcagattagttctaaaatcaacaaattgtatttaattgaaataatttagtgatgaggaagaggtccattctagtgcctgctaaatgtataatccttcttagaatgtgaagttgtccttaaacttttaaataccttcagttaatctttatattgtcatttatgaaaaccttgaactaagacttatgtatctttcatctagctctggttttaatgcaggtagcatttaattgtccccactgtactgggtatagtctgctaaacattaaggagtagttttgcatctctccttgttctgatactagggtcaaagcccactttttatagatgggcagcaaaaggcacattggacatgctgataaatgttgccctaattgtgatctaaacatgataaaatatacatacataagtgcccttatctgctgcaagtgacccttgttttgttttggttggggtggggggtgtttgggatggaatggtgatccacgcaggtggttcgcagaagcagcagtgaagagaagctactgtgtttggtgcgggagcgagctggccacacctgtgaggctgcagtgattgtgattctcatcctggtgtgggaaggaatcccgctgtctctggctgacaaactctactcggagcttaccgagacgctgaggaaatacggcacgctcaccaatcgccggtgtgccttgaatgaagagtaagtgaagcccagggcctctcccctctttgcggccactgataggaaagcccaatctttggttgaaaggaagagagttcagcgtgcacttttacatttataaaatgggcatcaaaatgcctgtttggcagtcatgcgataagaagttgtatttgctaatgtgaataacttgagatgatttcattatctgaattgtacagtttagccattaattaggagcagtcagagtgtctgtaaccacatggcctcagttataccataaacttgaaattgtttatgtgctcacatgctacaagtgacggctcctgtgtgcctggccactatattagtatgtattgactccacttccatgttgcagtatctgaaacagaaagtaagtctaatgagaaactttgggattcccaggtcaaataccttccatatgtatgtagcaaaaacaaaatacaaagcctagaagttctgtagaaatagaactgatttttactttcattcaaactattcattatttccacaatagtaatcaaaactgcttctacttttactgctgctaaatgatcagcaaattactggatatggatatatattattttccaggaatataagaatttagaatagaactgcaagagtatgcacttaaatatatttagtgcatccagttgctaatgttttgttttaaacaccatccactttgcatgaagtctaaaccttcagttggaaaaagcctcatttttaatattcctctactgtgctgataatcctgtataacactaaaagaatagatgaatgttcacggtgctacacagaaatgttttttttttttttttttttttttttgagatggagtttcgctcttgttgcccaggctggagtgcaatggcgcgatcttggttcaccgcgacctccacctcccaggttcaagagattctcctgcctcagcctccctagtagctgggattacaggcatgtgccaccacacccggctaattttgtatttttagtagagacagggtttctccatgttggtcaggctggtctcgaactcccgacctcaggtgattgcccacctcggcctcccaaagtgccttacaggcatgagccgccgcgcctggccagaaatcttacaagttattttgcccacgattggttttaaaataattttaattttgcactatttcctttagtgtctttttctctgcatccaccaaactatagaatcatttgctgagcttataagaaatgctcatactgctcattgcaacagctagccaaatttgtcctttgctgtttaaaactctaactagcatggttttactaaatttatgttaacacagtttctctctctgggttgtggggagacaaatcaattataaataatctctttagaaaagttactctttctatatgaaagtgtgacttgactttctatgataattatgatccaaaaattttatggtgtgtacctgaccacttttacaaatgattaattggaaggtagaaattgctgattcataacatgtaacttataaacttatgatggactactttaagcataaattttttttttttttttaagacagagtttcactctgtcacccaggctggagtgcaatggtgcgatctcggctcactgcaacctccatctcctgggttcaagcaattctcctgcctcagcctcccgaatagctgggattacaggcatgcactaccacacccagctaattttgtatttttagtagagacagggtttctccatgttgatcaggctggtctggaactcctgacctcgggtgatccgcccgcctcggcctcccagagtgctgggattacaggcatgagccactgtgcccagcctgaaatatttttttaatctaccctgactcctcttgctctttctgaagaaaaatttttaaaaatgtatgtaggtgcctttaattagaaaaaaaattaaaaattaaggcaacttgtgctcatattggtaatagcatttctttcaagaactcagtaatactgcattgtctttaaagcataatatctcttagacttgacggtttgagattctaaatcactgaagaacctcttgtgaaaatgatagttttaaaatttcttttcaaaaatagtcctattgcaaaatgtttgattttcttgaagtttcctggaaactatatttcattcattgtaatgaatttaattttcattaacatagatctctaatatttttctcagctcaccacaacctccacctcccgggttcaagtgattctcatgccacagcctcccgagtagctagaattacaggcacccacccggctcatttttgtatttttagtagagacagggtttcaccatgttggccagattgatctcgaactcctggcttcaggtaacccacccaccctggcctcccaaagtgctgggattacaggtgtaggccaccatgcccagccagcttttccataattcttataaatgccaatgcctgaaatggaatctgacatataaaaaattacatgaagaacttttattattttgcatttgaaaaccatgaaaaatagttggaccagagtctcagaaagcttgtagtttgttagtttaactgctctaaatgtcaggcagatacaaaactattaaaagacatgcttcaaatatgaagacaatttaaaagcacagctgtacacttttgctttttgtctagtttcaaggtaaagatgaataatcatttagataatgcttaagctatgcttatgcatacttagagcaattctccaaaataaaaaattttaatacttaaatacatgattaaaatagacacgtatccaatgtcaatacagactttactcagaaatagcttttgaagtttcttctaccccataaatagattttattttatggctggcagaaatgaaaattacaactttttgccaagaacagagaatagaataatctcaaattggggctgcggactcagttttatgttcaaagctgtgtgaacctcatcactgagttcttacaaatccctgtgtccacatgctccaaaccacccactgtgagttcagaaaagaactctgagtgcatctttcagtaggaaagtaaaaactgatttttacatttcctttgagccaaaccagctgtttcttctttaaagatttccctttgagatttccattttatgactaagtctaaccagtatttttttggcaagtaagagttgtgggagtgtatctgtcatcataaggaaatcaaagccagaaatgccttctgccatggtgggtgatgttaaacatttcaaggaactttatattataaaaattgtcaaacataaaaggaaaagtgcaatataatgaattccatggacccatcacacagcatcaatatttatcaacattttatcaatattttttcatatatttttcccacatccactcccactagtgtttgaaagcagaagacagataacttaccatcttacctgttaacatttcaggatgtatttctaacaggtaaagactttatcatttaatatttagactgtgtttgttcaaattatctgattagattctatttcagaaaacacacacataaacaaaaatgataatgagaaaaagaaagcccttccacatgattgacacttctgagtagtgtgatcccagttcatgtccattgtctgggatagctattaaataaaacttcctctcataaaattctctccatttagaagataaattctgtgattcacaagcctctttttatttataatagcccttcccctttctttatgaatttgaatttgttttttaaagaaactgtgattttctctgtaaaattccccacattctggatttggccgatttcatcttggttcttttgtttactttaacctattcctctatccccagtatcttctgtggactggtagtttgactggttctttttcttttctttttttttttttttttttttttttgagacaggctctcgctctgtcgcttaggctggagtgcagtggcccaatctcagctcactgcaacctccacctcccaggttcaagctattctcatgcctcagcctcctgagtaactgggactgcaagcatgtgccacctcatcctgctgatttttgtacttttagtagagacggggtttcgccatgttggccaggctggtctggaactcctggcctcaagtgatccgcccaccttggcctcccaaagtgctgggattacaggcatgagctatcacgcccagctgatttttaagtaatataagtatgtgtgcatgtatagtatacattggcaaaaacacttcataagtagtgctaaaatcatcttatttatatacatcaggagacacataatgtctgtttgtttcccattttagtgatattaagagtgtttagcatgtttagttgtcagcctgatccatcattatgttcttcatcaaactttcaccagatagtttcacatcaattgatgatcattgcctgtttctattattttgttttcaagttgacagttttctctcacttgatgttgtgtaaatttagttatataaagttaaattattttgctattttttctatgctgtatacatttgaataactgacctaatttttactttaaaaatattttacaattagaagtccaaatagtaaatcaaaggttaagaatttttgcagaaatctgttatatagatgacattttaatatttgccctttatatcatttaccatgagccaaatttcaagtcatattaaaatgactgtcatgtgctaattctaacaatatttgaaagacccctatcaaaataaatataccttttagtagccactttattagaaaatcaactttaagttattcccccatgtttttttctaattgagatataattcacataccataaaatttacccttttaaagtatacaattcagttgtttcagtacattcacaaagctatgcaaatgtcacctctacctagtttcagaacgttttcatcattcccagaaggaaaccctgtatttattaggcagtcacttccccttctccccttcttccttcctctaagtggcaaccacaaataaacattcagtttctctggatttacctattctgggcattttgtattagtgaaatcatgtatttggcctttctctctggcttctttcatgtacctcaatgttttcaagtctcattcattttattaaaaaaaaaaagtaccttttttctttttcttttttttttttttgtccacgtatatattcacaccacattttttgagacagagtctcgctctgttgcccaggctagggtgcaatggtgcaacctcagctcactgcaacctctgtctcccgggttcaagtgattctcatgcctcagcccccaagtagttgggattacagttgtgcaccaccacacccagctaatttttgtatttttagtagagacagggtttcaccatgttggctaggctggtctcaaactcagcctcaagtgatccttctaccttagcctcctaaagtgctgggattacaagcatgagccactgtgcccagccacattttctttttccatttattagttaattgacatttggatcgtttctactttttggcgattataaattatgctgcaatgaacatcggtgtacaagtttttgtgtgaacatgttttcagttaccttgggatatacacctaggagtgacattgttagtaatatggtaactttatgtttaactttttgaagaactgccaaactgttttccaaagtagctttatgcttttacatttctgccaacaatgtatgaaggttccagtgtatctccacatcctcaagaaaatgttattgtctttttaattgtaaccatccaagtgggtatgaagtttatctcgtgattttgatttgcattttcctaatggctgatattgggcatcttttcacgtgtgtattgaccatgtatttttttgagaaaagtctacttatatgtttttaattgtattatttttagagttgtaagaatatgttatgttgatacttgaactttgtcaaatgcctggtttgcagatattttctcctatcccacaggttgtcgcttcactttgataatgtccttaaagtacaaaagttttaaattgattttgatgaaactcaatttctttttaattggcagcttgtgcatttggggtcatatttaagaaatcattgcctcattcaagatctgaaagatttacacctatgctttcttctcagagtattataactttagttcttacatttagatttttaattaatgttgagttaatttgatggtgagagataagagtccaacttcattcctttgcaagtagctgtccagttttctcagcaccatttgttaaaagactgttttttttcaattaactgaccaagatgtatgggtttatttctggactcttaattctgttaatctgcatgacttttcttatgccagtaccacactgtgctgattcctgtagttttgtagtaaattttgaaatcaagacaggtaagtcttccaactttgtacttttgcctaccatgtttcttgggtttccatatgcattttaagatcagcttctccgtttcctttctggatttttttttttttttttttttttttttttttggtggagctggagtcttactatattacccaagctggttttgaactcctggctaaagagatcctccctcctaggcttcccagagagctggggttacaggcatgagccaccacatccaacccccttctgggactttgactggggttctgttgaatctgttggtcaatttggagagtattgatatcttaacattaaagcttccaatttatgaacacaggctatttttccatttattcttaaatttctttcagtaatgttttggatgaaacatgtacaaagtcctgcactttttattttttttaagacagagtcttgctctgctgcccagtccagagtgcagtgctgccatctcagctcactgcaacctccacctccgggttcaagtgattctcctgcctcagctggaactacaggtgcgcgccaccatgcctggctaattgttttgtgtttttggtggagacagggtttcaccatgttggccaggctggtctcaaacacctggcctcaagtgacctgactgccttggcctcccaaagtactgggattacaggcatgagccaccacgcctggcctgtacttctgttaaaattttttctatgtattttttttatcctattgcaaaatcaaattttttgttgataatatatggtcataaatttcatttttatatattggtctcatatcctaccaacttgctgaactagcttattagcactaactttttttggtagattccttaggatttgctgcatacaagattatgtcatctacaagtagagatagttttgtttcttcacttccaatctgggtggctttatgtttttttcttgcctgattacccagttagaacttccagaaaatgtcaggtacaattaacaactgcaaacatccttgtcttattcattttagaaagaaatttttagtttttcaccattaagtatgatactagttgtaggttttgtttaaaaaaagactgtgtcaagttcagaagttcccttctgttgctagtttgttgaataattttatcacgaaagggtgttgaacttttctcaaatgctgtggctacatctaatgaaatgatcatgcgttcttctcctttattctattaatatggtatattatattgattcatttttatacattagattaacattatatttctggaataaatcccacttggcctcagtgtgtattactttttatatattgctggagtctgtttgcaggtatttcattgaggactttcgcatctctgttgataaggtatactgatctttagttctcttgtgatatctttggttttggtgtcagagtaattctgagttcacaaaatgcattgggaaatgttcccttctctatcttttggaagagtttacaaaggattggtttaactcttttttaaatgtttgaggaaattctctacccctgggctttcctttgtgggaatttttaaacatttttaaaatagattatttttaaagcaattttagggtaaaagcacattgaatgaaaggcacagagcttccttaagtacatgctgcccctgtatgtgcatagcctccctcattatcaacatcctttaccagaatggtacatttgttgcagtcaatgaacctgcattgacaattgtcgatgaaagttcatagtttagagttcacctttggtgttatgtattctgtgagtctggatccatgtttaatgatactcattcaccattacagtatcattcagagtaatttcactgccttaaaagtcctctgtaccctacctatttttctctcctaccccactaacccttagcaaccaatgatctttttatctcaataattttgcctattccagaatgtcatatagttggaatgatacagtatatggagccttttcagactggtttttgtcacttagtaataagcttttaaattttccaccatgtcatgatcgttcatttcttttcagcattgaataatattccattgtctggtttatcacagttgatttatccattcacatagtgaaagacatcttagttgcttccaagttttgacaattatgaataaagctgttataaaagtatgtaggtttttgtgtggacaaaagttttcagctcctttgagtaaataacacagagcacagtagcttgattgacagtaagagtaagaaatattttttctcagtctgtgtcttattttttcattcacttgacagtgccatttgcagaacaaacagaaagttttaattttaatgaagtctaggttatcagttaattcatgaataatgtttttggtattgtatctaaaaagtcaacaccaaggtcatctatatgttctgtgttatcttccagaaattttatagttctgcattt

SEQ ID NO: 439 - DNA, 103785 bp, Homo sapiens
ctgccccagcctacctgggccccctgtcacaccttcatcaaatagaaacccatttatgtttcctactgagatacattcagatgccactaactgtacaaatccctctgtgttctgacccctccctccctgtgggctgctgatttttcagctttctttttattattgccaccctgaggagcccttttcgaccattcttcccaattgctctccctacacatggaattgtagtcccacagacagcctgtttgtctgtgtgcatagctgtgctctacacatacgagggaagctgtggcttcagaggggccagtgcccaccccctttggtgatgctacctcacctgtgtcccccggcttctcacccgcctggattctcacctgccagcctcactttccctctgacccccccacacaccagctctgcgtcttctcacctccatcctctgtctttcacttgtattgagataacattttcccatagttatcagagtgctataagttccctggggagcatccggataataccacacatagcagaaatcaaagacctcctgtgtgcccctcacgcagaaacattgaaatcacagctcttggcagatttcctgtcacttgccagttatccatgtacctgggtgctcagtgacatgatgatgtgttgcaggccgactggcgtggaccacatggcttccccactggttcaaacgtcacggagcaggttccccccgctagtcacggagaccagggggcagaatacagcagttcctggatgccgccttgtttctgtaagacagatttcattctatttcagtggaccatttaggttctgtattggaaaacaaacaaaaacaaccttggcacttccaagtgaaattagtaacatgagatctgagtagctgtattcaaatgccttcataatctgtttccagaaagtaaatgaatggcttatgagaatttacagggagtgagaggcttaattcaccgttttgtgaaataaaagcatgtcttgaactaaatcagaaattccaggtgtcaaggaaatctctgataggatagtggagcaaagaagagagcatgaaatttggtcaggagacaggcaggtccgcgtggatcctgccacagaaactctcttctatgacttggtgcaagtcactttaatctccctgagccttagtgttctctgtaaaaggggattaatgattcttacctctaaagaattgttagaaggacaaaatgaactcataggtgttaaatgattcctgacgtgaaattatgagctcagtaaattaggaccctggtcatttctatcggtcatttttacagctaacctttgctatgtctattgcagtggagggcaataccttctgcagtcagactcgcctcggccaggcagtcaggtctgcggggggtgtgctgtggccagcatgcatatccaggcagcccccaggtttacagccacccctcactccacttcacacaagtaacttgtctctattcattttatacaacacagaaggacccctgttgtaggaacataaagacatagtgagagaaaaaccctacctggggccaggttccctcctgcatgccctgtgccaccttgagcccagcactggaacccattcccagaaggcaagagttgcaaagtgttcatgtttaaccttagaataacatcattttacaaaaggcagcggagtgcagtggctcacgcctgtaatcccagcactttgggaggctgaggtgggtggatcacgagggcaagagttcgagaccagcctggccaacatagtgaaacctcatctctactaaaaatacaaaaaaattacctggatgtggtggcacgtgcctgtaatcctcactactcgggagactgaggcaggagaatcgcttgaaccctggaggccaaggttgcagtgagccgcgatcacgccattgcactccagcctgggtgacagagcgagactctgtttaaaaaaaaaaaaaaaaaaaaaaaggcaaacatcacattaaaaagtctgctacttcacaaatgcagaattacattttcttaaggttttttttatctctctttccctattatgacactataattttatcaggcttaatagtgcagttacataatcaaaatatatttcttcaggtatttatccttaggagacctgatccttagtaatgtctaactaaaagtttccaaatagatgagtgaacgattgagcatgtcgagattttcttttgtgtttttaaggattgcatttattttaaacaagaacatactatccttcatttagtacagaggaaggcatctacaaaaccgtgtgttgagtgccatgcctgacggtacagaacgatcgcgtcttcgagaaagaacagccaccctggaacggttgtcaaggcccagcacaacccacacgttccgggtgggttctctgtttcctgtaactttaattttgaaaaacatttgaaaaaaatgaaacttgtccctgattttatttttcttccagcagtcggatacgcctcgaaaaagttcattgacacaaatggaatttgctgctcacacatggacaggtcaaagtattttgacaggtcagcttttctccatatgtaaataaagtgatgtagtaagtgagatttcaagtttcagacagtgaaatggaagatgatctaccttgataagcctattttgctgtaggagggaatagcaaatgtttggggcctgtggcctgacctcagaaacctcgatcacagagcacacctgcagagacttacttacctgctgtgaggtcaagaagaggggaatgtccaaaagctctcaatgaactgggggcctcactcaaaaaaaaaaaaaaaaaaaaatgctgtcttaggagcagtgagtacctctgtctgctatagcgttttcatgctctatttctaagtgaaactctactctcagattctctttgaaaatctgatgataaaaatgcttgagaaaattaacacagatttgctaattactttataacacaaggttttacagataaataggtattctcagcctggtatgctgtttgcaggatattctagtttgaatacgggccagtgatgtttccagttccagaacagtctccaacactgttttcaaggcgttagtgtggcctctggagtctgacgttggatttccaccctcgctctgccaccggctgtgcaaccctaggaatgtcccaacctctctggccctcagcttcctcttttataacaagcagggtacataaaatcattattggaaaactgtgaaaaggatctagctagataccaggcatgtattgctcagaaatgatgaattatgaaccatttgtattataaataacctgaaatttcagggataatttattgttttacagggaattttaaacatataattctaaaaataaatttcgtaacatgtaagcattgcgtagcacagatctgtcgctgtccacatcagccctcctgtcgtcctgtagcatagtgatgtagcatagtgatgtcgagattcttcagctctgtaaagttctgctcctgcgctagtcgctctgggctgctgggcctttttgttgcttttcttgtatgttccttagcagcattagcggtcattcacatgtcaacagctcgttctctaaaaagcagccatgctacatggtcaggtgttgcttttatttatttatttatttattttgagatgaagtctcactgcgacgcccaggctggagtgcagtggtgcaatctcagctcaccgcaacctccacctcccaggttcaagcgattctgctgccacagccccccaagtagctgggattacaggcacatgccacgatgcctggctaatgtttgtatttttagtggagatgaggtttcaccatattggccaggctggtctcaagctcctgacctcaggtaatccacccatcttggcctcccaaagtgctgggattacaggcatgagccactgcgcccagcccaggtgttgcttgtaacacgattgtaggtgcttggggggaagtaggcgcccaagttagcttatcaatcatggatgggtgtatcaagtgctcactctgtgccaaggtctatgccaaaggctgggattcaaacagcaggggtgtttccgtctgtgcctcaaggagcattgagcctggcaggcaagctggaaaaggctgtgagaggggtgagcagcaccacctggatcccctgtcagatggctggagggtgccgaggcttcctagaggagatgaccatcacaagggatgtgagagagagggagtgagggctgacagatgactctctggatggccagcggcgggtggtgctgagcgagggaactggggaaattctgacgagttcacttttggggatgctgactacagcacgccgagtggaggtatctgggaagtagttggagcacacgtaagtagaggtttggagtgggaattgggttctgaatttgttctaaatctcactgttaatcattgaccaaatgccaagtcagtgtattctcttatcagtaactttttttcctttaaaatatgctagtcattgtttctacaattataaaaaataatacattatcgaaacagacaacttacaaaacacaaaaatccaccaaggacaacacagccaaggcccctgatctcacgacgtagagagaacgcggctcaaaggcgtgacctgtgatgttggtgcaatgaggcgcgtgccccatgcagacgtccccaggccccaggtgaggcacatgtggcctcacacacggatttgagcttgggagcgggaggcctaagtcttatccctcaaaagtcttgtccctcaaaaatggaaagctctttctttcctcctgagcactctgtcaacgtcagcccaccacgctgctcacacagggagtcgcctctctggccaccagctcaggcagcacaccacgatctaataggacattcaggaatgaattaaaaaccagagtggattcatggtgacaccttcggcatatcactcactgctttctggaagaggaggtgggggtagagctggtatcgggggactgcagtgacccccactgggggcgtccagaggagttacattaacacgtgcaatcacatatggccacttaactcatgtaggacccagggaacggtccatgccagtcatctgcgcctcactgcctcttaactactgacccaagacaaaagagctattagaagagagaatgcagccaaccaaatgcacagctccaagaggttttgcatctgtaacaacaagctaacatttagttctttggttcaaaatatttcccctccttaaccatttttttaatgcttcaaagttcatccccatttggggagtgggaagggtatgtccaggccccctcaggatcaggctggcttttcttcctttccaccaggtgcacaggcaaaactggccacaggggactccctggagctccatgcagctcggcagggcctgtgcagtccggaagggagggcagagatgcccagggctgtaggtgccggcctgtgcaatccggaggaggccatgcctggtggtcgtgagagacacgggccttggcacggaagtcctagctctgctgctgggtgctgtgacaccaggcattccctgtgggtctcagcttccatacctgtaaaatgggaataacacctcacttaaggactcctgaaataaaacacggagcagataacgcagtgcctggtgcataacaagcctcaacatatccaaggactcatcctgatcacccatgagcctacttaaggtcaaccctgcctcatttaaaaaacaaaacaagactgtgccttcaagttcaggtaggggtggccctgtccggggccaacccccgcctagaaccagccaggcttgtgctgctggagaggaatggccaagccaaggcactcgggaccagcactgagcagcctggtgagctctaagcccgcagagcaggcagggcccccgacaggcaggtggtgtgcaggggtccctggggcaccaagggacaggaaacctcaggagaaggaggccctttcacccgccaaagtggaaccttccccactgaacaccggatctcccagcactgtctgaccttcagtcacattttaaacactgaacagagggacagagggacctgtgttccttgatgtttcatctttgttcatccatcggtcgtcctccaaaccaaagtccagaagcttctgcactaatttcgaagtcaggctgaaccttgagtcatgaacaaaactctttcaattttcctctaagtcttcatggagctcatcataagcaggatcctcataaaggaatttctgaatcattccaatcagtgattctaagaaccacatctttctgcggtccttctgagtggcccagctgtgcaagagacatccccatgcaaaagcaaagccttgatagcacctgatctcaggccggatgttggctccgtgcaccctgcggtgctgccttccttcagtgacgcccacgctcctgccttcctcccagccttcctgatgcccttccccatgtaaccccgcatccgccttcatgatggcatccaacacggcccggctcccagggtcaggcccagacgcaccgcttcagaggatgagctcttatcaggaactctgagacagctactattgatggtcagaggtcttttctatatctgcagaagtgatcgagggtccataagagggatcttcctgtctttctgagggtttgttttctttttctctgacaagcaggcacatgacctccttgctacctttgcgtccaggtcaaaaagcactgggaactactaacttatcaacttttattatttctgtgatagaaaaaaaaaggagccaaaggggtattccaggtagtgggaaggatcccttaaagtacctggcattgcacctgcccctgggaagcaggagagctgccaggaagtagtgctccctcagcctcctgggccaggacccgcctctgcatggaagcttctcgtgaatccaccagctcgggaggacgcgtggcctgcacctccgcttgattttgggggagcacacttccttttccttaggaccctaataggcagtttttgcatatgactatttcctaatttatacaaaagtgtattaaaataaaatatatattttaaagtatttgcatggagtgtacaaaacaatcgttctgagtgggtgcctttgtaacattttaatgagaattaccttttgcttggtgtttccaggttcacaatatgtgcctaaatcttttcagaggacaactttgactttcaagaggagattccaagtgacatcttgaaaccacctcaccagaaccattggagcacctgtggcctcggcacactgcttatcacttgaaaaatggaggaacaagtgttatatttatctgtgtgtctgacagtgtgagatgttagaccgagagaaaagcaaacaaataaatcacttaatcttgaacactttgcactgtaaagagagtgaaagtcaaacccaccaagctgccttgctgaaagcatctccaaggttctgtaggctttgttcagaagcccctgatgtgtgtttgcagtccgtcattttatcaatgatacgcaaacataattagcatgtgtatgtactcacacactaattacatgtaagaatatattatctaggaatatgtcatttgtaactttgtactctgacgtattttctagtctcaccctattagtaattctgtcaaaatcctagacgctagtagatattagtatttgagacaatatgtcagagtctgaataagactcagcttgttctagtcatgctgagtttctcatatattttttaaaagtgcttccgccatgaacctctttgagaaatgtcagtggcaaaatctcccaagctaattttctttttctatgttccatcttcaaattcagacagttcacgtgaagtaccccacatttattgatcttagggttgaatataaacgcaattaaaagctatggcaggtgatgtcatctttattgtttacagtcgaagctcctccatgggaggggagcctcccaccctccacgtgccatcaggagctggcctttgcccagacgccaccactgcaatgacaccttcccagagccctcgtctcctcgcgctctgtcctgctctgcctggcttttcttcagagtgtgtttccccatctgacattactgtagaaaatggagcagagaacaggaaggggaattagcagagatgaggctccaggcatgtcttcctcttgtccctctccccactgtttctcttgattgtgattcaagtccttacactcatttttacattctcaaatctcaaatcagctaatttcctcttttctatcagataattgcatttcatcagtctaatttttactaatccaaactgtaactttataaggctatatatatgagcatatttataaacttagatttataaactatatacacacatatatgtatcatataaatgcataataaattactttcagactatttctggctgtaaggagaagggatcattgcctactagtagatgtctgaaattttaaaagatgtgttgagactaacattaatgttgtcctttatcacagggtgacaaaaatgacccagagccttgcctctgtttgaaaatttctccttgactttgctgactccatttcttttttcttttctttttttttgaaacggagtctggctctgtggccccggctggagtgcagtggcacgatctcggctcactacaacctccacctcctgggctcaagcgattctcctgcttcagcctcctgggtagctaggattacaggtgcatgccaccacacccagctaaattttttttgtatttttagtagaggcagggtttcaccatgttagccaggccggtgttgaactcctgacctcaggtgatctgcccacctcggcctcccaaagtgctgggattataggcgtgagcttccgcgcctggccagctgactccatttctatagcaatgagacacattaggcagcagcagcagcagcagcagcagcgaccaccaggtccatgcctcttttccgtggtcacagctccatgtgtccggggaagattgctaatgcttagtttcctgcacaaagcaaaccaaagcatttttgagaattttctacattattcctaaacattagcaatagaaacttttaagagcaaatgccagtcttaattcagcagctctcccacttgaggaatagttagatatgtgagtagcctggagcccatgttatagggctgctggttaggtgctctctggtgcatcattactgctcaaagcatgacccacttgctctttcagatccactcagggtattttatgtccatttccaggaaccatccaactccttccctattcagtccaaacttcctttttttttttttttacttgaagttcaggggtacatgtgcaggttgttacataggtaaacttgtgtcgtgggagtttgttgtacagattatcacccaggtattaagcctagtatccattagttatttttcctgatcctctccctccttccaccctccaccctttgataggccctagtgtgtgctgttcccctctgtgtccatgtgttctcatcatttagctcccacttagaagtgagaacggatggcatttgtttttctgtttctgcattagtttgctaaggataatgacttccagctccagccatgcctctgcaaaggacataatctcattcttttttatgagctcaagcttcgtagtagggaaaacaccggatattcagtctaaactaacattaaggtagggtatccaagataaaatgttttttctttgaaaaccactgaatatactttatggtagctttaccttgtttggctccagaggtttgcaaataagaatctattatttatatatatatattggtaaaagacaaaatattttttaaaaagtgatcttgagtcttctaaacattaaattggaagataaagtgccattttagagattacatagagacttggccctgtcattgattttaaaaatgaccttctcattgcactgatttttactccatgttaaagttagtattttatttatacattaaattagatttagagattagtaaataatgcttatatcaaggatggtgctttttaagctaattaggtaaaaattagggcagtgttttataatctactttaataaatgagtcttaccttagaattaatctattaaaaattaaaaaagaaaaattgaactacttctgagatagatttttaaattcagattagtgaattttacactaattgaattacattaattaaaatgcctgttagtttatccaaaaccaaagaaagaatgaagaaattttaaaacaatctaagaaaatgtaaaataccatagaaaactgctagattttgtgaatttaatataaaaggaagtatccatattgatattattctgaactagatggaatttctacaccaattcagaagtacgtttttatatatcatttggatattatattttttattgttttattataactacagatcattgtgtaggatttttgattccttaatttctaataaaatataaaagtgttaaaagagttttcaaaaatgtgtaacatttataaaagtatttttagattcccaatttttgtatcatttgtgcaaatatctctctattctgcagtttctaatacataggtatttattatttctaactacatagtaaactttccccagtaaattctaagtatatgtccatatatatttgcaaaggctttacataatttatgaatactccgttgtaatgtttgtttcagaagattatgctcctgtgtggtaatcatcatggatttgatttcatcaaacatttattaagcactttcttggtgtaagattttgttctaagcattatagtgaacaagacagtctttggcctaaaagaacttagattgtagtggaggcgacagactataaacaattaaataaaaacatgatacaggtcagttagcaataagtgctatgaagaaacaaagcgaggcaaggtgacggagtggaaggagctgcaactttccatcgagcggctggggaaggctgtgttgcagaggtgatatttgagcaaaccccaaagaagatgagaaaagaagcctgggagatatctggggagaaagaactgtagacagagcagaaagcatgtgcctaaacaagagtccacctggaatgtctgaagaacagcagagaggccagttcatgggatgcgcttggcaagggagtgaataatgggagctcagtgagctaacaggagctgagggactgaggtcccttttggactatgggaaatatgaaataagaagccactggagcagttgagttttggggatagaatgatataatcgacaagagatgatcctgtttcagtcagatgatagtggtaaggctgatgagaatcccaggactttgcatgtgttttgaaatttgagccaaaagatgtgctgttggatgagaggtggagtgtgtctaccaaaagaatcgagaatgcctccaggcttttggcttcacacttggaaggatggtgttgacactcactgaaattggaaagactgcaaggggaacacgtttggcagcatgaggggcaagttatgtgtgagatgccaattagatgcctaagtggagatattgagatatttggatatccacacttgggtgtggaggtgaggtatagactggatgtataaatttggggattgtcagcacgtagatggtatttaagaactgaaatggatgaggcaaccaagaaaatgagtgtagagaaatggaggaaaaagaagtactgagccttgtgccttttaacatctaaaggcctgggatgtgaaggaaaaccagcaaagcagactgagaaagaatggctggtgaagggaaataagagtcaggagaatgtggcgtcctcaaagtatgtgtgtgtttgtgcgggggaagtgtttcaaggaagtgatagggactcaagtatgttgaatgctgttgatgagtcaattacgatgaggtctgagaatcagactaaaggtctagccacatggaagttactggtggccttgacaagatctgctaggtgaatggacaaggcgaaagtaggcttgcagtgggtttgggagaaaagaagaagagagaaatccaagacagtagtcatgggcaagtcttccagggaatttttctgtacaggggagtagagtatgtgtgtgtgtgtgtgtgtgtgtgtgtgtgtgtgcatgcacgtgtgtttcctagtaaggttcatcttgatgaatgtcattattcagtataaaaatgttgatccaaaaaggaagatagctctagtgttctctggaggacatgcagagtgtattcccactggaaaattaaagaaaaagctgacagagctgagtgaatagtaagttataactcagaagcaacattcagagaaggctacaccttgtgaaggatgtcttcagagttcacaaaaagaacattgtgggggtgaaagttttagcttagaaggcaaaagatttcaaaaatatacagaatcaaaatgatgttaaaaataaacatggaggcattccactactgtttatgaaagaatagttcatgagcaaactgacctactgagaacaactataaaagctataaatggacaagaaacagctctttggaggcacgcgtggacacccacatccacacccacccagccccccaagacaaagcagcacaacttcaggaaacaaattgggagacaacaggaataatacattgagatgaaccccatatttgctactgttttctttccctgtatcaatatattttagattagtaatggggcatagaggccaagaaaaagggataccctcaaaatttgtgacaagctcactaggctgccaaaaggaatgatgttgggaaatgtctcagactttgaattgataatcttgaaggactacactctaggagtaagggcaagcttaatacagacaagtcctcaaaacactagaagcagaacctagaatcaatgaaacctctgtttagatccaggttatatgcctgtactttatatgaccaccagaaaaagtatcctctttaaagaaatatagcatcacctagaatttctattatttttatatacaatgtacagcattcaatctaaaattaagagacagcccaggatatagggccaagtgactgaaagccaagagagaaaacaaaattataatggacccacacgtgattaaaatagtagcactatcaggtacaagctaagaaacaatttgatttgcacattcaaaaatatattgaaaaacaatttcaagagagaactgtaatctgaaaaataatcaaactgatatcctagaaatgaataatacaatgactcaataattcactagctgtgttgaactgcagattacacatagcagacaagaggcttagtaaactggaaggcaggtcaatacacagtattcactttgaacaagcataaaaaatagatattccttaaaaattgtgaggccatgtgaaaaaatctcatatccgtgtaatgatagtcatagaggagaaagagaatagaacaatgcagtattgaacagataccatgaaagaatcttccaaaaatagatagaagacatcgatgcagtcatttaagaagctataagaaacacaagatagaaagcaaaacatactcaggtccatcacaaactgctagaaaccccaaatcaaaaagaaccaaacagcagtcagagggaggggggaaagactcattatcttcaaagaagcaacaataagactaatatttgacttttcaacacaagtgatggaagctgaaagacaatataaaaagcatctttaaagtgctgaaaaaaataattgccaacccagaattttatacgtagtaaacatatacctcaaaaatgagggcaaaagagcagtattttcagataaaccaaaattgggaatttatcaccggcaaatctgtactaaaggaaatacaaacgagagctcttcacagagtaggaaaattatcccagaaggaagtacaatgataaaagaagaagtaataaagatcagaatgtatacatacgtgggaaaatagaaaagaatacttactgtataaaataatgagtaatacagaattcagtatatatttgggattaaaatattatagaaatagcttaaaattgggaagggtttatttgctgttaaagtgttatagattcatcattgtccaggattactgttctaaggtagagttttataaagcagtgcgtgtgatatagcgagatgaaggcacaaaatactatcaggaatgaaaataggcataccactgctgattctatagatgtgaaaaaagataagcattatactatgaataacttgatttggtaatttagatgaaaattaaaactttgaaaaaatcacatcactcaagaagaaatagaaaatttgaaaagggttatgtctattataagacttaaatgtattattaaaagccttctcacaaagacaactccaagtcctgctgacttcattggttaatccttccaaatatttaaggaaaaactaataccactagtagcaatatcaaaaagctcttcaggcctgggcatagtggctcatgcctataatcccagcactttgggaggctgaagcaggaggattgcttgagcccagaggctcgaggttacagtgagttatgatcacgccactgcactccagcctgggtaacagagtgagactttgtctctctaaaaaactaacaaaaaagttattcaagatgattgtcattttgtaaggctaccacaaccctgatacaaaacctaacaaggacattacaaaaaaaaaaagtaaattacaataaagtaactgagaattataaaaaaaaaaaaaaaagcgaattataggccaatatcatccctgaactcccaagcaaaatcaaatcagtaatatatgaaatagataatacgtaccatccaaattaaatttatttcagaaatgcaagtttgatgtaccatgtgaaaatcattcagtgcaacaaatgatgtaaggaaacaagcatgggatcttctcgaaagatgaagaaaatgtctttataaaaattcttagtcaaccaggaagataagaatatcactgttatctcttcatgagtatctaggggaaaaaaacaactgcaaactgcatacttagtggtaattttattctgattttacttactgaagaagctatacttcctgagatcagataatacgaagtgtcagctaccgccactgttattcatgatacagaatatattttccaccccagcagggcaagattaaattattaaagggtcttaagatttaggaagaaagaaacaatttggtttttcacagaaaacatgattgtgtacatagaaaatccaaaataattacaaacacacttaaaaatgtgatttaacaacatcattgaaaacagtcaatataaaaattacgtgcatttctatataacaacagataatacaatttataaaaatacaatataatagattcaaaaatcaaatacctaggaataaatttaataaaaatgagtatattagagttcttcagagcaacaaaattattaggagatattagattatgtaatataatgtatatctggagggagagagtttttcttttttttgatttgagtgtattttattttattttattttttattatactaagttctagggtacatgtgcacaatgtgcaggtttgttacatatgtatacatgtgccatgttggtgtgctgcacccattaattcgtcatttacattaggtatatctcctaatgctatccctcccctctccccacaccctatgacaggccctggtgtgtgatgttccccatcctgtgtccaagtgttcttattgttcaattcccacctatgagtgagaacatgtggtgtttgggtttctgtccttgcgacagtttgctcagaatgatggtttccagcttcatccatgtccctacaaaggacatgacctcatccttttttatggctacatagtattccatggtgtatatgtgccacattgtcttaatccagtctatcattgatggacatttgggttggttccaagtctttgctattgtgaatagtgccgcagtaaacatacgtgtgcatgtgtctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctctccagcacctgttgtttcctgactttttaatgatcgccattctaactgctgtgagatggtatctcattgtggttttgatttgcatttctctgatggccagtgatgatgagcattttttcatgtgtctgttggctgcataaatgtcttcttttgagaagtgtctgttcatatccttcgcccacttgttgatggggttgtttgatttttttcttgtaaattagtttaagttctttgtagattctggatattagccctttgtcagatgggtagattgcaaaaattttctcccattttgtaggttgtctgttcactctgatggtagtttcttttgctgtgcagaagctctttagtttaattagatcccatttgtcaattttggcttttgttgccattgcttttggtgttttagacatgaagtccttgtccatgcctatgtcctgaatggtattgccaaggttttcttctagggtttttatggttttaggtctaacatttaagtctttaatccatcttgaattaattttttataaggtgtaaggaagggatccagttccagccttctgcatatgggctagccagttttcccagcaccatttattaaatagggaatcctttccccatttcttgtttttgtcaggtttgtcaaagatcagatggttgtagatgtgtggtattatttctgagggctctgttttgttccattggtctatatctttgttttggtaccagtaccatgctgttttggttactgtaggcttgtagtataggttgaagtcaggtagcgtgatgcctccagctttgttcttttggcttaggattgacttggcaatgcgggctcttttttggttccatatgaactttaaagtagttttttccaattctgtaaagaaagtcattggtagcttgatggggatggcattgaatctataaattaccttgggcagtatggccattttcacaatattggttcttcctatccatgagcatggaatgctcttccatttgtttgtgtcctcttttatttggttcagcagtggtttgtaattctctttgaagaggttattcacatcccttgtaagttggattcctaggtattttattctgtttgtagcaattgtgaatgggagttcactaatgatttggctctctgtttgtctgttattggtgtataggaaagcttgtgatttttgcatattgattttgtatcctgagaccttgctgaagttgcttatcagcttaaggagattttgggctgagatgatgggttttctaaatatacagtcatgtcatctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgatattggctgtgggcttgtcataaatagttcttattattttgagatatgtcccatcaatacctaatttattgagagtttttagcatgaagggttgttgaattttgtcaaaggccttttctgcatctattgagataatcatgtggtttttgtctttggttctatttatatgctggattacatttattgatttgcatatgttgaaccatccttgcatcccaggggtgaagcccacttgatcatggtggataagctttttgatgtgctgctggatttggtttgccagtattttattgaggatttttgcatcgatattcatcagggatattggtctaaaattctcttttttgtatgtgtctctgccaggcttcggtatcaggatgatgctggcctcataaaatgagttagggaggattccctctttttctattgattggaatagtttcagaaggaacggtaccagctcctctttgtacctctggtggaattcggctgtgaatccatctggtcctggactttttttggttggtaggctcttaattattgcctcgatttcagagcctgttattggtctattcagggattcaacttcttcctagcttagtcttgggagggtgtatgtgtccaggaatttatccatttcttctagattttctagtttatttgcatagaagtgtttatagtattctctgaggtagtttgtatttctgtgggatcggtggtgatatcccctttatcattttttattgcgtctatttgattcttctctgttttcttctttattagtcttgctagcggtctatcaattttgttgatcttttcaaaaaaccacatcctggattcattgattttttgaagggttttttgtgtctctatctccttcggttctgctctgatcttagttatttcttgccttctgctagcttttgaatgtgtttgctcttgcttctctagttcttttaattgtgatgttagggtatcaattttagatctttcctgctttctcttgtgggcatttagtgctataaatttccctctacacactgctttaaatgtttcccagagattctggtatgttgtgtctttgttctcatcggtttcagagaacatctttatttctgccttcatttcattatgtacccagtagtcattcaagagcaggctgttcagtttccatgtagttgagcggttttgagtgagtttcttaatcctgagttctagtttgattgcactgtggtctgagagacagttcgttataatttctgttcttttacatttgctggggagtgctttacttccaactatgtggtcaattttggaataagtgcgatgtggtgctgagaaggatgtatattctgttgatttatggtgtagagttctgtagatgtctattaggtctgtttggtgcagagctgagttcaattcctggatatccttcttaactttctgtctcgtggatctgtctaatgttgacagtggggtgttaaagtctcccattattattgtgtgggagtctaagtctctttataagtctctaaggacttgctttatgaatctcagtgctcctgtattgagtgcatatatatttaggatagttagctcttcttgttgaattgatccctttaccattatgtaatggccttctttgtctcttccgatctttgttggtttaaagtctgttttatcagagactaggattgcaacccctgctttttttttttgttttccatttgcttggtagatcttcctccatccctttattttgagcctatatgtgtctctgcacgtgagatgggtctcctgaatacagcacactgatggatcttgactctttatccagtttgccagtctgtgtcttttaatcggcacatttagcccatttacatttaaggttaatattgttatgtgtgaatttgatcctgtcattatgatgttagctggttattttgctcgttagttgatgcagtttcttcctagcctgatggtctttacaatttggcatgtttttgcagtggctggtaccagttgttcttttccatgtttggtgcttccttcaggagctcttgtaaggcaggcctggtggtgacaaaatctctcagcatttgcttgtctgtaaaggattttatttctccttcaattatgaagcttagtttggctggatatgaaattctgggttgaaaattctgtcctttaagaatgttgaatattggcccccactctcttctggcttgtagagtttctgctgagagatcagctgttagtctgatgggcttccctttgtgggtaacctgacctttctctctggctgccctgaacattttttccttcattttgactttggtgactctgacaattatgtgtcttggagttgctcttctcgaggagtatctttttggcgttctctgtgtttcctgaatttgaatgttggcttgccttgctaggttggggaagttctcctggataatatcctgaagagtgttttccaacttggttccattctccccatcactttcaggtacaccaatcagacatagatttggtcttttcacatagtcccatatttcttggaggctttgttcgtttctttttaatcttttttctctagacttctcttctcacttcatttcattcatttactcttcaatcactgatacctattcttccagttgatcgaattggctactgaagcttgtgcatgcattacatagttctcgtgccatgattttcagctccatcaggtcatttaagttcttctctacgctgtttattccagttagccattcgtctactcttttttcaaggtttttagcttctctgcgatgggttccaacatcctcctttagctccgagaagtttgtcattaccgatcgtctgaagccttctcctctcaactcatcatagtcattctccgtccagctttgttccattgctggtgaggagctgcattcctttggaggatatgaggcactctgatttttagaattttcagcttttctgctctggtttctccccatctttgtggtttttatctacctttggtctttgatgatggtgacgtacagatggggttttggtgtgtatgtcctttctgtttgttagttttccttctaacagtcaggaccctcaactccaggtctgttggagtttgctggaggtccactccagaccctgtttgcctgggtatcaccagtggaggctgcagaaccacagatattgcagaatggcaaatgttgctgcctgatcattcctctggaagcttcctatcagaggggtgcccagctgtatgaggtgtcagtcagcccctactggggggtgcctcccagttaggctactcaggggtcagggacccacttgaggaggcagtctgtctgttctcagatctcaaactccgtgctgggagaagcactactctcttcaaagctcagttggaaatgcagaaatcacccgtcttctgagtccctcatgctgggagctgtacattggagctgttcctatttggccatcttggaacctcgattttcgagagttatttcttttaagggaaaagggagctggcaagtttgaaatcggtaaggcaagctggaaggctggaaattcaggtaagagttcagtattgagtctgaaatctacaggacaaggcaagtaggctggaaattgtggtagggtctctgtgttgccatcttgaggccagattctttattcttcaaaaaacctcagtctttttttttttcttttttcagacggagttttgctcttgtcacccagattggtgtgcaatggtgcaatctcagctcactgcaaactccgcctcctgggttcaaatgattctcctgcttcagcctcccaagtagctaggattacaggcatgtgccaccacactcggctaattttgcatttttagtagagacggggtttcaccatgttggccaggctagtctcgaactcctgacctcagctgatccacccacttcggcctcccaaaatgctgggattacaggcgtgagccactgagcctggccaaaacctcagtctttattcttgaggtcttcactagttggacaaggcccactcacattctggagggcaatctgctttaccctaagtctactgatttaaacgttaaccacttcttaaaaataccttgacagcaatatccagattggtgtttgaccacataacctggccccataaccaaataggcacataaaatccattatagtaggtaagacttcgtcaaagaggtctagaaaacatttctgggagaaattaacgaagacccaaataaatgaagcgatatatcatgttcatggattggaagactcagtgcaagtattataaagatgtcagttctcttcaaattgatttttatatttaattcaatcacaaaataccatcagggagtgtgtgtgtgtgtgtgtgtgtgtgtgttgatattattctaaaatttatagggaaatacaaagcacccaaaatagcaagatagtcttgatgaatttgaaaaacaagttaaataacttataccaagaaatatcaagacttataaaattattaattaaaattatctgttattggcacacaaatggacaaatagcagtagaacagaacagatcatatgcatgtgtgcaatcccctgatttatgacaaggtgacattccatgcattgattaaaagacggtcttttcattaaattgtattgaatccattgaatattcatatttttatttagaagggtgtcaaactccactaccacatacatacacaaatacattacagatgcaagttcttggatctaaattagaaagggaagattatgaagcttttagaaggttaatgtaagagagaatatctgttttagcttgtggtaggcaaagattttctaaacaagatgcataaaacattaactataatgaaaaagataaataactggacttcattaaactttaaaacattcttattcattcaaatacatcagcgatggtttgactgtgtgccccaaagttcatgtgttggaaactaatccccaatgcaacagtggtgagaggtgggaccattaagaggtgtttaggccatgagggctctgccctcacaaatggattaatgctactattgtgggagtgggttcctaattaaaggatgaattcagcccccttcttcttgctgtctctcgtttactcttgtgcctttcaccttctgccatgggatgatgcagcagaaggccctcatcaaatgtgactcctctttctcggacttcccagcctccagaaccgtaccagtctgtgatatttggttataggagcacaaagtgaactatgacaacatcattaagagggtgataaggcaaactacagagaggaagaaacttggcaatacatagctggcaaaggatttgtattcatatataatttattatgtaataattgctcattaattatttataattcctacaaatcactaaaaatccagacaactacaacgttcaacacggaaaatgatttaataggtgctctctgaaatagccaacaatcttctgaaatgatgctgactatcctaggtcactaggaaaattcatactaaactttcaacgctcagcctaggcaacatggcgaaaccctgtctctactaaaaatacaaaaattagcctggtgtggtggcatgcccccgtagtcccagctactcagacggctgaagcgggaggattgcttgagcctgggaagttgaggctgcagtgagctgagatcatgccactgcactacagtctgggtgagagagtgagatcctgtctcacataataaataaataaataaataaataaataaataaatactcaatgcagttttagtacaagacccaactgaatggctttgcaaaaaaaaaaaaaaaaaaaagacaataccaaacattggcaagtatatggagccactggaactatcagagattgctcatgagtgtgtaaattggtacaaatgtggaaaactggcaagaagtactaagtctaaatgtatgcatgccttatgacctagcaattccattcctgggcatatttacaggaaggagaaatatgtacatatgtgtatcaaaagacatctacaacaatgatcatacaaaattcttcacaacataggaaaactggaaacaactgaaacatccattggcagtaaaatgaataataaattataatatattccaacaatggaataataaacagctgtgaaaaataagggaaaatattacacatggcaatatagtcaatatagattgtcataaatcaggtgattgtacacatacatatgatctgttttattgctgttttccatttgtgtgccaattacatgattttaattaataatgttataagtcttgatatttcttggtataagttatctaacttgtttttcaaattcatctaaactcagggttgagtttaggaagccagatacgaaaaagtgcatgctgtatgatttcacgttgtatcgcatgatctgggttgtggttacatggaagtgatggtttgttcatgaaactggacgtttgagtgttgtatactttatttgatccttgtacttgtgattcaaaatttcataacaacttcctgctaccctttatgatttgatgtgtgtaagtagagtttgcagataatgtagttctatactgagctatgaatttatttttataatgtacattgttttgtattaagaatcattccaagtgacagaaaatttgcgaaatcaaagtattaacatttataaaacccttctgttgtttatactattctggccatgactttcaaaagcactgatttttagggggacagagtatcaaagaaagaccttggctaaagaaagctctttcaagtgggaagggcatcatagagaatggatcttgaggagtgaaagtcaggagatgccttcctactcagctgcatagctcatgaagctgacaacccgcagagttataaatgttgtgggtagattgccttcacactggccttgcaatcatctgctacactgagcaccattacatttcatggtggacattctaaggtgtgacactgtgtactctgctgtcaggaggctttccggggagaagggtcttgccaaggatttcttgcactcccagccacctgactggtttagtctgaaatttcagtattccagggtagtatgagaaaggccctatctggtaacaaagaaagcataagaaagatggctaagggaacaaagggacaaggcttttattttgttctttacccacagattgccttcaaaataaagataaagcgtctaagcctggcagtgcaggtctctttaagctggctccatacccacccacctcatcctgcacctgtcactgcgtgggaccctgtgctccaggcaggggcacctcactgccccctgagctcattttacccctcctggctctgcagcatttctgaccatttctgcccaggccgagactcactgctgcccagagcaatctcccttctctccttctggaggggaggggttgtatgttacccgcctggttttatccacagaggttagcagagactgatacagacaaaccctttttctttctaattttagattcaagagcacatgtgcaggtttgttaaatttgcctgacgctgaggtttgagtttctattgatcccctcacctgaatagggaacacagtacccaatacacagtttttcaaccattactccccttccttcctccccctattttagaatccccagtatgtagacaaattgtttacttttatagctgtaattaaccttattatagctcagcctcaaccctttagagaggaggaaactaaagcccatgagacttgcttaaagatactaagtgaacatatttattttttaaagtgttaaagtgattaaacaatgtagacgtgaatgaaataaaaagcgtaagttccccatcttcattcccactccatagagctgatcagtatttttacttgcagacattagtggagccgtagagaaagaaaccttttctccaaaagaaggcattactttacacactccgttctgcaacttgttttgttcacttgctatttcacgtcagcccatgcagatgacttaaaacaaattcaaatggagaaaagccttaggcatgtttttctctgcactaaagaggccctgcaggtggctgtggccaacttatgcagtggcttcgagtgaacgaacgtaattagtaattaagcaaagcgggcatccaggacattcagtttcatcttcctggcactttagtgtttaggaagggcctggcctctcggggagcgacactcctcgcccggccactttgtaagaagcatcgagcgtggaaaaggggctggggtcagcactggggccctctgccgggaagagagactggcggccagcacacgcgtctccccaggctgaaatggggcaccctctcgcggcccttccctcccttcccgggctgggtggcaggtcttggctcttctgcgagtaccccgcggctgcggtctcccggcacccgctgagcagcctcgcccgccttcctctcccacccgcccctgcgtgctctccggggctccggcttcctcggtctggtgcctggtgcgtattttggaaaatacctggctcataaccacctcattgagctcccagtgtcccagtgggccagcggacacacacgggtagctgacttccctaacgtgtccccaaagcctccctggattacagcgcccgctgctccatgtgaccccgcgggagccaggacgcgccccgcctcccggggctgcaagttgcgcagggagcgagcgatgcgcagcagagctgggctccgagccggatgcgccttcctttcctctccagagcaggctgcccgcccgcggaatcccgcacgtagagcaacctcgcagcaccctcagaacagccccgctggggcgcgccgggctgccgcggtgacctttccgacgcccctgaccccgcatccggaggcggccggaagtgtcgccggcctcctcccggcgcagcctccgggcctccagtgcaatcactacgccctggggcccggaaaccgttttccggtctttcgctttcggctggggcgtggaggccgcggtgctgcgtaggccgggccgggcgcaggaacagccccgtggcgccctctctggccgccgcccgggcgggaaacgtcgttccggggaccgggcgaccccgcagcggggagcgcgccaggtccgcgcggggaagtgggcggtgtgcggccggcaccgcctcgcaccacgcccccgcgggcccgcactttcccggagtgcaccccgcggccgccagccggggcgatggcggggctctggctggggctcgtgtggcagaagctgctgctgtggggcgcggcgagtgccctttccctggccggcgccagtctggtcctgagcctgctgcagagggtggcgagctacgcgcggaaatggcagcagatgcggcccatccccacggtggcccgcgcctacccactggtgggccacgcgctgctgatgaagccggacgggcgaggtaagggccggcgctcctcctggagcgcaacggggtccgcagccccgttcccaccctccgatcagccaggaacccgctgcttgtggcgctggccgcaggagagaggagcctgtcaccctgtggagaatgcactcccagttctagtcgttgccccttggcacccgccgacactgctagtgccccatcccaaagtgagcattttctttgtgtgtagcacaggatgcggtatttccaaacccctgccctcggtcttttcccacctcaccgctgctcagctctcaaagccctgccgtttcctcctgccttggcttgggaagccttaggaacagaagctccctgggagcacagagcggttttaaactggccaacaccttaacgcccagagccgccctcctctcgctgccactttggaaaataagagactagagattcactggacgcttcctcccggcatcacaagacttgactgctgcttcagttcccgcttgaccttcatactttagccctttaaaggatgttacataataacaattaagagacggcagggccttcaggcagacttctttggagggtgtcaaacgccttgtttattaaagagtgaattttttaattaaaatcatgttttaaaacagagatggacattttattgatggaaaaaaatcacgttaagttagaaagctctcaaaagtacctggtatttacaactccctgtcagggagggcgaactcgatctcagagttttattttcatcagggattacgttgaggtacccagaaatgagaagatttgcccaaaatggcatattttaaaattggcccagaccagaacccagtttcctctgggattatttgttagtaatcgttttacaggctgagcattaactaactccaaagcttgaaggactttttctcattttcacttgttttctctaataaaaataatgctgtaatttcaacttcacaagatgaggcctcatggaagagtgtttaccaaaatattaaaaatactttgacagaaaaaaatcaagcgaactctttgccaaccaaatatcatcatgactgatgtaacaagtaatccaacacagatatgaaaatcacactggtaaaaatcatctcagttaattctaaaagcagagctaaccaccccttttgtcctaaggctttatggtattaaaaaataaactgtacaaaaatatagattttcccctatcccctacccctggaaagtaatatactgaagtctcatcatactgttttggggattccagtaattaaaatctctagtgaataaagacctgtttcaaaacaacctgtgagctgactggactatttaaagtaattctccttgtagtcactttcagagtgaagacaatgacgaatactgtcttttacaaagggactttttattccaccaacaaattctggattttggcatcaggaaaaccactgttcaatttccaacactatatccaagttgtttgagaaattatttaaaactctttaacttagagggttttctttctcctttacttgttaaagtgactatattacagagtcactttaaggattaaatttattgcatgcaaagtttctagatcactgtctagaagtcagttagagtaagttctttagttgtcaatcaagcatttagtaaggccctgctttgtgcccagtgttgacctcaacaaagttggggatatcagaatattctaagatacagtcgttgttcccaagaatcttgtctttcacatacaagaggtgttgcgtttcattttgcggctaatgtccaaacgctggcctcagccatttcaccttgaagattgcagttggcttccaactggcctctaaactctaatctagcattttccagtccattgtgacaaagtctgccttccccagctactcccagctgttggacctgctgccttagaaccacagattgagacctccctgtcccctctgtcagaccagaccagggcaggcagtatatttgcatgacgcaggatgattgacactggtgatttcacccagctcccttcatagcaattttgacaactgcttcatctgagagacatttggaagcagcatagtttatggtgaagttctggagtctcgctcggtacaagccagtttccaccatttactagctctgtgatactgggcagtcgttagaaagaatgcccgttctgggacatcaaaacctaataattattattctctaatagctaacatgcattatgtgtgtttatttgctgtggcaaatactatgttgaaaaaaactttagacttacagaaaagttgcagtattacaggcagttcacacatgctctctacctggcttcctctaacagtaacatattacagaattagtatattcatcaaaatgagaaaacaaacctttgtccaatactggtcacaactttctcatcttgattgaatttcaaatttgatgtttttccccagaattttttcagcagatcattgagtacacagaggaataccgccacatgccgctgctgaagctctgggtcgggccagtgcccatggtggccctttataatgcagaaaatgtggaggtgggtacatgtgaatatgatcagtattgtactgtgtatctgacagtgtgagaatctcaccagaatcaatataacgtgtccttatatttcagccatttcagcacaaaaaacattccactaagtattttagactatataggtgcaatttaatgctttccaggtatagcccgaatcctgggagattaacattctccagatataagtgcacaactgctatcaggtccctttatatttattctttttttgaaaggatatcgttttttagaaacacaaataaattattccgcaaggcaagcacttgttatccaccagacgctattttaagacttcaaaaatatatgactaataaaatatgtttccctcaagttgctcagggtctcatatcaatgataaacttagtccaaatttaaaagacaatgcaaatttgatatttatgggataaatattacaaacccatgctgttgaaattagtcctccaaaaagctgtagtctttttacttgttgaaaggtctggggaaatcatcttgtagtatggtgagaaaaggatttgggtcaggaaacaaagatggggtaaacagagcttctcttcatcgaccaaaattaaagactgaatttcctaggaagtagtgccaggacatgtctttctaattatggtgaaaatgttggagtttctcttgcttctccagaatcctggctcagagaagagagcaagaagggcagacaggatttctgccgctgttggcctagtgttaatagaagttggtgtggtggatgcagatggagatctgtccagagtaggggacttgagcaagaagcctggtgggcaccctgtgctcagccctagaccccatccctcctcccacttcacgtggactctgggtgatccgatcacgttcatggcttccattgctgcctctatgctggggacactccgaacaggcatctccagctcaggccttatcttggctgtctcacttgctttcagaccacagcaacctgaaggcctcaaagttaccatcacctgaaaatacacctatgatttccatctccccacatgtgcccaccctccagattcgcctcctcccacctcactgtccccctccccacattaaataactccacttggttcctggtttatggcgggaaccagagaatcatctgggacatctttcttccccccaactccattgagtccccaagactgaatgccagttttatgttcaaaactctaactgaatgtctttgaggcacaggactgaaaatgaacgacggagaaaataaatgttgtgaatgccctaaaaactagctgtattctagccagtattcctataattacaggaaggttgtttgatgtctgtatgtctctaaagtatgtttttctcttcctaaggtaattttaactagttcaaagcaaattgacaaatcctctatgtacaagtttttagaaccatggcttggcctaggacttcttacaaggtatgccagtgtacctttgtaaagctgtctatagaaatggttacttctacgtgcaacttgttatttcaagaattaacacagggtagctttttctgtagcaggactgttctctcagaaaggaggagaaaggctggaaaggaaggtccagctggcagctggcctttgcccgtcaagaggccaagagtccaggtgaacagttatcttcagctgtggtattcaatagcgactgtcgccagtgttcaggaagactcaggaggtcctgatggacgggagtggacgggatggaggacacagtaaagcaaaggagtgtctggagcagggaaatcttgaaaatccaatcaaaaagatggtcagccccagagaagtacagtgagctggtatctagaaacagggctccatcctctgagagagggccccacaagagcaaggcaggagcctagcagggactttggagaactggagaggggagagatcaaggtagaaccatggagtgtgaggatcatctgaggactgaggtattgatggaaggagaaataaatttattattagaaactcggaacttagaaattgagaaaaattcttaaatttttcaattttatgaatgctattttaaacatgtatagaacaatgtccaaaatactcatattttgtaactatagatgaatattttatagatatgtgtatatctttgtcattctgccaaaagcatttgagaacctgtagatgaagctgtttcaggagaattttgttgacttgctatatttatgctttaatcgttttggatgttacttttctctttctctctctctctctgtagatatattttttgtaaccacatattttatttctagtactggaaacaaatggcgctccaggagaaagatgttaacacccactttccattttaccattctggaagatttcttagatatcatgaatgaacaagcaaatatattggttaagaaacttgaaaaacacattaaccaagaagcatttaactgctttttttacatcactctttgtgccttagatatcatctgtggtgagtctcatcgatctgtttctaaatttatggcataaagagaaaatggcccaaacaggaaatcacactccaccgggaaggcaaatggggggacgggaaagggtgacgggctcttcagcgcggttctacgaccgcactggccttctgaggagcagcagccacgcccagggctgtgagtggggcaggcatggagcaactgcccagggaggcgaagggaaggaagaacaggaacagggagtagaagtggaccgtacaagagaagagggtaaagggaggaagaagaattctgaaatatacaaggacaaagcaggatgtacgtctttagtgtctgccgctgcaaaataaacacgagataactaacgtgcgtgaattgaatggttgcttctcacccatattttatagaaacagctatggggaagaatattggtgctcaaagtaatgatgattccgagtatgtccgtgcagtttataggtaaatggagtcctttcagttattttaacaattattattgatttaggctttaaaaattattgctaacaatttctgcgttgtatctttttatggtttcaaaattaaacattaaactagaagttaacctcatcatgtaagcatgtgtttaagcagtaaaggttatgtaaattatggcacatctagattatgtagtaatttaaaatgattattctctaacattgagattacattatattgtacataatgatgcttacattatgatgctgagaaaagaaagatataaacagttttctgtaccatgataattgttatatttaaaaattattcatagaaaaaaactagcagatattataacagaatgttagcagtgtttctcattgtctcgtgtatgtgtttctcattcttgtgctttccttttgttgttattcttcttcccatattttctgcaccaagtaggtattgttttagtcatcgaaacagtcaattttactctaaaattgcttgcaattattcacctgttaaaaggcagggcaaggacttgatgaagtacagagaagtgcattgagctgagtatatttaagtctcctgctcatttcacttcattttaaccaatatttattaggcatctgtgattttccaatcactgcacagggtactgactggttttgtagtagtacacaaaacagaataacacaggaggcaggcaacggacaaagaaattcatgaactgtaataattgctcaggaagaaaagatcaaattgataccagagagcaaaacaagaaagtgtcctacagagtgagaggccaggaaaggtctttctgaagaaccggcacctaagctggtcctgcaggagatcacataggggtctttctgctctatggctggacatgaaagggaggtgctgggacagccaagtgacagatgggtacttagagagccctcgcttgtagaagagggcagccagttgtcttctgtcactccagaggagtggtcagaccaatgatggaccttaaaaagaggccgatttcatctcaaaccctggtgcagaggtcctaggcagagtgggaaacttgccctggagaagcagaagcagagaccaaatggctatctagtaaggatgttttataatgaatccttcattcctttaaagagcccattattttctgaggcttcatgggatgcgtaatagcccatgccttcactgctaagcataaaacatggagctcttagtagcctctaagacaatcatcgtcattcccacgattgccttcatcaaggccaggtactaaagaagtgctcaagaaatacacatttctgatacaacagctgatgtatttttatcccatttatagaatgagtgagatgatatttcgaagaataaagatgccctggctttggcttgatctctggtaccttatgtttaaagaaggatgggaacacaaaaagagccttcagatcctacatacttttaccaacagtgtaagtccctgacttttacaattgtggtaaaatagacataacataaaatttccctttataaccattttaactgtacagtttggtggtattaagtgcattcacgatgttgtgcaaccatccccaccgttcatttccagaacttttggtaagtccatgatgttgatgttttgttaacatacccggtgtaggactatggagcctatgtctcagaaaataaaacttgaataataatagaaaacaatttttcatataaaaaattatacttaagtataaaaatgtatacttcaattatgtagtcaacaaatattaattaagtactcgctaagtgctaaccaccataccaaatgttggaaatgtagtaatgagtaggacatgtgtatatggtccgtacctgaaaggaagttattctagtaggagaggtgatctatcaacacataattacaacatgtgatatgagctgtgaacacttatgaacaaacagggtgctgtgtaaaagaataaaggaacaaagatctatgtataggagttttctggaaaatgtttggattcggcagtcattttcaaaggcagagggcattgatagcagtatcttaacatggaaaacattaaaactaactagatattagtattctatttccaattcaaaaataaccagaagatagtgatgttgttttgaatataggatgtcaatctttgtgttaataatgtgttttgaaaaagcaagacttaattgaaaatatacatcaaattataatttcagtgtattaaaaaactgcctgtttaaatatgtcctttctttgctgtaaattttggttaaaatctattggagttatgtccttgtggtgaagtacaccctacccccaagagagcaaatgatgaataaatcagtagatgttccatgaatgcaatgttggctgagctggccacagtggagtgtgatcacctggttataggagaatagccagcaggttatatttcataattatatttttccttaaattttgtgcattaatatttaatagcaataattaaatgaattccagactgaatagacaattttattcattgaataaacattgagaattgcctactgaggcctgggctctaggaattccaccaagaataaaaaaagacatggtgttttgccctcaaattgcttagaatctattcaggccacttagtagcaggtttggtcaattacctggtaggaaaagaaggttgaaatgtacaaccaaattaagtgtattggccttcattcttttatccatccaagaaatatctagtgagtatttgttaaatgccaagcagtgctctagaggttggaaatgtatcaatgaacaaagacatgcacaagcatggcagtgtttgagttgtaagagaaagatgctaaataataagtataacgtaagtataatatcacattataataataagtatgacagaagtatcacataatgtcaggtggcaagggaaatggagaaaaagcattgttaggaggcgtcgcagtgctagggacaggggtagcagggatgagggaggtctctctgatcgtgtgacaatgagcagagatctggaagaagggagggggcagccgtgcaggcctctgaggaaagcatttcaggcagcagaaatcgcaagcatagagggtgaattcactaatctgcttgctgtttcttttctcctctacaacatgtaattaagtctataattagactgttgtataatgattgcattcactctaccacttaaactttttctcattagcgcaatccaatctctagggtactatctagtagactatgattctattcttgtgttggaaagactgcaaaaatagcacttgaaaattaggaatttgcgtgacattaaatttgtttttaaaagtttcaccagataatccccaaaatattaatgaggctttactgtattttcacaagagcctatgttgtcgaaatgttgaaataggcttagaaaaataaatgaaagaaactagcatattttataagaaaatgtgttaactagggtgcatccaagtccaaacagaagcatgtgattatcattcaaatcatacaggtcatcgctgaacgggccaatgaaatgaacgccaatgaagactgtagaggtgatggcaggggctctgccccctccaaaaataaacgcagggcctttcttgacttgcttttaagtgtgactgatgacgaagggaacaggctaagtcatgaagatattcgagaagaagttgacaccttcatgtttgaggtattgtatattgttaggttcagatatcattaaacaaatttcagttattgttagaatctttagcattattttttaaaacaatcaaattttaaagtagtttaactaaagaagattcattatattttaattagaaattacaaaatttaagaaactgattaagtaccagctcaacttcttcagaaaacgattttgactagtgctgggcacagcagtagacacatttgtttttcctcaagaaaacctaagatttgtcagagttttcccaagcagaagagcagccagagattgctctcagttctccatgtggcttcaggcttccttctaacctcccagacatgcaagtccacttcctcaccacctgctttctgaggttccagcagatgagcacttagctgctgccatgagctactctacctagaggacagttaagagccctccaacagagaatcagccagttcatgattctaaaaagatctctgatctcaaatttatacatacatatgtgaagtacattttagcaagatagcctaaatattaaatcctacaaagagggactttctctatatgtggattgcaaaataaataaaacatggtttttagaagccatgtagtaatatcgtccacatggggcagagtgaaaggcacctgagtttttaatggctctgcctgccacccacgtgtgagctgctctgcggcagcctctggcggcagtgccagtgtcctgcactctggtgtgaggctccacgacacggtagaagaaggttgtgtgatgggtctttcgatccgagttccagttcaggctctgtgctgattagccaaataagatagttctgatcattccagagttctgtcacaattttcctatgtgtaaagcgagagatggactacgttggtggttttaaacttttttaagcagaaaactttactgaaaataaatcttaagcagaaaatggacatctaaattagctgaaaagtagagaggtgttaagtgtgtgggctctaagatcaaatcccagctaacatgctgggaccatgacctcaagcacctcacctagccgttctgggcctgaatattcttattttaatagcacaagcctcatggaatagttatgatgattagatttgtaaaggtgctctgagaatcgtgattggcccataagtatgcggcacataccgggtgttattattgcatgtcggagtagagagatctcacatcttcaccttgcccatgtactacacacacacacgcatacactcatgtaaacccatgcacacacatgcacacacttacacacacacatatgctcatgcacatacacatgcacagacacatgtatataccaacatacacacattcacatatacacacatacacaaacacatgcacacacctacatacactcatgcacatacatgcacacacaaacatatgtatatccacatgcgcacacacgtgcatacactcacacacaaatatacacacacacccagatactcatgcacatacacacacatgcacacatatacccacatgcacacatgcatgcatacacatgcatgcacacatatacccacatgcacacatgcatgcatacacatacatgcacacaccaccccccacagaggcacacattcatgtacatttatgcaatcatacaaaaacacatgtacacacctacatacacacatgcgcatatacacatacatagatgcacatatatacacacatgcacacataaatgcacacagctatgtacactcgtgtacataagcacaaaggcacacacaaatacatgtacatatccacgtacacacattcatatatgtgcacaaccccatacacatatgtacacacatgtgcacacacacatccatctcctaccaggaacctctcaatctcacgtaaacaatcagaaccagactaatgatttttcttccaactctaacattccttgacattctaattgttttcttctttgcattgaaagggaggcagcataccaggtgtgagtgtgatactgtggcctcctccacaggtcggtgcaggctgtgagtgacactgtggcctcctccacaggccggtgcaggctgtgagtgtgatactgtggcctcctccacaggctggtgcaggctgcaactgcccaggttccagctgtgagctaaaagtgggcgtcctcccctgctccaccagtgtgcctcggtgctttacgtttgccttatcatgctttctgcagttggcagatgaaatgaaatcggaagttcagcagactcctcttatgcatttggatcaggcttccgctcataaattcaaggaaagctattaaaattgtttagccagaatacttccttccgtacttagacaactgagcacaacgggccggagctcatctggagttccgagtaggttttgtaactgcaagtgctaggaaaatgcagaggcgccgacctcaggacctgtaggctgtgtcttttaagaattgcagaataagccccgagcaattcattttaggagctgttttataaaacaagtactttgaagatttctgcacagagaatgaaatattacaaaaatcacttgtgccacataggaaaaatggaaaagtgagatcttttatagaggaaataatttgttttttctttttgtcctcaaagtttcagagaggtagattactgttattgactttccagatacattttttttttttctgaagaactcaccacttttgcatatggaaatgtgctagggagatgaggaggtagataagaagccaggtcctgaaatatcaaatgggtgggaaagaaggttgcccgagacattacactagcttaagaggtggaggcggagacgttacgctaccgctaagaggtggaggtggagacgttacgctggcgtaagaggtggcggtggagacgctacgctggcgtaagacgcggcggtggagacgctacgctggcgtaagaggcggcggtggagacgctacgctggcgtaagaggcggcggtggaggcgctacgctggcgtaagaggcggcggtggaggcgctacgctggcgtaagaggtggcggtggagacgtttcgctggcgtaagaggtggaggtggagacgttacgctggcgtaagaggtggaggtggagcgtccttactgcacagggtgtggagggaatggcgtgggctcagctggctttgtcatcggacacgccgcaggctcagtttctgcctctgtttcccactaagctgtttagcacagaagaagttatttaaccacatctttggcctcagtttttaatctctgaattgtaaagaacagtaatgagtctttcatggagtttttgtgcagattaattcagtttctgcaaagtgcttagtattttgcctaaaactcagcaagtatgaaatgaggttgttgtcaatttttactgcagaggatatgacttagaaccacacctctaccccctggtgcccgtcatcaacaggtgaggcccacctgacagatgggggaaggcagagaagtacagccctgacaagcaggctcgtgaaaatcagactttgttctgttcacaaaggcgcagctcacctcgtgcccatggaacgccgcctttattaacacagcacaggcacgtcccaccagcgtgcaacaccgtgcggcgtggaactgccatctctaggcatgaacctccgctttgcaggcttgtttccttgtttgtcaccgaggcaaggtgctgcacagaattcatttcttatgtttgcagtcacagtgcagtcatcaaatccagagacaattcaaaagaggtttctggtcactcctaatcatcgcagcataactctgctttttaagctattgttttctgcatttgtaggggcacgatacaactgcagctgcaataaactggtccttatacctgttgggttctaacccagaagtccagaaaaaagtggatcatgaattggatgacgtgtttggtatgtttggccccttcactggttatattgtggtactaagtctgctgcagagatgtcactgtgttgtaaacacagtgtaatgagcaggaaggctcccccacgggatcctttccagtaccatcccctttgcaaggcctcgtccattcactcacaggcctctgccagtcgcctggcaagtgactgtactaggccggatgctggggtgcactgatgcgtgctgctgtcctcaagggtctcactgctacccaggcgaaacagaggctttgagtcatgggtcgtgcatttgagtgaagaaggtgctatttgggagaaaggaggagctggtgaaactatttagaaaggtacaggaaagctgtttcgcagattgcctctcaccacaaaggagagaaaatgtggattaaaaaggtggattaagcttcgaggagatacatttctattacacagcaagcagcccggaggaaaagtcctgccagtaggatgtccagggtcccagacttgcccttttgctcccagccatccctaccatcttggcttttgtcctcatgattgacgttccaagcatcacgttcatcttcaaggcaggaagacaggggaggtgggggtaccgggtgtgttggtgtcctgtggctgctgctgtgacaaatccacagacagggaggttcacagcagcgacgtctgttccctcacagttctggacacccgagtcaaagatcagtgtcattgagcccacatcaccatgtgggcagggctgtggcccactgggaaaatatccactccttgtctcttcagcttccggtggctgccagcatttcttggctgacagccgcatcactgctatctctgccagtctctgcatcgccttctcttttctctgggtgtgagtgtgtgcacgcacgtgcatgcatgtgtggtgtgtgtgtgtgtgcatgtgtgtgcttgtgtgtctttcacaagcatacttgtgacatacttgtgatggcgttcagggctcacctggataatctacccactgtaagatctttaatttaatcaaatctgccaagagttctcttcttccaaatagggtaacatttacagattgcagggattaagacctgatattttggggcccattatcagtctgccacaaagaggcttccatagattttatccttgttaaaaatcacgtgtcatatggcccccaatagctgcaaggtgaaaaggaataaagttgagttagccaagcaacaagtggtatctgatgcagttttacagtgagaagcagggaaagaaaactaaaggaataaagctggagagagaaggcattctagaaagagaggaagcagatgagcaacggcacagaagtggaaaggtttctggcatggagggcaatagtggagagtgagagaccgcgagaactcatctctcattcactgggagatgaggatggaaaagcagttttgtgtgcagattgtgctgggactggaatttcatattaagaggcaagcttttattttgcagaatggacaccatctaacacttttggcaacatttttgtcatcattttatctttttaacactgattttagttttgcttagattgccttgagtggataaatttggtcttccaaaagctcacaagttcttttggaataggcttcaatcttttgtatcccctacaaagtttagctcattaccagtttcacaaagctttgtggtcctgcagaatgagtgacacagtcatcattactagaagctttgctctgtgattcttgtgttttctgctcattgtgcctcactttttcttctacccccaatcctagttctagaatttttgagcaactaagctgggctcggtggctcacgcctgtaatcccagcactttgggaggccgaggtgggcggatcacgaggtcaggagatcgagaccatcctggctaacacagtgaaaccctgtctctattaaaaatacaaaaaaattagccgggcatggtggcaggtgcctgtagtcccagctactcgggaggctgaggcaggagaatgacatgaacccctcagggggcggagcttacagtgagcagagattgcaccactgcattccagcctgggcagcagagcaagactctgtctccaaaaaaaaaaaaagaaagaaagaaagaaaaaaacatttgagcaactattctttgtgtagtgagttattactttgcattattaattaataattaattattaaattatatttatattaaaaattatataatatataaaatatattaaaatatataaaaatattaaataattaataattaatactttgcaagtattaattccttaaatgttatttttttttttactgaggtaaatgtcacataacataaaatctaccattttaaaatgtacatttcagcagcatttagtaccttcaccatgttgtacgatagttatgtctacctaattccggaacattttcagcacctcgaaaggaaacctggtaggattaagcagtccctcttgattcctccttcccctggccctggaagcctgtgatttactttctgtctctctggatttacctattccgagtacttcctatatatggattcgtacaatatgtgacctttagtgtctgtttattttacttggcacattgtccattttattttgataatgcataatgttagaaattctgctttagctgtggctatttagcatcccctgccttgatccacatgttcttctttgatgggtatttagcatcccctgccttgatccacgtgttcttctttgaagggtatttgatggatatttagcatccagtaccttgatccacgtgttcttctttgaagggtatttgatgggtatttagcatccagtaccttgatccacatgttcttctttgatgggtatttgatgggtatttagcatcccctgccttgatccacatgttcttctttgaagggtatttgatgcgtatttgatgggtatttagcatcccctgccttgatccacgtgttcttctttgaagggtatttgatgggtatttagcatccagtaccttgatccacgtgttcttctttgaagggtatttgatgggtatttagcatccagtaccttgatccaagtgttcttctttgatgggcatttgatgggtatttagcatcccctgccttgatccacatgttcttctttgaagggtatttgatgcgtatttagcatctagtaccttgatccacgtgttctttgatgggtatttgatgggtatttagcatccagtaccttgatccacatgttcttctttgaagggtatttgatgggtatttagcatcccctgccttggtccacgtgtttttctttgaagggtatttgatgggtatttagcatccagtaccttgatccacatgttcttctttgatgggcatttgatgggtatttagcatcccctgccttgatccacgtgttcttctttgttgggtatttgatgggtatttagcatgccatgccttgatccacctgttctttttagatgtctgcacccccagcccccactgctctttcaggtcatcttatctacttgctttcatcagggaagtctgaccgtcccgctacagtagaagacctgaagaaacttcggtatctggaatgtgttattaaggagacccttcgcctttttccttctgttcctttatttgcccgtagtgttagtgaagattgtgaagtgggtaagtatgctatacctaaagtagaagggagagggaaactttctaatgtctaccttgctccggtctcataatgtattgactacttcttgacagcaggttacagagttctaaaaggcactgaagccgtcatcattccctatgcattgcacagagatccgagatacttccccaaccccgaggagttccagcctgagcggttcttccccgagaatgcacaagggcgccatccatatgcctacgtgcccttctctgctggccccaggaactgtataggtttgtatccatctgaattggtttgacctttcaggcccacttgatggtgggtttctcacagtgatttctttgagatgtgatgtgacattgcccatatgcaacagccttaaaaaaaaaataggtggtttcttttttccctcactgtgctttgtagttttaaaatattacggtcaaaaggtatattagtatattcgcctgcatgggcttccatagcaaaataccacagactgggtggcttaaacagcagaaatttattttctcacagttctggaggctggaagttcaagaacaaggtgttggcagggctggtttctcctgaggcctctctccgtggcttgtagatgccattttctccttatgtcttcacttggtctttcctctgtgtgggtctgtgtcctgatcttctctccagtcagactacactagggcctaccccaatgacctcacttatacttactgacctctttcgattacctgtctccaaatacagtcatattctaaggtatggggggggcttagaatttggagagagacacaattacccataacataaaacataattagcttcatggtagagtttcaaaatgttgtagagttttaattacagtagaatataacttattgtggtaaaaactttattaatgattacttatggttaacctaatttttgtgtttattgcttttaagaatttcattttgcaaatcaaaacagcaaatgcttgccatatggccagctagtacttaagcaaaatgaatgcacatcaccaccctgcattataaacccttttggttttagtatctctagcattttgtcatttatgtaaatgcagacatcggtaaaatgaggccagagtgaaacgggtgaatctgaagcttttttggtgaatccatagtaaatgaaagacccactaagacataatctagggtagtgagtctcaagcttgaaggagctcaggatttatctggatcagctggagtacaaattctctgatcctccccagctatagatgtgcaaggtgggatcagggagggaaactcaagactcttcatctttaacaggtgttccaagccattctggttctccttccacctactgcgaaaatgtaaagtggctcgcttcctatgacaggacctcttgtttctcacatttggggtaaatctataactaaagcgatggtatctacattaatttgaaggtcaaaagtttgctgtgatggaagaaaagaccattctttcgtgcatcctgaggcacttttggatagaatccaaccagaaaagagaagagcttggtctagaaggacagttgattcttcgtccaagtaatggcatctggatcaagttgaagaggagaaatgcagatgaacgctaactatattattgggttgtgcctttatcatgagaaaggtctttattttaagagatccttgtcatttacaatttacagatcatgagttcaatatgcttgaatcccctagacctaatttttccttgatcccactgatcttgacatcaagtctaacaaagaaaaagttttgagttttgtattttcttttttcttttttctttattttttttttttgaaaccgtgtctcactctgtcgcccaggctggaggagtgcagtggtgtgatctcagctcactgcaacctccacctcccaggttcaagcaattcttctgcctcagcctcccaagtagctgggattacaggtgcctgccaccatgcctggctaatttttttgtatttttagtagaaacagggtgtcaccatgttggccagactggtctcaaactcctgacctcaagtgatccacctgcctcagcctcccaaagtgctgggattatagtcgtgagccaccacgcctggccagagttttttatttttatcaccaccatagatgttacagttggctgtggtcacaaaagtagttaattgtgtcagcacccaaataaacatctaacaggtttctcaacagaggaatccacagtccaattccacttcaattgatagacccaaaaaatataatttaatcaaagttctagagtttttgtttgtttgtttgagatggagtcttgctctgtcgcccaggctggaacgcagtggtgacatctcggctcactgcaacctccacctcccaggttcaagtgattctcctgcctcagcctcctgagtagctgggactacaggcgcctgccaccacgcccagctaatttttgtatttttagtagagatggggtttcaccatgttggccaggatggtcttgatctcttgacctcgtgatctgcctgcctcggcctcccaaagtgctggcattacaggcatgagccaccatgcctggcccaaagttctagaattttttaaaggtattcatggtgactcaggaatacacacatacacacacacacacacacacacacacacacacatacacacatataatttgaaagaggtgagtatgtactctgacttcagctctcaggttttaaaaattatattagtgggaccagttatgacaagaataatcattatagtacttttcagattttataacctggagcagattattttaagttgattagtaggttctgttacagtttttcttttgatcgtgcacttatagtcttcatttaattcctcatagaatcccagtcacctttatatatcatattattggaagagattcatcttcataatctccagttttttcacagtgcctcacagagttaatcatgccttttggagctagaaggactttagaacttatctagttatgctcctttatattataagtaagggaatagaatcaataagacagtttctgcccaaagtcatgttaccagttggtgacagagctggaaatacgtagagatctatacccttaaatctctccactcacatgctgatatactttctactacaatatgctatagctttatggaactcagggtgatgatcagacgtgtcattagaacatgagtcctctgcttctgattcaggcatacttttgggattcttccatctttaaaggaaaaaggaagccattcatctatatttagtaacccagtaatatctcacttagtttagggttagatctttagttaattcaaccttatagatcatacttatgaaggtgataactgacacgtgttcactgaattttaatttgataggcaatacatctacccactccattattttttaaaacttcatttaatagtttaaacaagattggttttgttttcaatttttattcactcttcatagaatcacaattacctttatatatcatatgttattggaagagattcctcagtaatctccaatctctcatagtgcctcacagggttggtcaatggcttttggaactggaaggaccttagaacttatctgttatgctcctgatagccaatagcagatagaagcttgcaatcaagagggtaggacatgtgttcttcaatggatatcaaaggaagaggttgcaaaccaaagccatttggcaagccctgtagcctgggccatttaagacaggggcggtctcagccaaattgcacccatttaactatcccaaagagccacagtgcctacaacccaggccctaagttgatgaagaaaaagtcaaggaaggaggtgatacaattggaaatattcccatcaaatggttaatcttatttagaaaatgggcatattagaaaaagtccttccaagatgattttggataataaaagttgtatttgtggaaattggtattatctctgttttatgcacttacatttatcccttacattttgtttttagtgaccctacatgacattaaatttaaagtaaaacattgtttaatgttaccttttggcttgagaatgtctttcagctccagaattattgttactcatattttaatcagtaagtcatttaagctatgacagagtaggaattgagaaattatttcatatgctacagtattgaaatgtggatgctgccttgttttataagaagatgatcaaggtttgtgtgcccattacctttcctctgcctgaaagacgtgtctcaagaaaaataaattctattttagatgcaggtactgcattttattctaagaattgatatcaattcaaaacatagaaaactgtaaaagataaatcaggagatggctgattcataatgggtaataaaataaatagcactttcgagctgatgtcgtcagtgactcttggattttctaacaaaaggttcctttactgttgtcatagagagattgtgaatttctctgactctgaagaatcaactagaagaagtagaatcaccagaacattttgctcagctgaaagcacaaagtaaactcagttactgggaatcagcaaaaaccacaggcatcactggtcccagggatttagagtccagaaacctctccaggtgatggactgttgatttggggctctatgcattgtcacagacagctggggatatcagtttctggaccaaatgacccaataagagatgctggtcgtaaaaatccatttttatctggaatgtttctagaagatcaaaacctttttccttccagcatctaatgcctgagtgatacatttaaaaatttttagtctgcgtgggcaccctctttttctaggagcagcactttttatttttgaaattatcctacaatgaattaccggcttttcttctgttctcatctttttccttccccagcatacacacactgtaaatatgtgccatattcttaggcaatcccactttctcaacctttgttgagtgacccaagcaaggttaaattcgagttctccccaacgagttttcccagctgcaattgaagaagagatacagtccatctctgtggtggaaactccaggttgtgaaactcaagatcaatcagcaatagaacctctggagcagctgctgggtgatgagaagaagcaggcagaagaaatggacagaatcctggaggaacctgagtcccacatggcaggtgatgctgaggctcactgcatgtctgccctgctcactcttcagtgggtccaccctacttgggaacccaagagccagtatattgccgtttgcttaaaaggactgtctttcatttatgaccaaaagcgagttagtgtgtgtcaggtcagccgaaggatgaaggaagggcccccattctctggatatgatcttaggtcttcaccctattttctttgtgctgttcaataattctctgtattggatcatcagcatatatgcccaccagtcctttaaatgcaataccatttaagaaaatgcagagttttctcttttctagatagtaggaaagttaaagttacactgcattgttttagaagacagctaggcttaacctaacacatcagtctagttttttggttctgccatgatgactttctggactaattagtcatttttctcctctaattaaaccaggttcattttcctgctggctagctgtatgccacatttcagggataaatctctcatctctaattactaaaatggactcgttgcatccttgcctcagtttcttgtccagaagttcaccaaatggttatttccttgggctgaattcagttttggaattaactccagcatttagctgttgatcttgttctctttatcctagtagataagtttttggcacgttctttctccttcccatcattatctctcctctttacccgtcactttctttctgttgtggtttgcatttattgatctctgcctttcctgatactactcaatttatgtttcacagaaataacggctgtacttaaatgaaactcagattcctatataaaaatgttgggataactttgttccttcagtaagggtcatacagacattatagatcttatcgggaagaaaaattatcacaatatttagacatgactgtcttattttaaaaatgttttcagtttactttcagattccatatatagttttaaaatacatgttttagctgaatagtaaaaaaaaaaaaaaatatgtaggcacaggagtatctattgggcactcctgggaaggagagtagcctttctttctctttctttctctttctttctctttctttccttctttctttccttccttccttccttccttctttccttgctttcttctttctttccttgctttctctcttgctttctctctctctctccttgcttgcttgctttcctttttttttttctatattctacctctaggctttgcgtccttgcttgcgcaagtcaagcccaagttttaagttttatgcttatggaaatacagtaaattaagacatttatttatttatttatttatttatctatctatctattttttgagacagggtcacctaggccggagtgcagtggcgcaattgtggctcactgcaaccttcacctactgcgctcaagggatcatcccacctcagtctgctgagtagctaggactacaggtgcatgccaccgtgcctggctaatttttgtaatttttcttgtacagttggggtttggccatgtttcccaggctaaattaagacatttaaatcactcaggcacaactaattttttcatattgccacatcttcctaggagtgggattgtgcttcagttttttcagctgtctatgccttaattttgactcccatcaataatgcttgatgttgtagccagtgttggtttattattaccaaaagcaatgctgttctggaaaggcaaggactgcagtgtctcatatgatgcaattggacggaacctcaagacgacatttgctcccagcaaagggcattcagcagaacaaggaccaatcagaattcatccaacaatcattttcagtgtcatctaagactggcaggtaatagcttacatgtgcgattgtgactttcatgtgaggatgagatggtccacaactgcggggaaagcaaccttcctgtcctcaatctcttgtttttaaaagatatttcattccttattcatgtgcttatttatttatcgttttactctttcattcataaaagtctgccaagttctattgagggagctggggaaagacagcaagcaagccccagtcctaccagcaaggtgttacagacagtgggcgtctgaaaaacaacagagaaatggacaaggaggtaacagaatggcagggagtgagaagcgttacgcagaaagacaaagaatggtgaagagacaggaggtggaagagatggaaggtgccttttcagatgagatgcttgctggaggatggtatcctgaggagatgatgtttgagcagtggtctgattgaagtgagtcacgtggggatctgggacaaggggaggtggagagggctccatcctggcacgtgtctaaggggaggttctggagaaaaatcctctttcaagcacgtgcagtttgttggaatattcagtgctttgggatggtaggggtgaaatccccatgttctttttggctcttgtccagagatgactctcaggtccttccccgtgacccatctcaaagccagcgctggagcacttccctgctgtcaatccctcttaacgctctgaatctctctgacatctccttatgctgaccgcagaggaaaactctgcttttaatgggctcatgtaataagatttggcccactctgattgactccattttgattggcacaaagccaagtgtttagtaatcttaaccccatctgcagaattgcttttctcatgtaacataatcatgggcagatgtgatatctcgttttattcactgtccccaggatttgagtgggagatttgggagaatgttttagaattctacttaccacgcctcttttcaatttagttctgatttggttcacctgaatctacagaggtttttttagttttattgtgctactagaatgtaacatgtttcactgtaagaaaactccaactaaacctagaagcatatttaaataggttaaaagtctgtaatctcaccttttagaaaaacaaaccctgagggtttctgctgtgatgtgaaggcagggtgcttttgtcccagttgttttgttgttgttgttgttgttcttgttttctgctgagcctggtagctgatgaaatctaaaatataaactcttttctactgcacaaagtggagagatttgttgactactgctgcaccacttgatatcctaaaagacagcacaacatgcatatttaaaatatgctacttccttctcaccagaaaatattttattggcaacattatcctacatttctaataaatgtagttctgcattccagtaatatacataaaatatttatttaagaatcgactccaaaaactctaatgtactaatcaagatgatatactgtaatttcaaagaatagaaaacaaaggagatttagtgggcaggtcattgtggtctttaaatattttaaaagcagaaaaaggagaatcagttgttttgtgtgggtctagtacgtaaatctaggactgaaggatagaagtttgcaaggaggtgtatttcagtatacaggaagtttttttcttttcttaaaaataaaattaaaatagagctccctgagctctgaaataaaataaaattaaaatagagctccctgagttggagcaggctgcttaggaaaccagtttctcctcagtcgaagtattttgacaggaaggtctaaagtctatgtcagaagtgttatccagcagatttcagccaaccttatctgtagagtcagatagtaaatcttcttggcttttgaggccatgctgcctctgtagcaacttcttaactctgccattgtaaggtgaaagcaggcatagacagcaagtgaatgaatggccatggctgtgtttcaataaaactttatttacaaaaacaggtgcaaagccaaatgtggtctgtgaactgtggtttgtcaagcctgatatattgcatttcctgaattgggtgggaataggacctaaacatcaagccagtcccttccaaatctaagatttcagtgttatatgattctttggtagggtgtaggaaggcatagatatcatttgctaaaatatccctctaggaggagctatccatacccatccattattcactgtgcctgcaagcaactctaataaaaaaaagttctgttagatgaggtttcaactacatgccactaaatactgggaatgttataagcattttttaaaatggaaacctgtgcataaactgtgtgaccctaaaatgaaattagggtccttttgagtgcagcatttttctacctttttttatgtatcatttacaaataaaaattatatatatctactgtgtacaagatagtgttttgatatacatgtacattgtgaaatgattaccatagtcaagctaattaacatgtccattattttacatagtgtgtgtgtgtgtgtgtgtgtgcgcatgtgtgtgtgctgagaacccatcagatctattctctagtgaagttcatgtatacgatacagtattatgaactatagtcaccatgtttgcattagtcagggttctctagaaggacagaactaataggatagatgtacatataaaggggagtttattaaagagtattgactcacacgatcacaaggtgaagtcccacaatagtctgcctgcaggctgaggagcaaggaagccagtctaagtcccaaaacctcaaaagcaagaaagtcaacagtgcagccttcagtctgtggtcaaaggtccaagagcccttggcaaaccactggtgtaactccaagagtccaaaagctgaagaacttggagtacaatgttcaagggcaggaaacatccagcacaggagaaagatgagggccagaagacttagccagtctagtccttccacgttcctctgcctgcttttatcctagcccggctggcagctgagatggtgcccacccagattgagggtgggtctgcctctcccagtcaactgactcaaatattaatctcctttggcaacaccctcacagacacatccaggaacaatacttggcatccttcaatccagtcaagccgacactcaatattaaccatcacaagtccaccccttgtctacttgaacccatacgcatctcctgaaatcatatataatcttcaaataaagataataataaggtcataattatgttaggtaatacataatacagctatccttcgtacaaccagaagtgtaccaatccccaacccaaatgctgttacataaagttaacaacatttaaatgctgatttgaagtaaataaatcttatgtcacatgataaaggaaaaagaaaggaaataaaatgaagatattttcttagtacaagtgtatacatacacaaacatgttcctaacaaaataaggaggaaatatgacaattacagtcctcatttctgcagctggtcacgtgggcatagccggtattgatgactaccttcttctactacccattctgtattccttttgccttcagcaagcatctcagcaggttgtggttttttacctggtggagtgacccaaacattcattcctaaggggtctgggccttatgtagcactgcctggattgggctgttgtagtttcccattgaccttaatcacagggcatggtaatactaagagttgcctgaagggatctcctgtattccttgcatactcttccttacctccactgtggagtaatagactaacttcatcttgatagtccaggtcaatcaccacagccaacactgcaactcccttctgagcctgttgacttagaggtaaaaggatctcaaagtgtccaggtggcaagcttaacttccagtttaatggaatccttgttgtgtcttctggtggcagcatttttccctctgaaactaacacaactaagcaagcagaaggtaatgtattgggaacaggaagcaaaaattttgctagtggatagctaggggtgatggtgagtggtgccacttccacttctgccccttgattcctagacctgtgaatcctggctatgggagaaacggtgccatatattggatgttgattcagagcatacatagccttctggagaattttgccccagccctgcaaagtattgtcccctagttggcattgtaattgtgacttcaaaaggccattccaccgttctatcaatacagctgcttcaggatgacgggaaacaatgttgtacattagatcctccaacttattcacactgcataattggaactttggaccttttgaccaaaaccaccccatagctggcactccccatactctggctaccaccattctactctctgttagcatgactttgacttttttagattctgcatgtagttgtaagtgcctctcttcagatgatcatatgatttttatccttcattttgtgaatgtggtatatagcatttattgagttgcatatgttgaaccatccttgcatcctaggctcagttgatcatgatccttttaatgtgttgttgaatttagtctggctaatattttcttcaggatttctggatctatgttcatcaggaatattgatctataattttaattttattttattgtgatgtccttgtttggctctgctatcaaagtaatgctggcctcattaaatgagattggaagtgtttcctccttttcaattatttgaaagagtttgagaaggattggtgttaattctttaaatgtttatagacttcaccaatgaagacatcaggtgctgagcttttcttagttgagagtttttatttctgattcaacctccttactcattattggtttgttcagattttctatttcttcctgattcagtcttggtaggttgtatgttcctaggaatttatctatttcttctacattatttaattagttgatgtactgtttttcatagtagtctcatgattttctgtatttctgtggtatccattgtaatctttcctccttcatttataattttatttgagttttttttctttttctcctaattaggctaaagatttcttgatttatctttttaaaaacaataacagtgtcattgaccttttctgttgtttttctagtctctatttcatttatctctgctctgatctttattattttctttcttcctctgtctttgggcttagttttttttttttactttcttattgcttcaggtgtaaagttaggatatttcagatctttccattttcttaaggtaggtatttatcgctataaacttccttcttagaactgcttttgctgcatcccataaattttcaatgccacaaattttgtttctcttttcatttttctcaagacattttttgattttccttttgatttcttctttgactcattggttgttcaggagtatgttaattttcatgtatttgtgaattttccatttttccttctgttactgagttctacttttatgccattatggttggaaaagatacttgatatgatttcaatccttaaatttgttaagatgttttccatggcctaacatataacctatcctggagagtgttctgtgtgcacttaaaaagaatgtgcattctgctgcttttgaaaggaatgttctgcacatgtccgttaggtctattggtttatagcattttgaaatccacagtttccttgttgattttctgtccaggtgatctattcattgttgaaagcatgttgctatttatttctcctttagttatgttaatatttgctttatagatttagatgcactgattttgggtacatgtgtatttacaattgttatatcctcttaatgaattcacccttttaccattatataatgaccttctctgtctcttgtgacagtatttgacttaaactctatctcatctgttataaggatagccacctctgctttcgtttggttatcatgtgaatgcaatctctttttcatcccttcacttccagcttatgtctgtccttaaagctaaagttagtctcttacaggcagcatatagttagatcttgttttttattcactcatccactctctcttttgattggataatttaatacatttacatctaaagtaattattggtaggtaaaggcttactactatcatgttgttaattgttttctgattgttttgtagttcctttgttgcttctttttgtctcactgtcttcctttgtgacttaataacttttttggagcaatttgctttggttcctttctctttatgttttgtatatctactacagactttttctttgtggttatcatgaggtttacataaaatatttcatagttataaccatccattttaatctggtaacaactttgactgcatttaaaaatactgtattttaacttctcctcctcccacattttattattcatgccatagtttatatcttttgtatgttgtgtattcattagcaaattgttgtagttatagttatttgttaatacttttgttttttaacttttatactagagttaaaagtgactgttgcacaataacagtattggagtattctgtatttgactgtataagaatacctttaatagagttttattctttcatttgttttcatgttagttagtgtccttttgtttaaacttgagaattccctttagcattttttgtaaggcaggtttaatggtgttgaaatcccacagcttttatttgtctggtgatatgatttgttcctgaacttccacccaaatctcatctcgaattgcaatccccaggtgtcaaaggagggacctgttgggagatgattggatcacgaggtgttttcccccattatgttctcatgatagtgagggtgttctcatgagatctgatggtttaaaagtggtggttacccgtgcgcacatgctctctctctctcctgctgccttgtgaagaaggtacctgcttccccttcaccttccaccataattgtaagtttcctgaggcctccccagccatgaggaactgtgagtcatttagacctcttttgtttataaattacccagtctcaggtgatatcttttagcagtgtgaaaataaacaatacagagaattggtactggcagagtgaggtactgctataaagacaacctgaaaatgtgaaggcaactttgaaactgggtaacaggcagaggttggaacagtttggagggcttagaagataggaagatgtgggaaagtttgaaacttcctagagacttgttgaatggttttgaccaaaatgctgatagtcgtattgacaatgaagtccaggctgagatggtctcagatggagacgagaaactattgggaactggagcaaaggccattcttgctatgctttagcagagactggcagcattttgcccctgccctagagatctgtggagctttgaacttgagagagatgatttagggtatctgtcagaataaatttctaagcagaaaagcattcaaatataacctggctttttctgaaagcatacagtcaagtcatatgcgttcacaaagagatggtatgaaattggaacttatgtttaaaagggaagcaaagcataaaagtttggaaattttgcagcctgaccatgtggtagaaaagaaaaaccaattttctgaggaggaattcaagccggctgcagaaatttacataagtaatcaggagctgaatgttaattgccaaacaatggggaaatgtctccagggcatttcagaggtcttcaaggcagcccctcccattacaagcccagaggcctaggagggaaaaatggtttcatgggccctgctgctctgtgcagccttgggacttggtgccctgtgccccagccactccagctccagctgtgactaaaagggtccatagctcaggctgtcgcttcaagggtgcaagccccaagccttggtggcttccacgtgctcttgggtctgcgagttcacagaaaacaagagctgagctttgagagcctctgcctagatttcacaggatgtgtggaaacacctggctgtccaggcagaagcctgctgcagggacccagccctcatggagaacctctattagggcagtgcagaggtgaactgtggggttggagcccacacacagagaccccactggagcactgcccagtggagctgtgaaaagagttcccccatcttccagatgccagaatggtagatccactgactggaaagttgcaggcactcagtgccggcccatgaaggcagccgtaggggctgtaccctgcaaagccacagggacagagctgcccaaggccttaacagcccacaccttgcatcagcatgccctgggtgtgagacaggggctccaaggagattattttggagctttaaaatttaatgacttccctgctaggttttgcatatgcttgggacctgtggcccctttattttggccaatttctcccatttggaatgggaacatttacccaattcctgtacccacattgtgttttggaagtaactaacttgttttttattttaaaggctcattgagggaagggacttgccttgtctcaaatgagactttggactcggacttttgggttactgtggaatgagttaagactttgggggactgttggaaagacatcattggttttgaaatctgaaaaggacatgagatttgggaaaggccaggggaagaatgatatggtttggctctgtgtcctcatccaaatctcgtcttgaattgtaatccccacatgggattacatgggaggggcctggtgagaggtgattggatcatggaggtggtttcccctgtgctgtgatctcatgatagtgagggatttaaaagtgacagtttcccctgcacatacacactctctctctcgtatcaccttgtgaagaaggtgtctgcttcccctctgccttccatcgtgattataagtttcctgaggcctccccagccatgggtaactgtgagtcagttaaacctcttttgtttataaattacccagtctcaggtagtatctttacagcagtgtgaaactggactaatacatctgggaaattctttttgtctccttcctttctgaaggacagctttgcctgatattatattcttggttgccaggttttgtactttcaatactttgaatatatcatcccactctctcttggcctacatgatttctgctgagaaatccaccaataatcttatgaagcttcccttgtatgtgaagaattgcttttctcttgcttctttgaaaattctctctttgtcatggtgaggatttcttttttttttttttttttttagatggagtctagctctgttgtccaggctggagtgcagtgtgcagtggcgcaatctcggctcactgcaagctccgtctcctgggttcacaccattttcctgtctcagcctctggagtagctgagactacaggtgcccaccaccacgcctggctaaattttttttgtatttttagtagagatggggtttcactgtgttagccaggatggtctcgatctcctgacctcatgatccacccatcttggcctcccaaagtgctgggattacaggcatgagccactgcacctggccgaggatctctttatatttaatctatttggagttcttttgggcttcataaatctggatgtttatttcatttatgtctccaaattttgagagttttctattcttatttttttaaataagtttctgcaactttctctttctctacttcttctggaactcttctaatgcatattaattttcttaacagtgtcctataagtcttgtcagctttctgcaatttttatcattccttttattactctgactgggtaatttcaaatgacctgtatctgagcatgctgattctttctcctgcttgatctagtctgctgctgaagctgtttgtgaattttttcaattcagtcattttgttctttagctccagaatttctgtttcattcttttttatggttcctatctatctttttgttgaacttctaattttgctcatgtattgttttcctgattttgtttactgtctatctatattgttttgtagcttattgagctttcttaaggcaattatttttagctcttgtcatgcagtaaagatctccatttctttagggtcacctcctgctgctttatttccttcctttggtggtttcttgtttccccgattatttgtgatcagtgtggccttgcactgaagtaggcacctatttcagtctttacatactagcttcagcagagaaagccattcactagtcagattgaccagagattgttggtgggctgtctgttggggtctatgcacaggatttctgctggagttctaaggtgggaagggctggattctgggttcattcactgtggttgtctgtattctgtgcacaaggactggcttgaagcatggatccttgggggctgacttggcactgaaatgagccttaagcctgcgtctgcaggggccagcctaacatggggatcacctggcacctgagttcatggggataggcctgttcctgagtttattcaggctgtcctgggaacaaggtccactggggtgagcccagcatctgggtccacatggcccagcatggagccaagatctctggaggctgacctggtgctggatctgcaggggatggcctggattctaggcccatgggtgccaacttggagcctggggttgctggggctaacgtggaggctagatagagtcttgggggccaggctagagctggagcaggcctgaagtctaggttttgtgtggccatcttggagcctgaagccccaggggctgacctggtctggggtgagcatggggctgaggccacagaggctggtctggcctgtggcaggcctgaatcctggtgctggggtttactggagtgggcttggtgcttgggatctgtggtgaagttaggttctatcttaactgtccctcctccatgcaagagggcatctctctccatactgtgctgcccaggcttgaaggtgagatgacaccggtaatgtgaaattgtccttcctatacacttctatgtgtcttttcttatttctgtgctgcaaccaggtggcataacctctcacctgattccttagctctagtgaagttattttcgtgcatggatacttgttcgaattgatgtttctgcaagggatgagcgctagaaactcctgttctgacaaactcctattcctattcttgctgacatcactccctgaaatagttaatatacttaacagctgaacacggataggatgttcatggaatatgttgacaggacaaaaagttgaaactgttggcagaaacccaaagtcaatattgaagccaagcaaaatattgcctgcagtgccacattagaacagcttgaagaccgttcatttttaagtgacaagagactcacctccaagaagcaattgtgttttcaggtagcaaatttttattattctgattgtttccaaataaactataatttttaagtataattttttactttatgagaaaattaatcatttatattctaatttcctgagtatgtagagagtatagataatgttcctttatgtagaaatatttaaatgtaagatgattttaaatcagaaagaatatttgattgatttaaaatttttaaatgggctttaatattttcagaggttttctttacttagggatttttggactgacattattgccattatttattaattttgtttttgcccaaatcaagaggtttcataattgtttactctctctctaccaattccctttccaacattactagccacagagttggccaatgaacaataaacacaacagtagtctggaggtctcaatttgtatcttgggaagcattataaattttccaactccctagacacaaatgtaccaaaaaaaaacccttgttttctataccagtaattgtgtgctttgtcttgcaattcagacatttacaagaaaatctaaatcaccttaaattaagatttatgttaaatgtggtctaaaaccagcagagttatgtattgttttcttttttagaatgattttattcaagcaagcaacttatttcatttccttgtttgctacagtttcctgtggtaagtgaattatctataaaacatggaattcaggctaagacaggagtagccaagcaagtggcaccacccctggagaaagctattgaacatacagcttcgggggtggagattgtccctgatgattcaggacacgtgtctatttaatgttccacaacaaggaccacttgtcaggtatattgctgtagacatatgttgcagaccagaggaaggagctcagaagtaggaatgtcttgggacttgtgttaacaaaaacttctgttcgcagatgacactctgcaaagcaaaacttgaaacaaaaaaaaattagtcctctatttttattatcaacagtaaaaaattaaactttatctgaaaattcaaaagagtgctaggcattttatagtgtctgggtccaatccaagtatctgttaggaacaccatacatagttttactctggaccgctagggaaccatttcaaaaatgaaagtaactggtttaaatttaacttagcaaaccatgcatttggatagttctaggtgaatagctttcaacaccagatttagatctcatttctctattaatttcattaatttttggagaataaaaatgattctggacatttcattaatcattacagagggagttttctctgtgtccccacaaggcatgattctgggtctatggtgacttaagagggccacacaacaatgagtatttaattttcctcagatgtatggctacaataaacatctataggtaaggtttacattcataaagagacctttttttttccaggaaaaaagacttttattccccctaaatcacaactcccctgtgtctgtccctcaaccctgatttctcttctaaaccgtaatttacaaacccatgtgcaaacccactgaaaggtgagaaggagcataagccagagacactgggaaccacagccaactacagggggtttttcatttttttgttttgttttgttttttggcaaaataaatcatgattatggctaggaaaatcagggatgtaagtaagcaaaaatttagaaactacatattgcatgtagtccccaaattcagaaacagtcatcgttaaacatcttttatttagtctttcagatatttttctacatatacctatttgcacatttcacaaaaaagagttattaactgtggacactctttgacttgcattttccacttatagctatcttttggtgcaaataagtaatatattttggagcttgctattcttctctttttatggtatttttgtgtgcacattcttatgctcttattcagttatttctgtagaatacaatttttgaaataaaaatactagattcaaaggtgtgaatatttttgaaggttttgtggtgtggtatcatgaaattaggtttcagaaagtttactccatagttgactttttctaccagctaataagagtgctcatttaccccacttaggccaactctaacaggcttctgttgctttgcatcctgacatatttatctttctggaaacagtgtcctaatttatttctgcagagctactgcctctcagttttggtccatgtggttctggtgaccctgattcttctgctgaaccagaaagtgcacacatcctcctggctgtggtgacccaatcagagccaacgtcttgcaatgaagcttttctttagacatctagaaataagactcttatgttttttttttccaatttgacttgaaacttaagacaatacacaggcctgagttgttggtactattttgctactacgtggagcttgagagtaatggtaacaccaagactggagcaagtggaaggagacatattgtccactgatgctatcagttgagcacaatgtgcagttactttttaagccagattcaccatgggctttttggctcctgaaccaatagatttcatttgttttcaagccactttgtactaggttttccatcatttgcaatcaaaaccagtatacaaacactggttatttaatttttcatttttgctaatctcagggataaaatggcttctagttgttttaacttggctatatttgtgattcttcccattttcatatacttactaatcacttctatttcttttgtaaattatcttttcatatttgttatctaattctttaaaatttgagtactttaattctcattattgtttgtggaattgttaaacaagactgaataatctgcccaaagtccatggacatgggggcccatgtaaaagctttgaaagccaccatcattatgagataaattatataatagtactttacataggctccaaaatacagcacagacacagctatcattgtcatggtcatcattatcatcatgatcaccaacttatgaggataagcaagaacacctactagaagtttctttccattcagcaacaaaattggtgtctttctagtcactcccttccctgactgtcacatagcagttcacagaggctcagttgcagaatgagaagctctgggccaggacctgccattgtatgcatccttgcatgggaactgggggctggaagaggagtgactgcttgataattatgagtcagtcaaaaccaccaactgtctgaaaaaaataggcctttttgtaactagtattgtcactaaaccaactcctccatgttttgtgcatacatgaaatctaggcaatacacttgtattcccaaaagcttccacttgaagagatctgtgctctttccaaatataaaccttacccgagaggtggtcatcttggccacacctcagagagggagagaggcagtcttgttgggttgggtggtcataatggggctcagggccaaatccccagggggtaggatagtgcagagaagatggcactctccagtgcttaataaaatgcacgtggtctaagctgcccactccctcaaaggcaataaaaaataggtactatttaaattgaagagtaactactgccccagggaatggacaggttgtcattggaatagccatggttaatggtcccagttgacaactgaaatgaatgtgctacctgaacaggaaagcttattaaccagatttcaaagacagtctttcccggtaaatccaaatttacaaattaaagccagtaaagacaccgaattctctaataatatgtggggtgcagtatattttagagctgggaataattccaaacagcaaatagttcaaaatttattttcaatttagcatatgcatgcatttgcttaaactgtcttaaaaatgagtaaaaaatactgtcagtttgtttcaatcatactgagatgaggaacaatgtttagcattgcatgctagaaaaggacacaggattgggagtcagggctgggtgaccgtcacaggactttcactaactgtgtggatcttgggcaagtctgtgtgccctgagactcagttatttaactttcttttaaaaaacatagtccagatgcagataacaaagcctgcctctaatttcccttacagaattgtgagaagctggtggagatgtttgttacaaaagtgttttgaaaatagagcaaatattattctttttaaggcatgatgttttcatagcatgtcaggcaacaggaaaaaactaagttaggattttattttattgtggggaatttatgtgcaaattattgtgcaatttaatgaaaataagccaatgttttatacagaagtacccagaaaattaaataacactatacattgttcaaatagttgccttaatatattttattttctcagcataattagagttgtattatacaggtctttgagtagtcagtcagtgggagaagttaagacaacagatatctttttattaaaattattatatgaattatcgcaaattaatttttatggttctgtcacaggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtaaaagttggtatttcattattggagaagctgtttttcaaaactgaatcagttttgtgcagaaaggtgtagtataactgagagttcttcctcacacggggttcaaggaccagcttcagcaaaatcccgtcaagtggttcttacaaatgcagattcctaggccacaacccagatctgctgaaccaaagtttcttgtgaccaggaatctgcattttaaacaatcactgtgtttctttaaagtagtagaagctagtcattttctattcaaagcctcaaaatgcttgaatatcattgggctaagggattgtctcaagaaagagtctaacaggtgcacatttcatctgaataaagaaacagatttaactgtgtgacccatgatcacattagcggatagcacagtccaaagaaaataacataagacaagcattttgctgagaatgtaattgagaaagatctagaacttgtgattttgggacagggcagttctaaatggggcctatagtgagccagtttgggcacctgtggcatgatgctatgtatggtgtgtgtgtgtatgtgtgcttgtgcttgtgtgaatatgtattattaactggaaatttgtaaaagtattggaaaaatagtacttacgattttgtgtgtgtgtgtgatggagtctcgctttgtagcccaggctggagtgcagtggcgtgatctcggctcactgcaacttccacctcccaggttcaagcgattctcctgcctcagcctcccaagtagctgggattacaggcacgcaccaccacgtccagctaatttttgtagttttagtagagacggggtttcaccacattggccaggctggccttgaactcctgacctcgtgatccacctgcctctacctcctaatgtgctgggattacaggcatgagccaccgcacccagcggtaattacaatttttattaggtcagagagatgcttattaatcacgagccacagtttcatcttaatgatttttccttttgattaatatccagagtaagcttttctttgttgttcccatttccatgttcataactctttactcatcttcactctatgtgagtttaccaactagaaattggatagtcattctctgatcccacatgttaaacttgtagagaaaactcagattgtatgtgaggatcatcatattaaaagtggaggaaggttctagaattcttataaataatgaaattaacatgaaggtggacatctaagacagagggaagtcttccattaagtgcagactacaaggagttaataagcaagatgaacacgatatacaaatccagctcttatcactaagttaactttttaagtaaatgaaagtatttgcaaaaataattaccaattgagaacatagttgcctgaaagtttaagaacacaggaaaaatcattaactctttaatatggttgatttcctgtacttaaaaaatgtgagtgtaaagaaaacgcagtgatggagttagatattatggggtgttataaaattagctctaagagtgttctttccagcaagtattggggaagctatattattttccttattcctggttttatttgttagtgtgtagaaaatgctagacatttcctcaatgtatgtttattattctacttcctaagtaaagctacttttaaaataggtttggttgcttcttgaaagatagtgttacaggaaccctgccaaaagtacatcgaacaggtgcagtttctggacattccttgaagcaatgtggtcatcaaataagtggtaagttgtgaatttcttagctacatttgagttaatattggatctcgcttagaacagcttttgctcaaagtttgtactgctacagctttttggaaggcatcactcataaagataggagatggggcagtattctggacacaaaagagggacccatattcatctggacacttctattgtctttataaatcaacacatacttaatgagcctctattatttatgaggttagcgctcaagtgtaagatttgcagaaaatgaatccaaataattgtgtctcgtttccagataagaatttttaagaaaacacaagggaacatctctctcaagttcacttgagggtaatttttacatcagtgattctcaaccagcagtgattttgtctcttccactggggacatttgacaatgtctggagacatttttggtggctacaactagggaggatgctattagcatttactaagtagaggccagaatgtttgaatgctgaccaacattctacaaggcacagggcagtcgtccacagcaaataattttctggcccaaaacgtcaacagtgctgacatcaagaaactctgtgatataccactaggcccaaattgaagaactgagttctgcaaatcttgctaagaataatacttcctaaaggaaacttgaggactaggatgctagagaactttgattctgacatctgaagctactgatgtcttgggaaacagtttccaatgctatcctaataaatttaagacaaatgaactatttctcaaacatgactgggactgataagaaagtgaaaagtgctgaaaagattcaactgatgggttgtcagaatcttaaaataactgctgttattctatgtatgactatatatcattactattttattttcattatgcacaattaattttgtaggttcaaatttcagatgtttttaaatttgtcatcctttcctccctcattgatatcacctcttcaatacgtacacactttgagcctgctgtttgcattttaaccagttatcaaaggatggcaatgccttcattataaatgtgggcctgacttagccagtataataggtgtagtctacgtgaggtggagtacatttcctattttaaaagatcaatttttatgttaatccaatttggtataaattattcgagtaagtgctatttctgattgttgtatcttgtagcaaaatttaaagaaaaagtaatttgtgcctttctcaatattcctgttattgttcatgtattctaaaactcactgttactcacttagcttgcttttaatgttttttaaagtgaaaaattgttcccaagtacataaaatctctacactcaagaacaattctagtcaaaagcatttagagcttccgtatgaacacttaaagagtttttatttgtaagagtcgcatcccaactcttagcctgttcttttctcacatgcagaaaaataggaaagagacttcgtttccacagtctgcaaattcctgtgtttaagaaccacagtgaataatccacctccctgcccaactcatcgtactgtcatatagttttcctgacagtttgtgtattttctgtctttcccacccttaaatttagttttatgacttcaaccatacttcttaggagtggaaaggtatctgtagtagattatggtttattccacataatcttggggaataaaactttaaaaaagtatacagtttatacttctggttacattacttccttaaccaaaagtctaaccaagaaatttgaatctttaaaaaaaaaagaggccgggcgcggtggctcacgcctgtaatcccagcactttgggaggccgagacgggcggatcacgaggtcaggagatcgagaccatcctggctgacacggtgaaaccccgtctctactaaaaatacaaaaattagccgggcgtggtggcgcgcgcctgtagtcccagctactcgggaggctgaggcaggagaatggcgtgaacccgggaggcggagcttgcagtgagtcgagatcgcgccactgcgctccagcctgggcgacagagcgagactccgtctcaaaaaaaaaaaaaaaaaaaagagcctaattttgcttcactgtctgtgaaaagaattatctgtatcttttgcatgtaagacaaatctcaatgaaaagggtgcttaaatagaagttaacactattttaaagcaagaatggaagtggtttcatcatgcgtaaacaacaactctccacattttgtaatgattgatctggatgcaatttgtcatcagacaggagaagtcgaaagcaaagaaataacactgggagatagagaagctctttcattcaatgcgaaaggtcaaaggcacatcagtttctttaataatgcaaacctcagcacacattatcagtgtcctcattattattgccttgtttatttcccactgctcattgataatttcaacgtgaaatttacctgtattgctgcatgcatcttgcagtttaagaagtgaagtaacccaatttcaaagctagtgctttagggaaaatattggattgtatttacttcaagcagagttcgataatttatgtacataataaaaattttaaatcccttagttaatatagcagttgccaaaactgggctattatcattctaaactaccaacccaaatggtagtgggtatctaatctacctctagaaagaaaatggactgtatttgctctatgtatttttcttgtacagcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggtgagtacaattcaaggtgtgtgttctttgtattggtgcctccaggatttcactgtattcttcttaacctcttttgttcccaaactaaaaaccaaacagggcttttattctaaccactttcctcatttacttactctattttatttttttatcttttatttatttatttatttattgagatggagtcgcgctctgtcgcccaggctagagtgcagtggcgtaatctcgactcactacaacctccgcttcccgggttcaagcgattctcctgcctcagcctcccgagtagctgggattacaggcgtccgccaccatgcctggctaatttttgtatttttagtagagtcggggttttactatgttggtcaggctggtctcgaactcctgatcttgtgatccacccacctcagcctcccaaagcgctgggattacaggcatgagccactgcgcctcgcccttcattttttaattaaataattcatttaatttcatttgtttctctactcttttcccctggcatgtaattgtaccgcatcttcaaagcctgacatcctcttcccctacttctccaaagctgattcttgcaggtctttcctcaaataccgtcccctccaaaagcccatttctgagcattctcttttaagtcacactcagctctgtttatttcattcatagagctaatcacaatttgatattaacttgtgatttttttccttatttttaaatcttatttttatttgcatagatgtatggggtacaagtgtaattttgttactttgatgtattttacagtggtaaagtctgggcttttggtatatccatcactggagtcatgtacattgtacccactaagctatttttcaacgcccgcccccttcccacctctctgtcaccttcccagtctctactgtctatcgctccatgctctactcaattttggtgtcattttttcctgaagcaaaattttggtgtcattttttctgaagtcattttctgaagtctgtgtcatttttcgctttcctgaagcgaattttggtgtcatttttcctgaagttccgtttgccccacacataggccttgcttatagaatgagggtttagtgtcacggagtctcctgcctcattctcaccctaacttttcctttacccctttgcgaggggaaggatgtccattaggttaataatgcagacccctaacccactcattatcagggtcattgtttttccactgtgcattttaatactaactgttacctgcactgctccctgcccctcaaagtgcagaaagcaaagtaacctcttttcttcccattcaggaacaattgcctattaaagtacagtcccggaggaacacctaccgctataaaggtgctgagtaacgtggaatctggattctcactgaagccctgtgccctttcagaaattggtaattgtaggactacttcactttgtgattgtggtaggtggaataggagcccccagagacgtccctgtgctgagccctgggacctgtgcgtgtgttcccatagctggcaaaagcgtttctgtcaatggcatgcagttacgggcttcgagatggggagtttactctggattttctgaatgggcccaatgtactcacagggttgagtgctcacaaggctcataagaaaaagagagaggcggaaggctcagagccagagagagaggtttgaaggtattacactgctggctttgaagatgaaggtccgtgagccaaggaatgcaggcggcctctagaagttgaaaagggcgaggaaagagtttccctgtggagcgtcctggaggaagaagccctgctgatgtcttgattttagcccagtaagacccaatctctagaacagtaagataattaatttgtgttgtttttaaccactaagtttgtggttatgcccctagagcagcagttataggaaactagtacagtgatactgttagagttataggacagtgatataggacagtgatactgttatagttataggaaactagtacagtgatactgttagagttataggacagtgatataggacagtgatattgttatagttataggaaactagtacagtgatactgttagagttataggtacagtgatattgttatagttataggaaactagtacagtgatactgttacaggtacagtgatataggacagtgatactgttataggaaactagtacagtgatactgttagagttataggtacagtgacataggacagtgatactgttatagttataggaaactagtacagtgatactgttagagttataggtagagtgatataggacagtgatactgttatagttatagaaaactagtacagtgatactgttatagttataggacagtgatataggacagtgatattgttatagttataggaaactagtacagtgatactgttagagttataggtacagtgatataggacagtgatattgttatagttataggaaactagtacagtgatactgttagagttataggtacagtgatattgttatagttataggaaactagtacagtgatactgttataggtacagtgatataggacagtgatactgttataggaaactagtacagtgatactgttagagttataggtacagtgacataggacagtgatactgttatagttataggaaactagtacagtgatactgttagagttataggtacagtgatataggacagtgatactgttatagttataggaaactagtacagtgatactgttatagttataggacagtgatattgttatagttataggaaactagtacagtgatactgttagagttataggtacagtgatataggacagtgatattgttatagttataggaaactagtacagtgatactgttatagttataggacagtgatataggacagtgatattgttatagttataggaaactagtacggtgatactgttatagttataggtacagtgatattgttatagttataggaaactagtacagtgatactgttagagttataggtacagtgatataggacagtgatattgttatagttataggaaactagtacagtgatactgttatagttgtaggacagtgatattgttatagttataggaaactagtacagtgatactgttagagttataggtacagtgatataggacagtgatactgttatagttataggacagtgatattcttatagttaccgtggtatagttatagttaaaggtacagtgatattgttatagttataggacagtgatattgttatagttataggacagtgatgtagttacagtgatataggtacagtgatattgttatagttataggacagtgatatagttataggacagtgatattgttacagttataggtacagtgacgttgtaatagttataggacagtgatattgttatagttataggtacagtgatgttgtagcaaaactgtaaggtcattccttggttgtgtccctatctagtgaaatgactctaccaggggtagggaaataaaactctgtcgtttcacacataaaggtaatttcaatggaattatccagaaaattgccatgacattccacctcatttagcatgtcaggatgttaatgacaagatgttactaaaagcaaatcccttacggccagttttccgcagtactgggtgctggctctgtgcctggccctgtattgggtgctgggctaggatttccctgtggaagattgggaaggttggttacaaggtggctattttcctgtctcctctttgcgacagcacaccttctccatggtgtgtgccaggttcacgtgtactggtgatttaattttaacgttcatattatttttttctgggagagtttttgaaggctgccaggaggcaggactcgatgcaaacatgctccattctgtacccagccctgttgctggaaggatttgctgcacttacccagggaacaggcaagctcgtgctgtggctctgggctgtcacagctgctgtccacacctgggagagcaccctggatggctcatctgtgtacttgctttcttgttaaattgcagtgagttcacatgtgatttaatcggatcaaatggcctttacagactgataaaaatatggctgtttcaggtggtgttttgagctgctaagggcgtggcttttcactgagtacgtggtccccgttcctcagggaacacccagtagccacatgcctcctaaacctagagtagggctgtctcctggcctaactgcccaaatgagattcataagttagggatgatctgtagttatcactacagatttgtccttggtttcaccaaggattttcctaattttacaaacaaaacccctaaggctcctggaaggagggtagaagtgaaggtgctccgggggcaacacagctgatgagctgaaccagaactcgacccttgggtcacacacatttcacagtgctcactccaccttttgtttttttaatggatttaatggtgttttaaagcctcctgcctctcaacacatatgaattcattatatttacagatttccttctcttgtggtccatcttcctgcatagatcttgagagatgtcaggctaaccacgtttcctcagttaatttaacaaaaccatttgcaactctgacatggaaaattcctaccatgtgacttattaatttatcaattgagatggtacacatattttcaagccaaaaggaggaaaacataaattggaaaaaaaaggtttttttatttttatcacctctggggaagaaagtctgataaacgaagctggttgataaaattgcaattaggggaagcaacatcatggtttctgttcggaggctaaccagatggcatacttgaaatagagaatgtcctagaaatcaactggttgcttggccaaaatatctataaatagtgcccaacatattagataggaaaagcaaagtaaaaacaattttaacaggttaggacattgggctgaagtattgcatatatttaatgtcatgtgcgtccgtgtgaagagaccactaaacaggctttgtgtgagcaagaaagctttttaatcacctgggtgcaggcaggctgagtccgaaaagagagtcagtgaagggagatggggtggggacgttttataggatttgggtaggtagtggaaaattacagtcaaagggggttgttctctggcgggcagcggtggggggtcacaaggtgctcagtgggggagcttctgagccaggagaaggaatttcacaaggtaacgtcatcagttaaggcaggaaccggccattttcacttcttttgtctttcttcagttacttcaggtcatctagatgtatacgtgcaggcctgggcccagaggcctgacattcctgtcttcttatattaataagaaaaagaaaacgaaatagtggtaaagtgttggggtggcgaaagtttttgggggtggtatggagagataatgggcgatgtttctcagggctgcttcgagcgggattaggggcggcgtgggaacctacagtgggagagatgaagctgaaggaatattttatggtaaggggtgatattgtggggttgttagaagcagcatttgtcatatagaatgattggtgatggcctggatatggttttgtgtgaaatgagaaactaaatggaagacacaaggtctgaataagagaaggagaaaaacaggtgttaaaggactaagaattgggaggacccaggacatctaattagagagtgcctaagggggttcagtgtaattacttgcttggttggtgagtttttgggctctatccttgacagagtcctcctttttaagttggaggctgagcttggtgaggtgtgtttttaaaagaccattagtctgttctacctttcctgaagattgaggatggtgaggggtatgaaggttttactgaataccaagagcctgagaaactgcttgggtgatttgactaataaaggccggtctgttatcggattgtatagagatggaaaggccaaactgaggaattatgtctgacagaagggaagaaatgaccacggtggccttctcagaccctgtgggaaaggcctctacccatccagtgaaagtgtctacccagaccaagaggtattttagtttcctgactccgggtatgtgagtaaagtcaatctgccagtcctgggcgggggcaaatccccgagcttgatgtgtagggaagggagggggcctgagcaatccctgaggaggagtggagtagcagatggaacactgagcagttattttttgaggatagatttttacgacggaaaggaaaagtgaggttttaagaggtgggttagtggcttgtaacttacatggaagagtttatgaaatgatgacagaatagaatgggcctgtgaggctggaggagatattttccttggtccaagaattatttgccttgtgtgggaagagattgataggtggaagtttcaatgggggagtagatgggagtgacagatgaggaagaaaaaaactggctgtgagggatagaagttggaatgctcgctgcttttttagctaccttatcagcataggcattgtcctgagcagtgggatctgatgccttttggtggcccttgcagtgaatggcttcagcttcctttggaagtaaagtggccttgagaggagtttttattaaagaggcattaagatggagaacccttgtgtagtgaggaaacctccttcagcccatataaccgcatggtggtgcagaatatggaaggcatatttagagtcagtataaatattgacacgtagtccctttgcaagagtgagggcctgagttaaggcaatgagttcagcttgctgagaggtagtggagcggggcagagcagtagcctcagtgatagatgtggaagatactacagcatagcctgcctttgctggtgagtggtgattaggcctggtggaactgccatcaataaaccaagtgtgatcagggtaaggaacaggaaagaaggaaatatggggaaatggagtggatgtcaggtggatcagagagatacagtcatgggggtgggggccagcctaaaacagtaaggtcaagttgtttgaacagaaaggctacagggcgtggtcctggctcttgtgtaagaattttgactgcgcagccctgcacttcggctgtgtgtaatgaaaagggttgggatgagttagggagagctagtgtgggagcagtttctagggctgtttttaaggaatggcaagaggagtggctaaaggatttaggatctttggggtcagctagctttgcttttgtgagtttatataatggtttagtcaggatggtaaaacttagtatccaaaggcggaagtacttaaccatacctaggaagaaaaggagttgttttgtagaaggggttggggtttgggagatgagccagacacaatcagcagggagagcacatgtgttttcatgaagaattatgccgagataggtaatggatgaggaagaaatttgggcttgactgaagtaatgggggctgtcctcgaagccttgtggcagtacagcccaagtaagttgctgaggctgacgggtgtcagggtcagtccaagtgaaagcgaagagaggctgggatgaagggtgcaaaggaatagtaaagaaagcatgtttgagatccagaacagaataatgggttgtggagggaggtattgaggataggagagtatatggctttggtaccatggggtgaataggcaagacaatttggttaatgaggcacagatcctgaactaacctgtaaggcttgtccggtttttggacaggtaaaatgggggaattgtaaggagagtttataggcttcaaaaggccacgctgtaacaggtgagtgataacaggctttaatccttttaaagcatgctgtgggatgggatattggcattgagcggggtaagtgtgattaggttttaatgggatggtaaggggtgcacgataggttgccaaggagggagcagaggtgtcctatacttgtggattaaggtggggacacacaaggggaggatgtgaaggaggctttgaactggggaaagggtggcattgaggtgtggctgtggcctaagaacagtcagggaagcggataattgagttaaaatgcctcgacctagtaagggagctgggcaggtggtgataactaaaaaggagtgcataaaagaatgttgtccaagttggcaccagagttggggagttttaagaggtttagaagcctggcggtcaatacctacaacagttatggaggcaagggaaacaggcccttgaaaagaacgtaatgtggagtgggtagcctctgtattaattaagaaggggatggatttaccctccactgtaagagttacctaaagcatctgtgatggtccaggaggcttctaaggtgatcgggcagcgtcagtcttcagccgctaagccaagaagatctgggaagcagtcagtcagagagccttgggccagagttccaggggctctgggagtggcagccaggccagttagacagtccgatttctagtggggtcccacacagatgagacacagcttaggaggaatcccaggctgcgggcattccttggcccattggccagatttctggcacttgaaacaagatcctgatggaggaggtcctgtaggaatgcttgaccactgcagtttaggcattttgaagtttttgtgtgtgctggagatgtggctgggttttgtctcacagcagaggcaaggaatcgcaactcagaaatacattgctacttggctgcctctattattgtacatcttgaaggcgaggttaattaagtcctcttgtggggtttgagggctggaatctaatttttggagtttttttttgtttgttttttggttttttttttttaatgtcaggagctgactgggtgataaaatgcatattgagaataagaggccttctgacccttctgggtctagggctgtaaagcgtctcagggttgctgccaaacgggccatgaactgggctgggtttttcatatttgatgaaaaagagcctaaacgctaactgatttgggagaggtcggataaataaaaaggaacattaatcttgactatgcctttagctccaaccacctctttaagaggaaattgttgggcaggtgggggagggctagtcgtggaatgaaactgtaagctggaccgggtgtgaggaggggaggtgatagaaggattatagggtggaggagcagaggctgaggaagaattgggatctggcttggcctggcaaggagcagcctggggaggaggggagaggtcagatgggtccatagaaaaggaggattggaaagactcagcaacacttggggttgggattgagaggacagatgggttgggattgaggggacagatgggagggaaagaaggaagatttgggacaagttgcattgggaacagagactagggagggaccaatgtgtaaaagaatgcctggacgtcaggcacctcagaccgtttgcccattttatgacaagaattatctagatcttgtaggatggaaaaatcgaaagtgccgttttctggctatttggaaccattgtcgagtttgtattggggttaagcagcattgcagaagaaaataaggcatttaggttttaggtcaggtgtgagttgaagaggttttaagttcttgagaacataggctaagggagaagaaggaggaatggagggtggaaagttgcctatagtgaaggaggcaagcccagagaaaagagagggtagagacatggagagaaggggtgggggggtgcttgcccccaggaaagtggttcttgccactaagggtgaaggatcaaggcaggcattcgcgcggtgatcagatacctctgaaacgtgggtgaataatcaagcaggtgtccctgcagtgattaaacagcaaggaaagactatcttcccaagtccatgaccagtgccagagttttgggttcatggataaaacgcgtctcctctgtctctaccagaaaatgaaaggaattgaaattaagagaagggagagattgaaggatggcgccaagattgaaaggaaaaagaggttgagggatagggagagaggttggataagagagtaaaaagaggctgcttacccaatttaaaatcggtgagatgttccttgggcttgttggtctgaggaccagaggtcatgggtggatctttctcatggagcaaagagcagggggacaggggattgatttcccaagggaggtcccctgatctgagtcacagcaccaaatatcacgtgtgtccatgcgaagagaccaccaaacaggctttgtgtgagcaagaaagctttttaatcacctgggtgcaggcgggctgagtccaaaaagagagtcagtgaagggagataggggtggggacgttttataggatttgggtaggtagtggaaaattacagtcaaagggggttgttctctggcgggcaggggtggggggtcacaaggtgctcagtgggggagcttctgagccaggagaaggaatttcacaaggtaacgtcatcagttaaggcaggaaccggccattttcacttcttttgtcattcttcagttacttcaggccatctggatgtatgcatgtaggcttgggcccagaggcctgacatttaacatggataaatgtaaagttcttagaatcatacatacactttggaaaagatggggcttaatcgcactttataagacttgaaggatgtttgagaatcactatgaaactgctgaaaataccaagaaaatttaattcttatgtatataaataatgtgtctgttttacatgaatcccttctacaagcttggtatttaatatggcatatattgttttttcatagtagatttaaaatttttgatatctaatttagataacataaaattaaccctttgaaagtgtacaactccgtggtttttagtatatccacctgattgcacaacgatcaccactgtctagttccagaacatttttatcaccacaaaagaaaggctgtatccaggccgggcacggtggctcacgcctgtaatcccagcactttgggaggccgaggcgggcggatcacggggtcaggagattgaaaccatcctgggtaacacggtgaagccctatctgtactaaagatacaaaaaaattagctgggcatgatggcagatgcctgtagtcccagctactcaggaggctgaggcaggagaatggcctgaacccaggaagcggagcttgcagtgagccaagattgcgccactgcactccagcctgggcgacagagcaagactccatctcacaaaaaaataataaaaataaaataaaaaaaaaaaagaaaggctgtctttctcctttcccattggccgtctttctccattccctactcctccaatcccctggcaaccactaaatctactttccatgtctgtggacttgactcttcgggacattttacataaatggaatcatgcaatgcagcacattttgcatctggcttttttcacctggcgtgttttcaaggctcattcgtattctagcatatatcaatactttgttcctatttaggactaaataagattctattgtatgaataaaacatattttgtttatatacttagtttgatgaacatttgagttgtttctggatttttttttttttttttttgcctcttatgaataatgctgctatggacaacagtttttgggtaggcatgcattttaaattctcttatgtatatacttaggattaaaattgctggatcacagagtaactccatgtttaactttttgatgaattgccaaactgtttttgagagcagctacacaatgttacattcttaccagcaacaattgagggcttcagtctctctacaaccttaacaacacttgttattgtctttgtaattattgcctttctaggcagtgtgaagtggtgtctcactgtggttttgatatgcatttccctaatgactaacaatgttgtgtatcttttcgtgtgctcattttcaatttgaatacattctttgggaaaatctctgtttaaatcttttggccattaaaaataattgggttattttcattgttgagttgtatgaactctttatatactctggatactacactcttatgacatatattattttcaaaaattttctgtgcatctgcaggtcatcttttcactttactgatggtgttctttgaagcaccaaagtttttaaacttgatgaaatccagtctggctttattcttgcacgtgctttacctaaaacgccaaaacctaattcatggttttgaagatttttgcttatgatttgttcttagaggtttatagttttagctcttacatttaggcatttgatgcattttaaattaaattttgtatatggtgtaaagtagcaatccaacttaattcttgcatgtgggtattcagttattccattgtcttgaaacccttttcaaaatcaattgtctataaatgtaagagtttatttttggaccatcagttctatcctgttgacctatatatgcctatcctaatgccagttacacacagtcttgattaccataactttgcagtaagttttgaactcagacagtctgagtgcttttattttgtcctttttcaagattaatttggttattccggatcttttgcatttccatatgaattttaggatggttgtcaatttctgcaatagaaaagcagcaggattttgatagagagtgcattgaatctgtagaccaatgagtatcaatggaattatgtgttatcaaatttagtaaactacataaacgatatgtacacaactaaaacaaaactaagatataagatcatattaatgtaatgataataaaagtggattgtctcctgttctaattttaataggcacaaggcatttttgttaatcacttcttattaaagaattttttataatattcaggaaaatacaacaaaaaaacccttacattcctaaggcctcagagtcagagtaatataaaggaaatgtaaacacatgctgagtaatgcaagcatttggcaatggtggtgactggagctgggagcacagcttttatttctctgaaataggaatttgccccttagagttagaccaattttgccttcctctaaatggcaaacagtttggagatactttaaaggacattttttcacttaggatgtttagtactatgaataataaatagtcacaatttccttaactatggtgacaaaatacaagcaaatttagcctcatgtcatttcctaaggaacatcttctctctgtgagttcacaggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaaggcgagtatgcatggaaaatcgcatcacaaaggcgagtatgcatggggagcacttgctgctgtactttcatcacttttatagtctgagttcttaaaagtttcgttcatttccctcaaaacacttgaacctgcagtttcagtaggtactgttctgccaggtgcagattagttaagagattagcagacttctctgcctatcttctcttactttaaaacaaatgttaccattgaatcaaggaagcaatagccatgagaaaaaagaaggatctgacgcctttgaatgaagattcaaaacatgatcttcatgttttgtattagcttggagtaaaatccacttgctggcaatatagcccttaagcttgttgcctcttctctttgtttcagaaactagagccctgtttattctgatcaaggctctggcccactgtctttatctcagataacccaccctcttctgcacacagcatggagctaagagaagggtgtctagttatgtaatatcatcggcagcataaattcccagaatttgttctttgatttttttgtttgtttttccagttagaaggtggaacttcatcattgtcctcttttcaggttgtctgtgcctattagttttctccagagggagaggtggcttgatttacatttaatctctgcaatttattagagtcctgtagttggatttactttgaagagagtttcccagaagaataaaatttgctgcgttgctttttgggtgtgagctgcttttgtatttgcctaatgcctttaatgcaaatttctttctttctctcttgcttttttttaaaaaaaatagaaatgtttgtcttcttaaaacatctgaaagtggcacaccaagttcctctactcctcaagaaaacaccatatctggatatagccttttaacctgcaaaagaactttacctggtaatgtgatttgataataatattacataaaatgtaacctatttcatgacttttaacagcaacagtgatgaaacaatcctcaaggtaacagaaacttgtgtaaatgtcgttcattgcttttcccatctgatatctttttgtgtttataattgacacagaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtaaaggaaattttatttttcaaagacagttgacatgaccatttcatattctctttccccctgtgaaggcttactctttctactgttcatttcatctaggtgtaagtgtttcttaagattatctatggatggttctccaactaggattgcgtatgggacacaagggagctctggttactctttgagattgtgtaacactggggacaactctggtgagtaacctcactttttcgtggacctgtcagggatgtctgtcatgttgatagtttgcttagtcttaaggaattatgtgtcttgttctccttggttagaagggactttgattcacttctaattccaaccattagcgtcaacgctctcttttcagtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggtaagtgttggatgcatctcatccagagtcttatcttggcttttcattttgaaggatctatgatcagctgcttcaccgccatgtgactttatgaatagagacgtgttaaagcggggatggtattcacaacatttaacttatagggtccaagcactgaccaacctgaccattagaacagagtgtggtctctgtacagggcagatggcgctgagtgggtattctccacagaaagagaaacgaagacagtaccccactcctccaacccaccacccaccaccaatcccaccaccaattccaccaccaatcctgccacccaccaccaatctcaccaccaatcccaccaccaatcctaccacccaccatcaatctcagcaccaatcccaccaccaatcccaccaccaatcccaccacctaccccaccaccaatcccgccacccacgaccaatcccaccaccgatcccgccaccaatcccaccaccaatcccaccacctaccccaccaccaatcccgccacccacgaccaatcccaccaccgatcccgccaccaaccaccaatcccaccaccaatcccaccaccaatccctgatgtgttcttcaaagacttatttgtcaggcccatagaaatgttacttcttgctctttgattcataaatatactaagtcataataatttttaaaagtgagagtttcgtactctgtatatttcaatgtatataatttgatctatttcaatttattggtcaaatagtagacatgttaggtaagtcttaaaatactgaggctttggagttagacagaacatggcttaagtgacagctttgctgcttattagaggtgtggccctagaagatttgtaaatccctctgagctttatttgatctaaaatatgaatagtaatagtcccgaatttgtaacgttgttgggaagattaagtgacacatttaaaatgcttagtactgtgtgtagaacataaacacttcaaaaaatgtaaactgtgatttctatattcaataagaaatgtagaaatggacaaagcatataaaaagcaaaagaaatactagaagacacttgatttttctcaaaaataaacacaccaagtatttttgttttagtgaaattcatgcttacatgctgtatactaggattgaacatactgccaccaaaatatagcagtcggtggtacatgtgggtggagcaagacccctccaccttgtcatcgtgtgaaggggctctgccatacatgaccttgcatgtgactttaaggtggttggcctggaagaaaagtcccaagatgggaaatagtaggtgtcttttttactaaatgcactccaatttgggaccaaaaattttcattcttgaaggctcagtattgtgagtttataagagataatagacataaaagtgtaatgatttcattgcaaataaaaaaaggcccctttgcacctgatatctccatcatttttctagaattttgtgcacacatgccttgcactacttggtgatgataaagatttccagatctttgcacagaataaggctttgctttagatcagaattttggatgtacttagtatacattcatcttttaaataatctatttacattttcatactttccaaaatacagatatattttattttatttatatatttatttaatttattttttgagatggagtctctctctgttgcccagagtagagtgcagtggcacaatcttggttcactgcagcctctgcctcccgggttcaagcgattctcctgcctcagcctcctgagtagctgggattacaggcgcgcgccacacctggctaatttttgtatttttagtagagacgaggtttcatcatgttggtcaggctggtctcgaactcctggcctcaagggatccacccacctcggcctcccgaagtgctgggattacaggtgtgggccactgtgcccagctgtatagagatattttaaacaacactaaagtcctcctactttgactaattagaagagcattagaagatcagcctgacttcttgacagttctgaatttagtggagcaatgaggttcagctttggtgaatgagcttaatttttccatgataaactgctagtttcttcccactacagtgtctctcaaaaatgggacagcaacattctttttgttttcacttgcagtaagcatgatgcaattacataaatgtacacttttcaatttgttaaatagaatcttcagagattcactactgccgctattggtgatgaaaaattaccagaaggaggaattaggtaggagaaaatgtgtcctatgtatttccttcccagttctttgaaagagagtgataggaaaaaggaacactattgaaggaaggactgcccagtttcaaacaggtatttatttttctctcctaggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactggtatgtagcatatgtaagaaggtggagagcagaattgcgctggttgatattttcatatcagtttgaacaagagggcagacctagagagactgtcgtcgttttctgactggtggagttgagggaaacgtgagggttgctgggaagtgaagaccccgcgacttgccgtgaaatctcttctacttaaagagcaagacatgtgaattaattctttcagggagggatacaactgcatgcaggtgatggaaataatgggcgtgggaaatgtctgtgccgtctgagaggcactgggcttgctttgacaagagtagcagaactgtcattgctttgggcttagggatattcgaatgtgtgagggcaagtgggatcagatatctacttccaggtataatttgggtaggaaagagactcatgcagaaagaagccctggaaggccagagcatcgtggtcagaggtgttgcctttggagggtcattgctgccaggagccgaatacccactgtatccaataacattcatggtcaggaatggtggctcacacctgtaatcccaacactttgggatgcccaggtgggaggattgcttgaggccaggagtttgagaccagcctgggcaacacagtgagaccccgtctctacataaaattagaaaaaaacaattaactgggtgtggtggtgtgcacctgtagtcccagctagtcaagaggctgagacaagaggatctcttgagcccaggagctcaaggctgtagtgagccaagatcgtgccactgcacacaaacaattatgtgacctcgggcaagttgctttacctctttacacctcttaatttccttatctgtaaaatgaggatgataatttcttcctgggtctgttgtaataattaatacatcaaagcacttcatgtctggaacagtgaagataccctgctatgactattaaggatagtatacatggaataagacacaggaacttctaaatgcttttgaccatagatttaggttctgagttttaagaatttaactcaggaaattgtaacaccaaaaatgtcatgtgaaaaatggtggtgacaaattttcttgaatcattagccttagaggttgggcagaaagcaaaaaattattcttgatgctactctatagaaagagaagacagaaaaagagaaagatgtatttttaaagtctatatccataactttatttgaccaaactctaatttaaaaattatgtttcagaattccaaaaaccaatatgcctaccttccaaaggtgacacaagcacaatttataccaactgttgggtaaccggatggggcttctcgaaggagaaaggtaagcatgacgctttaaatattgcttctagagtaagtctcacatgttgaaatacatggagtgggtcgttttaatcggtttctgtctgaaattatatctaaactctttatctttcctatctatttattcccaaatatttattcagttattcttaaaaaatgtatttttgctttggcttgaaaaaaaattttagggagacttttaagcatcttacttcattataaagatcagttgcttgactttgcatgaagcagattgggcccttctagggctgacaagcccgtgcaagaccacccgctcctcagtgttagtagcgttcccgtctcccaaaaccatgttctcccttgatgctaatggccgggagcacaggcaggtgtgtcgtctcactatggagaataatatttgtgtcattctttacagaagaaggtagcttgccaaactgtctccatctttcccgattcagtcttttgttcaagtaattcacatttttagattttttattggtaatctgagacaagaagaaatttaaagtaatcttcactaagccatgaaagctcccaacattgttctccatgagagatgctggcctgcatttattcaaaaacaaaagacccctctgttgccaaagctcggagggcttttcagaaacgatatagttgtaaattataattttgaatatataaagcaaaaaaatgaaaagtgagaacttccaggctttggattgttgtaggtgataaatataaaatgggatttctggggggctgctactgagatgaggggatggcagaaaacatggaagcaaggtctctggtcagcccagggtgctgggcttgtcccaacaccacgtaggcaataagaggacagtacagggtgccgtctctctccctcttcctctctctgtctctctctctctgtgtgtgtgtgtgtgtgtgtgtgtaacactaccttcccaatttttactgtctatttgtattcaaagataaggtccttatgaaaaatacactgctctgattcactttaaaacttatttccatatttattatttattgtgggaataataatattcccaatattattatttattatttaagttattattattaacttccctctgaggttatatattggttactcacaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaaggtaactcatgagattatgaaaaacacaataggctgcttgagaaaattcatttcaaaatatattttccaatagcataattcaatcatagtttttaaaaaaattcagagacaaatgatctgataaattgataagcaacttttaacaaattgaatatacataatatatatttatattatttatgatatatgtcacaatctatgcatgtgctatttaagaggggcaaatatacatgcaataattgtgctagaatataaaaacattagacttcatcattgggatgatgatatcaagatttctttgttagatttatttcagatagaaaaggggatacgaaaaatgcaggcacatgagatacttggagaactttaagaaagagtgagtgtgtgtgtgtgtgtgtgtgtgtgtgtgtgtgtgtctggcaagcaaggtcttgcacacacacagcactttgggaggccaatgcaggtggatcacttgagcctaggaatttgagaccagtctgggcaatgtgatgaaacccatctctacaaaaaaatatgaaagtatctgtgtgtgtgtgttgctgtgtagtggactacagaactttagaggcagtcacttatttgaatcccattgtcgtaactttctactattttatttttccactgtgactcagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcacgattagcaagtgttttcttctggttgtgaaacagaactgaaagtaagtggttgaggttccagcacagttcctgggatccctctaattgcactgcttcctctggaactcagtatatctcaaagatgtaatttcctctccgtgctgcacctggtcggccactgaaacccactattgcctgcttcacgtgtggcaaagagctagcgggcttgggttttgttctgccgagaggaagggagaacacccacttttataagaaagagatgggttacctgaacccatgggcacctttgcctcttggcctcctaactttgctaccagggcatggctaggagggtccaggctgcgcgtgctgaggagctcgaggggctgcagcattgcacagccttcatggcaggcaaggaatctgctttgcaaggggcattagccctggaggctcagtggatatgggctattgcaatagtaattcaaggagcatttttaggcctggcgtggtggctcacgcctgtaattccaacagtttaggagatcaaggcaggtggatcacttgagcataggagttcgagactagcctggccaatgtgacgaaaccccatctccacaaaaattagctgggcatggtggtgcgcacctgtaatcccagctcccccagaagctgaggcaggaggaccgcttgagcccggggatgtcgtggctgcagtgagctgagatggcaccactgcatcactgcattccagcctgggcaacagagtgagactgtctcaaaaaaaggaagcattgttaggtataaattattattattattattattagtagtagtagtagtagtagtagtactgagacggagtcttgctctgttgcccaggctggagtgcagtggtgcaatcttggctcactgcaatctctgcctcccgggttcacgccattctcctgcctcagcctccggagtagctgggactacaggcacccgccactgtgcttggctaattttttgtatttttagtagagacgggtttcaccatgttagccagaatggtctcgatctgctgaccttgtgatccacccgcctcggcctcccaaagtgctgggattacaggcttgagccaccacacccagccctgttaggtataaattatttcataaaattcagacttgtaaatttatggtagcctttggaatgggtgatagatgtcctatgccacacaaattcctcacatgccgaggctcaccgtaactgataccagctcgcttgattcagttcagttaaactgaacaacatttacacagaattggcgatttacaaaatcttatgtaagttaagtagaaaaacagaaaaaagttttctgaaagagtttgggtttttccttcaatgctcaagacagaggtccccaacctttttggcaccagggaccagttttgtggaagacagtttttccatggaccagcatggtggtgggggatgattctggaatgattcaagtgcatgacatttattatgcactttatttctattattactacattgtaatatataatgaaataattatgcaactcaccataatgtagaatcagtgggagctctgagcttgttttcctgcaactagacagtcccatctgagggtgatgggagacagtgacagatcatcaggcattagattctcataaggagcctagatccctcacatgtgcagttcataacagggtttgagctcctatgagagtctcatgctgctgcggatctggcaggaggcagagctcaggcggttatgcttgctggcctgccactcacctcctgctgtgcggcctggctgctaacaggccatggaccaggtactgttctgggccccgggggttgggaacccctgctcagagacacaccgggtggtaggaggagctaaaggtggagagggtgaaggaaaatatgaggtctgggctatccacaaaccagatagcaggaaactgaagagttaaacatttacttcagaattgaatggcttttgtaaaatctggctagattccatgaaacgattttaaaaatgcactatttaaattttgcctttgcatgcgatgaagacattagtctttgttcatgtggatgtttttttatgtttaaaagggaaaaaatggtttgcaatgaaacttttatctcagtctttgagtattgatcatggggtgttggaacaggactttggaatgcttgcagggtaaacctttggcctctgttagtcagggaatgacctagtttggcaaaacagaggagagttttgaaatatggaactttcccgaggcatacattgtcattttaaagtggtcaatcaaagcccagtaggactgggctggtgtcttggtgactcactgtgtgctcatatacaggggtaactgaggagcccttcacacaggtctagcctcgtgggactaaaaagtgtgacatgggctaggaaaatgcgaggctgggatgccttcactcccatgaggaagcgtgacgggaggaggcgtgggccactggcagttctacttcacaaaggctgctggcagtgtcaatcctgcaagctggccttgccctcctgtggcggcagtgtacacgtggcatgcaagcacatgcacaagccacctggctccaaggtcagccaagggctccaacatctgtctcagtccctgccaaggcatgggaaccccccacgtaaacttggaacttttcctttcaattgttgcttatgtctgtcactttacttgactgtgagcagcttctagggaggctctctcattcatagtgcatatcatgggcatccagtaaacggctaatgatgatgatacacctttattacaaaaataaaggcaatggagactgaagaggtgaaatgattagctcaaggtcactggcaaggacagagctggaacaaagctcagcattcctatgccaggcaatgtcctctcactgatatccggttgcttctcactaggagaaggatgaaagatgacagagcatttataaccaccatttgttattttcattatcaactgacactggtgtttctctgcccggagcgattttgtcctcccttcacctcaggaaacattcggcaacgtctagagacacttttggttgtcctaatgggagagggtatgcaactggctgtagtgggtagaggccagggatgcagctaaacatcctgcagtgtgtgggacagcccctcgcaagagagagttatcctgccccaatatcaataatgccagggttgggaaagcctgatctcatgtcagcattaaaaccttgtaatgaaaagaggacatttcggccgggcgcggtggctcacgcctggaatcccagcactttgggaggctgaggtgggcggatcgcgagatcaggagatcgagactatcctggctaacacggtgaaaccccgtctctacttaaaatacaaaaaaaaaaaattagccgggcgtggtggcaggcacctgcagtcccagctactcgggaggttgaggcaggagaatggcgtgaacccgggaggtggagcttgcagtgagccgagatcacaccactgcactccagcctgggcgacagagcgagactccgtctcaaaaaaaaaaaaaaaaaaaaagaaaaagaaaaacaaaagaggacatttcaggaacagcaagaaaggggttgtaggacatggcgggctgtgccctttctcttcctttattttttactttttgatacattctatttgtacatatttgtggggcacatgtgaaattgtgttatgtgcatagaatgtgtaatgatcaagtcaggatgttggcatacccatcacccaaccatttctatgtgttgagtacatttcaagtccttttctagctatttagaaaactataataccttgttgttgactgcagtcaccctactcttctgtcaaacattagaaagcattccttctatctaactctgtggttgtaccccttcaccaacctctcttcgtcctcaccaccacccccccacacacacccttcccagcctctcgtaaccaccatatactctctacggccatgaaatcatctttcgtgggatcatgcaatgtttgtctttctgtgcttggcttactttacttaacataatgacctccagttccatccacattgctgcaaatggaatgatttccttcttttttattgtgtccattttcaaagcaagttctgaaagacaagagaaggagctctgagagttgattatggccatgcctgagaaggggtctcagtcaactaatgccgttgtggacattcctgtcccaagcagaaggctttaggtcacaatatgtccaaatgtccaatacatctcccacctatgatccattggaaagaaaacaaacctcgggacccccaaaatcactaagccacatggaaaagtaaagctgggaactgcattgggcaaaccttcctcccattctattcctaaataaaatagctttcttaagctataaaaaaccttttttaagctttaaaaaggttttaaaaagctacattcctcacaatttgcccatgaggaaattccttgtggaaaaaggacaggcagaagtcagagtcacccctctgctgacatgagacaggtgcgtatctgattgcctcgtttgccatattgtttcactgggccacactaaggcatgagtgactattcttgtaaattgcgtatttggtgaaaggctaattggaaactcgaaaaaatgcttctgtttgtctcttatctacctatgacctggaagcccccttcccttcttcgagttgtcccaccttttaggaccaaaccaatgtacatcttgcatagattgattgatgtcttatatctccctaaaatgtacaaaatcagcttgggccctgaccaccttggacacatgtcatcaggacctcatgaggctgtgtcataggtacatccttatccttggcaaaataaactttctaaattgattgggacctgtctcagatactttttgatttagaatcctaacttctgacttgtacttgggtctctgcagactaacttctatattcttcctaagactttgtctagttattcctcattttcatcagtcttcgaatattcaaaaacatttcatttcattgaaaaaaaattgaaaaaagtagttgatatcagaattttaaactgcaatgcattagttgaaaataattttttaaggatatctatggtcagtttaaaagaaaggtctatttaatctcaaagagtttctatgtagtcaagacttttattctaggctgggcacggtggctcatgcctgtaattccagcacttgggaggccaaggcaggtggatcgcttgtgcccaggcattccagaccagcttggggaacacagcaaaaccctgtctctacaaaaaatacaacaattagccatgcggagtgacatgcggctgtattcctagctattcaggaggctgaggtgggaggatcacctggtggctgcgttgagtggagatcacaccactgtactctcgtctgggcgacaggagtgagaccttgtctgaaaaaaaattattctacttttatttgaatagacaaaatttttttgaatcctgatactatttcaaagaccttaaagatttcactaactagctaaatcaaacttaggaaaatattatttggttttccagtgaagcatttctcttatttagagcctttctgtttctctcaatagggttggagagttatccttatcttctttttattggggcttaagaagagagatgaggttccatggagtaaacaatacaaggatataaggacctcatataatctcacgtatccattttccatgaaagccattcttggcacgaatttgccattctatgtttgagcctcataaaaggcaatgcatcataaatatgcactttttgggtagctggaatgtactttaaacgggaaactcaagaaaacagctaggaactctttatgccaggataagtcaaatgcactggcaatagatcaaataaaaatatctgagtaaatgccttccagatagaacatcaccctagttcttcagcactttacaaaaagatctgttctcagttcacattctcttaattccctgtcatttctccccggtcttccaaatatgttttttaaattatgattccatgtataaacacaagatcgtattttgcttttctatgaaaaattgagagccttctctgaaccataaacgtatctttctccaaaatgtattcaaatcaggcatattgaaaactgttttgtgttcgtgttgtgaggttttttaggggaccgcacagaaaccctcagcactagttagtgccttgtgttctaaatgaggaaacggaagccaaggacctgcaggtggctggggactgtgcacaggctggttccgctcaagtcacatgactcgtcagccagtgagtaggtctgggtagcagttggcatggatgaacatgccctccataggctttcagaccttcttcaaggccaaagggaaggccttcatggaaatataattatgtgaaacaccccagaattttttcacaaactttcctgcctataaacgccaggtcctaccactgtccagtgtcccacttcccactgtccagtgggaagactccctccaggacaaaaccaccctttccttcagggatgtgacgtgctgtgctttcgttgacagtcatgcagctgctagacatgtcacttcctagctctccattcgggtctgtgtcccaggacctaaagaaagctaaaagaagccgggcgtggtggctcatgcctgtcatcccagcattttgggaggctgaggctggcggatcactggagatcaggagtttgagaccagtctgaccagcatggtgaaaccctgtctctactaaaaatacaaaaaaagaaaagaaaaaagaaaaaaaaataagctgggcgtggtggcgcgggcctgtagtcccagctactccggaggcggaggcaggacaatcacttgaacctggaaggcggaggttgcagtgagctgagatcgcgtcattgcactccagcctgtgcgacgagagactctgtctcaaaagaaagaaagaaagagagaaagaaagaaagaaagaaaagaaagaaagaaagaagaaagaaagaaaagaaagaaagtaagaagcaagcaagctgaaatagcttatttttctgttttaaaaaatagacttttagtgttcacaagtaagaataaaaaaaaaaaaagcttggccttaggaggaatcctatctgcttaggcctctgagaggcagcgtcacctgaagggaaactgactgggcaagagccaggctcttaggagctgtctgtactttgcttcccatccgtccgctctcccccagcagccaaagtctcctccctccattatattgcaaatcaatgaatccattagactttccatgttttctttttagactttgagattcaaggtcagctagaattaatggttaacagctgacaggtgaaagtgtggttaaatgcagctttggctagcaggcacacaggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggtacagtttcagaacttactatttaacattcctctcaagcaaatacgccttgaaatgctttttttaaatcataggaatttaaaaacactttacaatagagaatgattgatttttaaaatgtgtctgatttagctttgtagagatgttccgctaatatccataactaatctgagaggaaatgtggaacaacagaagagtaacagtgtctactcagtaacaagcgttttacgagttaaaaagacatccaaatgcagtactgaaaaatcagaagtcttgatttgtctcactgatgactccgtttttcctagagcagtctgtttaatgcttactggagataaatagatttataggtgaccaagacaatcgattaatgtatcagccacagacttttttaaatagaaaattttctaagtaggaaatcattcatagctctttgaaagatatagggagaggcctcaaggaaagaaagaaaggaaaaaaattgggaaaggaaacaaagatgaaaaattggggtggggagagcggtcagatggtggccatgagaaggatctgaacacagagagcggcggggccggcggggaaggagggaggaggggagagcgctgcttccctgtgggttccggcttctgcagagctgtaagagttgaatgccacacacagtcacactaaggaatgctccaggattgggaaagaaaattcaacattataatgagaacactgtgaatgctattgaattaactactcccctctctccctatttcttgtaagtcttagtgtcagtaaactaattataaatttacattttatgttctaaaagcatgcacctttttctcattgtaggatgattttcttatatcaagtggtacatttcattttatttacttcagtttctggtggtaagtagagtgttatcttaactatgggctgggagagggaaatcacactgcaatctccacacatgtgggagaatcccacaccatttatgccgggaaggaaataaaatgtttttattaacttcctgcctgaggctccagaggttttcaaagcagggtaggaattgaggtgaaaaaattgtttgtactggtaggaatctgtgtctatatgtgtaccatatctacatccatgcctacatacatcattcatttaaatgatatttaaaagcaatattaaaaagaagaaatcttgatttgcctcactaattagttggtttttcataaagcagtcagttcaatggaacatacacacacacataaaataggaattttgtactgaaaaatgttatgtaactattcatacacagtttatgcatttcaataatttaactaccctgttaattctccaccctatgtcacatctgctaaatttgtttataaattacttagccaatattaagtaggatatatcagtacaggtattgtttagttccatgaccattctttatttaaaatgaaagctgaagcattcctttagaaaaatagcttatgtctacatgttatatttaatttctgatactattgctagcattttaagcatagtaaattctttttgctggcctatgtgaaaaaaggcaaacctaggtgaagatattaaaagtaaattccacttaatatattaaattacacagctcataatttcaattttctctgtgacaagactactgctcaggttataatattcctttgttataattatctggaaattgtattgttatttcattgataaatatgtcagcgctaaataatttgatatattttgaacactggacccaataactacataaacaattgaccctgaatcaggggttccacatccatggatttaaacaacattgaagtgaaattttttaaaaaaaattatatctgcactcaacatgtgcagagttttttcttgtcattattcccgaaacaacacagtataacaacaatttgcatagtatttacattgtactaggtattataagtaatctagagatgatttaaagtacacaggaggctgtgagtaggttatatgtaaatactatgccattttctatcagggacttgagcgttcatggattttggtatctgcaggaggtctggcagccaatccctcatagatatcaaggaatgatagtgtacatatttaggtcctttatacatgcacatggaacatttacaaatattgaccacacacaagc

SEQ ID NO: 440 - DNA, 60654 bp, Homo sapiens
gcttcagggccttgaaacttgggtccacacctcacaactcaaaaggacctcttcagactcctggaactgtacatctgctagagactttaaggtaaagctgtctaaggaaaaatctccagagcagatgacattctagttgtggacagctttcccaagatcacagatgaagacttctgtatcatcatgaaagccttacatttttttcttttctcctcatttcctgttgccctaattctttctttttccctacagaaaaatccatgggaccataaccagtggatgcctttagcttgagcatctgctgtagcacagaaccagagtttgtggattattgggtttgttgtttattgccaaaaaaatataaggaaacaattccactaatgccagtgcctctccatgttcccaatgagagtcaccccaaaattccaagggaaggatggaaagctatccttgatattctgaacaccactgctacttgctttcctgcactcactaaaaagaacactttaacttttcctttttttttttttttctttttttgagacagtctcactctgttgccaaggttggagtgcagtggcctgatcttggctcactgcagcctccacctcccaggttcaagggattctcctgcctcagccacccaagtagctgggactacaggcgtgcaccaccgcatccagctgatttttgaattttttgtagagacagggttttgctatgctggccaggcttgtcttgaacctcctggcctcaagtgatctgccagccttggtttcccaaagttctgggattacaggcgtgagccaccacaccctgccttaactgtttcaattaataacctgatcattaccaaagtatagaaaaccaatccaagtgatgactgcaaaagatatattgtgctttcaggcatcatgtactcaagatttgggatttacctatgtgagtacaagtaattgcttgtataatgtcaccagattaaattcaacagggtctctttttaccaaatgttttatatacccttacaacatgctataagaggggcacaaaaaggtcaatttctcaatggattttgttcagcagctatgcagatttattaatgaacaaatctaactgaaccctgctcaaatgcaactaggtagccctgtttttcaactcccaaggacctattttgggtctgtggataatctgcatatttcattctgcctcttcgttggctcagatcttgctatttggtctggctcactcctgcctttcaaatagtttcacctaaaaattctcctaacagctcttatgattggaggccaaaatagtcaataactgaaattagcactagctttgaaatagacaaagataagctagtttccactgaggaaagattccagtggggttcctgggggctcactcttggtggtagtgggatactagttgtatggaatccaaagctaatccatatgtggggtcttggattttatagccaatcaaacatcccagtgtttcagacaggtagacactactctccaaaaggtagatgtggcctggtgcaatggctcatgcctgtaatcccagcactttgggaggccaaggcaggtggatcgcctgaggtcaggagttcgagaccagcctgcccaccatggtgaaaccctgtctctactaagtacaaaaaattagccaggcatggtggcacgtgcctgtagtcccagctacttgggaggctgaggcaggagaattgcttgaacccaggagtcacaggttgcagtgagctgagatcaccccactgcactccagcctgggtgacagagcaagaccctgtctcaagaaaaaaaaaaaaaaaaaaaaacaagaggtagatgttacagttaatggaacatcatacagcttcatatctcctttttactcaagctggggcctgtgtttggtgttgaacaaaatagaatgctgcagttatctctctcctgattttgttactacagaaagcttaatgtaaaggtggctgatactgctgtttccttagacactgacaccaaatacaataaagaagtctctcaagaggaaaacatggtgtgtttacaggagcaactaacagttggtttgtaggcatcctaaatggtggatggcaagcttgggtttcccaaaggtttctagtctttatatgtcttctagtaggtgtccaggttagtatggcttgtgttaccagagcaacaatgaaaatggctacatctttaaatcaggccactttacagtgaactatgatccttaattgctaccacatttcaaacaagaactatgaccaattaaactttactgttgttgaactgcctatgttgcctgaactttgactggtttaagttggtttcatttatttaataagaacacttgttaaggagtgcatcttggtattttgatattattctcttgatagtcataataatagttccctagtgtgctgcatcctctcaagtcttaaatgttttgtatgcagccatacattgagaattgaatggtctcactttgactaggtcagcaagaacatagagaatcattcacctagtgtgaagctgtgacttgtgaacttcatagtgacaccagtaaagacttgtgaactggctgggcatggttgctcacgcctgtaatcccacacttttagaggccaaggcgggcggatcatgaggtcaggagatcaagaccatcctggctaacatggtgaaaccccgtctctactaaaaatatacagaaaaattagctgagcgtggtgatgggcacctgtagtcccagctacttgggaggctgaggcaggagaatggcgtgaacccaggaggcggagctacagtaagccaagatcatgccactgcactccagcctggtgacaaagcgagactttgactcagaaaaaaaaaaaaaaaaaagacttgtgaactccatactgagactaaaaagacttgtgaattccatactgagccaaattacaatagtgagagggtggcatcaatgcctaaagtttcggtctatctctctaaattgagagtctgaccaaaaggggggagttgataaatgaaactcaaatctggcctgaggacgccttcacattcccatatttgagttcttaagggcgaaccgtaacgtagttagtaggtaggcagactgaaaacttaacttaggaggatgcttctttagcaatagctgagtctcagccaatcccactggccatatttcaaccactcacaggcagccaactattcgaatcatgctcagataaggtaaacaccaagctgtaaacaatctggctgtttctgtacctcacttccattttctgtatgtcactttcctttttctgtccacaaatttgctttgacagcacagcatccctggtgtctgtctgtatctgctgtgattctgagggctgcccgatttgcaaattattcatttttcttgctcagttaaactctgtgaaatgtaatttgtctaatggatttcttttaacagcacttataattaaaatggaaagagggtgtaaatatttagaaaacttgcagcctggccatgtgatagacaaggaggaatccaagcagcctgctgagcaactatttgctagagacattagcatatctaaaagggagccaggtgctaatattcaagacagtgggaaaaggcctcagaggcatttcagaaggcctctcctatcacaggcccacaggcctaggaggactgaatggtttcagagaccaggcccagggcaccattgctgtatgtcacctcaggatgctacttcccacatcctagcttctccagctccagctttggctcaaagggcccccggtgcagctcagaccacttctttggagggtacaagccctaagccttgggagcttccatatggttgtttttttttctttttttgagacaatcttgccatgtcacccagtctggaatgtaacggtgcgatcttgactcactgcaacctctgactccagggttcaagcgattctgctgcctcagtatcccaagtatctgggattgcaggcatgcaccatcatgcccagctaattttgtatttttagtagagatggggtttcacagtgttggtcaggctggtctgcaactcctgacctcaggtgatccacgtgtgtcagcctcccagagtactggaattacatgtgtgagccaccatgcccagccttccatatggttttaggtctgcaggcttgcagaacgcaagagtgaaggaggcttgggagcttccacctagatttcagaggatgtatcaaaaagtctgggtgccctgacagaagcctgccacaggggcagaaacccacagagaacctctacaaggacagagccatgggaaaacatagggttggaaccccatacagagtccccactgggacattgcctagtggagctgtgggaatggggccaatgccctccagacagcagaaaggtagagtcaccagcagcttgcaacctcagcgtggaagacccacaggcattcaatcccaacctgtgagagcagccatgtgggctgcacccagcaaagccatagagacagggctgctcaaggccttgaaaggccactccactcaccagtatggagttacggaagatgattttggaagtttcagatttagtgtttgccctgctgggtttcagacatgtgtggggcctcttgcctctttcttttggccaacttctcccttttggaatgggaatgcctacccaatacctgtaacacaattatatcttggaagtatgtaacttgtttttgatataacagcctcataggtggaaggaatttgccttgaggctcagatgaaactatggattctggacttctgagttgatgctggaacaagctgagacattggagaactatcaggaagggatggtttcattttgcaatgtgagatgacatgagatttgggggtaaggggcagaccaatatagtttagatgtttgttctctccaaatcatatgttgaaatatgacccccaatgttagaggtggggcatagtgggaggtgtttcgctcataggggtggattcctcatgaatgggttggtgctttgtccatgataatgaatgagttctggctctattagttcacatgtaagctggttgtttgaaagcacctagcatctctcttgtgtgctgtctcgccatgtgacacatctgctcccccttcagcttccaacatgagtaaaagattcctgaggccctcaccagaagcagatgcctgcactgtgctttttgtacagcctgcaaaaccatgaaccaaatacacctcttttccttataaattacccagtctcaggtattctgttatgatcccctggaagagttatactacttccaggtctagcccatggtaaatcccacactcccctctgaggccaccttcttccctctgcagagaccctggagttagagtggattggttgtgtctctggccccaattcttctcccgaggctgcattccacccttttgctatgtgactttgcagcccttctcactgcagagacaggttcctctccttgagtttggggaagatgcaacacatgcaggggtttgaaaacacatttgtttgtttctgcttttgtttttgctcctctgcaatttccttgaaaccatgcctgaggtagcctgtgggaaaacgaaacagcaccattgacctagtctttcagccaatcccactgcatttgtacaatgcagtctgacaccagaggaactgcccagccaagctcaggcaaaattgctgacttcagactcatgaactaaataaatatttgtttcatttggtggttgttcttatgcaacattatgctggcactagaaaaatgaaacagatgggaatcaaaaagactgaatgaagcagaaacccagaagctaccccacaagcaatcacatgggactcagatgtgaatggacaataagcttttattgcattgaaaggtcattgcagtgaaaggttggggattgcttgctgctacagctgaatggattctattctgaccaatacacacagaaagagatcacagactccctaccttagaagaagggaggtggtagatgaaatgaactgtatgaagagccactagcctggcccacacacagaagaaggactggcccgtcttcttgaagcccatgctctggtagagggccatagcagagagctggatggtgccggtgtccaggataacttcactgtagccctggtcccgggcaaactggaggacagtcctgaccagggcttttgctatcccctgacgacggtgctcactgtccacaaagagatgaaacagctgcaaccgcttctccctcaaggtgggatcatcaacaggcagagctcctaccatgcccaccaccttctcttcagactcagccacccagaagcaggagccacgctcactcaggtaggatttggtaatgtcagacatgtctgtgcacaatgtcatgtccacatactccgtccagggttttttggcaaggaaccacagggcagggaagaggctgatgctgaacacgagggctagaagccaggatccagagaccaggagtagggcgaggggccccccaagtaagagtatgagggttcgaggcagcttcagcaattgccggaaggtggctggggcatgctcggccatcccccgggagagcaagcccacaacccactggcggtcgctctcctggtatttgcggatgtgacaaggagccatggacagacttctgtgtctgaaatctctaagtccaggagacagagctaggcctccctgcacgcctttacgtcagactggggaagagagagaaaatcatgtgagtgcctgcatggctcccagccttgcaggaacagggagacctgctcaagggtgtgtctttccgcgtttgcccatgaggaagcaggcctctgccactgggagaaggtagggtcagaaagacctgcattggaatctggttccatccctttctagctgtgtgaccttaggcatgtcacttaacctctctgagcctccatttcttcaactatagaacaggggagaagaaaacctgccttctagagttgttttgaagattgaataagatgccttctataaagccctggtagatgaactacccaccgctcttcctttttctgtttcctttttctggctctctcagcttctccgtgcattgagggggcacctacctcaggcaggccacacgtgcaacccttttgtccttctccagggaccatacatcgcaaaaattctctgtccaacacaagtttcaggaaaggctccctccagctttattgtaagtttttaggttgctgaagtggcataagagccaagcataaaaaacagcccagcctccagatcccaaggaaggtgcatgctcagagcactgtccttccacccagtcccctcacctgtcaccacaagagccttgagtgtccagggagcttcagctctcagccgctcactggcatccaggagataccgtctggggcttgctcacccctggaaagtagactgcctgccttattgcttggctcctgaatgtttggtaatcatcaaccctagggtcaaagagctgggctgtaacacagcagggagcccagtgtgcattcctctttgtggtcaaagggaacgacctggagggggagactcagggtctggaaccgcctgggttccttgcccttctggaaggcctgccacctctcttgcctgttcaggccccgtgcatctctctgccacctggcacacttagtactctcggtccctgtccacatatacgatccaccctggtccttgtacacatatacgacgagcctgagaactgtaccattcaccctgcaatcagtcaccattggccagaagccgagtccccatgcttggcaacaaggcccttcccagctaggcttctcctcgctgaggtttccctggtccacgaagcatctgttgttggcagttccttgcactcacctcaccaacccccatctccacccattcattgattcagtcaacagttgtgtgtcatgcacttcctgtgtcctggggtcatttcagccatgagcaaggttgacattcggcttgacaggcatggctgtgtgtggcttgtgtgtgttctggctgttggtcagaggctgtgccacacccgttgttaaatattttgcactgcagatgttggggaggcccaaattcatgctcttgtacccgacgtggagctgatcccaaacactgacacatgggtgcttggagatagagaaagttgtattcgatttggccaaagcaagaaggcaggagagcaagatctctcaacttcagttcaacaaagaagcagcagcagaatgtttttatgcagctagagagtgaggaagggggagttcagggggattgagaggaaaagtctgtgtttcctcagtctgagataacaccttgtgcaaccaggcttctcagtgtcagcagctggtcacagtgtccttcaaggcattcattcattctgcaaacttttcctgaccctgaaggaatgtcttcctgctgaacaaagaaacagtacatgagcagtttatcattatgttgtgggaacaaggaatattggaccaaaagcaagtggttaacatgtgcaagccagcaacggtctgatcagaatgttcattatttcagtcactaaaacatggtgtggtgctgaaatctcaaggggcccaattacaaggatgcaacatatacaagataggcaaaagcaaaacctaacagaaaaagcccttttccacaccaacttacatgctattgaagggaaacttcccttccaaagattagctaacctattgatgatcagccacgctgggcccgtcatctaggttaggtagtttggactctattccaagagcaaggggaggacattgatatgcacggaggggaggaggtgtgtgtgtgtgtgtgtgtgcgcacgcaagcatcactctggctgcaggtggacaatggatctgaggaggtaggaatggaagcagctacccctcaaggctcatgccacatccaggcaagagcggggcctccagtacagggatgcaggtgctcactgtacaagagcagctggcccagaggctctggtgggagctaaaactgggcctccctctggttgccaagccatgagccatggcacgaaactgagactggccaaaggaaaaggcaaccttttcttatttgctcaaaggcgttgcttgcctgctaaactctgcatccagtgggctgcatggcttgaggctgtgcctagctctgggttcacaaagaagccgcctgggttagcagaggcccatgagacagcagtggcttcaccagagggaggaagtcaagaaggtgagacatgagccgtatggaggtgcatttggggcagaaatggcaggagttggaatgattcacacagggaggaggatgaggaagggctcagagacgacagccaggcttctggtaggggcattcaggaaaacactggagagagcccagatctggaaaagtcaaggcttcccctaaaggtgctgccctgcagccttcttcagcagaaaccagaagctgggagtcagcagcaggaacccagggccagccagtggaggctgctgagattccagatctttggtacccaacaccacctccgaggaaaagtctaaggagcatcaagtctgggcaggaagtccatggctcatctttagagtgttctcgcaacatttcagtgtcaagcaggagttggcctaggaatcaaaagaggtgagcggtggctccaaagcaccactgagtacttctagtgtgagtctaaccaatattcagtcagaaacctgccggtcacgtggagggggagaggtttgtgctccgtccctgtgtgctgtctctccctccatgctcacccgtggctgtggcttcctcaaaacacagcgacctcacttgacattcaggcgtctcttgctcccaggatttactgtgacttctgcatttttgtagctttcctgataaaagcctgggctttccttgtcggacctgaaagattcatttattcattcaacaaacagtggccgaaggcttgttatgtgctgtgcctggacttggcatgaaggcaccagatgtcagaagcgaggctgctgcccaggaggacacacctgatggggctctgggaccaggacgatggtggagacatcacatccggaataactttgttaggaaggtgaacttgacagttaggacttagttctccttgaagacgtccttcacatcccttgtgagttggattcctaggtattttattctctttgaagcaattgtgaatgggagttcactcatgatttggctctctgtcttttattggtgtacttgtgatttttgcacattgattttgtatcctgagactttgctgaatttgcttgtcagcttaacgagatttttgggctgggatgatggagtttcttttgtgggcatttagtgctataaatttccctctacacactgctttaaatgtgtcccagagattctggtctttgttctcattggtttcaaagaacatctttatttctgccttcatttcattatgtacccagtagtcattcaggagcaggttcagtttccatgtagctgagtggttttgagtgagtttcttaatcctgagttctagtttgactgcaatgtggtctgagagacagtttgttgtaatttctgttcttttacatttgctgaggagtgctttacttccacctatgtggtcaattttggaataagtgcgatgtggtgctgagaagaatgtatattctgttgatttggggtggagacttctgtagatgtctattaggtctgcttggtgcagagctgagttcaattcctggatagccttgttaactttctgtctcgttgatctgtctaaagttgacagtggggtgttaaagtctcccattattattgtggtgggagtttaagtctctttgtaggtctctaaggacttgctttatgaatctgggtgctcctgtattgggtgcatatgtatttaggatagtgagctcttcttgttgaattgatccctttacctttatgtaatggccttctttgtctcttttgatctttgttggtttaaagtctgttttatcagagactaggattgcaacccctgcctttttttgttttccatttgcttggtagatcttcctccatccctttgttttgagcctgtgtgtgtctctgcacgtgtaatgggtctcctgatggtcacactgatgggtcttgactctttatccaatttgccagtctgtgtcttttaattggagcattcagcccatttacatttaaggttaatattgttatgtgtgaatttgatcctgtcattatgatgttagctggttattttgctcattagttgatgaagtttcttcctagcatcgacggtctttacaatttggcatgtttttgcagtggctggtaccggttgttcccttccaggtttagtgcttccttcaggagctcttgtagggcaggcatggtggtgacaaaatctctcagcatttgcttgtctgtaaagaattttatttctccttcacttacgaagcttagtttggctggatatgaaattctgggttgaaaattcttttctttaagaatgttgaatactggcccccactctcttctggattggagtttctgccaagagatcagctgttagtctgatgggcttccctttgtgggtaacccgacctttctctctggctgcccttaacattttgtccttcatttcaactttggtgaatctgacaattatgtgtcttggagttgctcttctcgaggagtatctttgtggcgttctctgtatttcctgaatttgaatgttggcctgccttgctaggttggggaagttctcctggataatatcctgcagagtattttccaacttggttccattctcctcatcactttcaggtacacaaattagatgtagatttggtcttttcacatagtctcatatttcttggaggctttgtttgtttctttttactcttttttctctaaacttctcttctcgcttcatttcattcatttgatcttcaatcactgataccctttcttccagttgatcgaattggctactgaggcttgtgcatttatcacatagttctcatgccatggttttcagctccatcaggtcatttaaggacttctctaccctggttattctagttagccattcgtctaatcttttttcaaactttttagcttctttgcgatgggtttgaactttctgctttagcttcgaaaagtttgattgtctgaagccttcttgtctcaactcgtcaaagtcattctctgtccagctttgttccgttgctggcaaggaggtgtgttcctttggagcgggagaggcgctctgattgttagaatttttagcttttctgctctggtttctccccatctttgtggttttatctacatttggtctttgatgatggtgatgtacagatggggttttggtgtggaggtcctttctgtttgttagttttccttctaacagtcaggaccctcagctgcaggtctgttggagtttgctggagctccactccagaccctgtttgtctgggtatcagcagcggaggctgcagaacagggaatattgctgaacagcaaatgttgctgcctgatcattcctctggaagctttgtctccgaggggtacccagccgtgcgaggtgtcagtctgcccctcctgggggatgcctcccagttagggtactcgggggtcagggacccacttgaggaggcagtctgtccattctcagatctcaaactccatgctgggagaaccactactctcttcaaagctgtcagacagggacatttaagtctgcagaggtttctgctgccttttgttcagctatgccctgcccccagtggtggagtctacagaggcaggcaggcctccttgagctgcggtaggctccacccagttcgtgcttcctggctgctttgtttacctactcaagcctcagcaatgatgggcgcccctctcccagcctcgctgccaccttgcagttcgatctcagactgctgtgctagcaaaaagcgaggcactgtgggcgtgggaccctccaagccaggcgcgggatataatctcctggtgtagtgtttgctaagaccattggaaaagcgcagtattggggtggaagtgatctgattttccaggtgctgtctgttacagcttcccttggctaggaaagggaattccctgaccccttgcacttcctgggtgaggcgatgccttgccctgcttcggctcatgctcagtgggctgcacccactgtcctgcacccactgtctgacaagtcccagtgagatgaacctggtacctcagttggaaatgcagaaatcacccgtcttctgcgtcgcttatgctgggaactgtagactggagctgttcctattcgctcatcttggaactgcccaacactccatccttatctataacccagcattcttctataccccatagaaagcaccccttacactcggacatgcacaggaaggaagctgctaattggagggaagactcactcacactgtccccaggctccactccaaaggtggccagtgcagctctttcacctccattacctccaagtggtgctgtcactcacagtaagcccagaagagcagtctgacctccacatagagccccctcatttccactcctcactgctggctgctggctccacggaccctctaaaaccacccttggtaagatcaccaggggtttcctaactgccaagtaccagtaatgctttatagtcctcaaacatgctgaacgctaagggagttcctgcattcataaagctgcttgcggtacctgggtgctatggtctgaatatgtcccccctaaactcctatgctgaaacctcatccccaaggtgatggtattcagaggtgggatcttgggaggtgattaggtcgtgaggatgaagtcttcacctatgggatcagtgcccttacagaaagacccaaaggagcttgtttgccccttccgccatatgaggatacacaaaaaccgccatttatgaggaacaggtcctcaccagacataaatctactggcactttgatcttggattcccagccttcagagctatgagaaataaatttctgtttacaagctaaatgtaaagtgtttaccagtttatgataattgtgttataacagaccgtatgaactaaggcactggagtcagtccaagagcttagatgtaagggaaataagatcagagcagagatgtgcaagagactggctcctagcagagcaactaagagtcaggcaaataatgtcaactgaggaggcttctgggtccagcagccacccagctgctttaacacatggctcttcatttcctatccccttctctcctggtctgtctttccctctttgatggttctttttcaagctttcattttgagtgttcctcaaatggaagttttcctcaaaacagaaaagttcatatttccttcctaataattaataggaaaaaaatgccaaatggatagaatggactccggataagaatggagaattttttaaagaagaagcaaatatggtttatgaatatattttaaaactgtgcaaaaaagaatatacaaaaaaactcactagaaatcaaataaataaaaatcaaattaatatccaggttttacctatcattgtaaagaattaaaagaatggtatgagctaatataggacaagcacaaagaaatgtgcagacacacacacttttgacggaatactgaaatgggagatccatgctggagaatcattacacagcatgtcaaaatcctttttttaaatcaaaacagagtctcgctccattgctcaggccagagcgcagtggcagagtcataactcactgtaacctcaagcttacaggttcaagtgagcctcggcccttgtcctcctctcaagtagctgggcctacaggcacccaccaccacatctggctaattaaaaaaaaagttttttttagagacggggtcctgctatattgcccaggctggtccctaatccttgggctcaagcagtcttcccacctcagcctcccaaagcactgagatttcaggagtgagccaccctgctcgacctcaaagtcctttgaaaagacttgatcgaaattcaacttctagggttagagctcaagaaagtaactggtcaaatgtgcaaagatgtttgcataaggatgtttatcactgtaaagtttattgtcatagaagcaaccgaaagtgcaacaagaggggactggctgaataaatcctgctctatttctgtagcacagtacctcacagccatgaccaatgctgatgagggtttactgacatgaaaaacattgcccaactatagcaccaagcaagaaaagattataaaacaatatgtttggatttatttttggaaaaatggtattgaaaaatgatatccacaaacaagcatgcagagagaaaagtctgagtggttccaccaaatgttggtagcagttacctctgaaaagaggaattgtgggggattctctgcataaaagataaactctgaaggtctttgcacattctaggcacttggccctgctttcagacagtgaaactgaatcttgggagtctaaagggactcagttatgattgtgagctcctaaaggtaagacccgtgttcggttttattttattatttcaattaatcctattaatgtgcacaattcagtggcatttagtacattcacaatattgtgcaacgaccacccctttcttgttccaaatcatttttatcaccgcaaaaggaaattccttattcattaagtggttcccccttatttccctctctccccagtccctggcaacctaatctgctttctgtctctatggatttatttattgtggatacttcatataaatggaattgtacaatatctgaccttttatgtgtggcttctttcagctgatgttttcaaaattcattcgtattgcatcatgcatcagtacttcattcctttttagggctcaataatattccatgtatgtttatactgcactttgtttatccattcattcattgatggacattaaggttgtttctacgttttggttattgtgaatggtgctgctgtgaacattcaggtacaagcagttatttgaatacctattatcaattctttcgatgtatacctaggagcaaaattgctggttcatattttaatcctgtttaacattttgaggaaatgccaaactgtcttccaaagtgtcagctgtagtttactttcccaccagcagtgaaccttattttactccactgcctgcctcagcactactgcctagaacataaagggaagaagcaatagctgtttttttaccaagaagttattagatgcccagcactgtgagaaagagggcttcccatgttgtgcaatttcatgttaacagccttggagctaaggttggtattattaacatccccatttggcaaatgggaaactgaggtccagaaacctgaggtttcctctccacggccccatatgggaagtgaaagctcaaacctaaggtagctctgactccaaagcctgcactgttttactttttcagtacagcatgctgaccctgcaggcagggatttgacaagtgtttagtgagtctgaaattcacataaagcctcacaagcccagagaagcagctctgtgtggaggcgcataagattcaccagtaaggccccatcacccccatcctgttgccagtggtcaggacacccttgaccaaattcccatatgtgactaaggctctgttccttcttcaagatccagtttagtgctacctgctccgtccacttctgaccacccaaccagatgaatctggtcccagtccctccctccttggaagcctttgcatttctcattaagcacttgtattgctgccatttgttgcttacttaataattaacttatcatagttaattagactagaaattaacagttcaactaccctgataaactattttgtctttctattgcctctatgaacctgattataataaatcattgtattgttggagtcactgttattcccagagctgtcaggtttcagagcagcgtgtcagtgccaccccatgcctgcatccgggaagatcactcctccactggaccagcccagcctggaaaggggccagtgaggcggaaggtggacaatccagggccaatacattctgggagtctcagaggaagagaaaaatcgattcagactcatttaacataggctcctggaaaggatatcatctcccccaatctctcatcaataacccaacatcagatcagtgccctggacttatcatatgaagcagaatgaaagtagacagataggtcatccttggttagatgtccagaaatccgaggatggtggtcctagctcttcagagaggacacgttctttaacctaaccttttaacaaattctctacagaagatatcaggtcccaacatttcaagtagcttcgtagatataggtaatcaaaggactaattatgaaagtgtagatgggtagaggggagcaacaaggatggcacaggaacccatagccctgaggaggagggagagttgttggaacctgaaaggacctgggcagagcaggctgcccttagagcaggcctggggccaaggcacaatcaataccaagcctgcctcacgctctcttccctccactcctcaacttgctgctggctttcagaaaagttaagaacttgccatttctacccctttgccattgttgttgtcttaccataaggcggggagcaatatagtatccagttttctagatatggaagtggaaatcaggtgtatatacccagtatattagtacctattagtattcttattggtattactttctagatgttatgtaactgtagctttggattttctatttaattcaaaagacatataagagttttttttttgctaattccatgttggatttattgtcactacttattaagttataattttaatgtattgtgattagagattgtactgtgttctatttgtgttttaaggatacatagagattttctttgtggctaaatataagtaatccatgggtgttttaaagaaggtagagtttccaaatagagtatgacattccagtcactgtcagattccacacaacatttcagtcagccacagaacatataaatgatagcagtcccatgagattaaaatagtatatttttcctacaccttttctttatgtagatattttagatacacaaatacttaccactgtgttaaaattacctacaatagtcagtagagtaacatgctgtacaggtttgtagcctaggagcaataggctataccttatagcctagatgtgtagtaggctgtaccatctaggtttgagtaagcatacgctgtgatgttcacacaacaatgaaatcacctaacaatgcatttcttaatatacatctattaaatcattttattaattaaattatattcttcctgaatattgattttcttaatctgtcgagaacttcaaagagtatattttaagttaattgaatatagcttttgttaattgaatggttttatatatatatatatatatatattttttttttttttttttttttttttttttgagaaggaatctgcctctgtcacccaggttggagggcagtggcgtgatctcgacttactgcaacctctgcctcctggattcaaacgattctcctgccacagcctcctgagtatcttggactataggtgtgcaccaccacacccggctaagttttgtatttttagtagagatggggtttcaccatgttggccaggatggtctcaaactcctgacctcaagcgttccacccacctcggcttcccaaagtgctgagattacaggcatgagccacagcacccggcctggttatatatatttttattttcggcacataaatattaatgacatgaatattaatgacacttttttcactgtgaatcataccataaatcatataaagtaacttttattttacattttgaatatgttttgccttttattctacttcatccaatacagttttattaaatgtggatttgtaccattgctctttgtccatccttttacttttggcttttctgagtcacttcactcaagtggaagtagcacctacttgaatttaacttttttcccccacccaatttgaaggtctttttttgaagtgagttcaacttaagttcattgttgtaacaaatatgtttggtttaaattttatcatttccctttttgtttttttttccttttctggtaaacttattaagttaatgtttgttaaactaaattccatttcaaacggtgggaaggagtaaaaaacacctaacataaagtttaccatcttaagcattcttaagtgtacaggtcagtaatgttaaatatattcacattgttgtgagacagatctccagaacatttgaatattgcaaacctgaaactctatacccattgaataacaacttcccttgtcctcctcccccagcttctggtaaccaccattctactttctgtctctgtgaatttgtcgataccaagtttggaagataagaaatatcttttaattcctgattttgtgtgataagagaaataaaatatctaccctttagtgactgactcatttcacttagcataagatccttaagattcatccatgttgtagcatgtgacaggatttcctccctttttaagtcaggataattttccgtgggttgtgtgtgccacatttatgtatccattcctcagtggatgggcatctgtgttgcttccacatttgcctattgtgagttgtgctgctgtgagcatgggtatgctgttagctttttaagtccctgcttactgtgcttttggagacatactcagaagagggattactgaatcaaatggtagttctaagtttcacctttggaggaatctcaatactgatttccagagcagttgtgccattttacattgccaccaacagcacacatgagacccattttatctacatcctcaccaatacttgttattttcttttttttttataatgaccgtcctagtgggtgtgaggtgatatttcattgttgttttgatttgcattgctctgatgattggcgatatagagcatcttttcacatgcttgttggccatttgtatatcaactttggagaaatgtctattcaattcctttgcccatttttggtcaggttattgattttgttgtcattgttgaattctgagagttatttgtgtattctgtatatcagaatcatgagttgcaaatattttctcccaatccgtaggttgtcttttactctgttgaatgcatcccctgaggcacaacttaagcctggtggtcccatttgtctatttttgcttttgttgcctgtgcttttggtgtcatattcaagaaagcactgccatattcaatgtcacaaagcctttcctctatgttttcttccaagactttgatagttttaggccttacacataggtctttaatccattttgagttaatttttttacataagactagagtccaacttcattcttttgcatgtgaatgtccaggtttccaagcatcatttgtgaaaaatctgttcttttcccattgagtggtcttggcacccttgtcaaaaatcattttggccagggacagtggctcacacctgtaatcccagcaatttgggaggccgaggtgggtggatcacctgaggtaaggagttcaagaccagcctggccaacatggtgaaaccctgtctctactaaaaatacaaaaaattagctgggtgtggtggcgcacatctgtagtcctagctactcaggaggctgagacaggagaatcacttgaacccaggaggcagaggttgcagagagccaagatcgtgccactgcactccagcctgggcgacagagcaagaccttgcctcaaaaaaaaaaaaaaaatcatttgaccatatgtgagagtttatttgtaggcactttatcatatttcgttggtctattcgtctgtctttatgctactatcacactattttgattattgcacctttggtaatatgtttgggttttcggttgttgttgattattttggtttgtttgttttttgtagagatggggtctcactgtgtttcccagtctgatatcaaatttctgggctcaagtgatcccccagtcttggtctccagaagtcctgagattacaggtctgagacgccgtgcccagccagtaatatgttttaaaatcaggaaatgtgagtcctccaacattgttgttctctttcaaaattgttttggctgttcaggatgtcttatgatttttactgatttcttgccatttccaatcttttttgttcattactatgtaatatatgcttcttattttattttatttttggagattgagtctcgctctgttacccaggctggagtacaggggcatgatcttggctcactgcaacctccacctcccgggttcaagctattctcttgcctcagcctcctgagtagctgggattacaggcatgtgccaccatgcccggctaatttttgtatttttagtagagatggggtttcaccatggtggtcaggctggtcttgaactcctgacctcgtgatctgcctgcctcagcctcccaaagtgctgggattacaggcgtgagccaccatgcccggccataatatatgtttctttgagctgtttttctgataacttagcggccatgtaatctaattaactaatatccttcaaccactttctcaatctatcactctcagacacgaaacagtatctgttgactctatcatatgaaaaattaagaaagtgactgcacttctccccacctgtgcccccacatacagacattcccccaactaaccaataatggttatattttgtggattttgtgtcagctcattgtagtagtattactacattgactagctttacttattcgtggattcttgtaggtttttaagattttatactatgcagccataaaaaatgatgagttcatgtcctttttagggacatggatgaaattggaaatcatcattctcagtaaactatcgcaagaacaagaaaccaaacaccgcatattctcactcataggtgggaattgaacaatgagatcacatggacacaggaaggggaatatcacactctggggactgttgtggggtggggggaggggggaggggtagcattgggagatatacctaatgctagatgacgagttagtgggtgcagcgcaccagcatggcacatgtatacatatgtaactaacctgcacaatgtgcacatgtaccctaaaacttaaagtataattaaaaaaaaattgaacaaaataaaaaaaaaagattttaagtctagttacttttctagggtatgtctcaatgtaggtcaagctctgtttttttattaattgagataaaattcacattccatacaattcttttttagtatataattcagcatgtttttgtatattcagaaagttatacatccttcacccctaattcctgaacatttttgtctccccaaaaagaaaccgtgtgcccattagcagttacctcccattacccttgttcttgcacccccgcctcgccctggcaaccactaatctactttctgtctctatgggtttgcctatatgagacattccacataaatggaattgtaaaatatgtggctttttgtatctagcttctttgacttaacatgatatttttaaggttgtagcgtatatcagtacttcattttttggtttgcagaataaaatccgttacgtggatttacaacattttatttatatattcatgaatggatggatacttgggttgtttgtacttttttactttcacaaataatgctgttataaattgttatagattgtgtacacgtttttgtgtggacataattttttcagttctcttggatatatacgtaggagtagaacagctgggtcatatggtaactctctgtttaacctttgagtaactccccaactgttttccaaagtggctgtgccgcgttatatttccaccaggatcatattagggtttcagtatttccacgtcctcgtcaataattgttattttctgatttttgattataaccatcctaatgagtgtgaagtgtcatctcattgtggttttgatttgcatttctctaatgactaataatgagaagcacctttttaagtgcctattagccatttgaatatcttctttgcagaaatttctattcagatcctatgctcatgtttaaattggcttatttttgttcttttattattgggttcgacgtgttctccatatattctgaacagcagtcccttattcactatgtaatttgaaaacatgtctcccattctttgggatgcttttcactttcgatggtatcatttgcagtacaaaatttttagttttgacaaagtccaatttatctacttttgtcatttgtgtttttcatgttgtgtttaaaactattgcctaacccaacatcacacacaaaaaaagtttacttctttgcttttttctaagagtattataattttagctcttaaattagggtctatgatcattttttagctaatttttgtatgtaatgtgaggcaggggatacagtttcattttttgcatatggatatccagttgaccccgcaccatttgttgcagagactattctttcttccattaaattgtctggggtcctttgccaaaaattaattgaccataaatgtaagagtttatttctagactcttaattctatttcattgatccatatgtctctgcaaatgccaccaccacaccgtcttgttgtggtgttcttgtggtaaattttgatgtgtgagtcctccaactttgtttttcttttataaaattgctttagctatttatgggttctgtgaactttaagatcagcttgccagtctctgaaaaaaaataaaaggcagcatgaatcttggtagggatgtcattgaatctatagttggaattggggagtactgacatcttaaaaatattaagacttctaatctatgaacatgggatctattcccatttagttaagtcttctttcatttctttcaacaatgtttatagtttttacttctttgcagttcggcacatctgtcattaaatgtatttctatatattttcttctttctaatgccattgtaaatgaatttgttttcctaatttcatttctaggttgtttactgctagtgtatagaaatacaactgatttttcttacattgatcatagattgtacaagcttgctgaacttgtttatcagctctaataatttgtgtgtgtatatgtgtgccttaggattttctatatagaataccatgtcatcttcaaatagagatggtttttctttctaatcttatgctattttttctttttctttgctgattgcctttgtttgaacctccagaactatgttgaatagaagtggcaagaatggatgtccttgtcttgttcctaatcttaaaagggaaagcttgacagtcattaagcataatatgagggatgagttatttgtagatgccctttaacaggttgaggaagttcccttccattcctagtttgttgagtgtttttaccatgaaagggttttttattttgccagaagccttttctatttctattgagctgattatatgttttccctttattctattaatatggtgcattatattgatttattcatatgataaaccaaccttgcattcctgagataaatcccacttggttttgatgtgtaatcccgtttctgtcttcttggattcagtgagctagtatttttgtagtattttacatctgtagtcacaagggatattggtctgcagttctgtgatatcttcgtctgcctttgatatcaggataatactggcctacatagaaggaatcaagaagtgatccttctgattatgttttttgtatgagattgtgaataattggtgttacctcttctttaaatatttggcagaacttatcagtgaagcttggtccaagctttacttttggagaagttttctgattattaactcagtcttttctcattataagcctactgagattttttatttcttcttgaatcgattttgatcatttctttatctagaaatttgtctacttaatctaggttgtctaatatcttggtatatgattgttcatagtatcccctcatccattcttaattttagtgatttgagtcttcggtttttccttggtgaatctagctaaagatttcagtttttgttgatgttttcaaagaccaaacttggtttctttaattttctcttgcattttcctaatctctgttttatttatttccattctaacatttagcatttccctccttctacttatttttgttttagttacatagaactttagttacgtagagctcatctttttctaattcctttttaaaataatttcaatttttattatagattaaaggacacatgtgcacatttattacatgggtatattgcttgacactgaggtttggggtataaataatcccatcacccaggtggtgagcatagtacccaatcggtggtttttcagcccattccctcctcctttcctcccatctagaagtcctcactttgtattattctcatctttatgtatattcagtgttcagctcccgcttgtaagtgagaacatgcagtatttggttttctgttcttgcattaattggcttaggataatggcctccagctccatccatgctgctgcaaagggcatgattttattttatttttatgtctgcacggtatttcgtggtgtatatacactacattttctttatccatccactgttggtggccacctaggttgatttcatgtctttgctattatgaatagtgcgggaaagagcatgtgagtacatgagattttttgacagaatgaattcttttccttcgaatatatacccagtagtgggatcgctgggttgaacagtggttctttttcagttctttgagaaatctcccaactgctttatacaatggctgaaccagtttgcattcctaccaacagtgtataagcattcccttttctctgcagccttgactgcatctgttattttttgactttttaataatcagaattctgactggtgtgagatgttatctcattgtggttttgatttgtatttctctgatgaatggtgatgttgagcattttttcatgtttgtcagctgcttgtacatctgcttttgagaagtgtcttcctgttctttgctccccctacttttttttttttttttttttttttgagaaagggtctcactctgtcacctaggcggtagtgcagtggcacgatcttggctcactgcaacctccgcctcccaggttcaagcaattcttgtgcctcagcctcctgagtagctgggattacagctaatttttaaatttttagtagagatgggatttcgccatattggccagctaattttttaaatttttagtagagatggggtttcgccatattggccaggctggtcttgaactcctggcctcaattgatcttcccaccttggcctcccaaagtgctgagattacaggtgtgagccaccgtgcccagcccctttgcccatttttacaaatggaattatttgatttttgctttttaaatttttacatttccttacagattctggacattagagatttgttggatgcataatttcctaatattttctcccattctgtgagttgtctcttgattgatcatttattttactgtacagaagctctttggtttaattaggtaccaatcatcaatttttttattttgttacaattgctattcaggacttagccataaactattttccaaagccaatattgagaagggtatttcctaggttttctgctaggatttttgtagtttgaggtcctccatttaaatctttaatgtaccttgatttttttaaatatagtgagaggtaagggtccagtttcttctgcatatggctagccagttatcccagcaccatttattgaatacagagttctttcttcattgcttatttttgccaattttttgaaggtcagatggttgtaggtgtgcaggtttatttctgagttctctactctgttccattggtctatttgtctgtttttgtaccggtaccatgctgttttggttactgtagccttacagtggagttttaagttgggtaatgtgatgcctttggctttggtgtttttgcttgggattgctttgactatttgggttcttgtttggttccaaatgaattttagaatacatttttctaattctgtgaaaaatgatatgctattttgatagggatagcattgaatctgtaaattgctttgggaagtgtggccattttaacaataatattgattcttctcatccataagcatggaatttttttccatttatttgtcatctctgatttcattcagcaatgttttatagttctccttgtagagatctttcacctccttgattaggtatttcattttttgtggttattgtaaatgggattgtgttcttcatttggttctcagctagaacgttactgatgtagagaaatgctactgattttgtatcctgaaactttaataatttgttcatcaggtccaggaggcttttggtggagtctttagggtattctatgtaactcatatcatcagcaaagagagatagtttgacatcttgttttcctatttggatgcctttcacttctttctcttccataattgctctggctcagactttcagtactagaagtggtgagaatgggcatccttgtcttgttccagttctcaaggggaatacttccaacttctgcctattcagtatgatgttggctctatgttagtcatagaaagctcttattattttgaggtgtgttccttcaatgccttgtctgttaagggtttttatcatgaaggggtgttggatttcatggaagatgttttgtgcatctaccaggctgctctggggtccaaggcctatggaggtcccttgtggacttgagtgttgcctccttatacactctgggcaggcagctccctgtatcagtctatatgcctgggggtcaggaggaatctcccatcccaggattgcacaggtccccgcaggaagtgtagatcccccaggggctctcactcactatggaaaccatttagttgcccatagtaatgtggttgaattctctttaactgccttatacatgtttataagttgctgtttgaatccccttcccaggacatgactggtaattgtgtgtggtttgtattaattttgttccttggagcttggagaagccagagagggagtaggtgattctaggactctgtgcaacctcctgaagtgacatttttctctgcgattgttttaaaactcacaaactgatggctgctttagcaattgcagggtaagggaaatacctagttctatgggacgtgcccttgaggttttgcttttgtacttctttaaggtggctgttggctgctttggtggcttcctagtgtacagtaatattgctgggcctgattttttttctagcaaatcttcataatgcagctaagctattcagatctaagagataattttctagacatttttctgatttctttctggctagaaggagtatatgattaatcttcattcaagctggggcagaaatgctgttttcttttttaaacagggttgcatgtctctagttgagaagtttatctcttaccttagtcaccttttctgtcaaaagtgggctatccgtagggtattttgaatgtaatgactcacctttcaccctctgtatgtatgatcctttgtggagaaagaactgtgtattagctctaaatttgtgatatgagttgagccccttctctggattctgaagattcttttcatgttttgtttgtttgtatatttcagtcatggaagaggagattcattatacctgtctatttcctaaaatccatcacctgttttctcagtgtttctctctctcctatttactcagcttctctgtatctataggctgcttcctcttcactggaaccatgctttagtcattcctcacatggactggggaggacaagtgtgacaggatggcttctgttgatgtttctactgccttacatctttctctttattaccaaatatgtaatcttttattaagtataaagataaaaggatagttaaatataaagagttcaacaacatagaaaataaaaaggccttgtaattcatccgtaattctccccatcctgaaatagtcctgattaacattttatatataatcttccagttttatattttatgattcacataccttgttttattttaaaaaatggaattataccaggtgatttgaaagtcttattttcaacttttgtttgttttgaaactgttcatttaatatatcataatagacatctttctgtgtgaaatacagatttatgtagtcttttttattgctttatgagttccattgtatacttatactgtttaattagttccctaataacagatatttaaatcatttaaaatatttcttttttattattattatactttaagttctagggtacatgtgtacaacgtgcaggtttgttacatatgtatacatgtgccatgttggtgtgctgcatccattaactggtcatttacattaggtatatctccgaatgctatccttcccccctccccccaccccacaacaggccccactgtgtgatgttccccatcctgtgtccaagtgttctcattgttcaattcccacctatgagtgacataggtgtttgtttttctatccttgcgatagtttgctcagaatgatggtttccagcttcatccatgtctctacaaaggacgtgaactcatccttttttatcactgcatagtattccatggtctatatgtgccacattttcttaatccagtctgtcattgatggacatttgggttggttccaggtctttgctattgtgagtagtgccacaataaatatacgtgtgcatgtgtcttgatagtagcatgatttataatcctttgggtatatacccagtaatgggatggctgggtcaaatggtatttctagttctagatccttgaggaatcaccacactgtcttccacaatggttgaactaatttacagtcccaacaacagtgtaaaagtgttcctatttctccatatcctctccagcacctgttgtttcctgactttttaatgatcaccattctaactgttgcgagatggtatctcattgtggttttgatttgcatttctctgatgggcagtgatgatgagcattttttcatgtgtctgttggctgcataaatgtcttcttttgggaagtgtctgttcatatccattgcctagttttgatggggttgtttgatttatttcttgtaaatttgtttacgttcgttgtagattctggatattagccctttgtcagatgggtagattgtaaaaattttctcccattctgtaggttgcctgttcactctgatggtggtttcttttgctctgcagaagctctttggtttaattagatcccatttgtctattttgtcttttgttgttattgcttttggtgttttagtcatgaagtccttgcccatgcccatgtcctgaatggtattgcctaggttttcttctagagtttttatggtggtaagtctgacatttaagtctttaatccatcttgaattaatttttgtataagctgtaaggaagggatccagtttcagctttctatatatgtctagccagttttcccagtaccatttattaaatagggaatcctttccccatttcttgtttttatcaggtttgtcaaaggtcagatggttgtagatgtgtggcattatttctgagggctctgttctgttccattggtctatatctctgttttggttaccagtaccatgctattttggttactgtagccttgtagtatagtttgaagtcaggtagcgtgatgcctccagctttgttcttttggcttaggattgtcttggcaatgcgggctcttttttgattccatatgaactttaaagtaggtttttccaattctacgaagaaagtcgttggtagcttgatggggatggtattgaatctataaattaccttgggcagtatggccattttcacaatattgattcttcctatccatgagcatggaatgttcttccatttgtttgtgtcctcttctatttcattgagcagtggtttgtagttccccttgaagaggtccttcacatcccttgtaagttggattcctaggtattttattctctttgaagcaattgtgaatgggagttcgctcatgatttggctctctgtttgtctgttattggtgtataggaacgcttgtgatttttgcacattgattttgtatcctgagactttgctgaagttgcttatcagcttaaggagatttggggctgaggcaatggagttttctaaatttacaatcatgtcatctgcaaacagggacaatttgacttcctcttttcctaattgaataccctttatttctttctcctgcctgattgccctggccagaacttccaacactgtgttgaataggagtggtgagagggcatctctgtcttgtgccagttttcaaagggaatgcttccagtttttgcccattcagtatgatattggctgtgtgtttgccataaacagctcttattattttgagatatgtcccatcaatacctagtttattgggagtttttaacatgaagggctgttgaattttgttgaaggccttttctgcatatattgagataatcatgtggtttttgtctttggttctgtgtatatgatggattacatttattgatttgcatatgttgaaccagccttgcatcccagggatgaagccaatgtgatcatggtggataagctttttgatgtgctgctggattcagttttccagtattttattgaggatttttgcatcaatgttcatcagggatattggtctaaaattctctttttttgttgtgtctctgccaggcctaggtatcaggatgatgctggccttgtaaaatgagttagggaggattccctctttttctgttgattggaatagtttcagaaggaatggtaccagctcctctttgtacctctgatagaattcaactgtgaatctgtctggtcctggactttttttggttgataggctattaattattgcctcattttcagagcctgttattggtctattcaaggattcaacttcttcctggtttagtcttgggagggtgtatgtgtccaggaatttatccatctcttctagattttctagtttatttacatagaggtgtttatagtattctccgatggtagtttgtatttctgtgggatcggtggtgatatgccctttatcattttttattgcatctatttgattcttctctcttttcttctttattagtcttgctagcggtctatcaattttgctgatcttttcaaaaaaccagctcctggattcattgatttttggaagggttttttgtgtctctatctccttcagttctgctctgatcttagttatttcttgccttctgctagcttttgaatgtatttgctgttgcttctctagtttttttaactgtgacattaggatgtcaattttagatctttcctgctttctcttgtgggcatttagtgctataaatttccctctacacactactttaaatgtgtcccagagattctggtatgttgtgtctttgttctcattggtttcaaagaacatctttatttctgccttcatttcgttatgtacccagtagtctttcagaagcaggttgttcagtttccatgtagttgagcggttttgagtgagcttcttaatcctgagttctaattgggttgcactgtggtctgagagacagtttgttatcatttctgttcttttacatttgctaaggagtgctttacttccacctatgtggtcaattttggaataagtgcgatgtggtgctgagaagactgtatattctgttgatttggggtggagagttctatagatgtctattaggtctgcttggtgcagagctgagttcaattcctggatatccttgttaactttctgtctcgttgatctgtctaatgttgacagtggggtgttaaattctccaattattattgtgtggaagtctaagtctctttgtaggtctctaaggacttgctttatgaatctgggtgctcctgtattgggtgcatatgtatttaggatagttagctcttcttgtttaattgattcttttaccatcatgtaatggccttctttgtctcttttgatctttgttggtttaaagtttgttttatcagagactaggattgcaacccctgcctttttttgttttccatttgcttggtagctcttcctccatgcctttattttgagcctatatgtgtctgtgcacatgagatgggtctcctgaatacagcatactgatgggtcttgactctttatccaatttgccagtctgtgtctttcaattggagcatttaggccatttacatttaaggctaatattgttatgtgtgaatttgatcctgtcattatgatattagctggttattttgctcgctagttgatggagtttcttcctagcattgatgttctttacaatttggcatacgtttgcagtggctggtaccggttgttcctttccatatttagtgcttccttcaggagctcttgtgagacaggcctggtggtgagaaaatctctcagcatttgtttgtctgtaaaggattttatttctccttcacttatgaagcttagtttggctggatatgaaattctaggttgaaaattcttttctttaagaatgttgaatattggcccccactcctttctggcttgtagagtttctgctgagagatcagttgttagtctgatgggcttccctttgtgggtaacctgacctttctgtctggctgcccttaagattttttccttcatttcagctttggtgaatctgacaattatgtgtcttggagttgcttttctcgaggagtatctttgtggcattctctgtatttcctgaatttgaatgttggcctgccttgctaggctggggaagttctcctgggtaatatcctgcagagtgttttccaacttggttccattctcctcatcactttcaggtacaccaatcagacatagatttggtcttttcacatagtcccatatttcttggaggctttgttcatttctttttactcttttttctctaaacttctcacttcatttcattcatttgatcttcaatcactgattctctttcttccacttgattgaatcagctactgaagcttgggcatctctcacatagttcacgtgccatggtttttagctccatcaggtcatttaaggtcttctctatgctgtttattctagttagccattcatctaatcttttttcaaggtttttagcttctttgcaatgggttcgaacatcctccttttgctcagagaagtttgttattaccaatcatctgatgcttacttctgtcaactcgtcaaagtcattctccatccagctttgttccattgctggaaagcagctttgttgctttggaggggaagaggtgctctgatttttagaattttcagctgttctgctctggtttctccccatgtttgtggttttatctacctttggtctttgacgatggtgatgtacagatggggttttggtgcggaggtcctttctgtttgttagttttccttctaacagtcaggaccctcagctgcaggtctgttggagtttgctggagctccactcctgaccctgttcacctgcgtatcaccagcggaggctgcagtacagcaaatattgcagtacagcaaatgttgcagcctgatccttcctctggaagctttgtctcagaggggcacccagctgtatgaggtgtcaagttgtcccctaatgggagatgtctcccagttagggtactcgggtgtcagggacccacttgaagaggcagtctgtccgttctcagatggcaaactccatgctgggagaaccactactcccttcaaagctgtcagacagggatgtttaagactgcagaagtttctgctgccttttgttcagctatgccctgccctagaggtggagtctacagaggcaggcaggccttgttgagctgtggtgggctccacccaattcatgctttccggctgctttgtttacctactcaagcctcagcactggcggacacccctcccccagcctcgctgccaccttgcagtttgatctcagactactgtgctagcagtgagtgaggctctgtgggcatgggaccctccaagccaggcgtggggtataatctcctggtgtgccgtttgcttagactgttggaaaggtacagtgttagggtatgagtgtcctgattttccaagtaccatctgtcacggcttcccttggctagtaaagggaattcccctaccacttgcacttcccggatgaggtgatgccccaccctgcttcggctcacactccatgggctgcacccactgtccaacaagccccattgagatgaacctcgtacctcggttggaaatgcagaaatgacctatcttctgcatccctcatgctgtgagctgtagactggagctattcctattcagctatcttggaaccctccggtggttttgaagttcatcactttttttagctatctccaggcctccttatctcacatgaaaattatatgcaagtgtcacttcagaatttccttctgaagatgcatcagactaatgtttggctagcattctcttcagagtttttccaggcccagtgaaaatagccaggctttttttgtcttaccaccttacaacaaacagcttaagtcctatccaactactacattctcccaacacagatacaaggcagcatgttcacattatctcaagcttcctccaaatacatctcaacagttagaattggattagaaagaggacttgttggcttgcttatcctgtgggtaactgtgacattgactgcaggtaataataacaagatctcttttatttttctaggtggcaaaccatgtgatttcttctgactctatttcctcttctgccagtagtttcctgagctcgaactctactttttgcaacaagcagaatgtacacatgttaaacaagggcacacaagcaggtaattacttgaatctgaactttttcattgaaatacattgaaatggctcttaaacatataagatactcaacctcaatcatagtaaaggacatgaagttaaaactatatccaactgccaattttcatcttatcagattggcgtaaattcaagtgtgatggcaagtttgtgggcaagagtgtagggaagtgtgttcccttgtatattccagtgggagtagaagttggtttactgtgaaagacaatttgacaggtcctgtcaaaattactttcactcagcatttttacctttgaaatgtctgctatagatatactatgaatatgtggattttaacctatagatatacttgcatatgtgcaaaatagtgtacaaaattaaccactgaaacattgttttttatagcagaagattaaaatgaatttaggtattcctcaatagctgaatgattacataaattattgtatatctggataatgaatgaaattctacatagaatgaggaagctctctctttactaacgtggaaagatctccaaggcatataactgattttaagaaaaggtacagaacagtgtatggcatactacaatatgagtttttttaaataaaagaaataaaggagggaagagaattgcttaaatgtgcaaaatgaattctctggaaccatatggggttgtgaacagagtaaatggagaccagaagtgggaaggaggatttttagctattgcctttctatacttttggtttcataaaataaaaataaataaactttcttgatttgtttcttcccctcaaatcctgtctttacttctgtcaacctcttccatacctgggtgactaccaaaaggactctaagtatttattgtctttctgccttgggatccaggtggaaattctttaccctttgaacccatattcattcttctttccctctcatacctaaaatgacttacaaataaaaccctttcttttttcttctccctctttttccctcctactctcccctgtccttccttcttttcctctctcttcccatcactccatcccacacaaagggattgtatttttgaaacattaaaaaggttcacatactcacttgaataaacctgtcaactcagcctcaaggttactcccagagacacctgtgatccttcccctcaggtaacttggagattgtgaacggtgccgaaaaacacactcgagccaactccaagttccagcgaggctaaattggaagaggacagtgatgtgacttcttggtcagaagaaaaacatgaagagaaaatgctctttaccagttatcctgaggacagaaagttaaaaaagaacaagaagaattcccatgaaggtcagtttctcattccagatcttgtagtagagaaactagtgaatttcaagtcccctgcaatgctgactctgtgtttccaagtgattctatgtgacccccacctacccccagtcaccaccttgtcagattttcgaagtccagcatggcagttacacagtcatccctgcagtgaaaccaaactcaagggcaccctgtggccgctgacagctgagacccctgagagcctgtattatatgcatctccttgatgaaagccaggtggggctgtaaaaagtgaaaattctgttttacttctaaaaactatttcctgtaggagtttcctggtttgttcctgtggaaaatgtggagtctagataaaaagaaggaaaacatgctcaagactcatgaccctggcatctcccggttggaaccagtaaccaagaccaagccgtggagggagccactgtgggagcggaactggcaggggcagcacctggacagtcggggctacctggcaggcccaggcagagaggatggcagaaacccactgaagctgtttgtgagagcaaccctgcaggtgcagtgacgtttacttaactttagccctacatgtagggagaagaagggtaaggcgcagagaagctggctctgtgacttggcgagctgaggtgtaggcctgagacgctcttttccagcacctccgcagttcacctgttttcacacgtgaggactgagtttctcatcatctgtcaaaggctgccttactcttagccatagatggtgcatcactgtcaggatctggagacaagggcacaggagggaggatttgtggctctgctcattgggtttgtgggtccctgtgtgtggagggcccagaggcctgatgcttgtgcagcctcatgcatgttcctccatgtccgcagctcctgtttctgctccatgtcggatttaaaggaaaccaagtctcttctgatgtgtccctctggggataaaggaaaagttattaatgatgtatttgtttgaatagatctttaaaatagcagcatgggcagagctgtattgcgttgatgtttcagagagttgtaatcgccatagtcttagttcctggcctatgctgaaggcatgtctttgatccctgtgggttccaagctgcagctctccgccatagagaggtgtcagaggtttcttcaactctaggtattttctcggcatttgaatcaggcttccccagacctcttgggtacgtggtgtgtttccagccatatggagagtagattgcatcattaatctgaggctgggtattttctctctctctctcttttttttttttttttttaaggaatcgcttcagtttcacagacctgacttcatctcccacattggggagcggataaagcgtctgaagttaatagtccaggagagaaagctgcagagcatgttaaagagcgagcgggatgcgctattcgacattgacagggaacggcagggccaccagaatcgcatgcgcccactacccaagagaggtacgccctgcccgttcactttcctgtgagtggaatagagaaggcaaggtctgctgctgtgctgcagagccctgctaaaggccagcccaggccagttacctgggcagacagcaaccttttgcttgccaagactcaaaccttcttagctaacagaacctccccaccttagccgtcagcacattcatgatccaagtaagcccagttactctagccctgtcactgcatcttaaaccagctctgtctgtgagcaagttagttccaaaagtatattgatttttcctgaaaagatggggctgattccaggcttgcctacctcttaggatggtaataatgataataataaacacatagtccttacatcttgcccaggcactgttcacattagcgcttacagcactctcagtaggtactattaatatatctactttatagtgagaaaactgaatcaaagggagattaactacctctcccaaggtgacatactcaggtgtgctgctctggagtctgcattcttaacaattatggtaagcagatcttgataaaataatgaaagctgtgaaaactacaaagtactatctaattctttcatcaagccttacctggaaactggccagttttttaattcaaagcctagtctttgctacagagtgttaggtccttagggccttaggctgctgtcctgttaccctagtctaaccctggcttgccttggtcattgctccccactcagtcttgccagctcagggtaggggcaccaagtcctagcagctccctctcccagctcttgcaccacaccctctgggttaagtcactgtccactgaaaaccctttcttctcttccttagtcttcctggctgtccagaagaacaagcctatcagcaagaaggaaatgattcagaggtccaaacggtaagaccaagaaaacaagagtttgtgtacaagtgttaaccaggccaccaagtggtcaggagctctggcttgcacccagaataaaggcattatgctcaaatttaaacattatgagaaagttgtgagagtcatttctcacttatggcactgaaaaaaaaagtagcacatcatggtatgaatgactcatatgcaaaagatgaaaaacttctcattaatttgcatatcttaggctcctctttattaacctaaatgtaaataaagaatattttaggccaggtgcggtggctcacgcctgtaatcccagcactttgggaggtcaaggtggataaatcacttgaggtcaggagttcgagaccagcctggccaacatggtgaaaccccgtctctactaaaaatacaaaaagtagccgggcgtggtggtgcacgcctgtaatcccaaccactcagaaagctgagccgggaggatcctttgaacctgggaggcagaggttgcagtgagcttagatggcactactacactccagtctgggtgacagagcgagactccatctcaaaaaaaaaagattattttaaaataaaattaaatatgtatttgggttattataccttttatcttagcaatcccatttcttggaattgatcccatagggtgagaaagaacagtgttctccagaacatattaagttaaacttttttaaaaaattaaattttcgaagtatgtcaacactgtttccatttgtggtctttaaaagtaagtatttgtgcctatgtagacgtgtatacttttatatgcatagaatatttctggaagacagaaaaacctgataatactgattgcctttggaaaggagaactgatgtaggatgtagtagattttttgactttttgaatgttgtgtcatgaggaacgaacattagttactcataaattaattcatttgagtgttggatgtggtggtacatttctgtaatcctacctactcaggagtcttaggtgagagaatctcttaagcccaggaatttgagactgcagtgagctatgatcacaccattacgctctggcctgggtaacagactgagactctgtatctaaaaaataataaataatattttaaaaaattaattcatttcagatattgatatattgatcatgggaatgccagagaataagttaaggttgacttttttaggtgttcattagagacttgctttaatgagaatagtttcttagttggcataatgcttctgaagtaaaggtactttaaaacagtttatcttacggactttaagcattcctcttgaaatcttgtttttactctttctagtcagtctttataggcaatccaaagggatgctttggatgctttagtccagtggttctcagagagtggtctgtggagtcctggaagtcgctgagaccctttcaggcaatttgcaaggtcaaaactaatttcagaatgacaccaggatgttctgtgccttttttgctgtgttggctatttgcactgatgatgcaagagtactgggagaggagtaaaaccattggtgtcttaccactattcaagacggtggcaccaaaccgtactagtctaataggcattgtatcctgcacagcctcccgccaggagtgtgatggaagaacaaggaagcagtgtaaatggaggtaaacgggaagcacttcctttgcaccgtgaaagatgatgactgtttcaaggaaaagcacttatgccatggtttgtgtcgtgagctgaaccagctgcctttgtcatggaacatgacttttaattgaaagagtaactgacagaaaaccaattattctgacttgtgtttagcagacattttcttgaaaatgaagaagtgactctctgacttcaggaaaatgtctgacagtatctgttgccaaagaaaatgtgagttttcaagccaacaatagaattctagaaaacttgtattcaccaccatgggcttgatgacatcttagtacttagacctttctgacgagatagcagtgacattaacaaatgtgacgtttttcatgttatctaaatacatttgtcaacatttggaagatctgcacaactccctggaccaggattttccaaatgattgttgctttttgttacaaaatcagggaatagatagaagattcaaatagtacaagatagactgatggatttttatgtaacagaataggaaaagtttgctgacatgctttcagattccaccttgcaactaatttttaagaaactaccacttgtcagccaggcacagtggctcacgcctcataaaatgagttggaatgaagtttttctttcttattctctagaagaatgtaatgtaatttattgcttaaataattaggagaattcaccagtgaaacccatctgggcctggattttcttttgtgggattcatttttttcaataactattcagatttcagtttttcttttatgccaaggtttagtaagttgtgttttttacgtaatttgttcatttcctagaaatttacaaattgatgatccaatgttataatatccttttgttatctttttttttttttttttttgagacggagtctcgctctgtcgccctcaggctggagtgcagtggcacgacctcggatcactgaaagctccacctcccaggttcacaccatcctcctgcctcagcctcccgagtaggtgggactacagacatccgccaccacgtctgactaattttttgtatgtttagtggagacagggtttcactgtgttagtcaggatgttctcgatctcctgacctcgtgatcagccctcttcggcctcccaaagtgctgggtttacaggcatgagcccccgcacctggccctttgttatctttttaatgtctggacgttctaggatctgtagtgatgttccgtttttattcctgatattatttttgcctcctgtcatttttacctgatcactctttccaaggggtatataaatttcactagtattgtcaaataacccactttgggttttattgatttttctctatcgtatattggtcttatattgattttttgttgtttattttggggccgtagcaggagccacagccagctccacatagttcagagggcctggcaagtatggaggaagacccttgctttcccctggaggtgctgagagtttaattcccgaggaagtaaggggattatttccctgtattggcaaaggttctagtttttgagtagaactagaggacctcacttctcttgaaggagaagtagagaggctcctcctcattcccttccctacaagtccccacgtgactgattcttcctctccaggggcttctagaattagcaacattgttccctttgatcctttggctgattacatatcctgcatttcttctgtagggctgggtgttgatagagggccataagacattatacataaggtattttatcccatttaccttgtttcttacaaaataagtcccagttggagaattgtagtattaatgtatgtaagtaactcatgttcagaccatctctcttgattccgtagggaacactggggccatatggtattacagtaatatatcatttgctttttggtcatggatatgggtatccaaatagtttccagtgctggaggaggcactgtaacgggctctcctccagtattgagacctggttccccatattctagggtctttgcccagaaggctgattccaccctccaagaagcttccactggggattagtgatgacacaaatcctgtaactcttagcctgtaggatatttctggtcctttcagcttgctgctacacgcaggccactatggagtggaggtgctgggaagctaggagaggacaataggggttgcctctccctggatcatgttcagtctgggtagcttccctggaaatctcatggagattccacagtagttccggatccagcttgagtggtgggaggtatgtaaatcaatcaagtaagcaaggtgttctttctggagagggtgcacactctgctcatgtaaagtctacatcactgtattttggttccaggaattcccacccaaactgccccattctaaattaggcctcttcaaatcaataacagttcttctgtgactgctggaatatggaagcccaatattttagggattaccacagactaaggagaagggaatccagacttcacatgcattcaggccacaaagaaacacaagtattggcaaaagtgacaagcattcagcctacagatataccagacagggacaaagtcttaaagatgagagtcctcgtctttatattagggcttcccctgttaaaatggatggagacatctctcaactcctagacctgaaggggagtcctgcccattcccaacagtcctggatcccttgagctaggtcctaaacctgacaacccagagtcctaataatcaaaaccaaaaccactcttttagtcagttcacagaaccaccaccacttactgcctcaaaattgcaccaaatgaaaggtccaagcagccacttctgctttcctggtgggctggggggatggggttggcatgcctgaggcccttcaccaatctccctcttggcaacttaacccactcatgcttcctcagactgctgcttcgcctgtaagcagcctataagggaggtcgagtcagggctcagtccatagtcccatctggatcaaccagatttgtttcccaggccctcccaccccactgcctccaaaaaaaaagcggggtttgtttgcctggtgagtaacaaaagtcgctgagaacacagactttgatcaataggagttttattacttgtcacaagtaggaagagctctgggaatattcgtcaaagcagtgtctcctaagagaaaatgacaggaaggctttatagagtgatcgagaggggagaaggtgcatcatcacatgaagaggaggggtcccagtgacacagatggagggagtcatcgtgccaccacataggacgcatgctatggtaatgaaactatagctctcccagggtgcaggatttagcattgtaatgaggaaagttcactgtaagtgagttcatctataagttgctggggtctgtcaggagcaggttccaactgactaggtgaccacatttcacacagggtttgagacaaaaccgtctgcaaggcagaaggctgtaaaacgggctaattgctcaaattcattaaattccttcactccctgggggcccgccctgtcttgtctatatagccagtccttaggaagtgaggccaagctgaactgttgacacagtctatgtctttacgagtctgggagctgggtgattttacctctgatgctagacttatttttactggttttgaagccttgcttacagccctttcccagtttctcacgaaatactcatgaaaggggatggtggggagtgggcatggggaaaagggaatgatattaaaattaaagctaacatcattggcctctagggggcactcatggctcatctccatagcccttggctcttgcagctgcccaagatgagagtcctgatctaaggaaactccaccaccaccaaggctggggtggtggcaatgggggcattattttccaaacctgactaggctacattttaaggggatcatagtcacagagaacatagatgtggactattaattttctttgcctgagcagccgtagccctatgtgctcctctccagcctttcagggagctatgatgggccaaaaaatgctcagtagcccaagccatctcctccatagacactggagtaaaatctctgcctatgggtgtgtgtgtcttgtcttactctatcctggatttgtttcctccaatgctggtggctttactttagatagtctgattgttgcagagatgagacccaaggctccactctggagaaaatagagccctcttgagaggtcagcccaacttgctagacttctgcatggggcttggggttcaatgttccagcctgtccccaaaaagtcatggccaaattcacatattcctttgatccctgatggtgtctcatcacacagttcgtctggcctcaccattgctccactaagtccaggaacctcaaggaactatgagacaggtagggctagacttaacaaaatggctatcacagtcttcatttcatgagacagaggtgaactgagaaaaggtggaaggtgcttcagagacttctctgtattcatccctaacttaggcagagagccttggccacacaggaaactggggaagacccctctcttactcaggagtcccccacactggtgccatcttatgacaggcaggcatcagcttcagagccagtcaaacagttaggaatagcaaacattgctccagaatttgttggggttttttttcccctgaatttgatagtaagctccacataggcaagaatgacaaccatcttgttctccttgtttctctggagtctaacacaacatgtagcacgtggttggcccaataagaatttgtcgaatgggggccagatgtggtggctcatgcctgtaatcccagcactttgggaggctgaggtgggagagtcgtttgaggcctggagttcaagatcaacctgttcaacatagtgagacccctatcttcttttttttttttttttttttaaagtggagtttgttgaatggcacacagaaaataaacaatccaaatgacagatcagaggtgctggaaaagaccagggagatctaatcgttaaatcacgtcatctaaatattaagaggagacatttggacatctgatagaatttggcattgaataagtgataaatacacagaaaactgaacaacggcaaaaagaaaagtatcagttctaagggaaaagatacaaatcaaaagccttcaggaaaggataagtcatcatggcttactgtatagcttagcttaaaataacacagaatagtgaagtagcccaaagggccatctaaccacactgggaagctgagcaggggaggagtgcgtatatgcatggaggagacttgtcttcaccctcctcagcagctgacagcaggcaggctagacctggacaatggagcaggagtcacacagcctgtgaaagaagtgctggggaatgtaggggctgctgtttcacatgacagagccattgaaccctggctgtttataatagttacatacataattttaatagaaataaaaaccaaaaagaaaaaagacttaaacatgaaaggcaaaaccattacaatttttagaggaaaatataagagagtaagaacagaaaaatgtcttaaggcacaaagtgctaaccataaagaaaaagattgataaattcatcttgataaattttttgtttatcaaaaggcaccataaagacagtgaaaagacaaggcacaaaatgggagaagataattgcagcacatctgaccagcaaagaatttgtatccagaatatataaagaacttctatgagtcggttttttaaaaacacaatttatatttaagtctctttaaaacaaatagacaattcatagaaatatggtgatatggtttggctgtgtccccacccaaatctcatcttgaattgtagcttccataatttccacatgttgtgggagggacccagtgggaggtaattgaatcatgggggcagatttttcccatgttcttgtgttagtgaataagtctcatgagagctgatggttttataaagagcagtgcccctgcacaccctctcttgcctaccaccacataagatgtgcctttgctcctccttcacgttctgctgtgattggtccgcatccaaatgtcatcttgaattgtagctcccataatcctcatgtgttgtgggagggacctggtgggaggtaattgaatcatgggggcagatttttcccattttcttgtgatagtgaataagtctcatgagagctgagggttttataaaaggcagttcccttgcacaagctttcttgcctaccatcatgtaagatatgcctttttcattataagttacccagtcttggatatttcttcacagtggtatgaaaatggactaatacacatgggctaaactcatgagcaggcaactttatagaaaaacacaaatagcccataaacataaaatgtagattgagttcattattaattagggtaatgcatgttatggatagaataaaatacctttttacattcactggattggcacaaagttttgtctttgtgccactctaaatgttgacagggatgttgatcaactggaattcacacactgcttgaggaagcttgcattcactctataattcagcattctgaaaagtgctcaccaataatcagcccaggaaggttcacaaggacatcttcaccaaatatgtcctttcaccctagcaaagaactagaaacaactcaagtgtcttttgacaagagaatgagtaaatggcaagtggtatgtcacgcaaaagaattctagacagaagagaaaattaaggaacatcaaacttagtgaatctttgagacgatgttgagtaggaaaaaaaattcagaagaatatattgtatgatacttttatcataaggtttaaaagcaagccaaggtaaacatgtgcagggacacctagggacccatgtcattttaggatcaaacagatagatggacagatgatagatagacagacagatggatttttttaactcaaaatagtggttacatccttagggagctgggattggagaagagacacttagctttgaaagtattgtcaaatatagtgacctttctagttcatttgggtgctgggttcaggggtattcattttattatgcaccataatttatgtgagacattttattatatcaaatattttctaatcttacagtaagcagtttggtaaacagattcataactgcatataatgtgtaggtcttgtgaacaatgctgctgtgaatatcaggacccaactgcacttgtctctcactgccttttgtaagcctgctcaattggggagttcttccccttatactggagatgagaactcaggtaatgcctcgactgttcggatcactgtcaggggattacatgttctaccgtgctgacttttcactgaaagcccagtctccactcaataagtaaaagtgtaataatcgaaactcccaatttgagttccacttaaaatcttctctcttcccctgccagacctctctgcaccatctaggggagcatagtcccctctgtccctgcctgacagggctctcctcctcagcagcacagggaggtgtctgacccatctgtgtgtgtgtgtctatgtggtggggatggggaccatagcttggcatcctgccctctcaccctggcagttcattgtctcaagctgactttcttgggtgttttcatggcttcttctgaggcctccctctggaatattggatcgtaactccagcaatgcaagcaataggttttcctccagcttctggtcctcctcctcctcctcctcctccccaaacctggtttctagcagtcactccactgagactcagagtcttcttggcccagtgccagcctcttgcatgtcccaaaccttgtcctcaggaaacacttatgcatcctatgctggggtgaactcttaagagtgcaggatcacctcatggccacagcctagctaggccctgaaacccacactctgggtttgtcagacgtgagtcagccccaggccactgaacctctcccactgcagggaatccctgtcaagtggtgaaagccagcatctagacctggagtcacaggcacctgtagcataactcctcctgaaatggaggtttttctttagagattggtccatatcccttatccctggacttctgagaagggtggacaacctgtggactggacttgagtctggaatttagagaagtgtccatagtagggctgccagatgaggcaaacacaaatacaggatgcccaattaaatttgaatttcagataaatgatttttaatgtttgattctgtcccatgctaaaaattgcccactgtttatgataagtttaaatttattggtccattctgtactttatcaaggacacacgcaggaggaacagtagcacaaaggcttcccggtgccttgtgggtgaaagaaaggcttccagggaaaggagagaaacacccagggatcccggtgacgtcgggaagcagcacccagaccatgtaaggacaccgcctgcagggggagactcaaggcctgggaaggttttctaatctgtgccttgagtcgggtggggggattttctgggaaaggaaaaccagacacagtaggacaaatattgtatagtttcacttatatgaaattgtcagaataggcaagttcgtagagacagaatgtagaacagggctttccgggggctggaggagaagacaaggagttcttgcctagtgggtacagagtttctgtttgaaatgatgaaaaacttctggaaatagattgtggtgacagttacacaccattgtgaacataattagtaccactgaactgtacacgttaaaatggttagttgtatgttttatgtattttgccataataaaaactagggggaaaaaaaggaaggggagattgtctcaggctggctgactttccctgcatgtacgcacatcttcacatgtgcacacatgtaaaacaaaaatgaagcaaaaaaagaaattctaatttaaccagtaagcaatatgtaaaaggaaatctgaatgtcattacaattttaccaggttcagaataaaataccatccttcaaaatgaacaaattacttattagccgaagaaaggtgaaaggaagtttggaattaacagtctagattttctcactgattggtccaagtcactgacctctaaaattatcttagatcatgccctccctccttcctactttctggaaaacaatcagtctcctaccctatgcttgcccaaagagtttcccatacaaatcacaaatctgcacttgccattccctggaagcccttacattcccaaggcctggcctcatccactgccactgcccatggccccagtccaggcaaagcaatcactccctctccctctctgtcattcctttcttttcctttcactctctttctaccctcctcttccccactctctgtttcctctctctctctctatctctctctccccaccatctcctctctctgtctccccccgccttctctctctgtctctgtctctctgtttctctgtgtctctctctctgtctctctctttgtctctctctctgtctctctctcacacacacacacacacacacacacgcacacacacacacagccagcaacattctacctctgccagagttccaggttgaataggtgtggactttgactttcagattcctctggcaagtgtcaacatcagtcctgttgctccctggcagaggaggacttggagtcaccttggccaagaagctgtctggaggtcacagtggcaccgcccatcggccccttggctgaggctagatgagggcagattcagcacagcagcaactctccccataaaaaaaatccctcagtgtcttagttctctgacccttgtactccttgtgagttttagagccacatgaactcttcttttttcccaatgcttggagacaaaatttacataacctacagttagccattttcaagtgtacagttccctgccatttggtacattcacagtgttttgcaagcaacacccatatcaagccccaaaacattttcattacccaggaaggaaacctgtcgtcatggaaccgtcactcctcacatccccttcccctcaaaccctggcaaccccaaaccgttcttgacagcctcctttggcatttcttcattttggtgtcagatctcacagcagaatttcttacctattatatccagtgcctcagtgcgaagttccagtttaacttcctgttacctcgagcccactatcttgccccaataataccctcccccaattcacaaacacagacgcattccctcctacagctttgggcctcctatctgagtccttcaggaaagaagagcttgtaactcccttagcagtgagtgtagacttggtccaaggaagatgagcaccagtcagggcagctggcccctcctctctccctggtcttcagcaaatcagcactgcccatcgatgcccaggcaatgggagcgtcgaccagcagaggacacacctgaatttctctgcctcatgggagggcggccactgtgttgcatttaggaagaagctgtgcaagattcatactgttttgctaatgttaatcttgtgggcataataaacgtcgtacccacacttaactttcgagatcagacaagattgggtgtgttcagggtggtatggccgtagaccccacacttatttttaacacacttctaggcaaggctgctgcactggtctggggatcacactttgagtagcaaaggactaaattgcaataactgccggggggggagaaaaaaaaacaggatgaactgcttcctcctggctcagcagctagggagtcactgaactaacaaggggatggggtggggataagaatgttccaggcaaaaggaacaacatgcccaaaggcctcaagcagaaagagagcttcaggtattgaagaagtagaagtagctctgtgtggctggggagtgggcataagatggagcagaagaatgccaagtcctattcctgggtctgaatttccaggagcagaagccctgtcccctctagaaggtggatatagtctggatatttgtcttcttcaaatctcatgttgaaatgtgacccccagtgttggaggttggacctagtaggaggtgtttaggtcataagaagtggatccctcccgaatggtttggtgccctcctcatgactgagttgttactctattagttcgtgtgagagctggttgtttaaaaaagcctggcatctctctggttccctctcttgccatgtgacacaactgctcccccttcacccttccccatgagtaaaagcttcctgaggccctcaccagaggcatatgccagccctgtgattcttgtacagcctgaaaaactgtgagtcaaataaacatcttttcattataaattacctagtctcagatatttctttatagcaacgcaaaatagactatcacagaaagtcggtaccgaggagtagggcgttgctataaagatatctgaaaatgtggaagtggctttggaactgggtatgaggcagcggttggaagagtctggagggcccagaagacagaaagatgagaaaaggtttggaccttcttagagatttgtaatgtcgttgtaaccaaaatgtggacagaaatatgtacagtaaaggccagcctgatgaggtctcagatggaaatgaggaagttatggggaactggagcaaaggtcacccttgttaagccctagcaaagaacttggctgcattgtatctatgtcctagggctttgtggaaggctgaacttaagagtaatgacttagggtatctggtagaagaaatgtctaagcagcaaagcattcaagaaatggcctggctgcttctaatagcctatgatcagatattggagcaaaggactgacttaaatttggaactattaaatcaaactaaaatctggcctgagaaagcctcctcactcccatacttgagtccttaaggatgaaccataacctaactttgtaggtaggccaactgaaaacctaacttagaaggatgcttctgtagcaatagctgagcgtcagccaatcgcagcagccatgcttcagtgactcacaggcagcctattgttcaaaccatgttcaaataaggcaaacaccatgctgtaaccaatttggctatttctgtacctcacttcggctttctgcgtgtcactttactttttctattcataaggttttttccgaccacatagcatctctggtgttgctctgaatctgctgtgattctagggactgcctgatttgtgaattgtctttttttttttcttcaaaattaaattctgttaaatttagtttgtctaaggtttttcttttaccagatctggtgttggaagtgcaatttgaagtaaaactctggtgacctccaggaacaccaggtgaccaggccagttgtgctcactgatctcttgattgtaactggaggttgtagatgcgttttctcttggattcagagctccactaatgtgtattctaattgaagctctccaactttactggagcgatattaaagtggactgggttcaggatcaaatttgaatcaataattaactggattaggttccgttagagcctcagacctatactaggcactttttttttttttttttttttgataatgggtttgtctcaatccaaagattctgggactctaccttctgggactccatctaatttgatatgtaaaattatggacccagaatatgtgcatttttagaaaaatagattaaccttactagagaaaagatggccacaatggggaagttttaatttgtataaaattgtttatttgcatggcatattagaaaaagggggtcaaaaccccacaaaaacagtgggatatagtctttcattggtacatggaagcctctaaaagacaaaatgaatgaaaacttgcctccttaaaagattcttcgcaaaagcaagtgaacagcttaagtaacaggctaaggacatgatgaaagagaactgtactctgactgaactaaccccaactgattcttctctttatgcatctctacctacgtactctgagtctactaacctttttactaaattgacctttcactctcaagatgatgaaaaaagaggaattagatgtacgcctcacaaaggaagaccttctgattatccaggcctgcctgctataaccactttcactccatggtctaaaactgagcttagagctattgtagaagacttccctgatctaggagagaatcctcaaaaattgactgaggagtgtagaatcctcataggagattatgatccaggactccctgacaaaggttcatataaatttattcatatgatatggaggcctggtgaagctcaaaaatggatggcagcagcagaatggaacaaaccggaggaagatattaaagactctgcccctactgcccgcccccacaaaacttcctcatgagaaggcccaacaggagctagaaatattgctgcaaatcccagcctgggcaacatggcaaaaccctgtctatacgaaaaatacagaaagttagctgggcatgatggcacacgcctgtagacccagctacttatgaggctgaagtgggaggatcacctgagcctgggagcttgaggctactgtgagccatgactgtgccactgcactctagcctgggtagcagagcgagaccccatctcaaaagaaaagaaggaaaaaaaaattgctgaaaatcttttaaattcaagtgctaaaatttttccgcaaaagttgattggtacatcatacaatattgtaaaccaaaaaaagaatgaaccagtgtcagattacagaacttgcttagaaataatgtgaaacattctgggctcagagtaccagcaaggagtatttcctgcagggactgaaatggtattaactactctatttataaagggacttcatcctgaacttagaaatttaattagaaaacataaactcggatgggaagttacagccatgactgaattggtggctctagctgaacattttgagaggactgtagagcaagaaaaaacccaaaaggctaacaagcttatgactgttcaattacaacagttacaggggccaagaccaaagggatcttctcattctcattttaaatcacaaccaagaggtattagaccaagaaattcttcaccctaagatgtctgccttattgcaaacaaccaggacagtggaatagggattgtgcccttttataccagcccaccaatgaccctccctttaggccagcctgtttcaccactagagggagcacaagagaccttagctctcctgaagataatcagcattgaagcggctctgagggatttcccagtatattgctcctcataacacccttaaaagaatatggagaaacagaggttacaataaatggggactcatgtatagtcttggtggataccagagctaccttatctgccactaccgtaaaacacactttcatacgccaacagatccctcagagttaaaaaggctatttctgtggttggggtttcaaatcaaattcaagaggttcccatatctgaacccgtccaattgactttggggcactcttcagaaaatcacacttttttactgtatgatagtgctccagtaaatttgctagagggagatttactttcaaagctgaaagggcatagaagactacctattgggtacattgtacactgcttgggaaatgggcacactaaaatctcagaactcaccagtaaagaacttgtccatgtaaccaaaaaccacctgtactcccaaaacaattgaaattgtttaaattaaaaaatttttaaaagtggggaggatgtaaaattttccttagaaggagtaagaatcagtttcctgattctcctgaaccagaattgttatgctctctataggcagaaattaataagattgaaactcaggcctgtaatgcctgatcttccaaaaatacatgaatgtttatgggtctcttcctcaactgacacaggaagaatttaaagtgtggaacttataaaagtccaaatagaccactctaaacttttgcctaaattacccaatatccactaaaactagaagcaattcaagggctctcgccaattatagaagatttaattaaacagggacttataattctatgcaccagccgttgtaacactccaatcctactggttaaaaaaaaaatggatgaggttgaagatttattcaagatttatgggcagttaacaaaattgtagtagcaaggtttcctatagtcccaaatcctaatactttattatccagtatacatgctgattcttaagtggttcacaatattagatctctgctcagcctctttttgcaatccaattcgtaaagagagtcaatgcttatttgccttcacttggaaaaatcagcagtacccctagactgtgatgccgcaagggtttaccgaagccccttcgtatttttcccaggccttgcatcaggacttaatgacattatagtttccttaaaattctactctcattcggtacatagatgacttactatatgctctcccactaaagagtgctctgaaatggactcagtttaccttttacagcaactcacacatcaaggtcagaaagcttcaatagaaaaacttcagttttcaaggggaaaaagtccattatttgggacatgacttgaagggatttccctctcacctaaaaagttaaaaactattcaaaattttccttggcctgcaaccaaaagataattaaatagttttcttggacttgcaggatatgtttttagacttgcaggatataaaattcctgggttctgaatttttccttaatagcctcaccatttcatgagctccctaaaaaatgctgtaccagagcctttatcttgggatgatagttacgagcaggcttttagctaaataaaattgaccttgtaacagcctccagctttaggacttccaaattgcactaaactgtttacctaattggctcatgaaagtaataatcaggcatttaggagttcttacccaggaacatggggagaaacataggcccattgcatattatagcctgcaattagacccagtagctaaggtatatcctaactatttaaaagcagtagcagcagcaaccaggatgaaagaagcttcagctgatctggttttaggaaatgaatttaatttggaagtcccacatgctaaattccacccaaacccagcattttttagtaagtagactaacatgaaatactctgtctccttctaatctctctctaaaacactgcaatttacttaaccatgccactgtattactgctgcctgatgatggtgaagaccacaattgcataagtgtagcatcagaaatagtggcccctcatgttaatttacaagttagtcctttggacaatcctgagttaatacttttgttgatgggtcctatgccaaaagctcagaaggaaaatatcagctaggatatgctgttaccaaaatgagttaatagagaagggaccccttcctctattagtcagctctattagtctaagctctataagtcagcttaactcttgaagatttttgccctcacccaagcttgtcgtatagctaaagacaaatcagtaagtatttagacagatagtagatacgctttaggagtagtacatgattttggcatgatagggaaactctaagggtttctcacttctagtgggatcaccatcaaaaatggactccagttagataaactcctagtttgctgttagtgatcgaagctcatacctgcagaactgaacctgaatatcaagggaatgcttagcagatatttatgctaaatcagctagtactgaaactgttcagatatgcaacctgaatgaacttcataagattaatccaatccaactaccttacaatgacctatttaataaacagtgcaatgcacctcatttggaaaaacaaaactggtatctaaaaggatataaattcaatgttaagtgcagactcacagagggcctagatggctgtctggtctttcctgagtctttgaagcttctattttcaaaagctctgtactccacaactcatcatggaacagaaaaatacgtccaaattgtgaaaaaatacttgtgggatgattgttccaaaattgctagaatatatatatatatatatatgtatatatattttgagacggagtctcactctgtcacccaggctggagtgcaagggcgcgatctcaactcactgcacactccacctccctggttcaagtgattctcctgcatcagcctcccgagtagctgggactacaggtgtgtgccaccatgcccgactaatttttttttatttttagtagagatggggtttcaccatgttagctaggatagtctggatatcctgaccttgtgatccacctgcctcggcctcccaatatgctaggcttacaggcattatccactgcacccagcctgctagaatattttataaccaatgttggcttgtcaaacccatagtcctggaaaaacaaaagattcaggtggtgtattgtattttcaccacctaatggatcatttgaacaattatagatagacttcattcagttgccaccttcaatgggggtctcagtatgttcttgtaatagtttccatgttttctggttgggtagaggccttcctgtgtaggaaagctgatgctgtgacagtagctaagaaattattagaaaatgtgttttctttatggagcatccctggaaaaatccccagcaataggggaattcattttattaggcaggttataaagcagttaaacaaggtgttatggacacaatggcactaccattgtccctatcgccctcagtcttctgaaaaggttgaaagaacaaatggcatattaaaactgaaattggcaaagttaactgaatcagttgggttgccttggccaaaggtactatcattggacttaatgacaatcagatccactctcactaaaaaacagaagtggatcccttatgaaatagtcactagaaggcctatgccccaatagtgaaacctcatgcatctttctgtctcctaaattctgatatgagtaagtactgcaaggccattataccaaagtgtactttcaccagataaaggaagcttttcaagatccaccaactgaggataatcaaaccttccacagtctagaacctggagattgtgtcttctggaaatgacatcagagaaaggctgctcttgacaactctttggaagggaccgtgctgagatcttctcaacacctacactgcagtgaagcttcagggccttgaaacttgggtccacacctcacaactcagaagggcctcttcagactcctggaactgtacacctgctggagactttaaggtaaagctgtctaaggaaatatctctccagagcagcgggcattctagctgtggacagctttcccaagatcacagatcaagacttctgtatcatcatgaaagccttacattttttcttttctccgcatttcctgttgccctaattctttctttttccctacagaaaaatccatgggacgataatcagtggatggctttagcttgagcatatgctctagcacagaaccagagtttgtggcttattgggtttgtttttattgccaaaaaaataaggaaacaattccgctaatgccaatgcctctccatgttgccaatgagagtcaccccaaaattccaagggaaggatagaaagctatccttgatattctgaacaccattgctacttgttttcctgcactcactaaaagcaacactttaacttttcctttttttttttttttctgaggcagtctcactctgttgcctaggttggagtgcagtggccttatcttggctcactacagcctccacctccaaggttcaagcaattctcctgcctcagccacccaagtagctgggactctaggcatgcaccaccgcatccagctgatttttgaatttt

SEQ ID NO: 441 - DNA, 23262 bp, Homo sapiens
cacatgatgtacttcatatgtatttgaaatattagctaagaattttaattttaaaaggttaaggtcataccaaacatagatgtcataggattcattactatttcaggccttaaataaggattgagaaacaaggaacaaaaaactccaagatcttgctctttgcataatgattcagagcaaatcaaatggtttaaaagtagtattacaaaaatatttataatccattataacaaacttctgcttcaattaatatcaacttagtttcaggggataacagtatactggatgttgtccaacacaagtaccatttgataggatatcttttttttttttttttgagttggagtctggctcttgtcacccaggctggagtacaatggcgcaatctcagctgactgcaacctccgcctcccgagttcaagcgattttcctgcctcaacctcccgagtagctgggattacaggaactcgccactacactcagctaatttttgtatttttagtagaagtggggtttcaccatgttggccaggctggtctggaattcctgatctcagggcctgcctcgatctcccaaagtgctgggattacaggtgtgagccaccacgcctggcctgatagggtatctttttttttaaatttaatttaatttaattttattttattttttcggagacggagtctggctctgtcacccaggctggggtgtgatctaggctcactgcaagctccgcctcccgggttcacgccattctcctgcctcagcctcccgagtaggtgggactacaggcgcccacgaccacgcctggctaattttttgtatttttagtagagacggggtttcaccgtattagccaggatggtctcaatctcctgaccttgtgatccgccagccccgtgatcagcccgcctcagcatcagcctgcctcggcctcccacagtgctgggattacaggcgtgagccaccgcacccggccgatagggtatgttaactttgcaatactttcttaaatgttatgtacatacaaactgtactttatacaggtttcctaataagtggtacataatgtcaacaggcatagtggcctagagacatcagtctagctttaccaattttcaaaaaactataaaaacgtgtgctttagaagaaagtataaacatactacttacataaaactcttagaatcatacctttctataaacactaataattagggacttaaaaaatcaatacctaaataagttcatgcttttttttatattttatttgttctttcttatctttcagtcccccatatgccctcctccaatagaatgtttgaaattacaaaaggttcagacaacaccatagaaggaaagaaattacaaatggaacactattttgtgtatatttgtttttaaaaatttctgaatctgcatttaatgaatttttattgaatgatgtgttgaatatttgttacctataattattgaaattattgataattaatgataattaatgaaaacagaaatcatgatattaaatactatagtaacatattattgttgtattcagttagttttacaactgtggcacagtagtagcacctataattactttctaaatatgtttattgggccgggcgcggtggctcatgcctgtaatcccagcactttgggtggcccaggagggcagatcacctgaggtcgggagttcaataccagcctgaccaacatggagaaaccccgtctctactaaaaatacaaaattagccgggcatggtgacgcacgggtgtaatcccagctgctgggtaagctgaggcagaagaatcgcttgaacctgggaggtgggggttgaggtgagctgagattgtaccattgcacttcagcctgggcaacaagagcggaactccatctctaaagaaataaatatgtttattgtgaaatataattcatataatgtagaaagatatgaattgaaaagtacgtcttgcttctaagactctgcatttagaacagagaaaaatatttaatggccaaaaacttcacattggtctatgacataaaattacaaattcaaaaagctctgcaaatcgtgaacagggttaatatgaagaaaaaccacatctactagtcaaattgctgaaaaccgaagatagaaaagaaatctaaaaagcagccagagaaatagcacattaaatacaagaaggagatcagccactggaatgacttttttctcaccagctgcaaagaaggtccaatatgagtataaaaaagaacattatacaatggaatagcaaataaaaaggtagaaaatatatatttattaaaatagaaattacttcacaattgactatagttattctttcttttctgtcccttcatatcaaaagttttcaaaacgcttaagctggtagaccctatgagtgtgtggcattaggcatccccagcctagatttttgtttgtttgtttgtttgtttgtttgagatggagtctggctctgtcgcccaggctggagtgcagtggcacgatatcgggtcactgcaacctctgcctcccgggttcaagcaatttccctgtctcagcctcccgagtagctgggactacaggcgcacgccacgaagcctggctaattttcgtattttttagtagagacggggtttcaccatattggtcaggctggtcttgaactcctgacctcaggtgatccatccacctcggcctcccaaagtgttgggattacaggcttgagccaccgcgcccggcccggatttattttttaacacacccaaatccgcagtcattaagtgacaagacttttgttttcaacaatatgaagtacttaaaatctggatattagatttttctccggtttggaagatcaaaaggtaattaattcatattcaatagctccccttccactacatggctcctacacagaaaaaaaggctaaataaacaacactagaaccagaaagtgaaagggggctttggggctctctgcaggaggcgtctacagccggggcccagcgcacgtaccattcttcggcaaactctggatcaccttcacggccgcctcaaacctagtctcgtgcacggatctcgtgtccgccatctccagctgccagtgttggccccggtcccaaggtctgtcggcgggaatcaggcagcagcagcaccagctttcccaagagcctgcatgaaactggaacatggagcgcagccgcggatcaacatgccccaaaaggaggaggcccgggagcgaagcgggtcagttcccctttgccctgccctatccaggccacacagatcgaagcggcccggctccttcctcctcccccggggcgtgactaaggtcacgaatccggcccgcgacgacagcaaaacaactcaccgagaggaagagcatgtctagcagaagacagagggggtccgggcatcggtggccgcggagccgctctcccaccctggggaccctggcggagcagccacaccccccattccgccggagtccgtctgtcagtccgtgccctccccacagccccgccccagagtcaccggaggacccactggcgccgccgccgccgcagcagcagtgcagcaaaccccacccacccgacccgccgccgcggcaaggacgcgcgcggtccgtctgtccccagaggagggtccgggaagcggggaaagggggccacagtcccggcttggtgcggggagcacactgtgcgcgcttttgttcagaagggggaaaccgaggccggaccgatgtgtccgctctggcagccgggtggacgaagtgcgcgctggggatgcgcggttgggttctgcacctgggcccaaagctgcacgcgacggcaccgctgggcaacaaaaatgactctgcggtccccagcgcctgcactctcctaagttaaggtttgaggaagttaaatggggcctaagcaaagggctttaagtcgggacaggttctgtgagaaactccagttctgccatttaaattatgtgacctagggcaagtcacttagcctttccagtggcaatcgtgacacccactctaaagggtagatggagaaaagcattggggaccttggatggaggtgctcagcagtccctggcccgcaggtcttcgacagttttcgctgccctgagccaagaacgtccgaggagcagccgaaggagagaggaggtcgccggctcctaaactgggctgggacggagggcaacttcccctacactaccctttccacccagccccagggagccaggcacctccagcgggatttaataggagactgggcatggggacggccgggcacagtggctcacgcctgtaatctcgatactttgagaggtcgagtggggaggattgcttgaggccaggagttcaagacgagcctggcaacatggcgataccctggctctatttaagaaaccaataattaaaaaaaaaaataaaaataggatactgggcgtagagggcggggccaatgaggagtctttacgggtcgtcaaccctagaaagggggtgccctgggccttcaacttactagcgcaaccccctgcgtccttaggcatttgggaagtgccccaggccgaacgttggtggtgggactgactaggttgtggggggtggagtcctgtagcccggaaatcccaaagtctcccggatggaagagtcgtttttgtcagttagggggatgggttaggagggttactaggaaaaatctaggcgcagatcgtaagttactcttccctctgagccgcggcgccggcatttaccttggtattgccggacaaggcctgtccggtaatgtccccgacgcccgcccctcgccctgccccgcgggcttatgggaaatgtagtccgccgttccgccgcgcttccggacacgtcccagcggcgtccggcgttcctgctagctcttccggttaggcgtctctgtcccgcggacgccgcagccgtgcggcggaatccctccttcctagccggttgcatttcgtgcctctttgaaatgccacattcgcttccagcttaagtgtcttgagattgtcgcggtgtctgcagctgcggcttctccagcgccctccggaggctttgcttcgggtttgtctaatacaacacagggggaaatcatttgatcgtggacgtttcacgtttctttgtcttcaaaaatgaagaggacattttgtaaaattatcacacaaagatgagaaatagattagagaaccaactttgggttgtaaatactaaagaattccaaatggtaatgtatgaatggctaaaaagcagtgacacttatctaacgcgttattactttattccataaaaggaacaaacctaaattgaaggaatattcatttcccccttattggatttaatagaacccttttcatttttaatgggaaataatcaatgtgacctatagatgtttcaattttttttttaaataaataaacctctttagggtgatttctggtgggattgaggaaaatgaacgggtttagggttatcttggcccaaagtctatcttggatttgccgctagttcactgtgtgactgcgtcaggaaacaagctctgaaaaatttcgttttctccaataaagtatgtgaaattacctagcatgtagtagccttcaagatttttgtatttcctcttttttgatacttagctgagcaataaatattggacagcagcaccagggaagaatctgaatcaggcagggaggatgagcactgcccaggaggaaaaagcgaaaaggaaagtgtgctgagcaggtgccttggcgggggagagaggaaaaggaaatgacttcacacacacacacacacacacgcgcacacacacacagagagaatgaagtttctttctgtctcttaagtgatgtgtgagtggatggacagattgccctcagctttaagggcagttcaggatgatctgtcttaagatcgatgctctgtggaatgagaaaaatgcgctctgcagggcatgcccactgcatgtgctgggaggctctcctacatccaatgggcagatgcgcagtctccacggaggcctcaggcctcggtgtgagccagggctgcttcaaacatgtcggctatctaaagtaagtcccagcaggggtcatttatttaaggaccgtggtgctttccatggctgatttgctggtaaatgacaggtgtgagtgtagtgaacatgtcttgcctccacctacttcacccaccatcctgtgcatcatggaaacctgtctcgatgatcagcagccatgtgtggtggggtggaaaggacagtctccagagacagaatcctgggaccatccctgactttgcaacttactagctttcttgccacactatttagttttttcaagctgtaatttccttaaaatggggaatatgatcaatctctatcccacagaaaatttggagcacatgagttcattcaagtaaagtataccattagcaggccataacacaggcacgaagaaggaaatacaataatttgtgcgtgtgtgtggtgggttaagtgtcacatcttcataaaattcaaccctacccccatttcagtcacttgtcagagaggaaagccaagaagccaattccaagagtttagtgtgacatcagtgtctaggtcatctaaatctggccatctttctgccatacctatctaagtcctgtggcaattaacacagtagagctatatttgcataagtaactttatagtctctgtgtatatgctgagcagagctgattcattttacaatcatttgcacttgtcatagagctccttcaatactactacccaaacatgttggacaaagaaaagaagatagacacttttgttttgttgcttgttttctactgattttgtaatactgtattttcaacttcttagcgacattggccccatgttaaaggcctatgtcacacagcctgttgtgaataagaagttttttttaacagttgcccttgcaataataaacttctatttgcattgaaagcaatgttattgccctttccatataaaattgtactcatagatcattttaaagtaacacatttttttttcttaaagagatgaaattggaaaataaagtggtaatagtgtgtttaatttgtaagtaaaccctaggaacacaattcattttactttgttattatcacaaaacagtaaaaatttatcttgtttttaacagattccgattattaacaaatccgatttgtatcctatttatgtatttgtcacatacgtgaaagtcgtctttttcttcttgctagagacctaaactgtgatgatcaaattgaacagtataaacaagcaattagatgattaatttgctacaacctactccgaaatatgagacattttatccacttatgtatattcaaggccaaggttatcaataaaatacaggcagaagttatgccgaatgaaaaataagacatacacctgtgtaatcgtcaagtctgtttttttcttattttctcacatcattcaagtcatcaaaattttattgcttattacatgacaagaaatacaatgttagacatgaaatgaataaagaaaattctctatcaagaaatttacaatgtggagaaaaagatgcagtaatataacattataatacaatataatccaatgcatatcatatactgcaatgaattctatgaaagatttgttaacaaagtgcttggggaaaacagaggaggtatagtgactcctgatcctggcttctggagaagaccagaaaatattagagaggatgaagcatatttactgaccttgaggaacaaggaggatacattctgtgggaaagaggtgggctgggcacagtgactcacatgtgtaatctgagcactttgggaggccaaggcaggaggatcgcttgcacccaggagtttgaggctacagtgagttatgatcacaccactgcactccagcctggccagtagagcaaggccctgtcattaccaaaaaaaaaaaagttgggcattccacatagaccacatgcaaaggcagaggaggaacagagttttgggagataaagaggatttggaaggaacatagaatgtatgacaaaaattagtgagatgagaatttggaacaaaacttggaggcaccttgtcagaaattcagacgttatcatggaggctttagagagccattacctaaatttgaacagggctgtggtgatacttttttctaaaaaaaacaacacaacaaaattgagagcacttgggaggaagaatttggaaatggcagaatcaccataaaggtggaaaatatttacttttgactaaattgctaaattgaggcatgttaaatagagaattcatgagtgtgtttttaaaagagcctaagcttcttgaattattattcactttagttagaatcactgcagttctatgcataaaattaagacaaaaagacaaaacagatacattgaaagttaagaaaactgaacaagtagattagtctattcttccagtgtcttgtggacttctcaggatgataaagaaattctactatgtcactgttagtgcacaatatataatatactaatgattttttttcaccaagaacaatggtatttaattgtaaaatctccaccccctgaggatatgttttcaggtctgggtgattaattagactgggaaacaaaggagggaacgacggccctgtgcttcctccgccggctgcctctgtggatgcgtgggccgctggcttcagtcctgcttttctttctgatggcccttgttgtttacgctaagtatttttgcaggacgcctgaggtgggctggggtcactctgtgttctcctcccgtggcagggcttcactctcctccccgttctctgttggggtttcgctgtcctcatcagatggggatctcatcctcattagatgacttcttgtgcagcttccatgcctggttatttactcttgtggcactgagaggtttgtacatatctttaagccagagtggctgtctgaatgagaaagattcatcctgagtctcacttcgtgaagagcatctcctctgtggcagaaatctgaaaatgccccttgagaatccttctccatcttcttgtgatgaccatcggtgagaataaatctcaatgaggcaaaaaattataatcaaagtcgttagtatttcggtcacaaatattgccaagatgagtttgttgttatagccatatcctggaacttcttttgtgagctcactcgacttctgctctttctgttcattctgggcttctgtgctgtcattgatatagttctcagttttccactggtccgtatcccattctgccttggacacctttacttcttgctgctcactgagaagcttcatcaggaggcctgtcctggagatgagcttggcacaggtcaattgcacatgggtctcagagcagtccatcttcaaggtccggataacatgagaaatgagccttctcacattgttgttggggatgagggaacgtggctgttgggttagctgaatttcaaactgatcacctggggacgagaacaatgggtaattgaagcttttgggctcgggggacaggtcagtgcccacgttgttgtattcccattttgtctcagtttgcttaatagttggccctaagttgaatgcagtcccagcggaatctgcctcaggaggatgattgtgggttgtgttttcagagatggtgccttatggcctagtagtgttttccataaaaatgttttcttcaaaggcatttcttgcagttgtgttttttacattagtgttttctataaaacgttctgaaggagcaaatacttctggaaaaggattttcctgaggactcgggtctcctaaagatgaaaaagccctttgggaaagggaatttatgaggctcttcactgcagagaatggaggcctctttgcgagcatcagtctaatgaggtaatttttctttctgaactttggactctttttggccttgagtgttctgtgggccatgcgggagcaagttttatgaaagcagtatttttttctggaatgtacgattggtttagcagccttcatatttttaactctagcctttgcattttctaaaatgaaaatggtgtaggttaagtcttttgctctgtctctgacctgaggtagggcttttgcaggggtggaggcagaaggcacacccatggagaagggtttcagcacagaggagactgcggccttatgctcttggatgaatgaaggcttggtgtagatggtgtttcccactaacttgtcaggcccctgctctatgtgaggctgtctcagctcccttggggctggactcccgagccttttttctttggcagcgttctctgcaaatgcctgggcaccctgttccctcctgatcctctgctttccacctctttgaagtgccttttcaagatgctccttgggcccatgaggactctgttcactctctgcaggtttttgcctacactttgaatctttgccaggctgctttcctgtggttagatagtttctaatttcttttcaaatatttggcatttaaatttgttacctagaaggctggactgcataagcatggcagttttttcttcccttttaacttcatcaattttttcttgtatttctgcatctaacatactttccagcaaatacagctttctcaatttattttcataagttgagttgttggatgcaggttgaagagaggggctctttgtattgttattcaaaatacccaggagcctatctccatcttgcacatttgaagaaagcagattaatgaagggtaacaacattgatttcacatctagatttaccgctgagaaataaagcaagatgtaacttagtgcactgataacatccctctcatcattggtgtctagctgcccactcccaaagcctgacaaattgatgccattgctgtctgaggctgcctccggctcaatagtcagctcagtgctcgtgtgcttcttctgggcttgtaacaccttcatgaacactcctggattctctacagatgcttcttcagacaatgtatggtgtttgtcagaaatgcactgctgcaatgcagcttgactgtcttgcagacagcctcagtgctatttttaaattggcagaggcagcaggtcatatggctaggtaagatcagtttctccagttcaacagtcatcacgagaatgttctcaattgttgtaagtgggacttgcattgttcccgtgtctagatatttaaatgctgacaatttaaagagatatggatcttcaacagttgtcagaggattgcgattgagaattaacttgtgtaaaaactgcattccatgccaggcctgaaatgttccaaagctcagttctgtgagtaaattgcaaccaagatttataaactgcaaaaatggtagtggttcaaatgtatgtctttcgatagactgtattttattgcaggataaatctaaatactggagggatagcaggcctttaaatgaatcgttatgtaattcagtcaaataattttcattgagaattagtttcccggtccaactgtatgctttccatacatttccatcaatgtaagaaatatagtttccttggaaatttaagatggtgaaggtgccatggtaggtgttgggctctggcacaggcacttggcagagcctctgttttgggctgagatcaatacacgacagcgtctcacctccgcaggtacagagctcacatatgttggtgcttgtggaggcctactgttcctctggtgcggttaaagccttattttgggcgtaactttcagactgcaccagtgaatcctgagtaggttctagttcagtaggtggacctgtgacttcagtcagttttcgatgcagagtctgaacctggtctggatgaggagctgtagtcttctccagggctgtagaatgtccagtctctgtagtgggctctggagttatggcaagccccaggtctggaggctgagttgaggtctcctccgtggttggagacggtttaacctctgtagtaggttctgtagttatggtaagctccaggtccagaggtggaagtgtgacttgagtcaggtttgaatgctgagcccgacccttgtctgaaggtggaagtgtcacctcagggtgttctggaggaggagctgtagtcgtcagggctgcagaaggttcaatctctgttgtggattctggagtggtggtaagccccaaatccaaaggttgaactgtggcttgagtcaggtttgaatgctgagtctgaacctggtctggatgtggaagtgtcaccttagggtgctttggaggaactacattcttcttcaggggtgtagaatgtccaacctccgtagtgggttctggagtgatggtaagtcccaggtccaaaggttgaactgtaatgctgggtgacattggatgctgagcctgatcctgacctggtgttggaattgtaacctcttgatatactggaagttggggtacaactttcttaggaggatgagttggggtctcctgcatggttggagaaagttcaacttctgttgtggattctggagtgatggtaagccccaggtccaaaggttgaactgtggcttgagtcaggtttgaatgttccggagattgagctacaactacattagggagctctggagtctcagctggggcctcctgctgggttagagaagacttacccttctcagcagtctgtggatgctcagctgcagcttcctgctgggttggagaggggttctcattattaataggttccggagattgaactgaagtctcctgttgaattgctaaaggtccagcatcttccggtgactctggaggaagaggtgggcccccgtgctggatagtgggaggttctacatcattacctggtcctgagagctgagctgtagcctcctggtggactggagaagttcccacctctgcactaggctctgttgctatggtgagctgcatgtctggaggcttaacagagacattgggcaaatctgaatgctgagtttgatggtgacctggaggtgaaacggtgacttcatgatgttctggaggctgagctggggtctcctgctgggctggagaagattcaacctccccagaaggctgagctggctgctcctgctcactgggggaaagttcaggctctacaggaggacctggaggctcagttggggcctcctcttggtttgcaggaggttccatctcttctggaggctgagctggggtctcctgccgagtctgagaagattcaacctccccagaagactcagaaggctgagctggctgctcctgctcactaatggaaagttcacgctccgtaggatgacatggaggctcggttggggcctactgttgggttgcagaaggttccacctcctctggaaactgaactggagcctcctgctgggcttgggaagattctttctcattggtaggctccgaagttatggtaacctccacatctgcaggtttaactgtaatgttgggcaagttataatgagcttgatcctcacctggaggttgaactgtcacctcatgatttggtagagtttgagctagactctccatagaggactctggaggcagagctggggcctcctgctgggttgaagaaggaggtgtggaagctgctctggggcttcttcctggagtgaagaggactggatatcttcaagggtctctggattttgagtttcaggctctagatggaattgagaaagtccaacttactcaggggaccctggaggctcatctgagttcacccggagttctggaggcaggctgccaggatactgtgtatccatactcgaatattcatcctgcaaagtctgtttctaacgctgtggtttggataattgctgtggaattccaacaatatcagcaatgctccaatgctgagctagatctttcttcaggttcctgggtgaaacaaacaataaataaatttggttggttttgaaaccttactgtctagtggaacaagtatttcatctgcctgatgacctgcagccccatctagatctgcagtttgaaccttacttttgaggcgaggaggctgaactagggtctggttctgatccctgtccagcattggaaccacctctgggagcctttcttgcagagtcagcttgtcattgaaatcctggtgtgcaactgagaactgccctggccctaggggcagctctccagctgaatccgtgtccaggaatggaaccaaattttcagttgattcctggggtggggctgacatctgcgaggaagcagagggccccaggtaatcaaagtcccccggatctgctggggcaataggggcatggggagattcccatgggagatgggaggagcggaagaccagggctcaggcggcccccgggggttagaggtcagctggagcagatccttgacccactccagaggctgagcctccttgactagtagccacaatagttgccacgtgagcaggggccataggccccagaaacacagccgggacatgacacatgctggcaccgcgcagtgagcgagagccattctggcagccccgaaacgctcgtgtcccttataagcgtgcgccctgccctgtctttatgacacctttatttaatgccacctttattaggctcgggtctaaatctgctccatgtcaccatggcaatcttatgtcacaatcctgtccaagcaccccttcccatcccgcccccccggaaccccctcccctccccttagcgaggaaggatttgggtcgcagacctgggtggtcccaggactccagggcctgcagtggtggggtagggtggggtgggggcactgcagagcttcccaaggaagtcaggcgacctcgcctccggatattcagaagtgctagtccacttctggcagcctgaactcttcctcctttttttgaaatccgagaatactcttctttccagggagagaaactgacctgtaatcccagctactcaggaggctgaagcaggagaatcgcttgaacctgggagtcagaggctgcagtgaagcgagatcgcaacattgcattccagcctgaagtgctgctgtaggtactatggctcctgaagttgctttccctgcagtaactggagtcctcctcgtcgtcttccagctcctccgggtaagggtaatcgaagtcatcgtcgtcctcctccatctcatcctcctagttgtcctcagactcctgggtctcctcagcgtcgccgtactcctcctcctcgctcttgaggtcatcgtataccactttgttaacggccgagggcctcggtggtgcacgccaggtggctgccccagccccgccgcccccgccgccgccgccaggggcgctggtgtgtgtggtgtggtgtgcgtgtgtgggggcggaaggcagcggcagcttccgccaactactgctgcccaccctggccgagctcagccgcgtcttgggcgccacctcatcctggcggcggcccacctgccccggctgctactgcgttgccgctagctgagcccccgatgggttcggacgtgtgcggcggcggcggctgagaccgggggagaagggaaagcggacgaggagcggcgggcgcagtggaggcagtggggagcgccggggcctgacgaggaggcccgaggggccgggcgcctgggcggtagagacccggcctgccgaagcgggtggagggagaaggctcaatccgaatcgctggggccccactctggatcaccttcagccgccatcttgtttcttcccgttcaatatactaatgattcttaaatccatgtagatttcaagaaaaaaaaatcaatatatatatagtcttaattccagccgcgcatggtggctcacgcctgtaatcccagtactttgggaggccgaggcgggtggatcacgaggtcaagagatcaagaccatccttgccaacatggtgaaaccccgtctctattaaaaatacaaaaattagtcgggtatggtggtgggcgcctgcagtcccagctactcgggaggctgaggcagaaggatcacttgaacccgggaggcggaggttgcagttgagccactgtactccagcctggcgacagagctatactctgtctcaaaaaaaaaaaaaaaaaagccgcagttggactcatggagccctggggaaatcttctcaagatgcaaaggaggtactatgccaaaagagacattctgaaagcaggaggcatcatcttttatacatattcaatcacagatctttatatagtagttcttcataggaagaatctacaggaaactgagaggtagaaacaggagtgtccccagttacaaatgctcccaataatcttctaaggttttcctgtgcttctcatcactgcagctctgggatctggaaggcaggcaagtcctgttctctaaaggttatgggttgggtgctttagattctttgggtccagtaaccaaaagacaagaaatacatcaccactggggcaggattcatatactctgatcagcaggaggaggcggggctgcttttccacaaaagaagcagagataatctctctctctctcacacacacacacactccccacccccatagtctctctttcacacatgcacacacacacatacacacacacactctctccacaccctctctgtctcttttttgttattaatttcctgttggagtgcagtggcaggatttcggctcactgcaacctccgcctcccgggttcaagcgattctactgcctcagcttcccgagtagctgggactacaggcacaggccaccacacccggctaatttttgtattttcagtagagacggggtttcaccatgttggccaggatggtctcaatctcttgagctcgtgatctgccagcctcggcctcccaaagtgctgcgattacaggcataagccgctgcgcccagcctatcttccttaattctattgtgtgttgagaagtttattaactttcccaaatagtcgattatttatttataggttagatttatcttcttatagtaatttcacttggaggataaattttatttctttttattacacttttaagttctgggatacgtgtacagaacgtgcaggttggttgcacaggtatacgtgtggcatggtggtttgctgcatccatcaacccgtcatctacattaggtatttctcctaatgttatccctcctgtacttccccactccccgacaggccccagtatgtggtgttccactccttgtgtccatgtgttctcattgttcaactcccacttatgagtgatgtatctcaaaataataagagctatttatgacaaacccatagccaatattatactgaatgggcaaaagctggaagcattccatttgaaaaccgacacaagacaaggatgccctctctcaccactcctattctacatagtattgggcgttctggccaaggcaatcaggcaagagaaagaaataaagggtattcaaataggaagagaggaagtcaaattgtctctgtttgcagatgacatgattgtatatttggaaaacccatcgtctcagcccaaaatctccttaagctgataagcaacttcagcaaagtctcaggatacaaaagcaatgtgcagaaatctcaagcattctatacaccaaaaatagagatccaaatcatgagtgaactcccattcacaattgctacaaagagaataaaatacctaggaatccaacttacaagggatgtgaaggacctcttcaaggagaactacaaaccactgctcaaggaaataaaagaggacataaacaaatggaaacattccatgctcatgaataggaagaatcaatatcatgaaaatggccatactgcccaaagtaatttacagattcaatgctatccccatcaagctaccattgatttgcttcacagaattagaaaaaactactttaaatttcttatggaaccaaaaaagagcccgtatagccaagacaatcctgagcaaaaagaacaaagctggaggcatcacgctacctgacttcaaactatactacaagaagggtaagttttaaaaatgtgaagcacaataattttttgttgacctttaaaaagtatatttttaatttgtaaggtacagtgttagatatttttactaaaataacacaatcatttgcacactctctcatctaattactctgttttagttcctatgaacctgattataaaccaacaatatttcttttggtctatttataagcttttgtttttatatttgaataaacatttaataaaaaaaccattgtataattttaaattatagactctacatttactcaaataaaaatttcttctctcttctgataaacctatttctgactagcatttctctagtttatatatctataatcacagctgtttcctatactaatataatcttttctgcacatatattgagggtgtcttatttaaaatatatcaaaaaatattttaacaacctaagagttattgttttctaattgtggagtatagtttttatttttttcattctttattgttgaagatgcttattctttttcataatttactatacttttttttttttttgagacagagtttttgtgctgttgcccaggctatatacctattagcataagcccctttctcactggttgcaagcctaagcttctctgcaggtagaagctcctttaggcgaaactattcaattcccaacaacttttgcactttcaaaaagagaagaaaagaacccaaaacaggccaggtgcagtggctcacacctgtaatcctagcattttgggaggcctaggtgggcggatcacttgaggtcaggagtttgagaccagcctggcccacatggtgaaaccctgtctctactaaaagtacaaaaattagctgggcatggtggcacatgtttgtaatcccagctactcaggaagctgaggccggaggatcacttgaacccaggaggcaaaggttgcagtgagctgggaggcacaggttgcagtaagcagagatagcactccagcctaggtgacagagccagactccatccccctgagagacgacaacacgctagcagcccttgctcgctctccgtgcctccttggcctcagcctccactctggccacgcttgaggagcccttcagcccgccgttgcactgtgggagcccctgtctgggctggccgaggcctgagccagctccctctgcttgccggaaggtatggagggagaggcctggagggagaggcgcgggtgggaactggggctgcgcagagcactcgcgggccagcgtgagttccgggtgggcgtgggctcggcgggacctgcacttggagtgcccagggcagtgaggggcttagcaccaagccagcagctgcggaggatgccccgggacccctagcactgccggcctgcgcgcaccactctcgaattctcactgggcctcagccgcctacccgcgggtcagggctcaggacctgcagcctgcggcatatgcccaaatccgccccgcgccccccacccccgctcccgccccgccccccacccccgctcccgccccgcccccctcccccgctcccgccccgccccccccgctcccgccccgcttcccccaccccctcttcccccgctcctcccctggctcctccccgccatgggcgcactgcccactgctctgcagcgccagatcccattgacccctcaagggctaaggagtgcccgcgcaccgcctgggactgaaggtcagctccgcccgcggcccatggcgcaggatccaccaggcctatgtaaagccagctgggctcctgagtcgcttggcgacttggagaacttttatgtctagctggaggattgtatatgcaccaatcagcactctacgtctagctccaggggtttgtggatgcaccaatcagcactctgtatctagctaatctggtggggacttggagaacttttatgtcaagctagagaattgtaaacgcaccaatcagcactgtgtctagctaaaggtttgtaaatgcaccaatcagtgctctgtgtctagctaatctagtggggacttggagaacttttatgtctagctagaggattgtaaatgcaccaatcagcactctgtgtctagctcagggattgtaaacactaatcagcaccctgtcaaaacggaccaatcagctctctgtaaaacggaccaatcagctttctttaaaatggaccaatctgcaggatgtgggtggggccagataagggaataaaagcaggttgcctgcgctagccaccgcagcttactgtggtcgtcttcctgacggtgtgttttgttctttccgctttttgcaataacagttgttgctgctgagtctttggggctgtgctgtctttgtgagctgtaacactcactgtgaaggtttgcggcttcactcctgaaggcagtgagaccactaacccaccaggaggaacaaacaactccagacgcgcaccgtttttatgaactgtaacactcatcatgaaggtctgcagcttcgttcctgaggccagcaagaccacaaacccaccggaaggaagaaactccagacacgtctgaacatctaaaggaacaaactccagacgcaccatctttaagaactgttaacactcaccgccagggtctgcggcttcattcttcaagtcagcgaggccaagaacccagcaattctggacacacccgaccctccaaaaaactgaaaataaaggacaaatatttaggtctcatatccctacatgtttgcaggaaggttctgctttgagctgtatccgtataatgacaggtgatatcctgaggacattccacatttgcctctttggcatctggaaaagaatccagtttcaattccgaaacatcccatcatcgtaaatgctctggcactggcctctaagcacagtctccctccaccccaagatagtgcattcttccccacccacccccgcctcaatattcctactcccttgtccctcactggttttccagttgggactcttgctggtagggtgtctagaggtggggtcaaaaccatcttaatggacaaaggtaaaagccatttaaaaaaagagatgggggacgtgttttcatttcactccgatcctctgccctattgaagagcgctttctgctttccaggtgagtatcagagtattctaacatattcgttttttggagagaaacatgtaagcctcaaatatcctaggagaagccctatgctatttgggggtactcagtgaagatttcaggtacatacaacgcacttgtctggaagcctgtggagaaatgtaaaaagggtttctaaggaatattttctctttcctttctgctctattttaagtttctgctaacttgtccccgaccccacaactgctcacgaccttcgtgaaggtcaacctttcctaccgcgtggagtgagttgggatgcatactggggagttgtataagagtgtctgagaaagggaaatgcagagttgaatgaaagtgtttcccgggaggggccgagtggaaagcagcaggtggccggcgcgggtggaacccagcgcgggcgcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtcctagcaacaggtgggcgccgactgcggcggggcagggcgctgcaggtgacttcggccgggggtccccaggcccaccccatgggggctctgcagccggccgcgtagatcgggaaaccggggccgctctccggccccgccgctgctgctctcgcctgcttccctttccctcccgggggccgagacctgccccctccccttttctctcccaggcccatctcgctccttcctccccgcgagaccctgcctcggccctcggttggggaccgtctgctcctcagtccctgcgcccctctctgcactaccctggacccatcacctcccggatcggttctccacttaccccgctgtttccctgtctctccttccgcgagcccatctttctccttcgcccttgcagctcggcctcccgctcccaacgtggtgttcgccgtcacttcccacctcgtccctttaccgaatccattcttggaaacttagggtctcagctctgacgcccccttcttgtaacgagtctggtgggggccgtcatcccacactaggcttagctttgattttacttagggccctgttcatgccagttctaaaagttcgattttctgtaggtcttactgagtaacttctgcattctcagaaagccgtgtatgcgcggactcccggtggatgttaccaatcacattcatagatctcagagctgatggctgcctttccatagccccctaaagaattcggtcgtgcttctgcataagtgttaacgacatgattcccgaatgggttttatttcactaatgatgctggaagcttaaaattgaccattagaaagaaaaacaatctatggtatctattggatagagagaaaaatgagtgttaactgattcccagtttatgtaaacacgtaatcaaagctttttcctttttaatctttaaacttattttctttacttcaaaggtatgtgctatttacatggattcattttaactatggttcttaagccaaaagagctaatggattggcaatgggtaggaactggggagcaactgcttttgattttaaaatcttagttttgagttataccgaccattttggaacaccatttatttattttctaataacattgaacttgccttctggattgtcataggccaccctgagggttttttttttttttttttctttttgagatggagtccactctgtcgcataggctggcgtgcagtggcgcgatctcggctaactgcaacctccacctccctgggttcaaatgactctcctgtctcagcctcctcagtagctgggattacaggcgcgcgccaccaagctggctaatttttgtatttttagtagagacgggcttttcaccatgttggtcaggctggtcttgaactactgacctcgtgatccacccgccttggcctcccaaagtgctgggattacaggcgtgagccaccgcgcccggcctcaccctgaggttttcttaagctgaccaaccttctttaataaaactgtgcattgctaccgttcactggacttggaaatacaatttgagt

SEQ ID NO: 442 - DNA, 91265 bp, Homo sapiens
gtctgtaatcccagctacttgggaggctggggcaggaaaacggcttgaacccaggaggcggaggttgcagtgaactgagaatgcaccactgcactccagcccgggcaacagatagagtgagactccacctcaataaaaaaatttttaaaaaaagcttaattaaaaaatttttttttttttaattagctggtgacggtgtgcatctacagtcccagctactctggagagtgaggagaggatcacctcacagcctaggagttcgaggctgcactaagccatgatcgtgcccactgcactccagcctgggtaacagaatgagactctcttaaaaataaaatacataaaatataaatttcattccccaataatcttaaatataaaaatataactcatttttatacattgacctggtatcctgtgatcttatgaaattctttattttgaagatttcttaagactttttacatacaaaatcctgtcttaagcaaacattgttttgttttttattttatttttttggagacagggtttccctctgtcacccaggctggagttctttgatatcagctcactgcagcctcgacttcccagactcaagggatcctcctgcctcatcctgccaagtagctgggactacaggcacacactaccatgcctggctaatttctgtatttttactacagtcagggtttcagcacattgcccaggctggtctcgaactcctgggctcaagagatccacctacctaagcccccaaagtgctgggattacaggcatgcgccaccacgcaagggggtttatggtttttctcagcattttgaaagatgtttcattgtgttgtttctgttaagaagtcagcagtcatttttatctttgctcctctacaagtaaagtgtctttttttctggcaatttttaagatgttatttattacttgtttctagcaacttgatcatgatgtggcttggtgtggttttgtgtttatcagatttaagattatgagtttttgggatctgtgaattatttttcaccaactttagaaattttgagattatctttttatatttctactgtttctcttctctccctcctcctgtaattccaattacacatacagtagactagttgataatgcctcacagatcactgaagcatttttattctggctttttcccaccctgtctgtttaagcctagataatttctattgccgtatcttgtaattcaatgttcgtttcttgtgaactgtctaatcttcaatgaggcctatccagtaaaatattcattgctaagatggtattttttggtttcacttgttttttttcatagcttaaatttctctcattatgtttatgtttccgaaacttcaagtccctgcacatataattactatttttttatgtttttgagagtgacaggatctcactttgttgcccaggctcagactgatcacaaactcctggcctcaagtggttcctcttggcccagcctataatcacttttttctttttttttttcccgaacattcatatcattatataatcactttttaaagtccttgtttattaatttaaatatctttattattttggggtctgttgcagtgactgacttttctcctggcaatgagccaccattttccttttcctatatctagtacttttttaatcggatgctgaacgttgtagatgtgtctagattttgctctcttcctttgttctagcaggcagttaatcagcttgtaggtcagcttgatcctttcaagacttgtttttaagttttgttagtattggtctagaaaggcctttgagggctgatttagccctagagtgtggcccttctgggttccacactaattatgccagtattcaacttggtcgttccactccaactagtaggagttgaacatctcctacacagaaaaactccagtagttattctttgcatagctcacgaaatttccctaagaagacacagctttacattcagccagtactcaccagaccccatatccctagagctgttccctccattccaacacccttcccagcatattccaactaccgccccaactctgagctctgtcttctcagctcagtaggaccaccactgctgaacttcgttcttcctctgagtcagtcctataagtgattccaggtagacagctggaatcattctagggctcaccttgtttcccatttttaggaattccaatcctatgctacctacctttcatccaatgtttgaacgtttttcatatggattttttcctctttttctagttgttttggcaacagagctaatccagtaccagttattctatcatgaacaaaagtatatgtatttggctgggcacggtggctcatgcctgtaatcccagcactttgggaggccgaggcaggaggatcacctaagctcaggagtttgagaccagcctgagaaacatgctgaaaccccatctctactaaaaatacaaaaattagccggacatggtggtgggagcctgtaatcccagctaccagggaggctgaggcggcagaagcacttgagcccggaaggttgagggtgcagtgagctgagatcgtgcccctgcactccagcctgggtgacaggtgagacactgtctcaaaaaaaaaaaaaaaaaaaaaaaagaagtatgtatatttgactcttttacagcactgtttgcatagcttcatatatatttaaaactttttattttatcttcccagatttatagagaaaagactatatatacaagactgaacatagtggttcacacctgtaatctcagcactttgggaggccaaggcaggcagatcacttgagcccaggagtttgagaccagcctgggcaacatggcagaaccccatctctacaaataatacaaaagttagccaggcttggctgggtgcagtggctcactcttgtaatcccagaactttgggaggccaaggcgggtggattacttgaggtcaggaattcaagatcagcctgaccaacatagcgaaaccccatctctactaaaggcacaaaaattagccgggcattatggcatatacctgtagtcccagctactcgggaggctgaggcaggagaatcgcttgaacccaggaagcagaggttgcagtaagccacgattctgccactgcactcaagcctgggtgccagagcaagactccctctcaaaataaataaataaaataaaataaaataaaataaaataaaataaaataaaataaaataaaaaattagccaggcttggtggtgtatgcctgtagtccctactactcatgaggctagagttgggggaaatcacctgagcctggaaggtagaggctgcagtgagccatgattgtaccactataccccagcctaggcaacagagtgagactccgtttcactaaaaaaaaaaaaaaaaaaaaaaaaaaaaaaaaattaagtttggaagattatatatcaaaatattaatatgggcagtccctgactgaatgtttttcttacatgtattaatttcctggagctgtcataacaaaataccacaaactgacttaaaaaaaaacaaggccgggtatagtggctcacgcctgtaatcccagcattttgggaggctgaggtgggtggatcacctgaggtcaggagttcgagaccagcctgagcaatacggtgaaaccccgtctctactaaaaatacaaaaattagccgggtatggtggcgggtgcctgtagtcccagctaccaggaaggctgaggcaggagaatcgcttgaacccgggaagcagagggtgcagtgaaccgagatcgtgccactgtactctagcctgggcaacagagtgagactctgtctcaaaaacacaaaacaaaacaaaaaacaaattaaaaaaacagaaatgtgttgtctcacaattctaaagtttggaagtccaagatcagggtgtcagcaaggccatattcctttgaaacctataggggagaatccttccttgcctcttcctagcttctggttgtcatcatcaatccctgctgttccttgtctcacagatttatcactccaatatgtatttctgtcatcgccacatggccatcttccctttatgtctttctctcctcataagaacagtcatattgtgctgggtgtggtggctcacggctgtaattccagcactctcggaggctgaggtggacagatcacttgaggtcgggagttagagaccagcctggccaatatagtgaaaccacatctctactaaaaatacaaaaattagctgggcatggtggcacacacctgtaatcccagctgctgaggcaggagaattgcttgaaccaaagaggcggaggttgcaatgagctgagattgcaccactgcactcaagcctgggcgaaagagaaacagtcatattgattaaggccctatctaattatctcatcctgactttattacatctgcaaagacctcatttccaaatagggtcacattcaggtattatagactaggacttctaagtatatttttgacagacacaatttaacccacaatatgggtggtgctttcctgaattctcctagtattctgcatgaatactactagttaatgaagttttaaaaaattataaatgttttactaaaacccatgaaagggtaaatgccaggcctgcaagaaaagggatcagctaggctaggatacctgtaagtatctagcgggtgggtgggggttataggaaaactacataatcagttttctccttctgtaagcccaggggtcttgctaatcaaagcatctttgaccatgtcagctggcttgctattgtaggaaataaaaacaggacaatgaatgttaaaggatttacttctttttattttttttttttaagatagggtctcactctgtcgccaggctggagtgcagtggtacgatgtcggctcactgtgacctccgcgtccctctcgggttcagttcaaccaattctcctgccacagcctcccaagtagctgggactacaggagtgtgccaccacgcccagctaatttttgtatttttagtagagatggggtttcaccatattggccaggatggtctcaatatcttgacctcgtgatctgcccacctcagcctcccaaagtgctgggattataggtgtgagccaccgcaaccagccaggatttacttcttaaacctgtgattactcccataacattcttaggaaatcctgcctttcttcttgggagactgggacccactggaaaagggaaaggactgcattcctcctggctacacctttgtattttctcacttctcttaacattctgtgaagcttaaatgggttttatttaggtagctgggatacaagcaagtatgaggaaagctgaagaatactgattacttaacaaatacaagaaaaaactttttttttttttctgagatggagtctcgctctattgccctggctggagtgcagtgccctgatctcggttcatgcaacctccgccttccgggttcaagcaattctcctgcctcagcctcccgagtagctgggattacaggcatgcgccaccacacccggctaatttttgtatttttagtagagacggggtttcactatgttggccaggctggtctcaaactcctgacctcgtgattcgcccaccttggccccctaaagtgctgggattacaggcgtgagccaccgcgcccagccaagaaaaaacatttttattggccgggtgtggttactcacacctataatcccagcactttgggaggccgaggcaggtagattgtctgagctcagccactgcacccggccaggaaaaaatatttttaaggtggctcagctcttctcttcccaccaaaaatactaaccaattccgttcctttgctataacaaaattcatcaatttcccaataattagccaacaaaaatagaaaaggaaaaaaagtcttcatatttgtatgtctgtatgcttaacatattgagtttttactgttttgagtaatgaaattactacactgtcatattcaactgctaactgatcagttagcccttctcaaagcagagttaattaaaaggataaggcaactgctaactgatcagttagcccttctcaaagcagagttaattaaaaggataacctcagtgttattatttataattacatgtatcggctgaaatgtgtattttcagctaaagagaaacaattcctaaactactctataaaacctaagcaattaggctgggtgcggtggctcctacctgcaatcccaacactttggtaggccaaggtgggaggatagcttgagcccaagagttcaagaccagcctgggcaacaaagtgagactccccatctctacaaaaatttttttttttttttgagacggagtttcattgttgttgcccaggctggagtgcaatggcgcgatctcggctcaccacaacctctgcctcccaggttcaagagattctcctgcctcagcctccccagtagctgggattataggcatgcgccaccacgcccggctaatttcgtatctttagtagagaaggggtttctccatgttggtcaggctggtctcgaactcccaaccacaggtgatctgcccacctcggcctcccaaagtgctggtacaggcctgagccatcgtgcccggccacaaaattttttttagaaattagccaggcaaggctgggcgccgtggctcatgcctgtaatcccagcacttcgggagaccgaggcaggaggatcacctgagttcaggagttcaaaagcagcctggccaacatggcaaaaccccatctctactaaaaatacaaaaaattagctgggcatggtgccaggtgcctgtaatcccagctacttgggaggctgaaacaggagaattgcttgaacccaggaggcggaggttgaagtgagccaagatcatgccattgcactccagcctgggtgacagagcagactctgtctcaaaaaaaaaaaaaaaaacaaaaaagaaagaaattagccaggcatggtattgtgcacctgttgtcccagctactcagaaggatgaggtgggaggaccatttgagcccaggaggtcaaggctgaagtgagctatgatcactgtacgctagcccaggcaataaaaggagacactgtttcgggcaggggaagcattaaagcatcatcactctcatcatttgcttaaaacactgaaagttaaagctatgttctgccaaaactaagtaagtatgcctgtaattccagcattttgggtggccaaggtgggaggactgcttgagcccaggagtttgagaccagcctaggcaacacagcaagaccttgtttctacctaagatttaaaaaaaaaaaaaaaaaaattagccagacgcggtggcatgcctatagttccagctactggaggggatggggagggtcctaaagtaagatgatcagttgaacctaggatgtcaaggctactgctctccagatcctgtcttaaaaaataaaaaagaaagcataaaccaaaaataaaattctaagcccccccaaccaactgaatgaaggtgaatccttctccattcagtcaagtgcattctaaagtaaacctgaaacactagttcaggccatgctgggaatgggtggtcagacacgcctcattatactctcttcccttcagaattctggcacagctaaccagcattaacattaaaacagagaccttaggactgacaaaacagattactagtagcaataagatacaaatatgacagacagcaaaccctgaaagaagtatttcaggtgttctttaatccccctccttttttttttttttttggtagagacagagtctctctgctatgttgcccaagctggtctcaaactcctgggtccaaacaatcctcctccctcagcctccaacagtgctgtgatgacaggcatgaaccaccacatctggcccaaaatatatagctttgacaaattttgaaatggccctgcaaagttgtctctttaagtcttataagaaacatttaacatttacagtgctcggcttcaggcacatgttgggggtgttgaggtctagtgggcagagtagactcttggccagacagatggtttctcagtggcaggatgcgagggcctccatgcaccggagatctctccagcaccaggagcagccgctggacagcaaggagcggcagcctatggttagccattgggagatctccgccagggccctgggttctctgtgcagacagttccaaagaaggctgcccctaagagccgtcaacctcaacctccggacaggtacctcctagaaacccctagaaaccagggtcagggcagtaagagactccaggctgcagctcgctcagctaagagcaccctgggtgccatgtcacagagaatccaggagtcctgccaaagtagcaccaagtgtctggtggagacccaggtgaaggccaggaggaggaagaaaggggtacaaaagggagagcagtgtctccccaactcacagcctgagccagaagaggattcagctgtatggagctgcccctgaccactcagctacagacccctgtgcatcaccacctctctacctggacaggctcacgtgcctaccctctacggcagtggaggcgggagactgccttccagagcccctactccttgacagagctcctctgctctcccagcgcatctgatagtgacctagcacctatggggagcaggaattcggcatctccagaagctgtcccaagagctggatgaagccattatggcggaagagagtggtgaaatgacactctcattcatgactgaggaagtgccctgcaggaaacaagccctgtctgaccaccaaggcttcgtaccccagaatgtctgtgcttccccatgagcttcctggcggaagctcccaggagtcatcagtacccctgggccactgctaacaaagacctgactagcaaggagcccagagcccccctgctccagccacatctggacccatcagtgactgcctgccacagcctgagagtgtcttggggagatcttgcagaggtggggagaattgttccttctactccccaaggggactcttgggtttagtaatgcatcgtatacttgaccttgagcctggtatttgcttcatctacaatgtgaagagctggcatcagatgtttgagagctctgaactcaaaccaggtgcttggtttttggggagtcatccacagagtcactcgcccactgtgtttccagtgccaaggcccttgggggcaccactctcatccctgctttccctaccagggacctggaggaaggcataggagatagttccaggcttaaaccctgggctcacaggtacctatttatatgttcaaggcagagcactgtgggtgtgccaggaggggtagccctgttcaagagcaatttctgccctttgtaaattatttaagaaaactgcttttattttattagaaagaaaccagatagcattgctttcttataataaagactagataacactgctttctcataataaagactgttttgtggctgggcgcagcggctcacacctgtaatcccaggactttgggaggccgacgcgggtggatcacctgaggtcaggagttcgagaccagcctggctaacatggtgaaaccccgtctctactaaaaatacaaaaattagccaggcgcagtggcaggtgcctgtaatcccggctactcgagaggctgaggcaggagaactgcttgaacccagggggcagaggttgcagtgagttgagatcgcgccgctgcagtccagcctgggtgacagagcaagactccatctccgtctaggggcgggggtgaggagactgcatttgggggaaaaaaaaaaatcatttacaggctaggcttataatcccagcactttgggaggctgaggtaggtggatcacttgagcctaggagttctagaccagcctggacaacaaagcaagatcctatctctttaaaaaataataaaaattttaaaaaaagaaacatttgcaatctgttctctctgaaacctgttacctggaggcttcatttgcataatatgaaccttggtctccacacccctatctttttttttttttttttttgagacagagtctcgctctgtcacccacgctggagtgcagtggtgcgatctcagctcactgcaagttccacctcccgggttcacgccattctcctgcctcagccacctgagtagctgggactacaggtgcccgccaccatgcccagctaatttttcatatttttagtaaagacagggtttcaccatgttagccagaatgatgtcgatctcctgagcttgtgatccacccgcctcagcctcccaaagtgctgggattacaggcgcgtgccactgtgcccagcctccacacccctatcttaacctagacactccattctactgattccagggatttaaatgaactctcacccaattgccagtcagcaaatctttgaatccacctgtgacttggaagaccgcccccctcacccttcgagttgtcccagctttccagaccaaatcaatgtacatcttacatgtactgagtgatggcttaggtctccctaaaatgtataaaaccaagctgtagcccgaccaccttgggcacattttctcaggatctcctggggctgtgtcatgagccatggtcactcacatttagctcagaataaatctcttagaatattttagagtttgacacttttcattgacaaaagtatcacaatttgggagtaccttaatctgttaatacagtcaataaacatttactgcctactgcatatcagacactgtattggacactacagctacacaatccccttctctggacatactctcaatcaactactgagaatcagttagttgaaacaaagattaagaggaagaggaaagggtaaagtcagaaaagtcttcctggggaagaccatttcaaaagcagtcttccagaacaaacaagttaactgagcagggcatagaagagagatgtagccttctaaggaaaggaaatgcaaagtcaatgaggcaagtaacagcaaggaatggcccagacaataacaacagacattaacaacgggaggtgactccagtcaacaatagtagagggtaacaacctgtggtcattgcaggcagtttagtgttgctgaaatagcaagccctgagcagaaagtaaacaaccagtctggggcagggtttctttcttaattttgcaccactgccatttacgacggataactgttgtaaggggttgtcccatacataacagaatgcttagcagcgtccctggccttgatgcactagatgctagtagcacccccataatgaatagttgtgataaccataaaggtctccagatttgtccctgggagcaaaattggccccactccccagaacaattgggcttgagatacatcaaaaaaaatacttcagggcagggcgctgtggctcatgcctgtaatcccagcactttaggaggccaaggcgggtggatcacctgagatcaggggtttgagaccagcctgacccacacagtgaaaccctgtctctactaaaaatacaaaatattagccaggcatggtggcgcacgcctgtaatcccagttactcgggaggttgagacagaagaatcgcttgaactcgagaggcggaggttgcagtgagctgagagggtgggccattgcactccagtctggacgacagagcgtgcctccgtctcaaaaaaaaaaaaaaaaaaaaaaaaaaatttaggccggacacggtggctcactcctacaatccctgcactttgggaggccaaggcgggatgatcacttgagcccaggggttccagaccagtcggggcaacaaagggggaccttacaactacaaaaaaaaaattttttttttaattagccacacctgggacccaagtacctgggaccacactcacctgtcccgtggctcacgcctgtaatcccagcactttgggaggctgaggcgggtggatcacgaggtcaagagatcgagaccatcctggccaacatggtgaaaccccgtctctactaaaaatacaaaaagtagctaggcatggtggcgctcgcctgtaatcccagctactgagagggtgaggcaggagaatcgcctgaacccgggaggcggagggtgcagtaagccgagatcgcgccactgcactccagcctggcgacacagcgagactccgtctcaaaaaaaaaaaaaaagtgtcttcaactcagatagaaggagtcaatgagaaggttcttaaaagcccgaagacctatttcccagaaaactctaattaaccttataatttgtatagttagttacagtgagtatgagctgtcttgctctgtacttcagctgttgtaagtgtttacgaactgtctccaaaaacagatgcaaatttccctcatggcagagatcgtaacgaatttatctatccactttctcacagcgccacaccgttccttacgcacagcaggaatgcaatcagtatttgtcgatggttccccaaactaacaggagtggctgcactacgcacacttaggtgatacgtacacttgtcaaaacggcagaaacgcaacctcaatttcagaaaaacaaaccacattcctttgggaaggccacctctgccacaagcagccaaagcgcttgcataggggtgagaggcgatgggaagggtactggaaggctcccccagataaaaacaaaagactccttccaatcgcctcaaacacgctcggaaacctccacgacctgcgccagcccacaggagggggccagcttgacctgaggctgcaccactccccacttaaagcggcgagtatcggcgggggagcgcaggaagcttactagtggggcgacccagtcgttccggcgctttccctctcccttcacgtcttacctgcttggccaagaacctgcccaactcactgcggctcttctcgttcttggctgcgattaaccgcagcggcgcggctgccacctccagcaagaagtgctccatgacccagggccctcaccccgagcggccacctgcgctccctacttcgcggccagcgtccccaagccgccgaggtcccagtgcccgagcagccagcaactacgcccgcaggaaaggcgtcctcagctccagcgcctacaccgggagaggggcaccacacgtgggtgagcacacggcgtttgacgtcatcagctcgggacggctacgctgcgccctcccggcctcagcccctcagcggcggaaacgccagtcttcgctgtcccgccttttccgggagggaaatggaaacaaaaatctagtcggtttggatgcaggagtgatggggactcgcgaacacagcacgtggtgggacagaaagaagagtgcgttaggccggggaggaaagagggggcgtgtgagtctcagcccaccgtgccttgcttctgccttaacacacggaaagatcagatgtgagagaaaagctgattctcggccgggcgcggtggcgcatgtctttatcccagcattttgggaggccgaggagggcagatcacttgaggttagcagttcgagaccagcctgggcaacatggtgaaacccccttctctactaaaaatacaaaaattagccgggcgtggtggcgcgcgcctgtagtcccagctactcgggaggctgaggcaggagaatcgcttgaacccgggagacggaggttacagtaagccgagatcgtgcagctgcactccagccgcgcgacacagcagacttttactgtctcaaaaaaagaaagaaaagctgattctccccttcttgttagcggtggcagttaccccctgtataggtaggggtcagcagtaaccttagttcttgcctcctcagaagaaataattccacgaagggcataaggcaggatagacctagacaagtttcagaatagaagtaaaagtttatcaaaaagctttagaacgggacggaaagaaaaggaggaaagtacaacttggaagactgccaagcaggcgacttgagaaaccaagtgcgcagcttgacctgttgacttgaagttttatatgttggcatactttggggaacttgcattgcttctccccactcctgagatcttactgggaagctactgatcagtttcaggtgttttctattaggagactgcctttcgctggccccggtgaacgttagagaaacagttaagaaccgcctgaccatcgtttgattgtcacccaatagtcctggtatgtgtggggtggggagcgctctcctgttctgctcatacctaactagttaacattctgccccagcaattccccttgtaggactctagcctgcggaaatcctcactaagtgtgacaaagacaccccttgcagttttcttaatacagatattggaagaaaatgttcaattgggaatattaaactatggggtgtaagttatagcatattctggaagtcataaaaaatagtagagtccataacattaaaagtgcacttgtgggctgggcgcagtggctcaaggcaaggcaggcagatcacgagataaggagttggagaccagtctggccaacatggtgaaaccctgtctctactaaaaatacaaaaattagggctgggtgccttggctcacgcctgtaatcccagcactttgggaggccgaggcgggcagatcacctgaggtcagcagtttgagaccagcctgaccaacatggtaaaaccctgtctctactaaaaatacaaaaattagccaggtgtggtggtgcatgcctgtaatcccagctactcaggaggctgaagcaggagaatcgcttgaactcaggagacggaggttgtggtgagccgagatcgtgggattgcactccagcctaggcaacaagagcgaaactccgtcttttttttttttttttaagtggggccaggcgtggtggctcacgcctgtaatcccagcactttgggaggccaaggcgggcagatcacccgaggtcgggagtttgagaccagtctggccaacatggtgaaaccttgtctctactaaaaatacaaaaagctgggcatagtggtgggcgcctgtaatcccacctactcaggaggctgaggcaggagaatagctcgagcccgggaggcggaggttgcagtgagcggacatcgtgccagtgcactccagcctgggcgacaagagcgaaactctgtctcaaaaaaaagaaaaagacaaaaaaaaaaatgtagttatgtagtgataatgcaccctggcaactattctcaggaatctgttgaaagagatgcgccctgaaaaaggaggataaaaccaagaaagaagacgacacgggatccaggaaataagagatttagcacagaaagaaaaagtaaaataaccctgtcgatcgtaatcctaatccacgggattattttacttttaagtgtttaaagttaagggaaatcccggaactttcatctgggcagcagcaggaagatgaacagctctagggtgattaaattaatagaacaggttagtggttgcctgagtttgggattagaagagaagacaatgtaaacagccaggaggcaaaatttgggggtaataaaaatctaagactgggcagggcacagtggctcaagcctgtaatctcagcactttgggaggctgagtcgggtggatcacaaggtcaggagttcaagaccagcctggccaagatggtgaaaccccatctctactaaaaatacaaaaattggccgggcacggtggctcacacctgtaatcccagcactttggcaggccaaggcgggcagatcacctgaggtcaggagttcgagaccagcctggccaacatggtgaaaccccatctctactaaaaatacaaaaattagccgggcgtggtggcacgtgcctgtagtcccagctatttgggaggctgaggcaggagaatcacttgaacccaggaggcagaggttgcggtgagccaagatcgtgccactgcactcccacctgggcaacagagtgagactccgtctcaaaaacaacaacaacaacaaaaatatatatatatatataaattagccaggtgcagtggcaagcgcctgtaatcctagctactcgggaggctgaggcagaagaatcgcctgaacctgggaggtggaggttgcagtgagtcgagatcccaccatcgcactccagcctgggtgacagaacgagattctgtctcaaaataataattaaaaaaaatgatgataaggaaggaatagagcatatatagtatagatgaaataaggttgacagtgtattagtaattattgaaaccagatattgggtaataggagtttattgtattcttcttttctcttctttcttttttttttgggacggagtctcgctttgtcacccagactagagtgcagtgacacaatctcagctcactgcaacctccacctcctgggttcaagcgattctcctgcctcaacctcccgagtagctgggagtacaggcacgctccaccacacacccggctaattttttcttttgtattttaagtagagacagggtttcaccacgttggccaggcttgtctcgaactcctgacctcaggtaatccacccgcctcgacctcccaaagtgctgggattacagaggtaagccaccgcgcctagcctattgtactcttcttttacttttgtgtatgtttgaaattttgcactaaaaaaatagtatctttgatccttttatagttcataagcatgatgattgggtttttgcacacgtgtaatatgtgcctccctcaaaccatgttatgacctcagcatattacctgtctgatataaaaatatgtatatattttagaaacagggtcttattctctcacccaggctagagtgcactggtgcaatcatagctcaatgtaaccttgaacccctgggcccaagcaatcttcctgagcagctaggactacaggaacctgctaccacacccaaatttttttttttttttttttttttttttgagttagagtctcactctgtcacccaggctggagtgaagtggtatgatcttggcttactgcaacctctccctcctggattcaagcaattctcctgcctcatcctctgtagtctctggagtagctgggattacaggcgtgcaccaccacacctggctaattttttgtattttttagtagagacagggtttcaccatgttggccaggctggtctcaaactcctgacttcaagtaatcctcccacctcggactcccaaagtgcacggattacaggcatgcaccaccacacccagctcttcttctttttttttttttttagtagacaaggtctcagtatgttgcccaggctggtctcccgctcctgggctcaaacaatcctccagccttggcctcccaaagtgctgggattataggcatgagccactatgcctggtcttaaatgtgttaagttgtcttaagtcttacgctactttctctgctggtggtgcccacccaacggccattggtgacctctgaaaattaatatttttgaaaaaaattatgagtgtcatgtaaagagaacttgggtatcaacttgtagatgctaccattgaccaaagatgatacaatctgagctttaataaagatagcagttataatgaatcaaaacctattagtttaacccattaatataatactaataattttaaaaatttgttgcctttggagagtaagaagtcaatcttgaaagctgataaagggagaaatataaaaatgtatcctgcctctcatatgtgaattgtaccactgggtaactaaatagaagatgatgacaagtgtctcttcctgagaatagtccacctaatttgaaaaagaattgccagtgtggtggctcacgcctgtaatcccagcactttgggaggccgaggagggcagatcacgaggtcaggagatctagaccatcctggctaacacagtgaaaccccgtctctactaaaaatacaaaaaattagccgggcgtggtggtgggcgcctgtagtccctgctacttgggaggctgaggcaggagaatagcatgaatctgggaggcggagcttgcactgagcagagatcgtgccactgcactccagcctggggaacaaagcgagactgtctcaaaaaaaaaaaaaaaaaaaaaagaattgacaaaattagaataccactattttgcaactcccagttaatccattaatcttggcattaagtatcaatggctgctaacatagcaaaaggggcaaaaaaaaccagactttagatagctcttgctgaaagaacataatgctacctatagtcttaccaaaaggatcaaacctctgatccagctgtcaatttttttttttggggggggtgatggagccttgctctgtcacctagcctggaagtacagtggcgcaatctcagctcactgtgacctccaactcctgggttcaagcgattctcctgcttcggcctcccaagtagctgggattacaggcttctaccaccacacctggctaatttttgtatttttagtagagacagggttccaccatgttggaccaggctggtctcaaactccttgcctcaagtgatccgccagcctcagcctcccaaagtgctgggattacaggtgtgagccactgtgcctggccccagctgtcgattttttaaaatgaagatgatagaatatgttaagctgcaccatgaatttataatcagaaaaactcagactgtgaaagattctacagatcaaaaactcaggtttttcaagacataaatttaagaaaaaagtatgggaggggaaactgtgaattataagaaatggcaaaatgatttaaatgtttgtgaacctccaaaattcgtatgttgaagtcttaataccccagtgtgatggtatttggaagtgagaccttttggaggtaattagatttagatgaggttttgaggatagagtcctcataataggattattgcccttataatgggagggaaagactagagtcccttctctctctgccaagggaggatacactaagaaggtggccatctacaagccaggaagggagccctcaccagacaataaatctgctggctccttgatcttggatctcccagcctctagaactgtaagaaatttttgcttgttgattaagttaaagaggttcagaacgtgcaaccccgaaacagaccattttgacatactgattattttgaagtaaagaaaaatcagaaccagccaactcagtgaaacgtctttacctccccaattgcctaaaataaagtataaacttacccttttgcaaaggaaatttatactcacaaaggaaatttctgttagtaaagctatctgtaccaggaagagagctactccaagacaacttttttcacttaacagactgttatctgtgtcaataaatccactgagaaagtttatgttttaagcctcagcctcccgagtacctgggattacaggcatgcgtcaccacacccggcaaattttgtatttttagtagagacagagtttcaccatgttgtattttagtctccactaaaaatacaaaaattagctgggcatagtggtgcacgcctgtaatcctagctactgaagaggctgaggcataagaattgcttgaacctgggaggcagacattgcagtgagctgagatcatgcactccagcctggggacagagccagactccagctcaaaaaaaatgttagttttattcagtctatagtcgtaccgaggactatagactgaggtctacagcccaggagctgtccttcagagttctgtcagactgctgcagcacagtatttcagcccactgtttatatacctgtggtggaggttcagtatgtgcaaaatcacattaaagttttggtgcaggagtacatctagttatagatttcagaggcataatcactaaccctatcagacgttatctcatgtgtaggaaaaggcactatattcctcctttcctttctttttttttttttttttgagacggagtctcgatttgttccccaggctggagtgcagtggtgcgatctcggctcactgcaagctccccttcccgggttcacgccattctcctgcctcagcctccctagtagctgggactacaggcacccgccaccatgcccagctaattttttgtattttttagtagagacggggtttcaccgtgttagccaggatggtctcgatctcctgacctcgtgatccgccctcctcggcctcccaaagtgctgggattacaggcgtgagccactgcgcacgtccatattcctcctttaagcaatatagtgactcaggcaagagatgttgggggctgtgtgcactatcctggtttgccttcaaagcatcttttcagagagctgcacttcctcacagagtgaggggctttgtgaaattagatggcaagcagaaatgagcaaaatggcttcttaccctttttactttgtctcacaataattagagcactatgtttaaatgtcacttcaaggaattattttctctatggttacatttctctctttttacagtttaactttttcaaataattttccattttaggatttttttctttctgatttaactcagtctttgaatatgtgaaacagttacatggttcaaaagtgaaaggttataaaaatacaaactcaaaaagtaattaattaatttagtttttatttttctcaccctgtcttatggtgctgaaaactcaacagtttaattggggccaggcacagtggctcacatctgtaattccagtaccttgggaggcccaggcatgaggatttcttgagcccaggggttcaaggttacagtgaactacgattgtgctactgcactccagcctgggtgacagaggcagactgtgtatctaacaccctcccacacccaacttatttgggtgaattatatagtatgtaaattatatcccagtaaagctcttattaaaaaaattaaagccggccagacacagtggctcacgcctgtaatcccagcactttgggaggccgaggcgggcggaatacctgaggtcaggagtttgagaccagcctggccaacacggtgaaaccccatctctactaaaaatacaaaaaacatagccaggcctggtggcaggtgcctgtaatcccagctacttgggaggctgaggcaggagaatcacttgaacctgggaggtggaggttgcagtgagccgagaccgccccattgcactccagcctgggcaacaagaacaaaactccaactcaaaaaaaaaaaaaagttaattaattaattaattaaaaaaaagccatgcatatgtgcaaataaaaatacataacttaggtggagtggctcatacctgtaataccagcactttggaaggcagaggtcggaggattgcttgaggtcaagagttggagacgagcctgggcaacaacatggcgagaccctgtctatattaaaaaaaaaaaaaaaaaatgaaagaaagaaaggcgagtgtggtgttgtgtgcctgtggtcccagctacctgggaggctgaggtaggagcattgcttgagcctaggagtttgaggatgcagtaagctatgatcacaccattgcactccagctaggacaacagactgagaccttgtctctaaaaaaataataaaaataaagccaggcgcggtggctcacgcctgtaatcccagcactttggaaagccgaggcgggcagatcacctgaggtcaggagtttgagaccagcctgcccgacatggcgaaaccccatctctactaaaaatgcaaaaaactagccaggcaggcccctgtaatcccagctatttgggaggctgaggcaggaaaatcgcatgaaccccggaggcggaggttgcagtgagctgagatcacaccactgcactccagcctgggtgacaagagtgaaactccgtctcaaaaaaaaaaaaaaaagaataaaaataaaaataaattggttgatatggcagttaagactaaatggggtcaggtgcagtgactcacacctgtaatcccagcactttgggagactgaggtgggaggattgtttgagcccagaagttcgtgaccagcctgggcaacatagcaagaccccatctctacaaaaattttaaaaaattagccaggggtggccgggcgtgggtggctcacgcctttaatcccagcactttgggaggccaagctgggcagatcacctgaggacaggagttcaagaccagcctggtcaacatggcgaaaccctgtctctactaaaaatacaaaaattaggttggcgtggtaacacatgcctgcaatcccagctactcgggagactgaggcaggagaatcacttgaaccccggaggcggaggttgtagtgggtcgagatcgcgccattgcactccagcctgggcaacaagagtgaaactccatctcagaaacaaaacgaaacaaaacagccaggggtggtggtcgctcgcgtctatggtcccagctactctggaggcagaggtgggaggatctctcgagccttggaggtggaggttgcagggagccgaaatcgctccactgcgctccagcctgagcgacaaagcgataccctgtctgaaagcaaaaagaaaaaaaaaagctaagtggacaaacgaggaaatgggtagggatgaatataggcagactataagtagccgaggaaggtggccttattttcgcacctatcaatgctcaggctgagctcctgaggctagacctaccggcaccccccattcctacaggttctataaggcaagtcaggtattccaccctgtaaaaagctcttctctctcctgccccgctagactagtatcccctccttaaggctcccaacatccgaagctaagttgtttgtctgcctatcatccaggaacgcgtctgagggcagggaacaaatttattcatcgtaatcgagcccagcactttgtctcgcacgcagctgacagcagaattttaagataaagtattaaataaatgacagacctctcaaggcttcctgtctttcactaaaaagcttctctcaggccacgcccctacctccactcaggtcagccccttcctattgaagccccgccccatcgccttccccgccaccttacaccccgcccctctctcttaaagccctaggaagattactggagtttggcgccaaccgtgtttttttttttcccttccaaaggcgggaactagttgtgggcgctgcgacgtgctttgcgtctgatatgattggccgtaggcactcagtcccgcctccataccctgatagcgctctggtattggtggagatgccagggagacctcggtgggcagaaaggaaccgggttgtcttgggccgggcagggcgggtaagttgtcgtaggggcccggtccgtgagggactgctaaggaagaggctgcatggcgcggtagtcccccgagtggaggtcggctgcccctgggaaaccagagagtcggagggagtccatctggagcggccaagtaggtcggggaagggccgcgcctgacgtctggccgcaggtagccacgttccctccgcccccggtgcagcttcagggcttgcaccctgcgtccctctgtggtccttcgagagggtctgggcggggactatgggtgggcgcgcccaggaattgtcccttcggcctctcgtcctgcccctcccccccaccatccagtctctccttggaatatactcttaaaatctttcggatggagttctttggagaaatgggtttcctggagtgtcaggtgatcattgatgttgattgtttctgaaatgtttatttaggcatcaaaccaacatgcctaaataagtttttcatttctacagcgcctagattcattcctagcacatagtaggccctaactcagatgtgaatgtaggattcgtaggagctgagcatttgtgcttcaggcatcaagttgtctttgactcttcgactcttccttggtctttttccattctccacacctccagcagcaaacctttcgcctctcctcaaggcctttcccccccatctccctcagcgcctctttgactggagggggacagaggctttcatggcagggattctcccatctcccttcctatccccgctatgccctccaattatcttttcctggcgttccgttttacaagagatggccttctttccaaaaacatttatattgtattgaatattcttgattttggccatcttgctttacagacagacctggggtctaatttcagctctgccacttaccaggtggttgccttgtgcaaatttcttgatcgtctgtgttttcctcatctgtaaaatggggaaaagaataatatggacctcatagaactctggggaggatttaaactaagtgaataatgtatttagatcatttaggttagtgcctggaacatagtaaatgtgccgtatatgatagcttttgttagtatttgccccttacctcttcttctggggtcttgctgtattagcctttcccatgagtgtaaaaatacactgtcttctctggctttttcctgtttttctctacaaatgcttgtgtttttctctaaattttattttttgtcttttagcgtctacattaaggacacattctcagtttcgtaatgatttttctttttcttttttcctttttttttgagactatagcccaggctggagtgcaatggcaagatctcggcttactacaggtttgacctcctgtgctcaagcaatcctcccacctcagccttccaagtagctggaactacaggtgtgcaccagcatgcctggctaatttttgtattttgtagagactgggttttgccatgtttcccaggctggtctcgaactcctaggctcaagtgatcagactgccctcagcctcccaaagtactgggattacaagtgtgagccaccccgcccagccacattctctcaattttaaaaagaaaacttccttcagactgcctataacgaaaggctatgtgatccttctcctgtctactttgctttcacatctgaatccattggaattgtcccagaaaagattatgcatgagtaaatctgcttacaaactttttttttttttttttgagacggagtctcgctctgtcacccaggctggagtgcagtggcacgatctcggctcactgcaagctccgcctcccgggttcatgtcatcctcttgccacagcctcccgagtagctgggactacaggcgcctgccaccacgcctggctaattttttgtatttttagtagagacgggtttcaccctgttagctaggatggtctagatctcctgaccttgtgatccgcccgcctcagcctcccagagtactgagattacaggcttgagccaccacgcccggccaaacattttttttttagacagagtcttactctgtcacccaggctggagttgcagtggcacgatctcagatcactgcagcctccacctcccaggttcaagcgattctcctgcctcggcctccccagtagctgggattacaagtgtgtgccaccatgtcaggctaatttttgtatttttagtatagatgaggtttcaccatgttggccaggctggttttgaactcctgacttcaggtgatccgcctgcctcggcctcccaatacaaactctttttcagcatgatagttctcaacttggaaaattttgcctctacactttcacaggtgcatcacttctgtcggtagcaactctcatatatcgagatcctcaaatgggagaaggtgaggaaaagtgaaaaagacccattttccaagagattctgatacatttttcttcctcctctccttcctctccttccaggagaatcactggcctatatgatttcaagagtgtaatctcacgtatcactaaggtgctgatgagtcccaaatcataatacctaccatgccttttctgtatgacatttccagctgttggacatctttttgttttttgtttttttctcccctagacggagtcttgctctgtttcccaggctggaatgcagtggcacgatctcagctcactgcaacctctgcctcccaggttcaagcgattcttctggtctcagcctccggagtagctgggattataggcacatgccaccacgcccagccaatttttgtatttttagtagagatggggtttcaccatgttggccaggcttgtctcaaactcctgaactcaggtgatccaccagcctcggcctcccaaagtgctgggattacaggcatgagccaccacgcccggccttttttttttttcttttctttttgagatggagtcttgccctgtcgcccaggctggagtgcaatggcgcgatctcggctcgctgcaacctccgcttcccaggttcaagcgattctcctgcctcagcctcccgagtgtgggattacaggtgcgcaccaccacgcccagctaatttttttgtatttttagtagagacggggtttcaccatgttggtcaggctggtcttgaactcctgacctcgtgatccacctgctttggcctcccaaagtgctgggattacagacatgagccaccacccccagctgctgttagacatctttatctggatgtcctacagataactcaacatgacttcactggttgtccattgcagttaaagcatgactgtcctccaaagctagaaacatgagaatcatctttaacaaattgggtatttctttaattcaacagatattcttttattacttgccattctgctaggcctgctgagagctggggatacagtgagagctggggaacagaacagggatggtcctaatctttatggagaaccattgggtggtccattgggtgagatggacatttctccaggaatcccacaaaaatggaatcatgaacttcaagaagaggtcatgtagggaaaggacacaatggggtaagagtatataacagagggcctgacttagtgggaagagagggtggacaggggagactcaaaatggcttaagcaaaatatcaaagaagagctaagtgaaagtagaatattgaggaaagaatattccctgcagaagccctgtgttgtttttttttttttcgatttataaatagtttatcctgttcacattatgcagaatttcagtgtcgttaatccacaatgttagtacggtaacagaaacataaaggagaaaaaaggcaggtggggggaggttcatagtgtggcctgacatagtctaagggttctctcctgtagtatgcatctcctgcaggcaagtattaatatcacttcattgtttgaaggacagtacactatccaggattcatttattgttcaggtgtcttttctaaagtatgagaaaacaggaataaattcaataatgaatatctgcaattcaaaccaatttaactacaggtcagtggtgtctttcttatctattatcacaaacatcccagttgcctccatctaaaaatttctttcaaaagttaagacacaattaattatatcttattaattccctcaaaagcaaaaaaaaaaaaaaagtaccattcagcatacaaaagttacacattaaaagtgtatatatagggctgggtgcggtagtgcacgcctgtgatcccagcactttgggaggccgaggcgggtggatcataaggtcaggagttcaagaccagcctggccaagatggtgaaaccctgtctctactaaaaatacaaaaaattagctgggcgcggcagcaggcccctgtaatcccagctactgaggaggctgaggcaggagaatcgcttgaactcggagggcagaggttgcagtgagcagagattgtgccgctgccctccagcctgggtgacagagtgagactctgtctcaaaaaaaaaagtgcatatttccttttttttttgagatggagtctctctttgttgcccaggctggagttcagtggcatgatctcggctcactgcaacctcctcctttcaggttcaagtgattctcctgcctcaccctcccaagtagctgggattacaggtgtgtgccaccatgtctggccaatttttgtatttttagtagagatggcgtttcaccgtgttggccaggctggtctcgaactcctgaacaaagttgatctgcccacctcggctttccaaagtgctgggattacaggcgtgagccactgcgcctggcctcaaaatttgttttttatcctgaaatcagcaggaagcactgaagggctttttggtggggttttttttgttttttgttttttttcttttgagacgaagtctcctgtcccccagactggagtgcagtggcgtgatctcggctaactgcagcctccgcctcccagcttccagaaattctcctgcctcagccttccaggtagctggaattataggcatgcgccaccacggctggctaattttcgtatttttagtagagatgacgtaggctggtctcgaactcctgacctcaggtgatctcctgacctcagatgatcacccacctcaggtgatcgcctgcctcagcctcccaaagtgctaggattacaggcgtgagccaccacatccagcctaagcactgaagtgtttaagcagagttgggaacacgatcatgtttgcatttttaaaagacaactcatgctgaggtttgaagaacaatttgaaatgggggaagactgtccatttgaatacactttccattaaatcttgttgactacctctcagatctgtttttagtgttttgtgggttttttggtttggttttgagacagtctcgctctttgacccaggctggagtgcagcagtgcaatcacagctcactgcagcctccggaagcatgtgccaccacacccagctaacttttcttttttttgtagatatggagtctcactgtgttgcccaggctggtcttgaactcctgggcataagaagtcctcctgcctcagcctcccagaatgttgggattacaggcatgaaccaccgtgcccagccaagatctgtttcttatttttatttccactactaagaacttacagtgacacctcgttgtcttctgctttgttttggtagccttttctatctcccttcccactcatattttccagactcttgccagagttaaacatctaagatgcagatttgatcattatattgccctactttaaaaaccttcactggttcccccattcccttctggatggaatccaagtatcttaatcacataatacatcccctgacctttatttttttttttttgagagagtctcactgtcacctaggctggagtgcagtggcacgatcttggctcactgcagcctcggggcctgtgacttcctaaactttattctcacattctgatcttgccttcccatgttctattctgtaggtgttcacacccatacttgattgtgaacttatagacagatgtggtggggaacagatgtggggagatcgtgtcaagaagtgttcgccaatgtgagcctaatttaattgaaccttgggattttggaaaccttgagatagtgaataatggagctagaatggtaggtgtcagtctatgtcaggataaggaagtttttttttttttttaatggagtctagctgtgtggcacaacctcggctcactgcaacctccccttcctgggttcaagcaattctcctgcctcagcctccagcagttgggactacagacatgcaccaccatgcccagctaatttttttgtatttttaatagaggtagggtttcaccatgttggccacgatggtctcgatctcttgacctcgtaatccacctgccttggcctcccaaagtgctgggattataggcatgagccactgcacccagtcaggataaggaatttgtactttatagaaattgggaagtaacggaaagtttttgagcaggattgcggtagaactaacccagtagttgtgcgtagcatgtatttggagtggggaaataattaggtagctatagtggggtcctgaaacaaatcgaaatggcaagaatgggaataaatgggagaaatatttcagaggtagcatcagtaaatcagtagtctgttagggaatgttagtgctactccaagaaattagagaaatgaggaggtgagcagatatggatggaaagatgatctcttgttttggacttggtgagtttgtacctacaggaatgtgtttattaatgttagcatttgtttgtttgtctgttttgagacaaggtctcattctgtcactcaggctggagtgcagtgacttgatctttgctcacagcaatctctgcttcctggttgtgcttaagcaatcctcccacctcagcctcctaagtatggttgggactataggagtgtgtcaccacgcctggctaatttttgtattttttgtagagatgggatttcgccatgttgcctgggctggtctcgaactcctggcctgaagtgatccacccacctcggcctccccacaaagtgctgggcccacaaagtgctgggattacaggtgtgaaccactgagccctggcacccagccactaatttttttttttttgagacagtcttgctctgttgcccaggctggagtgcagtgtgacaatctcggctcacttcaacctccgccttccccacgctcaagcaattcttgtgcctgagcctcctaagtagctgagattactggtgtgcgtcagcatacctggctaattttttttatttttagtagagacagggttttaccgtgttagccagactggtcttgaactcctgacttcaaatctgcccgcctgcctaggcttcccaaagtgctgggatttaggcatgagctaccatacttggccactaattgtttttttgtttgtttgtttttgtttgtttgagacagagtctggctctgtcgcccaggctggagtgcagtggcacaatctcagctcactgcaacctccgcctcccaggttcatgccattctcccgcctcagcctcccaagtagcgggaactacaggcgcccaccaccacacccggctaattttgtttttgtatttttagtagagatggggtttcaccgtgttagccaggatggatggtctcgatctcctgacctcgtgatccgcctgcctcagcctcccaaagtgctgggattacaggcgtaagccaccgtgcccagcccactaattggttttttaatgttagacatcctcacatttttgggataaatctcacttgtctgtagtgctttttcgtttaatatcttgctggattcagttggttgatttttttttctttgtgacggagtctcgctctgttgcccaggctggagagtggtgcaatcttggctcgctgcaacctccatctcccaggttcaagctactctcccgcctcagcctcctgagtagctgggataacaggtgcgtgctaccatggccacctaatttttgtgtttttaatagagacggggtttcaccatgttaaccaggctggtctcgaattcctgacgtcaagcaatctacccaccttggcctcccaaagtgctgggatgacaggccgatttttttttttaaggctatttctgtttatgttcataagaaagattggcttgtagttgtctggtcttgtagtttttttgttttgccctattcttgaccagtttttttgtttgtttgttttttgttgttttttgagacggagtctcactgtgtcgcccaggctggagtgccgtggcgcgatctcgactcactgcaacctcggcctcccaggttcatgccattctcctgcctcagcctcccgagtagctgggactacaggtgcctgccaccacacccggctaatttttttgtatttttaatagagaaggggtttcaccgtgttagccaggatggcctcgatctcctgacatcatgatccacccacctcggcctcccaaagtgctgggattacaggcatgagccactgcgcccggcccaaccagttttgaaattgaggttgtattcgcctcaaaaaattatttgcttattcacaaatagtttttttctgttgtctggaacagattaacttttcattattattattattatttttagagacagagtctcattatgttgcccaggctggtcttgaactgggctcaaatgatcctcccgcctcaacctcccaaagtgctgggattacaagcacgagccactgtgcccggcctaactgttttaaaatttgtggtgtttgtgccttatttctttttcttgattagttttgccatagatatgcttatttctcttttgacagagccaacatttatttttattgatctttctagtgcttgtttatttttgttagtttttgctggttatatttttatttatctgggtttactttgttctttttctgacttcttgaggtgattgatggcctcattaatattttgtcctttcttcctatacatttagtactgtaactttgcctttaaaagtactattttggttttatcccatgaattttctgtgttgtattcattgttattcagttctgtactttttcccagtttccattagtatttgttctttgacctatgtttattaagttccaattgaacagggaaatttgaaagtgcattgttaactttgaattttattgggctagacggaaacatttctttgatatttgtggaaacttgcactgcagcttgatacatagacaatttttataaatgtgcttaaaagtagtgtaagttcttttaattgtggtatgcagggttataaaattatcagatcaaacctgtcaattttctattcagagctatatccttaaatttctttaactgcttgatcatcagagaaaagtatgttaaaatctctattgtaacaattttttttttttttgagacagaatcgctgtgttgcccaagctggagtgcagtggtgccatctcggctaactgcaacctctgcctcctgggttcaagtgagtctcctgcctcagcctctggaatagctggctttattggcacccacgaccacgcccagctaatttttgtatttttagtagagaggaggtttcactgtgttggtcaggctggtctcgaacttctgacctcaagcaatccacccaccatccatcccaaagtgctgggattacaggcataagccactgcgcccggcctattgtgacttacttatctgtatcggtcagggtccagtcagtagacaaaaaccacatactaatttgaaagggaaagtttagtataaagaattattggtcgggttccgtggctcaggcctgtaatcctagcactttgggaggccagggcgggcggatcacctgaggtcagaagtttaagatcagcctagccaacatggtgaaaccccgtctctactaaaatacaaaaattagccgggcatgatggcgggtgcctgtaatcccagctactctgtggaggctgagacgggagaatcgcttgaacctgggagacagtgtttgcagtgagccgagatcgcgccacttactccagcctgggcggctgagtgagagtccgtcccaaaaaaaaattaaaaaaaaaaaaaaaaggccaggcacagtggctcacgtctgtaatcccagcactttgggaggccgaggcgggcggatcaggaggtcgggagatcgagaccatcctggctaaggccgtgaaaccccatctgtactaaaaatataaaaaattagccgggcgtggtggtgggcgcctttagtcccacctactcgggatactgaggcaggagaatggcgtgaacccaggaggcggagcttgcagtgagccgagattgcgccactgcacgccagtctgggcgacagagcgagactccgtctcaaaaaaaaaaaaaaaaaaaaagaattattgacaggattgaagtaactagtaattgtcaagtaatagttaaagaataactgaaaaatataggaatataagatataggaagcagctatgacctctagggttttgatagatcatccaaagaagagctgtgttccttcactctaaggatgggatccagacctcatggaaagagcattgctggggggtcaactggatggtggagacgttgctaagtgtcttactctgttctaaatctgccagaggaggtgtatggggaagctcctgggtgctaaaggatctatgagttggagaagctgccctctccatgaacctagcaggaggaagccgtattctgcaggagccaatcataataggagcctaatgtacaggaagtgagcctgtggaaaaccgccctgctggaactgaatgctggagacagcaggctctgtaggagctttgctagccagatgcactgaaactagggaaagaatcccccttcctcttccagtgttcctccaccattctgctgataaggtttaaccttgtgccagttagcaaaggagaaatatctacaaggcctagctccattatcacagaaggatggatttggaattgagaggcataactgtcacagtccctttaactacttttttccttttcctacagcctaggaagctaagaacctttaactttttcatgtgtacacagtgagaaaccacacacatataacttcttttgatgacttctctatattactgtgtatgttttcagaaattttgaaggactattaatgcatcatgtgacacaattaagaaatgagcatccacttcttaaatttataaataatcttttaaaaaatacctttggtggtggggacctagaattaagatgtggagataatgatctgacaaaaaatttggagaaaaatttaagacagatgggggcaaaagatccatgtttagctggtccgaaagtagtgttttctcagttggctgttcacaatcagttacagatcaaacttcttgttctactatttccccccttgactagttgttaaaaaaaaaagacacccaggattaccaggtctcttagatttatatttatttccaggtttaacttactaggtcaagtctttttctaattattatttttgagacacggtctggtctgtcactctgtcgccctggctggagtacagtggcatgatcacagctcactgtagcctccacctcataggctcaattgaccctcccatctcagctactaaagtagatagtactataggtgtgaaccaccatgcctcgctactttttttttaaatttattttgtttaaatagagatggggtctccctatgttgcccaggctggtctcgaactcctgggctcaagtgaacctaccaccttgacctcccagagtgctgggattacaggtgtgaggttttttgtttgttttcaagacagagtcttgctcagtcgcccaggctggcttgcagtggcgcaatctcagctcactgcaacctccacctcccgggttcaagtgattttcctgcctcagcctcccgagtagttgggattacacgcacgccccaccactcctggctaatttttatattcttagtagagacagggtttcaccatgttggccaggctggtctcaaactcttgacctcatgatctgcccacctcggcctcccaaagtgctgggattacaggcatgagccaccatgcccagcccgtttgtttgtatttttttttgtctcgatgtggttttgccatgttgcccaggctggtctcaaactcctaggatcaagcagtcccttccacctcagcctcccaaagtgctgagattacaggtgtgagttaccacaccttttttttttttttaaagtaatccctgccagtagtataaactaaaactgtatgaaataatagtgcagggaaagctttgatctgtttgatctctttaaccaaatcattagattctccattattctgagaggacacctcatgactaatgctcccctctccatgtgaccacttacagctactaatagtagatttctcattaggaaacctctgagtatctgatttcaccagttgaattttgctttgcaaagagtcagttgtgttatttaccaaacgtgatcgtgttatttgtgctttttgtaattgtgcaggctattttataacagctaatcaaatgaactaattgaaacaaatgttaggttgaggaatgtgaggaatggagaaaaaaaatacaccttgattttatttatctcttgtggtagaaccatgatcttttctttgaatatgaatccaatgatgagagtgttgacgtctttcttgcgtaaactacacccgtaagacattgcccatgattttcagtttttattttgtccttgcttgagcccagggaggttgcagtgagctatgatcatgccactgcactccagcctgggtgacagagggagactctgtcttaaaacaaaaacaaaaaaaaaaaaaaaaaacttacatactttttaattgatctgagtatagactagattttctcccctagtactttggatcattttgtcttcacttgatttgacatgcagaggtgtgtgtgtgtgtgtgttttgttacctgtctttccatagcattctgcctagttttcactagaaaataactccctttggtattgtgatctttcatcatactgtgatttagaaaaataggaaaatgagcataattgatttgataataaatgcacattggtaagctttgagaaaaacccagaatcgtatatagaaaaccttcccccgagctaagagggagccaggagaccaaaggatgactcacaagtccaggttggtgaatagatacatttactaggactaataagtttatttattacaaggcactcctggatggcagcaggacagctgtagagatccatgctgccctttgtctgcaaactatttttaagctaactttctggctcattgcctactgtatttaagccatgagactgtttttcttggtaggttctcagatactccccgggatgtttgggttctcaggggtacttgctcttcaggctggcaccatggccttggctcacctcctgtccttcaggattcaggcagcagattaagcattgagatataagcatatatctcaattggtgggagcagtagtatgcaggtgcaggcttgctaataatttcatagccccaagtggccacagttcagtggccataagcatcattcattgggttttactggcagattagaggatgccagataagttagtgaagagagacttttttttgtgtgtgtgtgtgtatgtgtgagacagagtttcactctttttgcccaggctggagtgcagtggtgtgatctcggctcactgtagcctccgccttctgggttcaagaggttctcctgcctcagccgcccaagtagctgggattacaggcacctgccaccacacccagctaatttttgtagtgttagtagagacgaggtttcaccatgttggccaggctgatctcgagctcctgacctcaagtaatccgcccacctcggcctcccaaagtgctgggattacaggcatgagccactgcggcccagcctgtttttgtttttttactgttttggattcttatgttgtttctagtcttaccataaacaacactggtaacagattattagatgtgaaatttttgggtcagagtattgtacttaaacatttcatcaaatttttaatcaaatcaaagctgttgccaaattgctttcatggagcttttaccagtgtacacttgagagagctatgagagtacatcttttcccatacctttgtcaacctagtgtactatcaaactttttgttatttgcttgtcttactatgttgttggtgaaaacgtgtcaggagtccccaaaatcacccctaagtttgatgatttgccagacttatagaattcactatgtagttgtacttacagctatgatttattacaatgaaaggatgcaaagcacaatcaccaaagggaaaaaaggtccatggggtaaagtctagaggaaaccaggttaaagttcccatggttttgctcccagtggagtcatgcacttatctgtttattcccccagcaactagtgatagcaggtgtgaaatgctgtctacctgggaagcatgttggagactcagtgcctaggctctttactgggggctggtcacataggccacctctgcctggcatgtactaaaattttaagactcccagaaggaaacaggtgtttatgataaaccaaattgtttgtatgaacagtttaggcacattgagccactttttatcagtctggaaattgtgggaaccctcctgaaatttgagttcttagactccagccaagggccttagtaagcagcctttctaaggataagtagccatgcctggctatgccaacactttcctacacaacatggcatatctcattgttttaatttgtgtttccttaattattaagtcaaacatcttttagttccaaaagctttgctttttttttttttttttttttttttttgagatggagtcttgctctgtcgcccaagctggagtgcagtggcgcgatctcggctcacggcaagctcctcctcccaggttcacgccactctcctacctcagcctccagagtagctgggactacaggcgcccgccaccatgcctggctaattttttgtatttttagtagagacggggtttcaccatgttagccagggtggtctcgatctcctgacctcatgatctgcccgcctcggcctcccgaagtgctgggattacaggcgtgagccaccgcacctggcctggtatcagtatttcttgttagtattaatgtgtgtgtgtgtgtgtgtgtgtgtgtgtgtgtgtgtgtgtgtgtgtgtgttgtgatagtagtgatggttcttattttagtacaaaagttaatttggccaggggcagtggctcatgcttataaccccagcactttgggaggctgaggccagcggatcacctgaggatgggagttcgagaccagcctgaccaacatggagaaaccccatctctactaaaaatacaaaattagttgggcgttgtggtgcgcgcctgttatcccagctacttgggaggctgaggcaggataatcgcttgaacccaggaggtggaggttgtggtgagccgaggttgcaccattgcactctagcctgggcatcaagagcgaaactccatctaaaaaaaaaaagttaatttgtattttggtctgttttataaaattatcatttactctgtacatagcttaatgacaattttttgtttatttgttttgtttttgagacagggtctcactctgtcacccaggctgcagtgcagtggcactatcgtggcttactgcaacctctccctgccaggctcaagcgatcctcctgcttcagccaccaagtagctgggactacaggcacaggctactacagtcggctaatttttgtattttttgtagagatggggtttcaccatgttgcccaggctggtctcaaattcctgggctcaagcgatccacctgacttgacctcccaaagtgctgagattgtaggcatgagccaccatgcgtggccatattaacaagtttaaaatttttgttttatagttttgactttttcctggaaaatattaggcactttttttgataacacaaatctgcttttaataatgttagagagaaaggccaggcatgggggcttacacctgtaattccagcactttgagaggctgaggtgggtggattgcttaaggccaggagttcaagaccagcctggccaacgtggcagacaggcaaaacccggtttccactaaaattacaaaaattagccaggcatggtagtgcactcctgtaatcgcagctatggtacactcctgtaatcccagctactcgggaggctgaggcacaagaatcacttgaacccaggaggcagaggttgcagtgagcagagatcaagccactgcactccagcctgggcgacagagtgagactttgtctccaaaaacaaagaatgatagagtgaactttttcaatgtgtccaaattcgaaaattgctttttgttttgaagctaggtttattctctgaattgtgaggtttattttaacagtggaaattttaaaatatttaataccgtaggtggtgactctcaaaaggaaataggatcatggcagcagatgatgacaatggtgatggaacaagtttatttgatgtcttttctggtaagagctacatttaattgtctttctaatttcctttttttttttttatgagacagggtctcccccagttgcccagggtggagtgcagtggcgccattaatagctcactatgacttcagacttgggagctcaagggatcctctcgcctcagcctcctgagtagctaggactacaggcacatgccaccacggccatctaatcattttattttttgtagagagaaggtttcactgtgtggtctaggctggtctctaattcctggactcaagcgaccctccctttttgcctcccaaagtgttgggattacaggtgtgagccactatgccttgcctaactttactttttaaattacaaaatcatttacctattctcattggaaacacagtcattatcagccttttccctctatacataaatgaattaataaaataaaatgcctgggacatgggaatgcttaataagtgtgaacttactgtatgctttcaagcctcagaatgtagtcaaattagtgattttactaatatgaatgataatgatttttattgttatacctaaaaatatataagataggtttttgttactcttgaagttaatatttctagtaaatgcaatgatgtttgttgttcagaaaaaaattgggccaggtgcagtgtctcattcctgtaatcccaatactttgggaagccaaggcgggcgaatcacgaggtcaggagttcgacaccagcctgaccaacatggtgaaccccgtctctactaaaaatgcaaaaattagccgggcatggtggcatgtgcctgtaatttcagctactcaagaggctgaggcaggagaatcacttcaacccaggaggtggaggttgcagtgagctgagattgtgccactgcactctagcctagatgacagagcaagactgtctcaaaaaaaaaaaaaaaaattgatagtcacaatggatgattagtttgaaaaagagataactgtcaatacctggtattaaaataagctcataaaatagaatttctttctttttttttttgtttgagattgagtcttgctgttgtcagcctgggctggagtgcagtgtcgcaatctcggctcactgcaacctccgtctcctgagttccagcaattctcctgcttcagcctcctgagtagctgagattacaggtgcctgccaccatgtctggctaatttttgtatttttagtagagacgaggtttcaccatgttggccaggctcgtcttgaactcctgacctcaggtgatctacccaccttggcctcccaaagtgctggaactacaggtgtgagccaccgtgcccagcccaaaatagaaatattttaaataatatgcagaaggtaaacttccaaacactgacataacattattatctctttcttttaatgataatcatgctgtgacctcattgaatttgttgagatatgggcatatgtttattgaccagaataatgattcctatgccatggagagtaagaaggacagttataaaacatgtttagtagaattccatttttgcttaaaataatgttttaaacaattcatagatatggaagagttcacaccaactatggccattataaccattctgggtggtgttatttggtgtttatttttgctgatgtagtttcaagttgttattctgttatgtaattctctttgatgttttttcctttgaaaaattttaagccaggccgagtgcgatggctcacgcctgtaattctagcactttgggaggctgagacaggtggatcacctgaggtcaggagttcaagactagcctgaccaacatggtgaaactccatctctattaaaaatacaaaaattagcggggcatggtggtgcacgcctgtaatcccagctactcaagagcctgaggcaggagaatcgcttgaactgggaggtggaggttgcagtgagccaagatcctgccattgcagtccagcctgggagaagagcaaaattccatctcaaagaaaaaaaaaaatttaagccaccaaactgaaaaattggaactataatataatgaacagcattatttgtcacctagattcacaaatgattaaatttcatcacgtctgcaacgattaaaatttgaaggacaaaactacaatttaatctgattttctggatgcagctgtttttatttctatgtatcactgtcaagttgctgtctatacacacacacacacacacacacacacacacacacacacacacacacattttttttttttgagacagagttttgctcttgttgcccaggctggagtgcaatggcatgatctaggctcactgcaacctctgcctcccaggttcaaggaattctactgtcagcctcctgagtagctgggattacaggagcgtgccaccatgcccggctaattttttcgtatttttagtggagacggggtttcgccatattggccaggctggtctcgaactcctgatctcaggtgatccgcccgccttggtctcccaaagtgctgggattacaggcgtgaaccaccgcgcccggccaggtttgtttgttgttgttgttgttgttgttgttgttgttgttgttgttgttttgagttggagtctcgctctgccgcccaggctggagtgcagtggcgcagtctcggctcactgcaagctgtgccttccgggttcacgccattctcctgcctcagcctcccgagtaactgggactacaggcacccgccaccacgcctggctaattttttgtatttttagtagagacggggttttactgtgttagccaggatggtctcgatctcctgacctcgtggtctgcccgcctcagcctcccaaagtgctgggattacaggcataaaccaccacgcccagcccatatatatattttttaggctaatcaagtgaagcagtaggaaaagcatgtacattttaaaaatagtcacagctacggtgtactttctgctttgtgtcttgcctttttttttttgagacggagtctcgctctgtcacccaggctggagtgcagcggtgctaactcagcttactgcaacctctgcctcccgagttcaagtgattctcctacctcagcctccagagtagctgagattacaggtgtgcgccactatgcccggctaagttttgtatttttagtagagacggcgcttcaccatgttggccaggctgttctcaaactcctgacctcaggtgatccgcctgtcttggcctctcaaagtgttgggattacaggcatgagccactgcgtccagcctagactctctctttgtaaacacacacacacacacacacacacacacgtctagatgcacacccattttttttcctgacccatttgagagtaagttgtatacattatggccccttacccctaagtatttcagtatgtatttcataaggaaaagttggttctcttatataaccacagtgtaatttcagtttcattagatttaacactgataaaatacttttgtatttgatttgctatttttattccagcgaatgatgttctttattattgtagttggatttaggtcattttaatatttgacttcaatttttctcatcagttatttttttctgattttctttcaaatattatttgagtatatatttatttacttattttaaatttttaaattttttttctccctttagcactagtgctaactgctagtaatgtttgagtgtatttttgaaatgcatttcatttatgtatgagctttttcactatacctgtttgtattatttttagtatttgtttgaggaagtgtatacatctttaacattttgtagtctgtttactagtattgtacctttttacaatatcttgcatgtatggttgcatctatctgcttctttgcctttcatgttagaaccccacaataaaatgctatagtgtttactgggccgggcgtggtgtctcacacctgtaatcccagcactttgggagaccgaggcgggtggattgcctgagcacaggagttcgagaccaacctgtgcaacacggtgaaaccccgtctctaccaaaatacaaaaaattagccaggtgtggcggtgtgtgcctgtagtctcagctgcttgggaggctgaggcaggagaattgcttggacctgggaggcggaaggcagaggttgcagtgagccgagatcgcaccactgcactccatcctgggcgacagagcgagactctgtctcacaaaaaccaaaaaaaaaacccaaaaaaaacaaaaaaacaaaaacaaaacaaaacaaaaaaaatgctatagtgtttactgtaacagttctatggatcttaaattaagaagaaaaattagtcttttacgattactcatttatttaccatctccagtcctagcattctttggtatccctctagtagcagtttccccccattctctatttgcttctggactccacatatacactatgtgaggacttttgatattatcatgtaggtcactaagactctgttcttttttaagaaagtgctctctcatctacagattgggtaatttctgttgatctgtcttcaagttcagtggttctcctgtcaagcacatccagtaattttttatattagatattgtaatcttcagttgtaggtttttcatttggttctttttcattgtttctgagattttctatgtagtaagtttgtgtttgtctgtgtggtttttttggagacaagttctttctctgtcagccaggctggagtgtagtggcatgaacatggctcacttcagcctcgacctcctgggttcaagtcatcctcctgcctcagtctcctgagtagctgggactacaggcatctgccaccatgctcagctaattttcttttaattttttttgtagagacagagtctcaccatgttacctaggctggtctcgaactcatgggctcaagcagtcctctggccttggcctcccaaagtgctgggattacaggtgtgactcactgcacctggccaccatgtagtaactttggattgaatagtcaacattgtaaatgaaatgttagacactggatgctgttaacattcctctgaagagttgtttttaattttagcagatatttaacttagctgaacttacaattcggtctcttctgtaatagcaactgaaatctctattttagatttagctggctttttggagttctacccttttttgagggtcacccagagatttgggcagaatttaagtaatgctctttgtggatttctgtaattcccctttcatgtactagtcactgttatcatgacaaattcttttctccggttcttcaagctactaggactggaggtttctatcttgagttgtcactgcccagtgtagctacaactagggcctgtctttatacaaaaagcagtaataaaaggggacagggagcttgggaggtgctattttctttcagttgtcattacccttttagtttttgcctgctttaggttgttctctagctctttagatagcttcacatattttatttagtgtcaacagtagttgcctgcaggaggattggtttcatagaaactactctgctataactggaattggaactctttcagtagaatatatatatatgagacaggatctcgcactgtcacccaggctggagtgcagtggcataatcatggctcgctgcagccttgaccttctgggctcaagcagtccaccttagcctcccatgtgccaccacacctggctaatttttatttttgatatgctatgttgtccaggctggtcttgatctcctgagcttaagcaatcctctctcctcagactcctaaagtcgggggattacaggtgtgagccactgcacctggcctcactagtatatttttgaaactgaatttttaaagtctgtatctgaggtagtcaataaataaatcagtgtgccaaaatcttcctgtttataactatgtgtagagacaatgtctgtctgtgtctctctctccctgtctctctttaatttgagacatggtctcactctgaaatccaggctagagtgcaggggcacgatcttggctcactgcaacctccacctcccgggttcaagcaattgtcgtgcctcaatctccctagtagctgggattacaggcatgcaccaccactcctggctaatttttgtatttttagtagagacagagtttcaccgtgttgtccaggctggtctccaactcctgggttgaaaagtgatctgcctacctcggcctcccaaagtgctgggattacaggcgggagcgaccatgcccggcctttttttgtatttttagtagagatgaggtttcgccccgttgcccaggctagtcttgaaatcctgagcttaagcgatccacctgcctcagcctccctaagtgctgagtttacaggcgtgagccaccatgcctggcttatctcttatttaaagcaaaactgttaaatctcattcttttcctggtcctttagtgtaggaatggaaaaatctcagtgcctaaagtcatttttaactaatctttgcctttcttgcagcttctcctcttaagaacaatgatgaaggctcactggacatatacgctgggttggacagtgctgtttctggtatgtgaattccataaaaatagtttcattttcttggtcagttcattgttttgtggttactaaatcctggtatatcatagctcctaaagaatttgctcattctttgtaattacactgaggtaattcttttctttcttttcccccacagtaacttccagaacccaatcttaaccaaagcttgatcagaaaaacaaattagcacacaggttttttattcatctcagtctcagatttaattgagccttgtgcaaaaacattttctactattgaagtgcaactagtgctggtgtctgttactactcactcatactctttttttttttttttttttttgagacggagtctcacactgtcgcccaggctggaatgcagtggcttgatctcggctcactgcaacctccgcctcctgggttcaagtggttctcctgcctcagcctcccaagtagctgggactacaggcacgtgccaccacacccggctaattttttgtatttttagtagagacaaggtttcaccatgttagcctggatggtctcgatctcctgacctcgtgatccgcccacctcagcctcccaaagtgctgggattacaggcataagtcaccacacctggccgcactcatactcttgaaggttatatgatattagaacatttgaaaagtgtaagttactataaatatttttaaacgtatcagtaagagtgatatgctgagaatctaatgacctattcaaattagaaaccttttccataatcagatttctcagagttttgaacagttatgatcttcatacctaatttggttgacacaaccattttaggtaaattggtagtccatctgtaaaatcagtataaatttggaatgtaggataagtgaaatgtaggatgaagtatgggagatggagaaatgtataatctttgaagtagataaaatatcaaaaagtgtaacaaggctgggcgcggtagctcacgcctgtaatcccagcactttgcaaggccgaggcgggcggatcccctgaggtcaggagttggagaccagcctggccaacatagtgaaaactcgtctctactacaaatacaaaaaaaattacctgggcatggtggcacgtgcctatagtcccagctactcagggaggctgaggcagaagaatcgcttgaacccaggaggcggaggttgcagtgagccaagatagcgccactgcgctccagcctgggtgacagagggagactcctaaaaaaaaaaggtgtgacaaatattttcactttgtgaggccaaggcgggtggatttcttgaggtcaggagttcgagaccagcctggccaacatggtgaaacaccatctcaccatctctactaaaaatacaaaaattagtggggcgtggtggcgtgcacctgtaatcccagctactcgggaggctgacgcatgagaatggcttgaacctgggagggtgaggctacagtgagccaagatttgcaccactgccactgcactctagcatgggtgacagaacgagactcaaaaaaacaaaagaaaaaagtgtaacaagtatttttatggaaggttttttttgtttgtttgtttttagacagcgcttccaaatcctgtgtaccatcaagaaattgtttggacttatatgaagagatcctgactgaagaaggaactgcaaaggaggcaacatataatgatgtatgggttgccacaattattaaggacagttatttactgttttgtagcttctgaagagcagtcagctgcttagttttgaacagatattttgtttaggaacttagctcttagactaacaaatatttaagtcagtttttgtcttcagacctgttttttaaaggaatgttttctgaatacttgtctaaatttagttataattttgcttgacccaatttaagcatctgaatataaaacctcaacaggcaaacagtgttacaacattttttctttcatgatatgtacaaagttaaattatatgttgcataaaatgtcctcagacttctatttctttctactatatttgaattttaaggtttggatgttgaatgtgaaactaaacaaaatagattatttgtaggcttaactttaaaactggttatctttctggtagaagtagacctcatctgccttcttagtgaattgatttgcaaaatttaaaatatttagaaatgccagttaagctaagaaaataattttgaatgatacttcaattaatccttttatattttatagttgcaagtagaatatggaaaatgtcaactacaaatgaaagagctgatgaaaaaatttaaagaaatacagacacaggtagagtataaatgaaaacataaaaaacaaattaccaggcacagtgactcacaccagtaatttcagcactttgagaggcagaggtgagaggattgcttgaggccaggagtttgagcccagccttagcaaggtagcgaaacctcatctctacaaaaaaataaaacaattagctgtgtatggccccctgtagtcctagctacttaggaggctgaggagggaggactcttgaactcaggagtttgaagttaaagtgagctgtgattgtgccactgcactccagcctgggtgacagagcaagaccctgtcacttaaaaaaagtaaaacaacaaaaaaaaagttgttataaatagaaattaaaatgttaaagtgttgacagtttataaggaagctttcttttagtattaaatgaaatagcaaatgtggcaagtatgcattatttcctgagttgatgaaattgaatgaaatagcaaatgtggcaaatatgcattattttccgagttgatgaaactgataaaggaaaacggcttgatttattaaatgacattgattataaagggtctgttagacttaggccaattaatagttaattaatagaaaattgtggagatgatgacaactggtttaaaagaatggttttgaggagcaaagatacgggtttaaaatggctcttgggggacactgttgatgccttcacagcttttgccaaaatgacctattttgtgactgtgctgcaaaaatcaggaatgtcatgtcctgttctagtttttactttttggtaaaattgtatctcttccttctcttccccctgaaagaaccagtgaactctcaattctttctttgtttatctggggactaatacatcttttttttttttctgatggagccttgcgcttcgccaggctggagtgcagtggcacgatctcggcttactgcaacctccagctcactgcaacctccgcctctcaggctcaagcggttctcctgcctcagcctcccaagtagctgggattacaggcacccaccatgacacctggctaatttttgtatttttagtagagacagggttttggcctgttggccaggctggtcttgagctcctgactttaggtgatccacctgcctcggcctcccaaagtgctgggattacaggcgtgagccaccatgcccagactggactaatacatctttgcaagtttaaccaaagctgttaaattataacctaattcttaccatttttattttcaattttcaagatcatgacccaggcagaacttactttttctgctgttcattggtttttcatttcaatctctgttttaagtagtttcactttaagtgggactatttctggtgccagttatcttctcatagtctcagcttccccacctgtataagggggataaatagtactcctcatagggcttataaatgtatgatgcctgcatgtagttaacattcaataattatcagctaatgtatgtagtagtattagtaaccctataggtatgtactttattaatatagtttgtggtgttttagaatttcagcttaataaacgaaaaccagtctcttaagaagaatatttcagcacttatcaaaactgccagagtggaaataaaccgcaaggatgaagaaataagtaatcttcaccaaaggtattactgagcggtgtagctgttataaattacgtgggtattgatatgtggaatatttttaacttttagaggaaagatgaaaataatgtatttttattttttattttttaatttttttttttttttagagacagggtctcattttgtcacccaggctggaatgcagtggtgtaattataactcaatgcagcctccacctcctgggctcaagagatcctccttcctcagccttccaagtagctgagataacaggtgcacaacaccatgtctgcctaatttttttattttttatttttggtggagacagggtctcactatgtagcccacactggtcttgaactcaaggcctcaagtgatcctcctgcctctgcctcctgaagtgttgggattataagggtgagccaccatgcttggcccatatgtgattattaatagaacattgtggccaggcgcagtggctcgtacctgtaatcccagcactttgggaggctgaaggggacagatcacttgagctcaagagttcgaaaccagcctggccaacagggtgaaaccctgtctctactaaaaatacaaaaatttggctgggcatggtggctcatgcctgtaatcctagcactttgggaggccgaggcgggcagatcacctgaggtcaggagttcgagaccagcctgaccaacatggtgaaaccccatctctactaaaaaaaaaaaaaaaaaaatacaaaattagctggacatggtggcgcatacccagcatcacagccactcgggaggctgaggcaggagaatctcttgaacccaggaggcagaggttgccgagattgtgccattgcactccagcctgggcaacaagagtgaaactccatctcaaaaaaaaaaaaaatattagccaggcatggtggtgggtgcctgtggtgggtgcctgtaattccacctacttgggaggctgaggcaggagaattgcttgaacctgggatgacgcagaggttgcagtgagctgagatcataccactgcattccatccttggtgacagcaagactccatctcaaaaaaaaaaaaaaaaggaagcaaataaaaatagaacattgccacatatttatctgaatatatttagtttcctaaaacactgagttcttgctctaatactgtttgccctgatgagatgatggtatatatgtcatgggttcttctaggtccccactaaattactaaaatatcaagagggcatctgtgctcatataccctattaataaacagcccttatactatctctcaattgtatattcttttctttctcaaggggattttctccattaatttctctcttttattggttggaggcaatattttgctccagagaggttcatattttcatagcctaacctctgaaaaagttgtctaaacttgtaaacttgttttcattttctttctttctgctaactcactttttattttttttaagatggagtctcactctgtcgccaggctggagtgcagtggcgcgatcttggctcactgcaacctccccctcctgggtttaagcaattctcctgcctcagcctcctgagtagctgggactacaggcacgcgccaccatgcctggctaatttttgtatttttagtagagatggggtttcaccatgttggccagggtggtcttgatctcttgacctcatgatccgcctgcctcaagcctcccaaagtgctgggattacaggcgtgagccactgtgcccggccatttttttttttttttttttttttgacagagcctcactctgtcgcccaggctggagtgcaatggtgcaatctcacctcaccgcaaccttcgcctcccaggttcaagcgattctgcctcctgagtagctgggattacaggcgctcgccaccacacccggctagttaaaaaaaaatttttttattttttgagatggagtctcgctctgttgcccaggctggagtgcagtggcgtgatcttggctcactccaacctccgcctcctaggttcaagcgttctcctgcctcagcctcccgagtagctgggattacaggcacccgccaccacgctggctaatttttgtatttttagtagagacggggtttcaccatgttggtcaggctggtctcgaactgctgacctcaggtgacccacctacctcggcctcccaatgtgctgggatcacaggcatgagccaccgcactcagcctacacccagctaatatttttgtatttttagtagacacggggtttcaccatgttggtcaggctggtcttgaactcctgacctcaggtgagccacccaccttggcctcccaaagtgctgggatttcaggcgtgagccactgtgcccagacttttttttttttttggcagagtcttgctctgttgcccaggctggagtgcagtggtgtgatctcagctcattgcaacctttgcctgctgggttcaagcgatcctcccacctcagtctcccgagtagctgggattacaggcatgcaccacctgtaaaaaaaaatttaaaaaaaaaaaaagatttttttgtatttttagtagacggggtttcaccattttggccaggctggtctcaaactcctgatctcaagtgatctgcccgcctggccctccaaagtactgggattacaggtatgagccactgcacccagcttcaagggtgttccttttgtggttagtgcttttcgtgtttacatttccccaatgatctcaaaggtatctaccaacagttggtcggttgagtcagtatctatattagtttcctaggcttagtgtaacaaaactaccagaaatgggtggcctaaacaaccaaaatttgtctcacagtcctggaggctagaagtccaaaatgaaagtgtcagcaaagttagtttcttttgagagctctgaaggaaggatctgattcaggcctctgtactcttagatggttgtctacttcctatgtctctttatatcctctttctaaatgtatctctgtgtccaaatttccccctttttataagaacaccagtaatattgcatgcccaccttgaggacatcactttaacttgattatttctgtaaagaccctttaaataaggtcatattctgaagaacaatgggttagaacttcaaattatgaatttggtcaggagaggggacacaatccataacagggttcatatgaggcttacatattgttttaggttgtgtgtttttctaatcctctcttataacaatctgcctatatttctgagttttttaagttttgggtttttctacacatttgctactgattagaaaaagatatatgaaatttcagagaaattatggaatttctggaagatgaagttattaccagaagccaatataggccaggcacagtggctcacgcctgtaaccccagtactttgggaggcgaaggcaggagaattgcttgagtccaggagtttgagaccagcctgcgcagcatagtgagatcccatctctacgaaaaattaaaaattagctgggcatggtggcttgtacctgtagtcccagctacttggaaggttgaagtgagaggattgcttgagcctaggacatcaaggctgcagtgagccatgatcattccgctgtactcagcctgggtgaaagagggagaccctgtctcaaaaaaaaaaaaaaaaaaaaaaaaagctaaattgagctatctacattttattgctaggaaacctaccagtttttttaaacactaatataaaaccttaagacttagatttttgtttgttttaaacagtaaatatataccattctcctaggaaagaattacaactctttattcctttttactttgcgtagtatataacatcttaagatggcctttggtgctttggcttgctgtgggattgtatgtgaaacagaaaactaggatagagaattatgtagagttttactttgttcatgtctgttgtttagcaagattttacttttccttgtgtttcagttgagctagaatgaataaggcaagaaaataatgtcacttgttctaaaagaagtgaacttgtggttagctggggagttatgcactgtagtgaagtaagtctaagagccattggcaagtattgggatagatcctcaggtcctcaaaacttatttgagcaaggcacatgaaagagaatttcatgttttaaaaacaggctaatttagttggaagctggtaatttctttttcttcttttttttagggacagggtctcacttcgttctgtcacccaggctggagtgcaatagcgcaatcatggctcattgcagcctcaacctcctggtcttaagtgatcctcccacctcagccttccgagtagctaggaccacaggcatgtaccactatgcctggctaattaaaacaaaaaatttttttagagacaggatgtcaccatgttgcccaggctgatcatgaactcctgggctcaaacaaatgatcctcccgccttgtcctcctcaagtgctgatattagaggcatgagccaccacatctggccaaagctggtaatttctttctcaaccaggaggttgaggctgagacagagtcttgccctgtcacccaggctggaatacagtggcgcagtctcggctcactgcaacctccacctcccaggttcaagcaattctcctgcttcagctcccaagtagctgggattacaggtgcctgccaccacgcttggctaatttttttgtatttttggtagagacggggtttcgccatgttggccaggctggtctcaaactcctgacctcaagtgatctacctgcctcggcctctcaaagtgctgggattataggcatgagctaccatgcctggccaaagctggtaatttcttaatcatgaattactcatgtgaatgaagtttggaatattgctaaatataatttaacttttttttttatttcataatagattgtctgagtttccacattttcgaaataatcataaaactgcaaggacatttgatacagttaaaacaaaagatcttaaatctagatctccacatttggatgattgttcaaagactgatcacagagctaaaagtgatgtttctaaagatgtacatcatagcacttcactgccaaatctggaaaaggaaggaaaaccacattctgataaaaggagtacttcacatttacctacatctgttgagaaacactgcactaatggtgtttggtcacgttctcattatcaggttggcgagggtagctcaaatgaggatagtagaagaggaagaaaagatattagacatagccagtttaacagaggaactgaaagagtacgaaaagacttaagtactggctgtggtgatggtgaaccaaggatattggaggctagtcaaaggctacaaggacatcctgagaaatatggtaaaggtgaaccaaagactgaaagcaaaagttcgaagtttaaaagtaactcagattctgactataaaggtgaacgcattaactcttcttgggagaaagagacccctggagaaaggtcacacagtcgagtagactctcaaagtgacaaaaaactagaaagacaaagtgaaagatcacaaaatataaataggaaagaagttaaatcacaagacaaagaagaaagaaaagttgatcaaaaacctaaatcagtagtaaaggaccaagatcactggagaagatctgaacgagcatcacttcctcattccaagaatgaaataacattttctcataattcaagtaaataccatctagaagagagaagaggatgggaagattgtaaaagagacaagagtgtaaacagtcatagttttcaagatggaagatgtccatcttctctttcaaacagtagaactcacaaaaacattgactctaaggaagttgatgccatgcatcagtgggaaaatacacctttaaaagcagaaagacatagaactgaagataagaggaaaagagaacaagaaagcaaagaagaaaataggcatattagaaatgaaaaaagagtacctacagaacatttgcagaagactaataaggaaactaagaaaaccactactgatttaaagaaacagaatgaaccaaagactgataagggagaagtccttgataatggtgtttctgaaggagcagataataaagagcttgcaatgaaagctgagagtggtccaaatgaaacaaaaaacaaggacctaaaattgagttttatgaaaaaattgaacttaactctttctcctgctaaaaagcaacctgtttcccaggataatcagcataaaataactgatattcccaagtccagtggtgtatgtgattcagagtcttcaatgcaagttaaaacagtggcatatgttccctccataagtgaacatatcttgggggaagcagctgtcagtgaacataccatgggggaaaccaagtcaacgttattggaaccaaaggttgctcttctagcagtgactgaacccaggatcggtatctcagaaaccaacaaggaagacgaaaatagtttgttagttaggtctgttgacaatactatgcattgtgaagagcccatttgtggtacagagacttccttcccatctcctatggaaatacaacagacagaatccttgtttccatcaacaggaatgaaacaaaccattaataatggaagggcagcagctcctgtggtaatggatgtattacaaacagatgtgtctcaaaactttggcttggaattggataccaaaagaaatgataattcagattattgtggtatttctgaaggtatggagatgaaggtggcactttcaacaacagtgagtgaaaccactgaaagcattttgcagccttcaattgaggaagctgatattttgccaataatgctttcagaagataataacccaaaatttgagccttctgttatagttacaccactggttgagagtaagtcgtgtcatctggagccttgcttacctaaagagactctagattcttcacttcagcagactgagttaatggaccacagaatggcaactggtgaaacaaactcagtatatcatgatgatgataactcggttttgagcattgaccttaatcacctgagacctattccagaagccatcagtcctctgaatagtccagtgagacctgtagcaaaagttcttagaaatgaaagcccacctcaagttccagtgtataataacagtcataaaggtaatagtttgtattatcttctataactttgcattttatgagaatgtaaaatacataagatgaattggtgctttttcttttttgataacataaaaagtagcatattactcagcccctgttatctagaagtgcacatggagggtttttttgttttttggttttttttagatgaagtctcactctgtcccccaggctggagtgcagtgtgcacaatcttggctcactgcaacctctgcctcctgagttcaagcaattctcctgcctcagcctcccaagtagctgggactacaggcgcgtgccaccactcccagctaatttttgtattttttttagtagagtcagggtttcaccatattgggcaggctggtcttgaactcctgacctcgtgatccgcccgtctcggcctcccaaagtgttgggactataggcgtgagccactgcacccagccatagttgtttttttgtttcttttttttttttttttttttgagagagagtcactctgtcgccaggctagagtgcagtggtgcgatctcagctcactgcaacctccgcctcccaggcccaagcgattctcctgcctcagcctcccaagtagctgggattgcaggcacctgccactatgctcatttttgtgttagtagagatggggtttcaccatgttggtcaggttggtctggatctcttgacctcgtgatcagccctcctcagcctcccaaagtgctgggattacaggcgtgagccaccacacctggccccaagcactttttaaggtcaataaaaaccaatgatacaggcggggcatggtggctcacacctgtaatcctagcacttagggaggctgaggcaggtagatcatgaagtcaggagttcgagaccagcctggccagtgtggtgaaaccctatctctactaaaaaatacaaaaattagctgggcgtgggagcagtcgcctgtagtcccagctactcaggaggctgaggcaggagaattggcttgaacccgggaggtagaggttgcagtgagccaagattgcgccactgcattccatcctgagtgtcatagcaagacttcgttctcaaaaaaaaaatcaataatacaagtattaggcattaacattctgcttcaaaaagaactagtaaaacagtgaattgccggctgggcgcagtggctcacgcctgtaatcccagcactttgggaggccaaggcgggcagatcacgaggtcaggagatcgagaccatcctggctaacacggtgaaaccccgtctctactaaaaatacaaaaaaattagtcagacgtggtggcgggcacctgtagtctcagatactcgcgaggctgagacaggagaatggcatgaacccacgaggcggagcttgcagtgagccaaggttgcaccactgcactccagcctgggcgacagagcgagactccatctcaaaaaacaaaaaaaacaaacagtgaattgcctcagtatttaattttttgttatatgtaatatttaatatggacatgtcaaataactaaactttaatatacttttatcttctataaatgtgtttaatatatttttctcttctacagatgtgtttttaccaaattcagctcattctacctctaagagtcagtctgatctcaataaggaaaatcaaaagccaatttacaaatctgacaaatgtacagaagcagacacatgtaagaattcaccattagatgaattagaagaaggagaaattagaagtgatagtgaaacatctaaaccacaagaaagttttgaaaaaaattccaaacgtagagtgtcagctgatgtgcggaagtcaaagactatcccacgacgtgggaaaagtactgtgtgtttagataaagacagtaggaaaacacatgtaagaatccatcagaccaataacaaatggaataaaagacctgataaatctagcagatcttcaaaaacagagaagaaagataaagtgatgagcacttccagcttggaaaaaatagttccaattattgctgtaccctcttctgaacaagagatcatgcacatgttacgaatgataagaaaacatgtaagaaaaaattatatgaaattcaaggcaaaattttcattaatacaatttcacagaattattgagtcagcaattttgagttttacatctttaattaaacatctcaacttacacaaaatctctaagtcagtgactaccttacagaagaatctctgtgatattatagagtctaaacttaagcaagttaaaaagaatggcatagttgatcgtttatttgaacagcaactaccagatatgaaaaaaaaattgtggaagtttgtagatgaccaacttgattatttgtttgcaaagcttaagaaaatcttagtatgtgattccaaaagctttggaagagatagtgatgaaggcaaacttgaaaaaacaagtaaacagaatgcacagtattcaaatagtcagaaaaggagtgtggacaactccaacagagaattgctgaaagaaaaattatcaaaatcagaagaccctgttcattataagtctttagtgggatgtaaaaaatctgaggaaaattatcaagaccaaaataactccagtattaacactgtaaagcatgacattaaaaaaaattttaacatctgctttgataatataaagaactctcaatccgaagagcgctccttggaagtacactgtccaagcaccccaaagtcagaaaaaaacgaaggaagcagcatagaggatgcacagacatcccagcatgcaactttgaagccagaacgaagtttcgagattcttaccgaacagcaagcatcgagccttacttttaatttagtgagtgatgcacaaatgggtgaaatatttaaaagtttgttgcaaggttctgatcttttagacagcagtgttaactgtactgaaaaaagtgagtgggagttaaagactccagagaagcagctgctagagactcttaagtgcgagtctataccagcttgtacaacagaagagctagtttcaggggtggcttctccatgtcctaaaatgattagtgatgataattggtcattattatcatctgaaaaaggtccatctctgtcttcagggctttcattgccggttcatcctgatgtgttggatgaaagttgtatgtttgaagtgtctactaacctacctttaagtaaagataatgtgtgtagtgtagaaaagagcaagccctgcgtttcttccatacttcttgaagatctagcagtctctttaacagtaccatcgcctctgaagtcagatggtcatctcagttttttaaagcctgatatgtcgtccagttcaactcctgaagaagtcattagtgctcattttagtgaagatgccttacttgaggaagaggatgcatctgagcaagatattcatttagctctggagtctgataattcaagcagtaaatcaagttgttcttcttcctggacaagccgatctgttgctccaggctttcagtaccaccctaatctacctatgcatgccgtcataatggaaaagtccaatgatcatttcattgtgaaaatacgacgtgcaacaccatctacctcttctggccttaaacagagtatgatgcctgatgaattattgacatctttgcccagacatggaaaggaagctgatgaaggaccagagaaagaatatatttcatgtcagaacacagtttttaaatctgtggaggaattggaaaactccaacaaaaatgttgatggcagcaagtcaactcatgaagaacagagctctatgatacaaacacaggttcctgatatatatgaatttcttaaagatgcttcagataagatgggtcatagtgatgaagtggctgatgaatgtttcaaattgcatcaagtatgggaaacaaaagtgcctgaaagcattgaagaattgccttcaatggaagaaatctcacactctgttggggaacatcttccaaacacatacgtagatctaacgaaagatccagtcactgaaaccaaaaacttgggggaattcatagaagtaacagttttacatattgatcagttgggatgttctggaggcaatttaaatcagagtgctcaaatattagacaattctttgcaggctgatactgtaggtgcttttattgatttgacacaagatgcttcaagtgaggctaaaagtgaaggtaatcatcctgcattagctgtggaagacttgggatgtggggtgatacaggtagatgaagataattgtaaggaagaaaaggcacaagtggcaaacaggcctttaaaatgcattgttgaggaaacctatatcgacttgaccacagaatctcccagttcatgtgaagtaaaaaaagatgagttaaaatcagagccaggatcaaattgtgataactcggagttgcctgggactttgcataattctcacaaaaagagaagaaacatttctgatctaaatcatcctcataaaaaacaaagaaaggaaacagacttaactaataaggaaaagaccaagaaacctacccaagattcttgtgagaatactgaagctcaccaaaagaaagccagtaagaagaaggcccctcctgtgactaaagatccctcatcattaaaggcaaccccagggattaaggattcatcagcagcacttgccacttctacaagtctttctgcaaaaaatgttattaaaaagaagggagaaattatcattttatggacaaggtaagaatcttgtgagacattgaaatcaccaggaaattttgcactcagaaatctaatctgtctggctgggcgcagtggctcatgcctgtaatcccaatactttgggacgctgaggcaggtggatcacttgagcccaggagtttgggaccagcttgagcaacatggcgaaattctgtctctacaaaaaaatacaaaaattagggccgggcgcagtggctcacgcctgtaatcccagcactttgggaggctgaagcgggcggatcatgaggtcaggagattgagaccatcctggctaacatggtgaaacccaatctctaccaaaaatacaaaacttagccagacgtggtggcatgcacctgcagttccagctagttgggaggctgaggcaggagaatggcatgaacccggggggcagagcttgcagtgagccgagatggcgccactgcattctagcctgggcaacagagcgagactgtcttaaaaaaaaaaaagaaaaaaaatacaaaaattagccaggcgtggtggtgcaggcctgtggtcccagctacttgggaggctgaggcaggaggatcacttgagcctgggaggcgaaggttgtactccagcctgggtgacagagcaaaactctgtctcaaaaaaaaaaaaaaaaacctaaagttacctagccaggcatggtggcaggcacctgtagtcccagctactcagaaggctgaggcaggagaatggccgtgaacctgggaggcggagcttgcagtgagctgagatcacgccactgccctccagcctgggtgacagtgcgagactccctctggaaaaaaagaaaagaaaacctaaagatatctaatctgtcatgtcttcatagctttatcatcctaaaataaggaaaatgaggacttcaaaagtggccaaaggtagttgaagatacattctagagtacagacctgctgtactgttgtacaatctagaacagtggctcttaaccagaggtgtgcagtaataccatggatatagcttttcacttcgaaaagctctattgtgaagttaaaaaaagaaaagtgaagtgaaaaaaagttaaaaagtgaagggaaaaagtgtgttttaacttcactgtttaaattaaaaacttacttcatttggaaggaactgctgtaagcacatcttagaaggaatgacaagtgatgaaacacagcaaaaaatcgagtgttggtataggttggtgctgcaaaaccacaattacttttgcagcaacctaatagtttgatttttcctccagattagaagtttacagttttgtaaaccggttgtacttttgagggtttttgtttgtttgtttgtttgtttgtttgtttgagtttcactcttgttgcccagactcgagtgcaatggtaccatcttggctcactgcaacctctgcctcccgggttcaagtgattctcctgcctcagcctcccgagtagctggaattacaagggcacacccagctaattttgtatttttagtagagacagggtttctccgtgttggtcaggctggattgtaggtaggaagtactggattacaggcatgagatgctgtgcctgtacacttttgagttttatatgaactgtttaagaaaatcaagaccccattcagatgtaaaagtaaccagttatgaatcattggactagaggtagatatacttgactagaatgctgaatgagagaagctgagttttgtgaaaactggtgatcagttttgttaattccacagtcctcaaatccccattgcaggtaactttgcagatggcagtataatatctcagcaattgtattaatacccatttggtcagagtatgtagaaaaagcagaggtctgggaattagaagataggattctattttagttctggttcttctgcttattatgtctgtgaccatctttgggccctaagttttttagtgtatacattaaaggtagaattaaaaagaaatactttaattttgtcattaagaaaatcagtagatttgttatagaatacatatgaactcagaacaaaatcatctaaatcttatttctcagagacacccattgtccatattttggtatatacacttttcctttttcctatgggtttaaatttccctggttggtggacttcaaggcagtgggatttttattacctttctaatacagtgtactaaaactaaatacaattttttcctcctcagaaatgatgaccgggaaattttattggagtgtcagaaaagagggccatcatttaaaacatttgcatatttagccgccaagttggataaaaatccaaatcaggtaactacccaatttttacatctctattggttcacagatgttgctactctaaatacttaagatttaggctaggtgtggtaactcacagctataatcccagcacagccaaggtgggaggatcccttgaagccaggagttcgagaccatccgggcaacaaggtaagacttctgcctctacagaaaaattttaaaaaattagtgggtgctgtcgtgtgcacctgtggtctcagctcggaaggctgaggagggaggatcgcttgagcccaggagatcaaggccaccctggccaatatagtgagaccatgtctctacaaaaaacaaaaaaaatagcaggacatggtgacatgcacctgtagtcccagctactcgggaggctgaggcaaattgatcacttgagcccaggaggttgaggctacagtgagctgtgatcatgcaactgcacaccagcttgagacagagtgagaccctgtttcagacaaaagtaaataaataaatgtttagattgaattttttttctttttgaattaaagttagtttcattcagtcttttttttttggaaacagagtcttgctttgttgaccttactggagtgcaatggcgtgatcttggctcactgcagccgccacctcctgggttcaagtgattcttgtgcttaagccacccgagtatctgggattacaggtgtgtgccaccacacccagctaattttttgtatgtttagtagattactagagaggcggagttttgctgtgttggccaggctggtcttgaactctgggtctcatgtgatctgctcacctcggcctcccaaagtgctgggattacaggcgtgaaaaaaatgttttaagagatggagtcaggccaggcgcgatggctcacgcctgtaatcccagcactttgggaggccgaggagggcagatcacaaggtcaggagattgagaccatcctggctaacatggtgaaaccccgtctctactaaaaatacaaaaaattagccgggcacagtggcacacctgtaatcccagcactttgggaggccgaggtgggcagatcatttgaggccaggagttctataccagcctggccaacatggtgaaaccccatctctacaaaaaatacaaaaattagctaggcatggtggcacgtgtctgtaatcccagctacttgggagactgaggcatgagaatcgcttgaacctgggaggtggaggttgcggtgagccaagattgcgccactacactccagcctgaaagagtgagactctgcctctcagaaagaaaagaaaaaaaaaacaaaaacttgatttggacatagagcgcagtgctagtgaaatcttcaaaatatgtgtagtagtttactatgatgttaaatttcttttgtttgttctgagacggagtctcactctgtcgcccgggctggagtgcagccgcatgatcgcagctcactgcaacttctgcctctcgggttcaagtgattatgacgttaaatttctacttatataattcagaatgttgccgggtgcagtggctcatgcctgtaatccgagcactttgggaggctaaggtgggcaggtcacctgagttcaggagttcgagaccagcccagccaacatgatgatacttcatttctaccaaaattacaaaaattagctgggtatggtggaacgtgcctgtaatcccagctacttgggagcctgaggcaggagaatcacttgaacaaaacacaacagaatactgtaagcttgaataatggggaatttggagaagaagcttattctaaagaacttttttttaaaaagctctgggcaaaagtggcttgattatttattagattaactgtgctttttaagatttttgctgcctttaagaaattaaatcgtttcttttttttaccttaatgttatattaaagtatgatttccgttctcttgtgaagagaatgtaaattcttttaaacagagatggggtttcgctgtgttgcccaggctggtctcgaactcctggattcaagcgatccatctgccttggcctcccaaagtgctcagattacaggcgtaagctactgcacctggccaaaaatctaaaaccatttaatgaatttgatatttgagatttctttgcttgcaggatagcacatattgtgggttatttcattcgtagcttgcctcttaactgattttttttccccacaagtactgtagtcctattaaatttttgtcaatatcaagtataatgatagttaccaaactgattgcaaaagctaggtttttttttaaattttgagaccaattggaagatgagaaagctagtttattaaacaccaatatcgtctaaatggagctcatttaagataacacattatgagatagtcctatcagaaaaatagaataataactttagcattttcttacattacagataagttgctgaattcctgggactcttaactgatattgcatactacacagaagcttcaaattcctcatgttttaaatgagcactagagggaggtttatcacctttttggttaccagatgataatctatatttgttattactcagtgactctctaatttcacatcagcatgttcagcttgtgctagtcatcattctgatttgcttatctgtttttggtcaaaatatttatttttaaacatgttagaacttaccaaaatgaaagcaacagtgatgtattgaaatcttagttttgatattttaaagaaatgactttctagattaaaaaaatagttttgtagcattttaaacttagtgactatttagttcaattgttcatccattttttatttgcttttataattgcctccttgttttggtatattgtaaaataatttaaataatgtatttataaatatgtataattatgatgtaaaataccgtgtgtatatgtatgtatgtgtgtttctgtatatgcacacacataaacggctttgcctagccaaggattttttttatctgtataaaactttttgtataaagtttgctttcaataacagtaatgtataataaaaccatgtaaagttttgttgtattttgattcgaatgtttcttttacttttattgtgtttaggtaataatttaaaaaatcaaaagaggtaaaagtcctaggggacgtagggtgcaattttgaagtggttcctggttggggtgtggctggctgaatggttctgagtagattgagaaaactgattgctgttgcctgccttctcacagcaagtactagaacggtgaaccatatctctgctgcaggtgtcctcacagataaaattagagtagcacaagagctttttgggtgaagctttggagaaaacaggtgtaaggattgattagcttgggcattacttcttcacccttcagccttcagactcacagaacttctcagttaataatctaggccctagactctaggaagtgcctcttctcattgccatttttctcagggtgtccaaaggaagaagccctgtcctaaaagattacacattgaaataaatagcagtggttttgtagtgctagggctctccaacatggggcttgtccccttccctctctttgaacccttaataccaactagagggttggccatcagtccttctgcagtgcatactctcactcagaagatctcataccaccaggtaagtgagttcacaaacaatatgataaccgaaagatactactggttcaaaagaaaactggattacataagactttcagaatctaaaatgaaactaataaacattaaaagatgttagcaacgtgatacaggaaataatgaaacatttaaagtaaataacataataaatggagtaaaaggatagaggccaggtgtggtggctcatgcctgtaatcccagcactttgggaggccgaggcaggtggatcatgaggtcaggagttcaagaccaagcctgcaagatggtgtaaccctgtctctactaaaaataccaaaattagctgggcatggtggtgggtgcctgtattcctagctacccgggaggctgaggcagagaattgaacccgggaggtggaggttgcagtgagccaagatcacaccactgtgctccagcctgggtaacagagcgagactcaaaaaaaaaaaagggtagatacaggtgcagaataaactagttggaaaatcaggctgagaaaccaccagaaggaagcaagaaaaagaatacaggaaatatgaaagcggatttaagcaagatggaagccagaagtaggtgtgccaacattcaggtaagaggcctagaaggaggaaaaaaatagagattgaaagggccatagggtgccaaatgagagacatactgaaattgaagagtatcaaggtaacgagaaaaatctaaaagcttttagagtaaatgtataaaggaacaagaataagattgacttcagtcttctcaagtgcaatactgggtgcaggaaaataatgtcatatttaaagtaccggacttaaagttttagtctatctaaatttgtcattcacatgtgaggaattaataaaaacattaagatttaccaaagatctctatccaaaggaaaagaagtcactttatcagaaagacacacacgtttattgcagcacaattcacagttgcaaagacatagaatgaacctaagtgtccataaattgatgagtggatagagaatgtggtatacatatatcatggagtgctactcagctgcacaaaaagaataatgtcttttgcagcaacttgtattgaactggaggctgttctaagtgaagtaactcaggaattgaaaaccagataacattcaggtgtggtggctcacgcctgtaatcccagcaatttgggagggtgaggcgggcagatcacctgaggtcaggagtttgagaccagcctggccaacgtggcaaaacgctgtctctactgaaaatacaaaaattagccgggtgtggtggcgggcgcctgtcatcccagctactcaggtggctgaggcagggagaattacttgaacctggaaggcggaggttgcagtgagccaagactgtgccattgcactccagcctgggcaacaaagcgagactccgtatcaaaaagcaaacacaaaaaaacccagatacccctttctgcttccactgccaccatggcactcatgaaaaagcttgtggcaaagcagggcagaaaacaaaaaagaagcaggtttctgaagtttactcttaattgcacccactgtagaagatggaatcatggatgctgctaattttgagcagtttttgcaagaggggatcaaagtgaatggaaaagctgggaatctaggtggaggaccaagagcaagatcaccatgacttctgaggtgactttttcctaaaggtatttgaaatatctcacaaaaaaattttgaagaagaataatctgtgtgattggttgcacgtagttgctaacagcgaagaaagttatgaattacgttacttccaaattagccaggacaaataggaggaagatgaggattaaaattcatttatctggaatattttgtatgagtttgtgaataaaacttgggaaccagaggaaaaaaaaaccagataccacatgttctcgcttataaatgggtatgcaaaggcatacagagtggtataacagagattggagactcagaaggtggaacagggaagggatgaaaaactacatattgaatacaatgtttgcgacttgggtgactggtgcactagaatactagacttcagcactgtgcagttcatccatgtaactgaaaaccacttgtacctctaaaggtactgaaaaatttttttaaaaaatgaaaaaaagatttgctgggccgtgtggggtggctcacgcctgtaatcccagttctttgggaggctgaggtgggcggatcactaggtcaagagatcaagaccatcctggccgacatggtgaaaccccatctctactaaaaatacaaaaattagctgggtgtggtggtgcacgcctgtaatcccagctactcaggaggctgaggcaagagaatcacgtgaaccctggaggcagaggttgcggtgagccgagatagggccactgcactccagcctggtgacagagcaagactccgtctcaagaaaaaaaaaaaaaaaagatttgccaatgattcgcattgaaaattttggaaaaaatactcaaaaagtccagaagatactacaaaatctgtggggataacagtgttcagataccttggtaagatgtgtatagggggagaaagatttttttagaaagcaataaaccagaattataattttagacagtatcaacataatggcgagtagaggagatcaaggaagtatacaaatgttacagttcttgccttgttaggaagaaggtatagacataaaaatgccacacttaaaattgaggtatggcattcacgtagaaaagtgcatgaaagaaatagttttcacaaagtaaacacttgtgtaacagcacccagatcaagaattagaacattaccagccctccagagtgccccccattcctagtaatagtccttccttctccctagggacaaacattatcagaacactgtctctgatttatattatcatagattagttttgcttgtctttgaactttcaaatggaattataactgtagatactatttggcttatttcattaagcaatatgtgaggttcatgcctgtgttgagtatagcaatactaaattctttctcactactgtatgtatttcaattgaaccacaatttatctatcctactgtcatagacatttgtgttctagttcagaactgttagaaataatgccattggctgggcgcagtgactcatgcctgtaatcccagcactttgggaggccgaggcgggcagatcacgaggtcaggagatcgagaccatcctggctaacacggtgaaaccctgtctctactaaaaatacaaaaacaaaaaattagccgggtgtggtggcaggcgcctgtagtcccagctacttgggaggctgaggcaggtgaattgcttgagatggactttagctcttgttgcccaggctggagtgcagtggcgtgatcttggctcactgcaaactccacctcccaggttcaacaaattctcctgcctcagcctcccaagtagctgggattacaggcacccgccaccatacctggctaatttttttgtatttttagcagagacggggtttctccatgttagccaggctggtctcaaacttcagacctcaggtgatcctcccacctcggactcccaaagtgctgggattacaggcaggcatgagccaccacattcagacttttttttgtatttttagtagagacagtgtttcaccatgttggccaggctggtctcaaactcctggcctcaaatgatccacccaccttggcctcccaaagtgctgagattataggcatgagccactatgtctggcctattttattttattatttatttatttactttttttttttttttttttttgagacaaggtctcactttgttgcccaggctagagtgcaattgtgcagtcactggtcactgcagcctcgacctcttgggttcaagtggtcctttcacctcagcctcccaagaagctgggactgcaggcgcacaccaccatacccagctaatttttgtgtattttgtagagagaaggttttgcagtgttgctcaggctggtcttgaactcctaagctcaagcaatccccctcctatcctcccaaagtgttgggattacaggcgtgagccactgtgcccagcctaccactttttatttaaccattcagtggacatttgggttgtttccacatttaggctactgtggagtattatgaacacagctgttcatatttgggcccctgctttctgttctgtactcatttatttaattttacttttttaccagcttctacatcaagaacacaaagcttggcagggtgcactggctcatgcctgtaatcccagcactttgggaggcctaggcaggatgatcacttgaacccaggagttcaagaccagcctgggcaacatagtgggaatctgtctcttaaaaaaaaaaaaaaaaaaaaaaaaaattagccagacgtggtggtggcaccggagtgtggtggcacactcctgtggtcccagctactcaggaggttgaagtgggaggattgcttggacttgggaagtcaaggctccagggagccatgattctgccagtgcactccagcctgggagagagtgtgagaccgtcttagaaaaaaaaaggaaaaaatgtatactgtttatcagcttacaaaagtttctttctaggctgggcgcgatggctcacgcctgtaatcccagcactttgggaggccaaggcgggtgcatcacttgaggtcaagagttcgagaccagcctgaccaacatggtgaaaccctgtctctactaaaaatacaaaaattagctgggcgtggtggcatacacctgtaatcccagctccttgggaggctgaggctggagaatcgcttgaacctgggaggcagaggttgcaatgagccaagattgtgccactgcactctagcctgggtgacagagtgagagattccatctcaaaaaaaaaaaaaaaaaaaagtacctcctttatttattttctcctttattaaatgtggtaaattaaatcattaaaaaaattaaaccttgcagtttcagaataaactttacttttatttcattttttcttaaaactccttgtcaacacaataataaacccaactttaaagtaatgtattatatcctttttaaatatattgttggatttagtttactatactgtttgtttaggatattctgtttgtgtgtgtgtgtgtgtgtgtgtgtgaaattggcttacatttctttctttctttttttttttttttttgagatgaagtctcactgtgtcacccaggctggagtgcagcgacgcgatcttgctcactgctgcaacctctgccccctgggttcaagcgattctcctgcctcagcctcctgagtagctgggtttacaggcacctgttaccgcacccggctaatttttgtatttttttagtagagacagggcttcaccatcttggcgaggctagtcttgaactcatgacctcatgatccacccaccttggcctcccaaagtgctgggattacaggtgtgagccactgtgcctggcccatttttttctttcttaatgtcttgtaaggttttggtatccaagttatgctgactctgtaaagtgaattggaatgtgttccctctttttaaattcttgaaaagttacatgataagatcagtgaaaaacgtgagcataagcccattgctgagcttattctcctgtgaaatctgtttcttgaacagaaaatgtgtacaatgccataatggcgaataagtattccattaggctgtgcttggtggtgctgacaaaagcattaaggtcagggaggtaaatccatacttggagaatacgtctctcccagtgaaaacaaattacattcccctccatggatagggtcagtctgatgtaagaaacctgctagtaggtagttggctagtccatattgggacttaactttgactttgttcttgacatgctaagccttccacaatggaggcacccaggtcagctctggtgagtggaaatccatgtcgctgagcccatagccttctttctcaccaccatggtgattttgtttatgggtccattgagcaagcactggatttgcaagggaaagacacagactgacatccccagaatgtattattttgttcatttcactattgagattctcttctacagtaggtgtctttggtgaacactgacataaaacacaaatatcttcacattttgtctctaatcctagaagtcccttcacgatacttttttcttagaccttgtcacattttgttttttccaagtcttaaaccatccagccaaacctttaaccacttcccttgaatgtacatcctatgtctggccctttcccactccagttgaagaagacaatcatatatgctgctcaaagttctacctcccaggagaatttcccttcaacattatctcctggttggcattgtaacattgcagcagtctatttctggcctttgctggcacatcagtcagaaacatctggaaaataggcccaaatattttttctcccccccagttaaccggtcataaggaacttcatatgaggctctaggtgttgactgagtgagaaaagaagcaggtacagtattgggtatcagaggaatctgcttatgcaactaatacaccttccagacctgcttcagcctgatgttttatataacatttacacttattgatgtattgctgctgtgtgtgcccaaccttatggtggcatggatcagataatacccagttcattctggatatctcaggtcacctggtcacttgacgtaccatggtcaggcattcagtctctaacagggcatagctatgctccagaatgctgaagctctgcactgtgattcttttattaaggcttgctagagcctccatgtgacatattgtattaatcagttctcatgctgctgataaagatatacccaagactgggtaatttataaagaaaaagaggtttagtggactcacagttccacatgactggggaggcctcacaatcatggtggcaggccggagagcttgtgcaggggtactcccatttacaacaccattagatctcatgagacttattaactaccacaagaacactatgggggggaaaccatcccatgattcgattatctccacacggccccaccctggacacctggggattatttcaatacaaggtgagatttgggtggggacacagccaaaccatatcacatatttattagctaaagtttctttgaattcatctaatttgctgggattttgcacactcttgcactgcagactgaacttactgcagagttttttctttctctgtttcccaggaaaatctcacagccttacaggttattcatttaatggaccagagtagcatatcaaatgacttccataattcacaaaggcttatcaagcattgcacctttttttttgtatggtgttggtggtagtggtagttatagtgcaagggatagaaactactttcacttggggaggactggatctctagaaactttgctgaagtggcaggtcccttaatttttgtggggcttgtattctaccctgtggcctgcatttgtcttcttactaaaatatcgacagtacttttctcttgctcatcaggtctaatcagcattatgttatcaatgtagtgacccagtatgatattctgggggttatcaagctcatctagacctctgtggcctagattatggcagagaacaggaaaattgatgaagcccttaggcaagatggtgaaagatgtattgttgaccctgccagataaaagcaaattgttggaggttggcagcatacattctaacactccagggccttataaaaatcaagaaagtagccattctcagatgtcaggcctgctcagctcatggaagcttagaattaaaaaaatatatatatatgtacatatatatatttcataaaaatatatattcctataaacaacatatagaattgagagttttaaatttatgagagtattccaaagtatgttttgttctgtgatgtcctttattcactcagatttctttttattcaaatggagttttgctcttgttgcgcaggctggagtgtgtgcgatctgggctcactgcaacctccacctcccaggttcaagcaattctcctgcctcaacctcccaagtagctgggattacaggcatgtgccaccacccctggctaattttttgtaatttttagtagagacgggggttcaccatgttggtcaggctggtctccaactcctgacctcaggtgatccacctgcctcagcctcccaaattgctgggattacaggtgtgagctactgcgcccagtcactaagaatatttttgaaatttatgttaatacagactcattcactttgttttgttctgagacggagtcttactctgtcgcccaggctggagtgcagtggcgcgatctccgctcactgcaagctctgcctcccaggttcacgccattctcctgtctcagcctcccaagtagctgggactacaggcacctgccaccacgcccagctagtttttttgtattttttagtagagacggggtttcgctgtttgccagtatggtcttgatctcccaacctcgtgatccgcccacctcggcctcccaacgtgttggggttacaggggtgagccacgacgcccggcatttttttttttttttttgagacggagtcttgatcagtcgcccagcctggagtgcagtggcgtgatctcggttcactgcaagctctgcctcccgtgttcacgccattctcctgcctcagcctcccgagtagctggaactacaggcgcccgccaccacacccggctaatttttttgtattattagtaaagacggggtttcaccatgttagctaggatggtctcgatctcctgacctcgtgatccacccaccttggcctcccaaagtcctgggattacaggcgtgagccaccgcgcccggcccactttgttttctttttaaggcaaatgacttctgttaatatttgcaaattgatatagagaaaaagcatttgccatgtgaatggctgcatactgtgtgacaagactaattcgatttcttccattaaagataccacatctggagcagtaactgcaattggagtcagtgcatgattaaggtgataattttctaagatctattattctttttctgtacaaaggatgagataggtagtaccatgcagcacatttagtgtcttttttctttttgagacagggtctcactctgttgcccaggccccaggctgaagagcaatggcatgaccttggctcactgcaacctctgcttccccggttcaagcagttttcgtgtctcacccacccaagtagctgggattacaggcatgcgccaccatacgtggctacgttttgtatttttagtagagatggggtttcaccatgttgcccaggctcgtctggaactcctggcctggagtgatccacccgactcagccttccaaaatgctggccccttgaaaagggccactgtgctcagccgctttcaagactttaatctctgcaattgcactaatctctgcaattgccctgaggatgaagtattgtttttttgtgggggaatttaaatcttccatccaactctttcctctattatgtcctatctcctctgtgttatttcctctcctcttctttaatttcttttaggttgattatttttaattcaattttacctctcttaactttattgttctctgagagattacacatgcatcctttacttatcaatgtttaagagattacacatgcatcctttgcttatcaatgtttaatattctgactctgacaaaatgcattcaatgtattacattcattacttttcaggtgactttttacctaatactatacaaatacagttattaatacatcatatgtttttacctctagttaattctgacagataatttgtactttgggctgatgtgccaggctagtggaagtttaatgtcacctgtctacctttcattatcatccttttttaaaaactaaatgaccaaaaatagaataggcagatgataacgatgaactatcagtaattttatgcacttctacattttatatggaaaagagcaggcttagaaatgtgcctcagagctgtgatctgaaaccctcattgggttctagtgatgcccttgcggtcaacacctcttaagatggcaagaagattatatgcttgagatgtgactagcgaaagatgctgcacactgagagtttggagacctggtctatcagcattgggcaagtcgtttgacctctctggaattctcattctttctctacaaaaatcagacctaggtttctaaggctactactggcttccagattctctatttagaaagaaaaatattttcttgagccatatgttttgacctaatagaatattgctacaacaagaatggtgatgcacacctgtagtcccagctactcaggaggttgaggtaagaggatcacttgagcccaggagttggagtccagcttgggcaacagagcaagaccctatctttaaaatactagtactactactactactactactaatagaatatcggcacagaaatggacggcatgctgtggcggggctggtgcaagatgccgctgcgggttcaggtgtttaatttgcagtaggggctgggcgcggtggctcatacctgtaatcccagcattttgggaggctgaggagggcagatcacttgaggccaggagttggagagcagcctggccaacatggtgaaaccccgtctctactaaaaatacaaaaattagccgggcatgatggcgcatgcttgtaatcccagctactcaggaggctgaggcaggagaatcgcttgaacccaggaggcagaggttgcagtgagccgagatggcgccactgcaccccagcctgagcgacagaggaagactccacctcatttaaaaaaaaaatacatacatacacacacacacacacacacacacacacacacacacacacacacacacacacacacacacatttgctgtaggtgttacctcctcctgcctggcatggccaggaacttaatcttgagctccagcctgtcgtcctgtacgctactctgaggaggcggctgtggagcccatgcaagtcgacaaggacctcccggaggacctgcagaatgcacccgacatcaactacttggtggacgccaccctggaactggagcagtgcgttgccagttgcagcggcctgatgtgcactgagcggctgcagtttattgctgactgactactgccccttgctgcgggtggatgccctgaatatggcgctctccttcctgcagagaatctttaacgtggacctgtacgaagaggtccaccggaagctctcgaagaggtccacctgaagctctcggaggccaccaggaatctgaggaactcacccgacgccatccttgagagtggcgtggagcccccgtccctggacacggcctgggtggaggccactcagaaagaggccctgcttaagctggagaagccggacgcagacctgaagaactacaagcgcaactccaccaaggagcgcaccaggcgcggccatgatgattcagcaatgccctcaagtgtcactcacggcctgagactactgcagcagcgccaagcacgccatcaacatgtcctcaacgtcttcaaggtcagcgtctacttgcaaaattggccttacgtgctgagccgcgtcagcaaggccgagtccaccctggagattgcctagcagcgaggacagaggggcagccagccaggcgcaggcggtcctcacccagcttcaatgcgctggaggcttggcagagctggtcgcgaggaagtacaagcaggctgccaaatgcttcctgctggcttcgtttgatcactgtgacgtcccccagctgctgtcccccagcaacgtggccgtctgtgggggcctatgcgccttggccaccttcgaccggcagaagctgcagcgccgcctcatctccagcagctccttcaagttgttcttggagctggagccgcaggttggagacatcgtcttctaattccacgagtccaagcgtgcctcgtgtctgaagatgctggacgatgcctcgtgtctgaagatgctgcacctttagccttgaggccaggagtttgagaccagttgggtcaacatggcgaaatcccgtctctactaaaaaatacaaaaattagctgggcgtggtggtgcctgcctgtaatcacagctactccggaggctcagggaagagaattgcctgagcgtgagagacagagtttgcagtgagtcgagatcgcgccgctgcactctagcctgggagaaaaagagagactctgtctacacacacacacacacacacacacacacacacacacacacacaaaggaggagatgtaggacgacctgctcttggacatgtgtacctcccccacccccactccctcaccgccccaccgtcaggaccctgtacgcccagattcgcaactctgccctcaactcgcacagggtggccgtgcccttagccccgctgtggcagcccgggagggtgagctgacgcagcaagtccgggaggggctgacgcgcccgcgtggactcgcacagcaagatcctggacgcccgggatgtggatcagcgcaagcaccaccttcgagaagtctctgcggatcggcagggagtttcagcaccgcgccaaaggccggatgctgagggtagctgtgctgcgcaaccagatccacgtgaaatcccttccagagaagggagcccggggagcgactccggccaacagccagtcccggtggacaccagcttcttaggggtcagcctccaggacgtctgcacaccctcccgccccaacggacctgttcacttcgaggcagctctgtgccacccgcggcccagtggagagcctggctgtgtgccctagcaccccgtgtgccctcgcaccccatgtgccctgtgctggggcctgggaggcaggcggctgctagccatcctggaaggcggggcctgtagggcttgaccgcgtgggtgtctgtacctaggaagcaggctgtgcagcgcctagggggcaccacctcctggaaccctcctattccaaggagggagaggggaaggggaggggaggggaagggagaagaggaggaagaggaagaggcagaataagaagaggaggagggagagaggaggagagggaggtttatttttttcttttttttcgaggcggagtcttgctctgttgcccaggttggagtgcagtgtcgcgatctgggctcactgcagcctccacctcctgggctcaagtgatcctcccacctcagcctcccgagtagctggaactgcaggtgcacaacaccatgcccagcgaatttttgtgttgttttgcagagatggggttttgcagtgttgctcaggctagtctcgagctcctgggctcaagtaacctgcttgaggcctcccaaagtgctgggattacaggaatgagccaccacgtactggtcttttttcttttctttctttcttttttttttttttttttttttttgagacagagtcttgctctgtcaccaaggctggaacgcgatggtgcaatcatagcactgcaaccttgaactcccgggttaaagttgtcttccctcctcagcctcccgagtagctaagactacaggcatgcaccacaatcctttgttaatttttttttttttttgtaaggactggggtctcactatgttactcaggctggtctccaactcctagcctcaagcaatccttctgccttggcctcccaaagtgctgatattataggcatgaaccaccacacccgaccctaaaaatgtttattctctttttgagatgtttcttctttcagcatggcatgatttgcagtaacactttaggtttgattgccactccattactatttgttcacatttatgaggccacactcaccccaggcagttgtttatgaaatcggacatgactcattgatctgtgagcatcgattcctagaacaatcaacagactgaaagaaatgcacccaaacttaaatcactgtatgcattcaccaacgcaaaaggaaaattctcatttgtttcacttttcatttccaaatatgatataccaggagaggtcccagcttggtatcaattagaaaaaaatactgtaagaaaattgcaaagcaccagaggacattttgaaccttgggggaggactaggttagactccattgatcaaaataactgtgctcattctggattagggccccacagccacctgatcagagcctttatatctgcaaccagcagcaatttttccactaatgagccacacacggtgcaactttgaggttctgcgaacccaatcgtgatttttttgttcactcataaggtaagtagtaaatatgtggactctcttgtttatgagaaatatatagaaaatccttgtgggtatagaaaacaagatctgaaataatatgcagaaaagggccatcagcattttacataggatatgctaaatttgtatttgataataaaagaaaattcagtaatatttctaagacccacattcatttaatggtaaaaagtagttatttttagaaaacggactagttgtctaaaggacaaaatgtcttgtattctagtatgtaagattgtatttttgtttttcgtataggctaagctcggttttcctttccttgctatttaaaaataataatttccacattttaaagagatagtggcaaaaagaagtattatatagtttagtactgccaaataggaataagattgacataagttagctttcccacctcagggtttttatataaaatagaagctatagattttttttaagtgctaaaggaatcctttattttttttccggatctctacctgcagaggaaatccctttttaaaataaagaataatgaccagaaagttttaagagaataattatgggaaaagaccaaaactttaagacaggatagaacttagtaaattattgcttttggttaatgaggtctgagtcctcattttaatatctaatttttatttgcaagtaatataaatgactgcattcttaatttttgaatctcaaacaattcacaagtatatagagtaaattataaaagtctcattaatacctcttccaaattctgagaggtatctaccactttttcaatttcattaaaaaattatttatatttatatacgtacatacaggtaaaaatgtacataaacatacacttttgataaaaatcacttatgctttcttagaagtcttttttcctttcctttctctttttagcctctcttttttccaccttaacttcccgtccactctcatcaccttcaacagctcaggtaacctatattaaattcctggtgtgtatccttctgcatttttttctccatgctcaattaaatcacatacatatatatctcatatacacatgcatacatatacatgtacatttatagaattttgttttactgagtgatttacaattccacactgaatctttggattaatttgggaagaattgacatctttacctatattgcaattttcaatccctgagcatggtatatcaccattaaattaaattaatttatatagtggtgtgtttgtgtgtgtgtgtgtgtgtgtgtgtgtgtatttggcattgtcaactattccccttcttgaaactctggctttgggctttggtttcagagacagcaccctcatgattttcctcctctttctccttggccatttctcatatttatttgtagattcttttgtggggaaaagaaagagatcagattgttactgtgtctgtgtagaaagaaatagacataagagactccattttgttctgtactaagaaaaattcttctgccttgagatgctgttaatctgtaaccctacccccaaccctgtgctccctaaaacatgtgcagtgtcaactcagagttaaatggattaagggctgtgcagggtgtgctttgttaaacaaatgcttgaaggcagcatgcttgttaagagtcatcaccactccctaatcttaagtacccagagacacaaaacacttcggaaggcctcaaggacctctgccgaggaaagccaggtattgtccaaggtttctccccatgtgatagtctgaaatatggcctcgtgggaagggaaagacctgaccgtcccccagcccgacacctgtaaagggtctgtgctgaggaggattagtaaaagaggaaggaacgcctctttgcagttgagataagaggaaggcttctgtctcctgctcgtccctgggcaatggaatgtgtcggtgtaaagccgattgtatctactgagataggggaaaaccgccttagggctggaggtgggacatgctggcagcaatactgctctttaaggcattaagatgtttatgtatatgcacatcaaaagcacagcacttttttctttaccttgtttatgatgcagagacatttgttcacgtgtttaccttctgacctcctctccactattaacctattatcctgccatgcccgataatgatcaataaatactaagggaactcagaggccggtgctggcgtggatcctccgtatgctgaatgccggtcccctgggcccctttttctttctctatactttgtctctgtgtctctttcttttccaagtctctccttccacctaacgagaaacacccacaggtgtggaggggcaacccaccccttcactctttcttcctctatattagtctcagggttctgtcattgtctcactttttctttttgtctctgagggatcttctctacttattcaatgataattcataaatgtttatctcctgtttgtaccatttttgttgtcgttgttctctagacccagataccttctggacagctccacctttgccattcagttttgctggtagaatctgtattttctttttcttttttttttttttttgaggaagggtctcactctgtcacccaggctggagtgcagtagtgtcattatggctccccgcagcctcaaattcctgggctcaagtgatcctcccacatcagcctccctagtagctaggactataggcactcaccatcatgcctggctaactttttacatttattttttgtagagacaggggcctcactatatttcccagcctggtctgcaactcctgggctcaagcagtcctcctgcctccacctcccaaaattctgggattacaggagtgagccaccatgcccagctagaatctggatttttttctaattataatttctggcactaatgtgcttaaaaagccttctacttcaagattacaaaacatattcttttataatttattttaatacttttatggtttacttttttacaattaatattatgttccatctggaatcaattgttgtgtttggagataagttggaaaaaaatctaagaattccaggtttttctctctttttcttttggttgatattcatttttgtattatcagtattgattcattttataggttagtgggagtccttagtgatcaagtactgtgaggtctgggaccaaatatattttgttattgaattcctggcatctagcccaatgcctaagcgatagcaaggtttgatttattttattttattttatttatttttttgaggcagagtcttgctctattgcccaggctggagtacagtggcatgaccttggctcagtgcaacctccgcctcccaggttcaagcgattctcctgcttcagcctcctgagtagctgggattataggcgcacagcaccacacctggctaattttggtatttttagtatagacggggtttcactatgttggccaggctgtgttcaatctcctgacctcatcatccgcccgcctcagcctcccaaagtgttgggattacaggcatgagccactgcgcccagccaatagcaagatgttagcaaatattactgaatgaatgaattatggaaggagagaattgtttcattatctttttttttttgaaacagagtttcactcttttgcccaggctggagtgaagtggcgtgatctcagctcactgcaatctctgccccctgggttcaggtgattctcctgcctcagcctcctgagtagctgggattacaggcgcgtgccaccacaccggctagttttcctatttttagtagagacgggatttcaccatgttggccaggctgatctcgacctcctgacctcaggtgatccacccacctcagcctcccaaagtgctaggattacaggcatgagccaccacgtccagcctcattatctattttaacttaataatactttcctatttttcctctgtatctttcttatctggaagtcttccatatcttagaaagctttaacctactaagtattttaaccttattgaaccttgaaaaacattagtttttcaggataaaccaagtaacctgttcatgtcagctatacctgtattgtttcccagatcctaagcttgctagagaagcagtttatattcacttttcttctaagttagcaaaaattccatgaaaacatgatgttccagatgtggcttaatggatgtaattatgtgttattgctggtattgtttctgtgtctgcctaatctttactgctaccctgatatgagccagttcctgagggtttgactgatttgtattttctttacctatactttgtcttgcagtgaaagccctggataatatatcatgaggatctactttattttgcctattgatggttattttggtgatagggtcaaggaacagaattttaaagtgaaaagacaattccattgactattatatattgacgccttgtgtgtgcgatgaccaacatgctttagaaagagtctctatctgcaaggggtgtacctttccaggaaggggaacacaaccatcacaaaactcatttaggcacagtcccaggtgattaatattaataatagtgttgtgaggattcaggaaagggaaaaataactacaacttgggatgggtagggaacacttcctgaggaattgagactcctttacgatcatgtcagatgtatggtaagtagcgtatctcatgtggatagaaaaatgaatacaattgtgcaattagaatgaattgtacaaatatggagacctatttgtatactagaataacaggcagctttgtgggggagagtaaaagagaataggaagaagtaaactgctgaaattgtgaggggtatttagtgttttttcaaaaattaatatatttggaaatgtcctattttaagcatgggctataaatattagggctggaagatccttcataattttgctgacatacaaaagaacctgctgtatttttgagcttgtgtctatatattaccaccatgggtgctattaacctcagtgttttctgtatatttcagacattagtctttaaccatgggggactggaacttattgggtggcatcctagaggaagttcactcccactcaaccatagtggggaaaatctggctgaccatcctcttcatcttccgaatgctggtacttcgtgtggctgctgaggatgtctgggatgatgaacagtcagcatttgcctgcaacacccggcagccaggttgcaacaatatctgttatgatgatgcattccctatctctttgatcaggttctgggttttacagatcatctttgtgtcttctccttctttggtctatatgggccatgcactttataggctcagggcctttgagaaagacaggcagaggaaaaagtcacaccttagagcccagatggagaatccagatcttgacttggaggagcagcaaagaatagatagggaactgaggaggttagaggagcagaagaggatccataaagtccctctgaaaggatgtctgctgcgtacttatgtcttacacatcttgaccagatctgtgctggaagtaggattcatgataggccaatatattctctatgggtttcaaatgcaccccctttacaaatgcactcaacctccttgccccaatgcggtggattgctttgtatccaggcccactgagaagacaattttcatgctttttatgcacagcattgcagccatttccttgttactcaatatactggaaatatttcatctaggcatcagaaaaattatgaggacactttataagaaatccagcagtgagggcattgaggatgaaacaggccctccattccatttgaagaaatattctgtggcccagcagtgtatgatttgctcttcattgcctgaaagaatctctccacttcaagctaacaatcaacagcaagtcattcgagttaatgtgccaaagtctaaaaccatgtggcaaatcccacagccaaggcaacttgaagtagacccttccaatgggaaaaaggactggtctgagaaggatcagcatagcggacagctccatgttcacagcccgtgtccctgggctggcagtgctggaaatcagcacctgggacagcaatcagaccattcctcatttggcctgcagaatacaatgtctcagtcctggctaggtacaactacggctcctagaaactgtccatcctttgcagtaggaacctgggagcagtcccaggacccagaaccctcaggtgagcctctcacagatcttcatagtcactgcagagacagtgaaggcagcatgagagagagtggggtctggatagacagatctcgcccaggcagtcgcaaggccagctttctgtccagattgttgtctgaaaagcgacatctgcacagtgactcaggaagctctggttctcggaatagctcctgcttggattttcctcactgggaaaacagcccctcacctctgccttcagtcactgggcacagaacatcaatggtaagacaggcagccctaccgatcatggaactatcacaagagctgttccattctggatgctttctttttcctttctttcttcctggggtgtgtatgtatgtttgtgttgacagagaggcagatggagggggagattatttatggagagataaaattattcattcgatacattcagttaaattcaattcataaaatagacttagaaaaatcttattatatcaatcgctcttataagtgctgggcatgtaaatgggtaaaatacagtctctgacatcaaaggactcaggatgtaggagtaaaatttaggcaggtaaaatgtaaatatatcaagtgtaaggcgtcacgttagtgggaatgagtgagcaaaggagggagtgatcatatggatgggtcaggaaaagttcatagttgaagttaccttgagctgaatcttgaaagatgtggcaagtttttccaaaaccggaaggactggggcacatgaaagaagctgtcctggtagagggagcagtgcaggtaaagcctaagagtgagacatagcagtgctgtctgaggagctgtgtgtggctggagcacagggtggtaggagggtgcagagggagggaaggctggagaagtgggcatggaggccctgtagggaagccatagagaactgacggaggatgtggagcagaggagggactggatcagagttgcagtttagaaagtccttctgtcacagtgtggaaaacagtccagaggagggatcatttgtaacttgagttgccctcatctcactaaaaaaggagtgtgtacttcattcttttaatacttttgacatttcaaagtcatatacaaatatttggtgatatattttacaaagacaagaatcaatattgtatgattttaattttgttctctgaaaaatcactgtgggattaaacatttcttacccattataaacatgaaatggatatttactgtggattcttctcaattctggaacaaaggacgacacttgattactcactgctcccaatagtcaactgtttccattaaaaagaaaattcccccaaggttggtgggagagcttctgagttgagctcacctgcttgtttcttcctttgttccactttttgtgttgataattactgaatccctctaccctagttttacatctcctgtgggtttagatactgatgttactgtactacagacataccatgaattcaaatcaacctacttggatttttactaaaatacttctctcaaactgatattcatttcttgtcagtgaccagccatttatttaggagactgtttaggatcaatgcatgggtgcttagaaacctatgccaaactagagcagggttcttaacccttgccatacattacagtcatctgggaggcttaaaagccatcatgcccgggacccatccaattctaattaaaccagaatctctgtgggtgggatgcatgcatgaatatttttcaaactcccatggtgagtgcaatgtgcagccagggttaagaaccactgttttagaataacttgaggccaggcatggtggctcatgcctgtaatcccagtactttgggaggtcgaggcaggtgaatcacttgagctcaagacttcaagaccagccggggcaacatgatgaaaccctgtttctcaaaaaaaaaaaaaaaaaaatacaaagattagccaggtgtggttatgcatgcctgtagtcccagctacttgggaggatcacttgagcctggaaggttgaggctgcagtgagccatgatcatgccactgcactccagcttgggctacagactgagaccctgtctctaaaaaataaaaataaataaataaaatagaattatttggccagtggcagctacttctttttttaaaaatttcctttctttcggacaagtgtggtggctcacgcctgtaatctcagcactttgggaggccgaggc

SEQ ID NO: 443 - DNA, 24541 bp, Homo sapiens
gtatgagtttttatacaaaatagttgtttacacgtattcatcttctatttcacttacaagttgtgtaaaaactgcattccgtgccaggcctgaaatgttccaaggctcagttctgtaattaaattgcagcccagatttctacaaaaaaagacataagccaaaggaaaaaaaaattatttcagaacatttatcatttgctgtgagtctaatttacataggatggaacatcacctcaatcctttctctgtgcactaaggcaatctcactgtggaagatactggcttatgatttatactttaatattgcacatgtggtgcattagctacaaaacagtgaacgctcagtaaatacctgtgttaagtgatcttcatttctctagaacaggatttcacaacttcagtaccatcgacattttggactatataactctttgccgtgggggtttgtcttacactctgcaggatgtttagcagcatctctggcctctgcccaccagatgccaggagcacaaccacagttttgtcaagcaaaactgtctctggacattaccaaatgtcacctgagtacaaaatcacaccagttgagaaccactgctctctgatgattcactatgatctgtgtaataattctcacactaatctttgctagagacaaaaaggacttgctatataattttagtacctttctactggtcaaattttaatcatatttcaaaatgaatagcaaagaggtttataattaagttttataaaaattccaaatgtaataaagttatatttgtaacttacgtatactgcaaaaatggtagtgattcaaatgtttgtctttcaatataccgtattttattgcaggatgaatctccaggaaaaataaaaggaaaatattgccttgataagttatcagtgttgactagtatgaataatagcaagagtttagaataatattgaatacacatttttcatctcgactctaaacatttggacctgtagttgaactttccagagcccctaaccctgcctgtacctctcctagagtctcgccttcatacttttaataaataaaatatacaacttaatagactttggaattaatttctcctgagagcagtagacttgattagatgcccttttgtagtctcatcaaatcctagagtatgagctcaaagcttttatctgtatatatagttactaatattaaaacgaatagcctcacatttatacaccttcctagttgaggtttgttttcctaagccagttcagtatcagaagaagtaaaagacatcctttcaacagcatttgaaaggaagttacccctttacttaatacataactttgaactaatattcaaatcatattaatacaattaatttctatcatattaatagaaattcatttttggttttatattgctttaatatttcatgaaagcaatttcttcagttatacagagatggggcttttccctccctctttacctggatggtgtaacgttgtctggctgatgtctccatctctagtctctcccttcctaaactatcctccacacagtcatcatataaactctccagaagtggcttgcaaagaccagcacctcctgggaaattattgaggatgcaaattcttggtcccactctagaccaactgaatccaataactatgagggcggagtccagaactgagttctaacgtgccctctcaatgattgtgatgcagatccatcttacagcactgctgtgataacatggttccccatgatggctccgcagcttggcattcaaagccctagaagatctggctccaatttcctactctccctccttgtaatctacaggtactcatggcattcctcgaatactttcctgtgttttgcccttctcccatttcccttttgcaagtttagaatattgtccccaagatgtctgtccgatgctacacaatggcccttcaaagtcctattcaaatgggattgttctagtaacagcttcctgggtccaaactgaagtcattttcccctcttctatgcttcagaaacaatttatccctcctagtgcccacatccatttcttcttattaatgtagttatttttcatcccattttttctgagcataaactccttgaaagcatggactaggtcttgctcatctgcattgcccaccatgtttaaaactgacacatggaaatagtaaattcaaatatttgtaaaacaaatgaatagctggccgggcacggtggctcatgcctgtaattccagcactttgggaggctgaggcgggtggattacaagatcaggatatcgagaccatcctggctaacaaggcgaaaccccgtctctactaaaaatacaataaattagctgggcgtggcggcgtgtgcctgtagttccagctacttgggaggctgaggcaggagaatggagtgaaccagggaggcagagcttggggtgagccgaaatcgcaccacagcactccagcctgagtgacagagcgagactccatctcaaaaataaataaataaataaataaataaataaataaataaatagctgggggagtgagtagaaggaaaatgattattttaaagcaaatgtagttttattacttcatggcctctgcagcactttggcatccacttgagggtctttacacccactttccttaagcctttcacatttgaaagaatctgtctgcaaaagagcatcactaataaggattaatgacatacacacctctgcggacagaggataagaatcaagctttcatagcaattgaacatagtatcttcttgtctctaaacagacagaaatactatgcaggtatccctttcttggtaacagggctggggagatagttactgtgtaattagtgaagagttaggggcatttctgatatgcttcttactgtaaacatttctagctctaccacttaaccatcattttaaacatctgttttaatataacaattcctgaaatgaaatccttaatactagtctattctcttggtagcttaatattcttgataatattatttctataattcagctgatttcaaatatttaaatgttaatttaattccgattaaattaccaaaaaattctggattaatgatgttcaaatgaatgtaggtggtctatattttcttctcctttaggcaacaatctgacgttaactttaattcctttcatcctactaaaccaactgtttcaaatctttttttgtgaaggtcagacagtaaatattttaaggctttgtgggccacatatgatctctctcacatatttctctttcttttttctttcacagtcctttaaaaatgcaaaaaccattcttaacttaatgggctattaaaaaatagaccttaggttagatttgatctattggctgtagattgaatagaagaagatggtatgtaaacccttagaaaacaaggttcatatgggtgtcagtcactgctcagatcttcttaccatgtgaaattttttctgtcagtattttgtctatacaatttaaaaactgaaaatgcataggacatagcgaatgctagagatgggctgagaccctatacaaacttacagaattgcagaattttattgctggaagaaatcttagagattatctaatttgaacctcttattcattttaaagataatatgactaaaaactcaaaaatatgattaactaacttacaaatactggagggatagcaggccttcaaatgaatccttaggtaattcagtcaaataattttcactgagaattctggaaaatgaaaaagttatttctaggttaaaatgcaaactacaactatttgctacacaggactatctcctgcatgtggaggaaagctgggtcatggtcatttcaagatggtgggatctgctctgctttcgttcaaaccttttcttccattttccttttcgtgtccatccctctccaccaccaccaccacacacacaggcaagcacacacacacacgtgcaagcacacacatatgcaagcacacacacacatgcaagcacacacacacaagcacacacacacaggcaagcacgcacacacacttgcaagcacacacacacacgcacacacacaagcaagcacacacacacatgcaagcacacacacacaagtacacacacacaagcacacacacacgtgcaagcacacacacacaagcacactgctccactcttcccaccaaattgtatctttaatgactcctctctagatcataatatacctttcagaatccaactctgggtggcaccaagatcagcagaacctccatttcctcctctcttttcccaaaccttattacaaaagccccacatgggaccatgtcagggctgcaagtgaagccattcgacttttgtcccccatcaaaaaaatttgagaactacaatgtgcgtaaagtgcacataacataaatgttgtttatctttaatttaatttaacttaatttaatttaatttctgagacagggtctcattctgttacccacactggtctcagactcctggctcaagtgatcctcctgtctctgcctcccgaagtgttgggattgcagacatgagccacctcacctggccaaatattcagtttaataattataaagcagatacccatgtaaacattgttacaaaagattattgctagcatcccagaagccccagtgtgcccctttccaaccatattcctctctctaaccctagtaggtaaccactactctgacttttgtaatgactttcttgcttttaaaatgtagtcctggcctggcgtggtggctcatgcctgtaatcccatcattctggaaagccaaggcacatgaatcacctgaagtcatgagtttgagaccagcctgtccaacatggcgaaactctgtctctactaaaaatagaaaaattagctgggcatggtggcgggcacctgtaattccagctacccaggaggctgaggcaggagaatcccttgaacccgggaggtggaacttgcagtgagccaagatcgcaccattgaactccagcctgggcaacaagaacaaaattccatctcaaaaaataaataaagcaattctcctgcctcagcttcccaaatagatgggattataggcacccaccaccatgcctggctaatttttgtattttcagtagagatggggtttcgccatattggccaggctggtctcaaactcctgacctcaggtgatccgcctgcctcgacctcccgaggtgctggggttacagctgtgagccaccgcacctagtatgtgtttgatttttaatttagaactcatgtatgtcttgtctatataagtcaaactaatgatgtgacagaaactgttgtgaaaaatgttactttgaatgtaagcatttttccaaaatcatttatgtgtctcaactaattccttctataaatcaggaagacaacgataaaacaattcaacaggaaaatgaacaaaggacagaaaactcagaggagaaacacaaatgttcaataaacatataaagatatttaattaaattcatgagtgatcagaaaaattcaaatttggatggaatcccttttattcatccataacttcaacaaaaatttggtgaatacccaacagtgaaaaggtgtggggaaatgaatgctgtcacattctgctgacaatacagtcagttggcacaacatttttgaggacaattaaaattttatatctacatagtcttcaccccaactcttccatttctagatatctatgctataggaatacttgcccactaagcataagctcaacattcatcaatggggaaattattaaataaactctgatgcatccatactatggattatgcaggagtttaaatgaatggggtgaccctctaagtcccaggaaggaaagaaattatgaagtgaaagaatatcatataagtgataccatgaagtgaaagaatcaagttgcaagatgttaccctttatgaaaagaaaaaagattttaaaaaccacacaacaaatctattttgctttatgtaaatatgtatgtaggtaaatggggaaaagtctggaagcatgtatactaaacacacagtagcattacctcagggacgagaaagtagggcagaaggagggtttttgttatacctgttattgcatttttatacattaaaaatagaatcatgggctgggggtggtggctcatgcctataatatgagcactttaggaggccaaggtgggaggatcacttgagcccaggagctcaagaccagcctaagcagcataggaagaacccgtctctacaaaaaatacaaaattaggtggatgtggtggcatgcacttgtgtgtggtcccagctacttgggaggctgaggtgggaggatcacttgtgcctgggaggtgaaggctgcagtgagatgtgattatgccactgcactccagcccaggggacaaagtaagatcctgtctctgaaaaaaaaagagaaaaaaaagaatataaccatgtattatttgtatgataaaaaataaatttaaattgcctcttagagagagcttcccaaatttaattttaaaataaccataggattgcaatccacagaggttgatttcgggtatggaggggaaatatcttttctcagaggtatagacctcaaaattctggaccaagaaggatcttataatgcagttagttttttgtcatatttggagagaatatactcacagtttctcggtccaactgtatgctttccatacatttccatcaatgtatgaaatatagtttccttggaaatttctgtgaagaaagacagtttatatccttgaataggcaggaaaagaatgaacaggataaataaaagaatcatggcaaccttgtcggggatattcggaaacagaaaataacacctgctttctcatttccagagctatcagcttcccagtttgcacaattcatcaagaaataatgcagggccgctggcacaaatgatgaggcatctcccggaagcttaacttcctatccatcccatctcttggacagacgatgccagttaattacgttgaatgtaagtattttatccaaaagcacttatgtgtctaaacaaactcctacaaatcaacacaaaaatggtaaataattcaacagaaaaatgggcataagcttatctttatcgataaataagtagaaagaaaccctatgccaggtaacaccaaagctttgccctctgttgaaacatcctaggctttttctttccactcttattacaactgatctgatttagccccttcacactttactcctacattttgctagacctttctattttgtctccctgaaataagcttttccttttgggcactctacatatggattctaaaataatcctttgcatgtctatacttgaacataaagcaaaaaaaacaaaataaaataaaataatcttcctgttttaatcatttaatctctcttgcttggaaactttcaatggctttccatacctcattgtgtactctttaagacccaagtaaacttttagcttatccatgtagctttccctgatctccacacctcaaggaccacagattctggtaaattctagcaacgatggtatgcattatctttcaggaattaattatatacaccgccctttttatgcctattctctttcttccctcctatcatcttcatgttctgcggacaatagcatactttgtcctgggtttgtcacaaaatgagtgctacatataaaaagccagggacaaagaggagttctggacataactaaaggacagagtaatcatgttaacagccaacactcctacatatgctaggcactgatgaagtgtttcatatattcactcacccaaatttcacaacaatcctatgaaatggtaactagcataatccccagtttaaaaggaggaaattgagtcacagagcagaataacttgctctggatcaccaagctaataaacagacctgggttcaaacccaggcagcctggctccagaatcaattcttaaccacttagagcatcatcactgagatcgggagagtgacaggctgctgtaaagaaggtgaagcgggccaggcgcggtggctcacgcctgtaatcctagcactttgggaggctaaggtgggtggatcacctgaggtcaggagatcaacatggagaaaccccgtctctactaaaaatacaaagaatgttttttgtgtgttgccaggtgtggtggcacatgcctgtaatcccagcaactcaggaggctgaggcaggagaatcacttgaacctgggagatggaggttgcggtgagccaagaccgtgccattgcactccagcctgtgcaacaagagcaaaactctgtctcaaaaaaaaaaaaaaaaaaagagggtgaagcgaaaataggagcagagcagcggttaagcaatgatgtgatggggtaaataagaatggataagaaaacgagtaagagtaaaagactggagaaaaagtaaaagactggagaatgggtctaacattaaaggagaatgaggagaagggagaattgacaagcaaaggtgaaagcagaaagtcagttgtcagtatggcttggggagataaagaaggccctggaaggcctccaggaaaaggctgccatgtcaggcaagacacagaggatgattgaggaaaggtgattcttacaaggtggtgaagatgccattgtaggtgtagggctctggcacaggcacttggcggagcctctgctttgggctgagaccaacacatgacagagtctcatctccgcaggtgcagagctcacatatgttggtgcctgtggaggccttctgttcctctggtgcagtttcagactgcaccaatgaatcctgcgaagattctaactttgtaggtggacctgtgacttcagtcaggcttcgatgcagagtctgaacctggtctggatgaggagctctagtcttctccagggctgtggaatgtccaatctctgtagtaggttctggagttatggcaagccccgggtctagaggctgagctgaggtttcctccgtggttggagatggtttaacctctgtagtaggctctgtagttatgctaagctccaggtccagaggttgaactgtggcttcggtcaggtgtgaaagctgagcctgacccttgtctgaaggtgaacacctcagggtgttctggaggaggagctgtagtcgtcagggctgtagaagattcaacctctgttgtggattctggagtgatggtaagctccagatccaaaggttgaactgtggcttcagtcaggtgtgaatgctgagtctgaaactggtctggatgtggaagtatcaccttaaggtgctttggaggaactatagttctcttcaggggtgtagaatgttcaacctccatagtgggttctggagtgatggtaagtcccaggtccaaaggttgaactgtaatgctgggtgacattggatgctgagcttgatcctgacctggtgttggaatttttacctcttgatatagtacaagttgttgtagagctttcttaggaggctgagttggggtctcctgcatggttggagaaagttcaacctctgtcgttgattctggaatgatggtaagtcccaggtccaaaggttgaacagtgacactgggcaatgttgaattctgagctggatcctggcctagtgttgggactgtcacctcataatgagctggaggttgagctgcaacttccttaggtggctctggaagctgaactgggaccatttgctgccttgaagattctacctccctaggggactctgcagcctgaactgtggcctcctgctgggtcagagaaggttctgcctccacagggggctctggaatctgagctggaacctcctgctgagttacagatggttctacctcctgagggaaccctggaggcaaagatggggccatctgctgggtcagagagggttctatcaccatagtggggtctgaagactgagcagggactgcctgctggactggagaggattctacctctttaggtggctctaaaagccaagttggggcctgctgtagactggagatgggtcaaccttctcaggtggctctgatggctgagctggtgtctcccactgtggtggaggactgaccgcttcagtggacttccaaggatgacctgaggcttcctgctgggttgcagatggttcaacctccttagggggctctggtggctcagctgggaactcttgctggactggagaaggttctgcctccttagggggatctggagtctgagctgtggcctcttggtggactggagattcaatcttctcaggagaatgcagaggtggggaagggagatcaggctgggttaaagaaaagtcagcctgctcagtgggaatagaagggttgtcctgctggactggagaaggttctacccacatagtgactgctgtaggtttggtaagctccctatctagatctagatatgacacatctggaggtgaacctattgcttcatcatccattgaacttacaaagtctgaggagagctgagttggaggctgagttgtaggctctttatggactggaggaggttcataattttcaggtctatttagctgctgaattataatgtcttgctggtctttcaaatgttgaaactgctcaggggacattaagggctgagctggggcctcctgctggattggagaagactcaccctcctcagcggtctgtggatgctcagctgcagcctcctgctgggttggagtggtgttctctttattaataggttctggagattgaactgaagtttcctgttgaatttgtaaatgtccagcctcttctgatgactctggaggcagaggtgggcacccgtgctggatggcgggaggttctacattacctggacctgagagctgagctgtagcctcctggtggactggagaagtttccacctctgcactaggctctgttgctatagtgagctgcacgtctggaggcttaacagagacattgggaaaatctgaatgctgagtttcatggtaacctgaaggtgaaactgggacttcatgatgttctgggggctgagctggggtctcctgctgggttggagaagattcaacctccccagaagactcagaaggctgagctagctgctcctgctcactgggggaaagttcaggctctataggaggacgtggaggctcagttggggcctcctcttggaatgcagatggttccatctcttctggaggctgagctggggtctcgtgctgggctggagaagattcaacctctccagaagactcagaaggctgagctggctgctcctgttcactgggggaaagttcaggctccataggaggacctggaggctcagttggggcctcctgttgggttgcagaaggtgccacctcctctggaggctgaattggggcctcctgctgggcttgggaagattctgtctcatttttgggctctgaagtcatggtaacttccacatctgcaggtttgactgtaacgttgggaaagttgtaatgagcaacctggaggttgaactgtcacttcatgattcagtggagtttgagctagactctccatagaggactctggaggcagagctggggcctcctgctgggttgaaggttctacctcctgagggagcagtggaagctgtgctggggtttcttcctggagtgaagaggactggatgtcttcaagggtctctggattttgagtttcaggctctagatggaattgagaaagtccaacttgctcaggaggccctggaggctcatctgcattcacccggagttctggaggcaggctgccggaatacagtgtgtccatactcaaatattcatctgcaaagtctgtttctgacgctgaggtttgtataattggtgtggaatcccgacaatcttagcaaggctccaacgctcagctagatctttcttcaagttctttggaaaaacaacaaatttggttggttttgaaaccttactgtctagcggaacaagtatttcatctgcctgatgacctgcagcccgatctagatctgcagtttgaaacttacttttgaggcgaggaagctgaactagggtctggttctgatccctgtccagcagtggaaccacctctgggagcctttcttgtggagtccgcttgtcatttaaatcctgatgtgcagccaagaactgctctggccccaggggcagctctccacctgaatccgtatccaggaatggaaccaaattttcatttgattcctggggcagggctgacacctgtgaggaagcagagggccccaggtaatcaaagtcccctggggctgctgggggagcaggtgcatgaggagattcccatgggagatgggaggagcgggaagaccagggctcaggtgaccccaggggttagaggtcagctggagcgggtccttgaccaacaccagatgtggagcctccttgactagtagacacaataattgccactaggagacacaatagctgccacgtaaggaggggccacgggccccagaaacgcagccaggacatgacacatgctagtgccgtgcactgattgggagccattctggcagccctgagatgctcatgccccttataagcgtgcgccccgccctgtctttatgacacctttatttatgccacatttatttggctcgggtccagatctgctccattttaccatggcaatcttatgtcacaatctcgctcaagtgatcctcccacctcagcctcctgagtagctgggactacaggatgtgccaccacacccagctgatttttgtgttttttgtagagacagagtctccctatgatgtccaggctggtctcaaactcctgggctcaagtgatcctcccacctcagagtcccaaattgctgggattacagggattagccaccatgcccagccaatccagccatcttgcagccaatcctccagccccaattaagccttcagatgactacagccccagttagtatcttgactacaaactcatgacagatcctaagctagaaccactcttctaagctgctcctgaattcctaacccatatacagtgtgtgagatcataaacacttattgttgttttaggcctcaaattttggagcaatttattatgcagcaataggtgactaaaacacacaataaaattgctgtcattactattataaagtacttcctgattttgagctgaaatccactttcttgtaatcaccaccctctcttccagttccgtctttttgggccacctagaaaaaatacaatctctcttcctcatggtcaaaatgtttggtgccagttttcatgccaacaatttaattcatcagacatttgaagagtgatcactgtaccaggcagtaggcatgcaaagataagtaggacgaggtccctgcctagccatacactcaaaacattcttccacaggaggtgtgctgtaatgaagggacctgactcccagtgcaggagaaggaggtccaaatgcaggtgtggctggttctgcttacagaggtgagggaaggcttctcagaacaggtggcaggcgctgaggcctaagggatgaataggccttctccaggatgacaggaggggaaggactaacaagcagaagctgcaggcagaagaccaccctgacactaaccactttcttccgcagggtacacatctcctctcctcttgtccaacttttgagtcctctcccaacccctcccaatcttggtaactccactcagaacacaccctttcctgtcacatgatggcatctagagggagccagccctcctccagggtggtccggccagtgtggagtggagttggccgtcacctttctttttctggaagctctgcttggtccagacttgtctgaggttttttggcctccacatccttcagctgactcatgctgggcctgcaggcatctggactgcaaagtcatttttcacacgtgctcctgggaaaccacatctcttcgtactttgtacttctgctgttgttttgttttcacaatttttcatgggtgttttgaagttcaataatttgatctatgcaaactgctcatctcagctcctggttggcaggggccttgtggaagcaaattgagccaccaaaagaatccaatttagaacacgccctggaaacagaaaccgtctgtcattctaaggccattgtggttgggagtgattcagactcattgcagctccttccagccttcaaagatctcaccggataagagcctggcttggatttgaagacaccttctatgaaggaaaggctttggcagggggtgaggggggtgggctgtgatactttgtaggagctgagcacagacggaaggaaattggaaggggatgtttgtctggctcccaccttcccccgtcagggagaatcaggccattgtctaggtagaactcttggcttgtttatcttctcagacccagcttagaacaaggtttcactcagttttctttccacccaaaaaatgaccacaggaaagagtgacttgcgtttgctaagtgtccagtccgtactctccgttcccatttctctgcctctttctcccattatcggcttctaacagaaaataagaagagcaagcttccctttggtcccatcaaagataacatgtagacattcattcatgcgttcattcctttaactagcatttattgggttcctactatgttcccagcattgttattggtactggtgaccctagtataaaagacacaatccctgctgtcaagaggtcacagttctggaaggaacccagcggtactggcagcagcgctagtggggaatgggagcacatagaagaggcatttgactcagctttggaaagaattggaaaaggctttaaagtagagtaaaagtttgccagaaagaataatcattattacagcttttttaaagcgtcttctacatgccaagcactgtgctaaaatctccctatatatattgttttattttaatcctcacaactctaagaggtcactactgtaattattccaacttcacaaatgaagaaagtgagatttagcaaggtcgccttggtggggcatggctgctcacacctataatcccaggatttgggaagccgaggcaggaggatcacttgagtttaggggtttgaggccagcttgggcaacatagtgagtcctctgtctctacaaaaagaaaaaaaaatagctggatatggtagcatgcacttgtggacctagctacttgggaggctgaggtgggaggatggcttgagcccgggaggttgaggctgcagtgagctgtgatcatgccattacactctagtctgggtgacagagcgagaccctgtctcaaataaataaataaataggctgggcacgtgactcaggcctgtaatcccagcactttgggaggccaaggcaggtgtatcgcttgaggtcaggcattcaagaccatcctgaccaaaatggtgaaaccccatctctactaaaaatacaaaaattagctgggcatggtggcacatgcctgtagtcccagatactcaggaggctgaagaaggagagtcacttgaacccaggaggcagaggttgcactaagccaagctcgcatcactgcactccagcctgggtgacagagtgacacactgtctcaaaaaaatactaataataaataaataaataaataaagtcaacctgctcacctcttcactaagaatgaatagcagaaatgagaaatagatgcagcttttcctgactgtgtagcccattctcttacccaaggctgctatttacagtcgtgcaggttgtacattgcacaattccaatgctggccctgcactcaataagccattatagatgggaagggtatccaggcagaaggggcctactttgcagaaatatgaaaaagcaacctatattcagggaactgaccccatacagccatgtcagaggctacagaactccttgaagatgggcagctcctctgcacctccagtgattgtttacagaactgaccgatagtgtcttgggagagctcctggggttttgcatttgttttttgtttgtttgtgtttgttttgcttttgagacagggtcttgctctgtcacccaggctagagggcagtggtgcaatgacggctcactgcaaccttggcctcccaggctcaagctattctcccacctcagcctccagagtaactgggactacaggcatgtaccaccacactcagctaatttttatttttatttttgtagaaatggggggggggtctcactatgttgcccaggctagtctgtaactcctggctttaagcgaccctgctgtcatggcctcccaaagtgctgggattacaggcatagccaccgtgccaggccaggctttgcatttggtgtagagacccaatccttccttcttacagagctatggagctctcagcaggatgtgcatacttctgaactgttgaccatgcaaacattcaagcacagaggatgcaggaggtcctgagtctccaaactgctcagtgtcctatgaatggccaatcagtttctcatgcataggcaccaaacataacctgccaaacaagccagttcaatatctaagccaccccaacttctttgcagaagtcgtttcagtagcaaagaatggtctgagaaaaataggcacaaccagggtgaatgcctacaacactccaggtgctcagcaaacgtgatctcttccactctcacagctttatgagacatcatctttcattttgctgatgaggaaactgaggttcagggatcaggtaacttacctaggttacgtgtgcaacaagcagccacgattctcaccagaatctttctagtggcacagcctctatgcttctatcctaatgttggctttcaaaaggtacccggaaaagggcaggaaacagcttacatggctcctaaaatgcctgacagcatgtatgtggcagagtctctctctacttttttttttttttttttttgagacggagtctcactctgtcgcccaggctggagtgcagtggcacaatcttggctcactgcacattccacctcccgggttcatgccattctcctgcctcagcctcccgagtagctgggactacaggcatccgccaccacgcccagctaattttttgtatttttaggagagacggggtttcaccgtgttagccaggatggtctcaatctcctgacctcgtgatctgcccgcctcggcctcctaaagtgctgggattataggcgtgagccaccgcacccagccctctactaaggtacccagaaaagggcaggaaacagcttatatggttcctaaagtgcctgagagcatgtatgtggcagaatctctctctatttttaattttatgtatttttctagaacctatgtcatcaatctcagagctcagagacccctcctcaggtggagaggctgcttccagacatcattccaccacagccttttctcactgtgcaatagtttggtgttgacagagtagaataaattattaaatgcttttctggaattgatttgactccaagggtctttgtgttaaaataatttcctatatcaaatagggttcttggttgtgcctgactctgactaacttaaggggggtagggagtggaacttattggaaagatacagagcgagaaagagtctttttaaaaaaatgctgtaataatagggacgagaaccagggtagctctggggaaggaagtcacagaagttaaaggttggttcttcaggatgtcattatcaggatgtttcagctctgactcctttctgcccttattcacacacccagctagagttcgagttacccgccataccatggcacacagagaacaagacatcatgcctgacaattcccctaaagcttcaagcaaaaagtaaggggcaatctctaaagcaaaatcaaggtaatgctacatggagaaagggaaatagatctggcactctgacagcatttgtttttgcttgaccaggttctactgaggcaggtaatacaagctgggcatgtgaataagggcagaaaaaagcaggagctgatataacctgagagcagtctttctccaagaatgttcaactaaattatttcttttctttcttcttcttcttctttttttttttgtttttgagacagagtcttgctctgtcacccaggctggattgtaatggcatgatcttagctcactgcaacctctgcctcccaggttcaagcaattctcctgcctcagcctctcaagtagctgggattacaggcatgtgccaccacatccacctaagttttgtattttagtagtgacggggttttactatgttggccaggctagtctcgaactcctggcctgaagtgatccacccatctcagcctcccaaagtgctggaattataggcatgagccaccaagccaggcccaggctaaattatttcaatttaatgtactggaggtttgaaaattaatacttaaaaagaaacttgtctaatgtttcagagtttcagtttggaacgataaaaacgttctggagatggatggtggtgatggttacacaacaatgtgagtgtacttaatgtcactgaaccacacatttaaaaatggttaatatggtaaattttatgttatgtatattttaccacaatttgaaaaatcacaacaaccttaagaaagagagaaagttactaaatgatatgtggtatcctggaaaagaatacaatctatagtttagttaatatcattgtaccaatgttaatgtcttaattttgataaatgtgtcatagctatataagatttttaacattagggcaaactgggttcaaagtataagggggtcaggcatggtggctcatgcctgtaatctcagcactttgggaggctgaggtgggcagatcatttgagatcaggagttcgagaccagcctggccaacatggtgaagccccgtttctactaaaaattcaaaaattagctgggcatggtggtacacgcctgtaatcccagctactcggaggctgaggcaggaggatcacttgaacctggaaggcagaggttgcagtgagcagagattgtgccaccagactccagcctgaggaacacagcaagactctgtctcagaaaaaagaaaaaaaagaaaacaaaaaaaggctgggcatggtggctcatgcctgtaatcccagcactttgggaggccaaggtggatggattgcttgaggtcaggagttcaaaaccagcctggggaacatggtaaaaccccatctctgctaaaatacaaaaattagctgtgtgcagtggtacgtgcctgtaatcccagctactcaggaggctgaggcaggagaatcacttgaacccaggaggcagaagttgcagtgagcagagattgcgccattgcaccatcctgggcaacagagtgagactcctcctcaaaaaaaaaaaaaaaaaagaaagaaaagaaaagaaaagtaaaagaaagaaaacagtatatggggctgagtgtggtggctcatgcctgtaatcctagcattttgggaggccaagacaggaggatcgcttgaggccaggagtttgagagcagccagggcaacatagtgagatctcatctctacagaaaagtttaaaaatcggctgggcatgtggcgcttgcctgtagtcccagctactcactaggctgaggtgggagcatggcttgagcccaggagttcaaggttgcaatgagccacgatcgggccactgcactccagcttcacaactgaatgaatatatgggactctttactatcatgcaacttttctgttaatctaaaattatttcaaaataaaaagtttattttaataaggaaactacattataaacattttaataaataacttttataaatgacgttcaattcgtgagggttttcaacatgtaaactaattttgtggaagacgtccacattgttccataaaatgaataagaaatgttcttaccagccgggcgccgtggctcacgcctgtgatcccaacactttgggaggccgaggtgggtggatcacgaggtcaagagatggagaccatcctggccaacatggtgaaacctcttctctactaaaaatacaaaaattagctgagcatggtggccgtgcctgtagtcccagctactggggaggctgaggcaggggaattgcttgaacccaggagacagaggttgcagtgagccgagatcgtgccactgcactccagcctggcaacggagcgagactccgtctcaaaaacaaaaacaaacaaaacgaaacaaaacaaaatgttcttacctattagaaattccacagtatgatgatgttctcatctgagtcttcagttccctctgccttgatagtacagtcaatagaatgttccttctcagaatccaagccacatagactcagaactgatggaattaaaactgtacaaatccaggacaatcacacaccacatacctctccaggtgatgcaacacgaggcacaccatgtcacttctaaggtaatcatccccaaaatgtttaacttgaatcttattaaggctttaggttccattttggggggaatacaggagatcaacgaagaagttttgtgacaccatgaggagagaagtctgcaagctcagagtctggggcagaccggaagacaactggtgtggtctctggaaacaagtctaagttgtattctttagagaagtttggccatgaagggagcagaaaaatgaggaagtaggagctaagaggagtcatgggtgggcttttttctgttcttaatttccagtctttcatcagcaggggatcagtaagatcctgagcctgagccaggcatggatgagggaaatgtccctgtcttctttccctgttcttgttctgtgtcatttgttgcttcttctgtgcattatatggtcatgttcgatattagaacatttccttcttatatcaggggttctaatttaatctgcagagcattttgtccggctggctgtgtgctccataaatactgaataaaagaatcgaaaaagtcaaagttgtgaatgaagtggagatgaacggagcattaagagtcaggctggcactactaaggtgaggtgagtgaggcacttaagtgcaaaatttaagagaatgcccaaaaactcattgatcaagagcaatacaattttaatgcaatattttcaaaatcaaaattaatataaaaacccatggtgaacaaaatatcagaagtttaaagagcctacatttgtacaaccctgcctcattcatctcatgctaatcccagccccgtaaaacttttcctgcaaaaacatgcagctggcctacaggcataggtagctcatttgactttttgaaatattgcattacaatattattactcttgattactgagttttctggggcctttttaactcatctcatcctagccctgacattgcttaagttctgtatatgactcaaagaaacaatagccataaaagacattttggggataaaaggaagaaatggtataagacaacattggggaatactgttaacatttaggtgataatgacattgtgattgtgtagaagacgtccttgcttttttggagatgatgtcagcaaaacttatagatgatatgtaaatgaaacaaactggctgggggtgatggctcccgcctgtaatcccagcaatttgggaggctgaggtgggtggatcacttgaggccatgagttcgagaacagcctggccaacatggagaaaccctgtttgcactaaaaaaaaaaaatacaaaaattagcccggcatgatggcgcacacctgtaatcccagctactcgggaggtttgaggcatgagaattgctttaacccaggaggcagaggttgcagtgagccgagattgtgccactgcagttcagcctgggtgaaaatgtgactttgtctcaaaaggaaacaaacaggtaaaattttaataattgaattttgttcctgggtacatataggtattcattgcactattctttctaagtttccaggtgtttaacattttttatgataaaacatttttagacacttatataagccaaacttttataacaatgtaatagactgcagaccatctagaagaggctaattcattactacatagctgggtggtgaggatggaggtaactcacttgccctaaaactaaccctaacccagtcctcctccttccaatgcctgctgcctcacatgtagcctgtctttgttccaggcccaggaggagctgggggtaagagcacaatcaagtttcagtttagctactcagaatccagattaatgaatatcatttcaggcagttccgctttgtctgtccttttcctggtatctccccagagatgtccaatgtaagacaggccagcctcatatcagacatagagaaaaggcaaatgtgaacttttttattacacagaacagacagactgtcacaaatgggcctcaggtgacacagtagcatgacctgagtacttgctgcaactcctggggcctcatctcagacctactgaatctgaaactcagcgtgtggcccagcaatctgtgtttaacaagtcctgtaggagattctgatgcacaccaaagtctgaaaaccacagatgcaaagagacacacaagtgcatatgaataggcttgtttcatttggtccttccattttatcagtatgtagcctgtgtttcattatacctgtggtggatgtgttaaaaagagttctacaatgacactctcgtgcataattctcagagagagcttccattagtgtgctcaggaacctgcaggaaagcgtttcacaaaagtgccagtgtcactttaaggagccactctgactagagatgaacccaaggatcacgggctgttgccaaatctgtggtgtcttctgaccttgcttgtctttttgagcttggtcatgttttgcacggagccatggaggcccgtatagtctaggtgtcttacaggcattttcaagtttttacgaggcctcaaactatataaaatatatataaaatattttgaagcctcagaaaaacttgaaaatgcctgtaagacacctacactacaggtctccatggctctctgcaactattttatagttgctttaatttataaaagcttcccagctgatgtttatatgcagcctggattgagaatcactgctctagtgtctctgacaagtgaatatctttgataaaagagtaaagaaatctttgtttctttctgtttcatacacacacaaacacacacacatttgataggtatatatatagaagaaacagaaacaaagagagctcattgaggacattaggagcaggcttttggatggggtggtgtgcttcatccagtggcgcccccagttgggccctgcttctacttgcagctccacacactgcacagggaggcctacagcagccactggctcccctccatcccctagaccacagcagcctccatctggcctcaaaacatggagctgttgctgcccccagccacagctggcccagctgcattcacgttacccatttggccttcacaagatttaggcagaagataaacacagatggggcaggtgagcagcaggaaggccaggtgcgctgaaattccatcgaggcaggaagtgcaagtgctgcactatttgaagacactttatctaaaaacaatcaaaaagcaattcttctcactggatctggacccccctcaggtggagatggttctccccaactgggagcctgggcgttttcatgagtgggccactttcatcaggtgcaggaggctgcaggctcctcagagggtgcatcttcaaggggggggtcagaaaatgccaccttctaaaataaaaatgaaaatgaatcatgtgcataaactatgctaaatgatgacttggaatcgtgcttctggggtttctctaatatcagtaaggggactagaacgtgacataaattgtgtttcagggattgttgtaggcctgagttaatgcatccctgttgtgatggacatttgtcaatgtttgtggcagcctagcatccatgccctccctctatttgggggaaattcccactctgtcagtcacagcaagctacccctccctctagggaagtaggaaggtctagagactaacctcttccccagcacgcttttagttagcacagaggccaatgacaggctggccaatcagatgctctcaccctagactttatattgtgaataaaagtgtggtgtgaggcaaagatgaatggaaagctagaatccatgtgcattggctgggtgtggtggctcacgcctgtaatcccagcactctgggaggccgaggctggcagatcacctgaggtcaggagttcgagaccatcccggccaacaaggtgaaaccctgtctctactaaaaatacaaaaattaactgggcatggtggcatgagcctgtaatcccagctacccaggaggctgaggcaggagaatctctggaacccaggaggcagaggctacagtgagctgagattgcgccactgcaccccagcctgggtgacagggcaagactccatctcaaaaaaaaaaaaaaaagaatccatgtgcattggaaggatctggcc

SEQ ID NO: 444 - DNA, 103888 bp, Homo sapiens
ggctattttaaggtacgtatttccataacagttttagaatcaacttgtcaatttctacaaaaatcaccttctgggattttgattaggagtgcattaaatttctaggtcaatttagggtgaattgccatcttaacaatattgaatattcttatccttaaatacagtatacttctccaaaaatagttttctttcgtttatgtcagtgatgttttatagttctcagtgagcagggctataccatcttttcttaaatttcagtgtgatttactcttcaagtgagaaatcacaaggcttcttggaccaatctctaaatctgagactttggccagaattaagactgtataggctgggtacggtggctcacgcctttttaaacccagcactttgggaggccagagcaggaggatcaattgagtcaggagttcaagaccagcctggccctgtctctactaaaaatacaaaaattagccgggcatggtggcgggcacctgtaatcccagctacttgggaggctgaggcacgagaattgcctgaacccaggaggcagaggctgcagtgagcggagatcgcgccattgcactccagcctgggcaacagagcaagactccatctcaaaaaaaaaaaaaatgtatagaagtaaattattaaatttttatttatatattttagtttacattatacattttcctaataaaaattattttgacaggctgggcatggtggctcatgcctgtaatcccagcactttgggaggccaaggcaggcggatcacctcaggtcaggagttcgagaccagcctggccaacatggtgaaaccccatctctactaaaaatacaaaattagcctggcgtggtggcgcatgcctgtagtctcagctgcttgggagactgaggcaagagaatcgcttgaacccaggaggcggaggttgcagtgagccgagatcacgccactgcactgcagcctgggcaacaagagcaaaactccatctcaaaaaaaaaattattttgacttcttaatctttagattataatctgatagttttagtatttgaagagttggacttgttagagataaagtcttgcagaactaccagttcctttgtggtttttcatgtaaatactaacttaggcccttctagtcattgatttatcatttgatgtttcaatatgtgtctatttgtaatagtattaaattttaaatgagtgatttcagctgaagtagagtgttgctgccagcccagtattttgatctaatttccccaagaatttcatgaaattagaaatccttaccagcttacaaaaaaaatgttacatagaaaaattttcagtaaattcaaagaagtaagatcattttggggatctttaaattcctggtcaattcctgactttttttttactgtatggactgtcttgggccactctttatggtcctagattaccttcatctagtttgactgacttagttttggaaatcttcctcaacttcaaacctgtaaatttaaagaataaaaactgattttgctctcaggtaaaagaaaatgtaatcaggactgtgaccctgatatccttcaagtctgtaatgtattcaaaagccagataaataaacttgaatgatgtttaatcatctgaatttcctgaatcatcattccccctaccacctccctaccctaaccaccatagaagatccggacttagtggtattggactggaatgataaaaactatccagggaaggccgagcgtggtggctcatgcctgtaataccagcactttaggaggctgaggtgggtgggtcaggagtttgagaccagcctagccaacgtggtgaaaccccgtctctactaaaaatacaaaaactagcggggtgtggtggtacatgcctgtaatcccagcagttacttgggaggctgaggcaagagaatcacttgaacccaggagtccgaggttgcaatgagccgagagcacgccactgcactccagcctggatgacaaagcaagactctgtatcaaaaaaaaaaaaaaatccagggacaaaagaaacttccctaatctcactacccgaagatttagggacattttttggtgttttctctttttccttcagtttcctttggtaactgtagctaaatactgagtgatttgttctttagtttgccttaaaatattgactgtttccacaagcttgtgttttcattgttgttgtacagaactaggtgcaaatgacacagattaataaaaggttggaaatatgttcttttctctcctctttaggatgatgactttgagttcactggcagccacctgacagtaaggaatggctactcgtgtgtgcctgtggctttagcagaaggcctagacattaaactgaatacagcagtgcgacaggttcgctacacggcttcaggtatgtcactgctttacaaaaggtaagagagaactctcctgaaacaggactgatcttttgttaggtgcgacctatcaggtacatttcctgatagagtgtttatgacaccataggtaaaaattggcatttatagacagttgagcctatagagtctttggtggttctaaccctatcattttataaactgggaaatcgaagcaagttttagagtttccaatttgtgcatgagctagttggatattactggtcgagcatccctaatctgaaaatctgaaatctctaatgccccagtgagcatttcctttgagcaccatgtcagtgctcaaaaagttttccattttggtgacccagtgagtttggatctagttttgttaagtatattcataaataccaggattttggcccctgggctccactaggacccaccccttatatttcaccatccgcattttggtctttggattcattttggctttttctatgcatttgggctaattcgcttacgtttggttcctagttctggagcagtcctgctaataagttgacttcttcagagatagagtttccctgtgcttgctatggggataggctcaatgctcattattattgctggtttcaggctacatttgatgtaaagtgcagacaactgttggattttgaactcctcaagataactagtcatctccctctctgagaacccatgtatgactatgtaggcatgagaaatggagacatagccatcaatcttaccctgcgctgcccctttccttggagttactgagatcaccacagatgttttggttttttactaacaatcagtgaaacagttttccatttaattttcccatcagaggcagcttgtagttgacagtgctgagaagatctgcagccttgagccttttgcaggcagacggagaacagtgagaatagatgttgtgccattttctcgagttctgcagccatagaaaatgagcatgtactgagctttcatatttattttgagatatataatttcaaaatatatatagtatataaacagacattcattaaaaaacaaacgaggaaaacgatgttaacataatttcagtaccctctctgaggtcagctttgaactcattcatactctgacaagctgagaatcactgtgcattctcaagcatagcacgctccacagttttaggctgcatcccccagatctgcatcacagccttcttgtagcattcttctgttggtcgatagtgagcagctaaccacagtcagaagacattggttctattgggatgagcactttattctttatttttggtctaaatgtacttaacttgagtaagtggtataaggtcctttcattagtctagatcaccagtgtatcaggagggtagtgtggggatgacagttgaggattctgaagttgactacaagggtttgaatcctggcacttattacgtgtgtagccttagatgagttatttcacctctacctcagttttcttatgtgaaacatgaaggtaatgaaaatagaaaaatgagaattgagaaatggatgtccatctgttgtacactaaatgttcagtgtccttatcagtgccatattcatcaccactagtcttttcccacccaacctctgcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtagcttgccctagacactcctgtctacagatctgatgtacaaatagcagtcttcgttgtttacttggtgaggaggtggccttgcatttttgggcatttggctatgctcccaattgtgacatcagggctgaggcgtgtcagttgattctcttcagtgcctaagtctatcatcaagtgtctgttcatatggacttagtcttatggggtcatttcacaaactcaggcctataaaaaggggatcgtaaatgtcatcctaaataataaggattgctgggcttattttgaaagcagattagaagagactttaaggaagtctgttgaagccagtattatctggcccctgtcactggctcatgtgcttctttcttatggtaggtggtgttgtgttttgatcgggtgttctgggatccaagtgtcaatttgttcgggcatgttggcagtacgactgccagcaggggtgagctcttcctcttctggaacctctataaaggtaaatgccttctaattttaatcttttccatatccttacaggaatatagaatttgaaatattttgggttttctcaatatatatgccttaatttctctctttattaactcaacaaacaattcctgaaataccttctaggtactggggtataaaaatacctgccttcaaggagctcccaacttagtggggatacagtaagcggggaagcaggcttagaacagggcagtaggtggcctgatgggctgaacgcccaggttactggaggtccactcagcctggagggataggcccagggaggcttcctaccaggggaagcttgcgttctcattctcagactgacttgcccctgattctttgattacttctcttactatgtgtttatgaaattcctacctcctgttcagttattttcttttgtaattggacttaactgtatgtagacttgtaatatttgtaccccacctcattccaagaaaaggctgtaaaaataagacattggccttgtcagtgcagacacatcagctaaccgttggcttgctccccatccccagttctttccattactcctcactgcccagtggtgaatggtctttcacaccccagagcctctaacttcacagagggggaacttggctccctgagcacattgctttctgagagcagcagcgtgtcttttcccttccccatccaggctgtcaagtcctgtcagtgctagccttacaatctcttgcaaacctatttacttttttctattgcctacctcccagtccaagccattcttacctgttgcctggacggttaccaatagctactactgctattcctgcttcttttagtgactttctactgctgaaagaaaatgttcaaactccttatcttggcccatgctaaggttcttcattatctagctcatctctacttccttgtccatccccagattccaggcacattcggctgttctcacatcctggaaggcaccatgctgctttctgcctcagagcctctgcgtgtactgtggtctaggcctgggggtgctgcttctcccaccccctcgacccccttccttcccaacctgtcttactcagcattcaggtcttgacataaatttcaaagtatttcaaagacgacttccaggacacatctccactgccccaaatgtaaattaaataccccatattcttttccgtgtagcctacgtttttcttcatagcttttaagttaataattgtctgtgtaattttgcatctgttgctctattggagtaatagtttatatcatattttttatcccccttttctagtactgtgcctaccacctaagtctgttgcataattactcaccggatgggtgactgaagacagtcctgggcttggaggggcctgggatggctaaaagggatgtagtcattgtcatggagctatccaaggtagtcaaggttaagaattctgtgccaaagtaaagcgatgcttaataattcccttttattagcaagatctgaaattatatcttcagaactgctgtattttgccaggttagaagcagtgaggtgcctgagaatcttacttcactctagtctgccagctcctactggctggtgtctggcgacaaagagttctgtatgctgtttcagaaacataatctgtctcttcgcatttgaatggtactgcgtgtgtcttgtcatcagatttcagagcaccaggaataaggtggggcctgataaggaagtttttgaggaaagtctgtaggaaaaccctagaattatcctttctgtttccccagctccaatactgttggcactagtggcaggagaagctgctggtatcatggaaaacataagtgacgatgtgattgttggccgatgcctggccattctcaaagggatttttggtagcagtgcagtacctcaggtaagtaggtaggtggggcaaggagggatctagggttcagactcaaccagggtttaatgtatttgcagcatgttcttggtcaggacagtttaagctagaattgaggtctgtgcttttacatgaataattaatgtttggagttcatggcctaagcgtggggttcagaaaaccccccaggacaagagctggggagtctgaaggctgctagctgcatttctcctccggctttagagtcacaccagatccctgacattttagacaaaatggccaaactccagtgagtatctccgggaagttttcagagaacctcttggtactttttcgtgttctttgaaatactttaaccctttaggattcctttgaagggaaggatattgtgaatttataaaagagaataaaggccaagccctgtgtagatctctggattcatagacaggaaggcaacatggaggggcatccttcctgtctgaagtccttttgtccatgtgtgttttaaagcaggcattcatcacttgatcactggctctcacatgttgcccctctttctcttcacttgcatctccacccaccactgcttttccacctttcaaggattgatttgtgcttggtgtctcgtaatgacttttgctcctggtttttcttttagcccaaagaaactgtggtgtctcgttggcgtgctgatccctgggctcggggctcttattcctatgttgctgcaggatcatctggaaatgactatgatttaatggctcagccaatcactcctggcccctcgattccaggtgccccacaggtgagaagctggcaaactatctgggcttatttgggaagaggccaggatctcatgatgtccctgattttttttttttttttcagattttagtcattccatcttcggaccctttcagataaccaagagcagagttaaaaggatgggcagcatttctgatttctcataatttggttttgtaaatctaggcagtctacattcagaatggaggagtccagagtataagtcaaataacatttttccttattcaggttttctccctaaaaaacaaaaccatttttaattgcacttccattttgtaatggctcataggattgctgtaaggtctcaattactaggggcttccagggcatttctgagaaataaccctgggtccttgtctagacccttatgccagaccccactccaaagagcggtaagaattccttagtgtcatagcccagacctgctgagctgcgaggcttaagtgtccctgatcaccaaatgtcctgtgcttcagggtagcgaggctccctcccagaaggtagttatacatgagggaaggacgctttacaactgggtatctaaactgatgagaacacatgttaagcatcactttaggactgagcctaggtagagttttattgtctcatttctacttgtcaattctgggaaagtgcctactgataagggagactcttcgatagaatgatgaatagtaattgggggggtcagcctttaaaaaggtcaacagcaatttaagtacttagcaatttaagtacaagaataaaggtatatgtgcagcctgccaattttctctttttcccctaaaatagccgattccacgactcttctttgcgggagaacatacgatccgtaactacccagccacagtgcatggtgctctgctgagtgggctgcgagaagcgggaagaattgcagaccagtttttgggggccatgtatacgctgcctcgccaggccacaccaggtgttcctgcacagcagtccccaagcatgtgagacagatgcattctaagggaagaggcccatgtgcctgtttctgccatgtaaggaaggctcttctagcaatactagatcccactgagaaaatccaccctggcatctgggctcctgatcagctgatggagctcctgatttgacaaaggagcttgcctcctttgaatgacctagagcacagggaggaacttgtccattagtttggaattgtgttcttcgtaaagactgaggcaagcaagtgctgtgaaataacatcatcttagtcccttggtgtgtggggtttttgttttttttttatattttgagaataaaacttcatataaaattggccctctcttttgttcctttgagttggagttacatacaagatgggggcattactcctttggaaatgccaagtttatcctatggcaatagtaatacatgttttctccatgtttaaataaggaagaagatgttcatataaaagagaaaaatggtttgatcaggtcagaagataaggtaggggggccggtcctgtagaagcagtggacttcctggtcagtcggactaggcttcctcacttgggtgggggtggagtgtggtggtgtgccaagaacatggttattaggaaactttggatgcactttcaagatagaacacaaaagagctgaaacaaagtctgagcctttgggagaccagtctgcctttattcctgattccctccatgggtatgtgctaaaacttcccaattctactaaaggtggtggtgtacattttgggaagcgcactacataggatcaagggcttaggtaacagctggtttaacagattgccacaaacttagtggctcttaaaaaaacagaaatctattcgaaagttctggaagcttaaagtctaaaatgggtacacagggctgcattcattacagaggctctcagagcagggaggatcagttcatttccttgctcttttcagcttctaggtgtgggaaggctcgtggctccttcctccatcctcagagcacataactccagtttctgcttccatcatcacattgccttctcctgtagtcaaatcttttgtctctctcttaaaaggatactacctgtgattacatttaaggcccacctggatcatctaggatgttctgcctcatcccagcatccttatctgcaaagtcccttttgccatataagatgataaaaacatgttacatgctggttccttcccaggggctcctgactgactgacagatagatgataaacactgttactgcaaatccaagtaatgtcccttaaatgtggttttattctttcttactgtgagttaagggacatcattatatatattggtgatctgactggaagatgaaaacggagaaggcttttccccccctagtcttagaattcgtggcagtaatggaaagaatctgcacaccaggatcagggcagttaatgtttccagtccttgcagtatcagtaattggttaggtaaaatacccaattttaagtattacacaatgaaataaataaatatactagagctgcgccaacgcatagaagacagatgatacacagggatgacattgacaaaactggcatcacagactcgcacagagtatacggaaacgagggagctttattggttacatattgtactgcagagccaacagagagcattcgcgccagaggatacatgcagacaggcagctccaatgatacacatgcacccaaggagccctgagccactgctttgccctggtttccagcgacaggttctggcctccttggtcccatgcttggagctgctgcacctagactctaaggggcaggggtgagagagaccagagcacctgcctgagcaagtaggtgtggaccaacaggctgcccccaacaaaggggcctataatgcaataacagtttatttgagggctactttcttagccctctcaatctttaaaatacaaaaaaatagactttattctcttaaaaatacattccattcagtatatgttctgagctgggaagcagcaggaaaatagggcccctttcctatgatcctatggttgtgaggctttgaggagaaccctgctccccactcggggtattcaaaaaataatccctaaaagcagctctttccaaagcaatcttgtcagagaaataacaaaacctcataacaaggtagccagggacccagcctctgggtccccattcctttattgggaagtggtagcacttggcactgacccactaaatataaagaactaaaactgccccaggacgacaagtccaagaacactatagtgccccctgcatcccgaacactccactgacgggggttatttatgtgcaagcttgcctacagctgagggtggggtggcatccttggccccactgcagatccctttaacccacactgtgactctttctcattgccacccaaaagcaaaaaacagccacagcttctttatccacctgcagctttctctggtttagtatcagagtggcaaaaaaagcagcagcacgtggaagagatcagctgctggtactaagccagcttcacttcctccaaccaagcagctctattgccaggtcccccaactcactaggaaccctccaacaaccatacacctgccagtaaaatttaagagccaagctgcggaagaaaactgtcataaaagtgggtttgttgaccgggggcagtgggactatttggcttgattaaacaactattcaactaccaggtctcccctctacttggaggcttcctccaggacccctgatgatgaggcctgggtccaaacagtcacacctcagttgcttttcagaaacatgcctcccaactttgggatttgagagccagccttgccagccatttgaagcccagagaaacagcctccagcctttacttgctattacaatgttattttctgcaatgctgaggacacttaaaaataaaatctatctagaaagtgtgcagattaaagaaacaaaatatcctgaaataactgttacaagcaaatcctattgcactcagatttcaagatggcagccccagcaaaagggcatcacagctgtccctcttcaacaggacattttgagtagcagcagatgttggtgctgctgaaatgtggaaagatccagactttggcaccaggagctatagcaccagaatccagggctccaacactcaaagacaagaattattggcgagatctttttaggcatggcttggcgcccttctgtttccatcagcagagaagagccacagacttagtttcctaatacctttagttgaccaccacagaggttgattttctttgaactctcaaggttgccaaccagtgaaggagaatggcagggaggctgcaagtgaaggatggcagccttgagtgagctagtttctggccagtaagccaggagaagcagcagtaagagatcttggaaatagcatcttgagcatcagaggtggggatgtggacaggaaaggcaggccacatgacaatgcctttagattggcaaaactctgggaagcagaagtatgagcaatagattcctgtccctgaaagtaaggtaggtgctccccaagcctcctcactgccaaatctgatacagacaaggtcaggatgaacactggttcccatgctgagtgaaggcagagaagacaaattcctctggaggaagtcttgagtcttcctcttgccaggaaattcataggagatgcacaggaacaggagatacacagacttgggtactttccataatacctagactcctagaacgccaggagatactgtgtggcactgggcaaggctgatgccacaaagagcctcagagaccatcccatctaatcccttcacactttgcagattgggaaacaggcccacggagcttctctgagctcatccccatgagattaaaacatacagaaactaaaaaacaaggcccagaaaaacaattgagggcaggagggaagaacccacacggatgataccttccacaagcaaaaatcatcccatactattatagatggtgaaaacaggagaaccttagaataccagatttggtgcccttagagatcatccatttcaaagaactcattttacagacagggaaactgaggctccaagaagacaatgactcacccaaggtcacacagcaaggaagtaaagccatggggaaaaaaatccagcttaccagactggtagtttaatgttctctcattctgagggcaatagtgtctacttcataaaggtagcctttgaaagaggatcccttctttgaattgacagaatgctaaagaaaaagcactgccaagaatatacaattcttttcaacttccccatgtgactggtataaggaacctaaccaatttatttacgtggctttctgaaaagtttgctgcattttgaactatataaagctgaggccctcaatgcgtatgtacgtatcacctttcctccagcgaagtcatcatgatagtcgacttgcagaaatccggggcccacttctgtaggaatgcatcagcttggtaaagtgcgatgcctcctccatgggggatggagaaggaggaacaggagggagtagtctcacagtccatgcctctcatggagctattgcttgtggagtgactaaaggggtctgctttccctcttgctgggcacttcctagaaggcagaggatgctgggtcaggcccagcttagcctagggattttcccaaggtggaaacaatgaagtcagcttgaagtctccagccactggagagaaagcaggcgatgccagcagcattactggtgctcaggaaaggagatgcatgaggcttgcacctccaggtgcctttggaaggtgagcagagagagctggggttggggagggatgatgtcattccaatgggtatccgcatgagtatctgcatgctctgcttccaggagactggtaagccaggagccaggtcaaacttcaacctaaagggtagtctcataatcctttagaggcagcacagacccctttctgctttaagtctgaagaaaagaactccaaggggaaagaaatgaaagccccctagatagagctgatggctggtaaatcttatggggtacttgagcccattgggcaaatgaggagtgaagtggatatagtgaggagactgagaaaccagaacattaaccacacagacagaggctgccctaggatccagaaacaacccaccaaggagccgagaagaatttttgactcctgctgtgtgctggggactttatcttcccttgtttgggggccagaatggtccaactacttggtggacagggacaaggagagagagaggactcgtgcattggggaaggttgggcctgggtgactgtccagcttgtagtctctgattccctctggccaaatggcaaaaattacctgagccacagcccggctctaccacagttttccagccaaggcttgtgtcttgcctggttaactggccttggatccttcgtggggcaggacggtggaagagctgagaagcaggagcagagggcagacaacagacacccagcgggctcagttctcctcagcacagggcctggttggccgtaatcgttcctcggcccgtactcgcccagactctggcagcccctgcttcccaggcagttcagacggatccagggagttgtgcagttgcctgtagacactgagtgtacagtcttccccttcttcctcctgtgccaataaataacaaaagtgagctgtggaggtcagtaaagtgaggaccgagacaccctcacctgctaccatagtgggtcctttccaacccagcagaggcagatatagcccagacaggccataagttaactgcaaagatatgcttttgcctgagtatgggccaatatgtaaattccttggaaatcggcagactgggaactccaagctgctgggaacaatcagggtaggctaggaggaggctcacaactcaacaggagccttacagaggatagagcctggaatgggggcatgggactagcacccctgaggaggggccagcagtctccgagttctgcacatgcatgcaggccgcatgattctggggatgaggtccacatccttgatggggagctgaagagaggtccggacagctctcttcctccttcccacatacaaactaccaaaaagctcacattcccgtctctcatcctttatctctcctcttaaatgtccaaagcttcaggggcccaaatagctgtctttctccctacgcctagaattctacctttttttttgagacgaagtctcgcactgtctcccgggctggagtgcagtggcgcagtctcagctcactgcaacctccgtctcctgggttcaagcgattctcctgcctcagcctcccaagtagctgggattacaagcacgcaccaccacacctggctttttttttttttctttttttgagacgtcatttcactcttgttgcccaggctggagtacaatggtgcgatctcggctcactgcaacctccgcctcctgggttcaagtgattctcctgcctcagcctcctgagtagctgcgattacaggcatgtgccaccacacccagctaattttgtatttttagtagagacggggtttcactatattgtccaggctggtcttgaactcctgaccttgtgatccgcctgccttggcctcccaaagtgctgggattacaggtgtgagccaccacgcctggccagaattctacctttttaatattctccttggttctcccaagcaaatgcagatcaaagaataacataggcatgagtaagaaaggttagagtagaaagagcattggatttagagacaggaatcttggattcaagtcttcgctcttccagtaattctgctgggtgaccttaggtaagatattttgtgtttctgacccttagcttctacatctgaaaaatggggataatatctgcccccaggcagatattcaagggactgaataagatagtgggtagtgaagtacttttgtccagtgttaagtaccctgtaaagagtcacagggcttttcaagttaacagagtcatctgcttttttaaagaagggagcactgtgtccaggtccaagaagtttttcatcatcacaggtttctcatcaaaaagacactcccaggggcttctccagatgctgttctgacaccctgagcctcacactcacataaggcaggtggttctggatttatcaaagctgtaatgagctatactgaaccagccctgccctcagactgataatatgagacagacagctgtctggggggcaaaagaaagtgtcacttggaattgggtatacgcttatctaaaataggcccagtgtaagccccggctctcctcatccctgagaggccagcagcctgtgaagatctgctaactgaggcggccgagaacttgctgacctggctccccctcactgtgccctacagaaagggcaccgggcctcctcctgttgcccagagctccccatcagctgcagctgcttcttgtgcttttcatgctgttctgagggcctacggggagctcctttagctgctctggcaaaccaagggaagagaagacagatttcctttttatgtcaccttcatatacgagagcaaaatgaagacaacaaattggaaaagggattttggaaagtgatgctgccaaaaaccttctttaggagaaaggtcaaacccccctgatttttcaacagttctctaaggaacccagttctactcagttctcaagatcctgggtcacacaggccagagcagaggggaaaaaggaaaaggcaaagaaggaaaagggagggagaaaagagagaggggagagaggctggaactcaccatgcttgctgagtggttccaggctgcgacagtgatggtgtctcctacccgattccgacgggtaagcacctctgacacagtgaggctactttgggtccttctggaggagggctcaggggcatcccctgaacttggtcctacccttcgagtgccctgctcaaaaaggcaggacctgggctgttcgagttctgagaagtctgtggaagacctctgggtgtaggcattgctattggtagattccacgtttttacctattcgagttggggggtcttctaaagatttcaagtctcgcctactcttccaggcattccgcacagtaacatgtctggcatctgagaagcccacttctgaaggggcactatggcttttccacctgattgtctccgctggaggtgcatggctattcctctccacaggatccgatggcttgattataatgctgctccgagagaccactgtttctggcctgtccttcaggggcccatctgccattctctccgcttctgcaagctgcagggtgatgtcatgtttgtgaatggagagctcaaaaggggagctgacatggttgctaactgatgtgagctctgccagccccacctggatattgctagtggatgtgtgcctctccctcagggcctcacccggagcagctctggggctgctgctgtcagatggatatatagtaatgctacttgtcactttgtttggccctggtttggagacgggtttctgtttctccaacgtagtctctgttccagatcctcccatgatttttttcacatccttatcaacaataacaggtttgatgatggctctagaccgcaacgcctctctggggctaaagggcctttggctttttaccccagcaccattggtatctgggagctccatggtattggtggaggctctgacagatttcacagattcattctccattccagcatctttatcattctcaaatagggaggttctaggtgcccctcgggttttagccttttctctagagttaggctgtggtttgggctctggctctggagtgatggttgtatttaccaacttggcagtaacaagagatgctatgtccaagtcatcatctgagtctggcttctctctgccactggatttgatgactcgacacctcaaggcttcatgcggactgctgtcttccatcacaactgctgcaggttgattaaccccttctttatgtgaggttgaaaatccctgaaggatgttctcttggcttctacagctataaggatacttcgatagaacaggagccttggaattcgggcaactgttatcagcctcaaggccattggcagcctttttgcctttagagagcccttctgaggaggatcttcgagatgaggccagggctccaatggccttagaacagccagagtttgcagcctgagttacttgacttccgttgccaagcacgtgtcccctcttgccaaagacagtctcagaggaggtgtcagaagccttgtcagctctacccaatgggtcactgggaacagatccatgggtggtgtcactaaacgttcgtgttgtcttctccacttttcccttcagtccgctctcggtgcctggcttggaagtccccttccacgctttactgtgctcctgagcagccggggggtagcgactcagcactgagggctgctccctagacttcttcccttcgctctgggaggagccgggtacaaaccggtcttcagttttctttgtctcctgagtcccactgtctgtactcacccccatgtgagaagcttttgctgccctcctgttggtgaaactgggagaagaaacctgcctgttgctcagagaatagttttcattgttgagagcaaactccctgttccggagtcgttcccgcttatgctgaggagacagttcccgcgctgtgtgcttggacacagaagcttcacttccgtggcctctaaacttagtcctctcatgtctgcctttgctggacaggaaagcatcttccccttctacctctccattttctaactctttctgtttcttgatttgtagctttatctcctccagttggctggctaataatttgtttttattttgttcacttaggtaattatcctgaaggtcgttatttttggacttcattttcttaagctcttcttccaacgattcaaagtgtttgatttgtgtcttaagtttctcaatctcttggttaaggtctttgactttgttgtcttcctgattgcggttcttttcattttctgatttgtttcttgtttcattctctacctgctttaggtagtccagaccacccttccttcttgattctttggacggcagtgtggaagagatgccatcctcaatccgtaggtcatttctttccagattagaagcattccttgtataatctcggttcatttttttgttctgctctagtttttgagtgagttcttttatcaatttctcattttctttctccttttcattcaagtattttctctcacttacaaagctcagagttaatgatttcagcttttctaactctgacgctaaactctgctcagttttatccaggcggtcctcagaagattctagttctttcactttgactctgagcatttccagctcagaggagattttcttggtcagatttctctcctcattcaggctcagacacagctgggtacagtcattcttactcctgctgaaggcctcttctagcttctctaattcagccattcgtttctgaagccgctcaatctcagatttcagctcccgggtgaggttttcttcctcttcaagtttctccttcatcagacgacacagatcctctgctctcttaatttcctcgtctttgccttcaattctcagcacccgctggcgcagcacttcaatctccgccaacatgctggagttgctaccttctgcctgaatcaccttgtcctggagatccaggagttcatcctctgctttctggaggttttttgtggcttcctccaactcatcaaggcggcggcttagactctgtagcttaaaccgcaagtggcggctggaggccgtctccttgtagcttgtaaattcggccatgtctactgccagccaatgtgggctcctagaggcatccaattccactcaaggggatgagaaatggttacctttctcttggcaaccacaatcttctttgacagctggagaccatcatcaatctacaaaaggaaagtagaaagcatgtcagtcagcaaatgtaaaacctgcacgttagctcccagttatagaaaagtgctcctatctgttcctggtgcctggatcatagcaggggctcaaacctgttgaatgaatgacttgaataaacctgcaagaaaacactggttctttatggccgatattgagttgatacctcatttcgccctaataaagaatgtcaccagtggcagcatggcaaaaagacatataagaagcctcaattttcatggcagggtataataacatcattaccatctgcaacctgcataatctcaggagagtcattaacaatggaaactaagtctcagttttacttagtggtaaaatgggcataatgatgtctaccgtatttctccccagtgttgttctgagataatatgtggaagatcttggtaacaaagcaataaacaatcctaagatttttttttttaaagattatctcttatgagctattgtgacttaaaagtgatacaaattaaccctctgccttgctataaatggtgagcttcacaatatactaaaacaatctctctacacccattttcaacatctcttctcccaaaagtatatttgtaagtggaattcaggtgtgagttggcccgacccagccaacaggcagcttctacaaaacatatccttttgcactgtaaaagaaatgccccagatgttaaggttggtatgaagactggtttgtttctttgaaagccatttcactggggatatataccaaacatataataataccccaaggaaatagagaaaggggaaggtttagtttttttatgtaattttctcatttttaaaacaggagaatggattgataaatgtattttaaacagctttcatgaacaataagtcctacgaaattaaaaggcaaacaacagacttccatttccaccactacagcaaaccagataacctggaaaacctctaatactataaaacagctaaaaatactgaataaaatgtaacaatcacttaaaatgtatagttgatcacatagaaagtaagtgacattccagctaaaaccagaggaaaagaaaactaaatgaaaaataatagtaagtttaaactaccactgagctgtccttcttagggtcttgccgatctccagaaccaaggagtttgggttctaacaatcatgcaggtataagaggcaagagtttgggctcaatagaggtggtaagttgaaaatgagactccagtccccaatctaaagcaaggattattgaagaactacagctccaggataactagtgaaaaaagtcacctccctgatatagggagataagaggacccgggctctattaggggttaaaggaggattatccctagagaatttataatcttagacctgctctcacttgaattcagagttcaaatttataccatctgagtggtctagaacctatctgtcctgagaaactaacataaaatggccatcagcctagtaatatccctgggaaacctagctgagcaaacaaaagtactctggagggagccactctctacagaggtcacacaggattcccacagattaaagtccagctgaacctgagcttataactaaaaattacaaaacacataaagatccatcttttacttgactgggcagagcaagtcaagtaaaaaagaaccaaagttactaagattattggctagagaccatacaataagtacattccaatgtttaaagtcataaaagaaggaatgaaaaaaaaaaaaaacaggagaaaggaacaaggtgctatcaacaaagatcagaagatctgaaagttaactaaatacaacagctagaaacagagaagagaaatggcatattagaggcaaaggaagatattaatagtggtcaagagagatacgtaattacaaagagcagcacagagttaaaaagatggaaaaggtaaaagagaggttaacagatggggaaataattaaaaaggtccaaaacaaggaagttttaacaggcagcccaaaaggatagaatacagaatagggaacaggcaatatttgaagagctagcaggtaagaattttcaagagttgattaaagatatggacctcacattcaggaagcaatgtcccaacaggagaaaactaaatctgcacctaggatttaggatcggaagaatcctaaatcctcgtaaggatacggaagaatgtatcacaaacagaaaatctttaaaaagaaaaaagaaaaaaagaccattgtctcagtccatttgtgctgctgtaataaaatacctgaggtagtaatttataagaacagaaactggccaggtgcggtggctcacgcctgtaatcccaacattttaggaggctgaggcaggaggatcacttgaggtcaggagttcaagaccagcctgaacaacatgatgagaccccatctctactaaaaatacaaaaattagccaggtgtggtggtgcacacctataatcccagctacttgggaggctggggcacgataattgcctgaacccacgggacggaggctgcagtgagctgagatcgcgccactgcactccagcctggtcgacagagcaagacaccatctccaaaaagaacagaaattatttcctcacagttctggagcctgggaatataagatcaaggcaccagcaggtttagtgtctgctgaaggcccagtctctgcttccaagatgacacctagaatgctgtttcctcacagggaagaaggaatggaacaaaaagggttgaacttgctccctcaggcccttttttaaaggtgctgatccctaatactatctccttaaaggtcctacctcttaatgctgttgcactgggggttacgtttcaacacgaattttggaggaagcaaaaacatcccaaacacaaaaacaatctataataacaactgaaccacttctcagcagaaacttttaagtaggtggcaagtagaatggactacaggggataaggttgggagcaggaagaccaaataggaggctattgcagtaatccaggcaaaacatagttatggcctagaccaggatggtggcagtacatgcgttccaagagcacgtgaccaagacagttgagaaatggtcagaattctggccgtatgaaggcacgaccaaaagatctgctcttagactacatgtgaagcatgaggcaaagaaaggaattaagaagccgagtgcaatgactcatatctataatcccagcactttgagaagctgaggtggagttcaacaccagcctgggcacaacacagtaagatcccgtctctataaaaaaaggtaaaataaaataaaattagaaggtacagtggcatacacctgtagtcccagctacttggtaggctgaggcaagaagacagcttgagcccaggagtttaaggttccagtgagctatgactgtgccactgtactccagccagggtgacagagcaagaccctatctctaaataaataagcagatagacagatagatagataggaattaaggtagactctaaggtggctgggctgaatttgtagagggacagcattaccatcaattcaaatggagatgaccgcagatggagcagtctgagaaggaagatgaggagtctcatttgggacatgtgtatgagatgtatattagatgtataagggcccacttgaaattcctggtaatgatttaaagtgaaaccaatccacaaagttctttttctccagtcttgttcagctggctgaacagacaaaagaatagagaaaccagaattggactgaaccagatcgaagcactgcagaacaaagcaaaagaaggacaggagagcagaggatgtgtgtgagggactttaaattcactcagtacagaaggaggtgaagaatagtgaaaatataatagaaactaatgaagtgaaggtcccaaggggacttgaaggcttgttggagtaagggtaccaggtaccagaggaaactaagcctgaaatatagaagaaagaaatcagagagggacttcaaggaattgaaatcatggagggactgtagttattgataatgtcaaaaacgaaggtataatcataggaatcctgtgggggagtagggagaagtagagaacaagatcattagaagagagaaataattgagaggtaaaggtgttgcaagggtcaccagcatgtaagcgccataaattaacaggaataatgctggaaagagtgacgttaagacagaatctgaagttgttgagaagttaggggcagtgactcagggcgtcgacagacggcagcaacgatagagtattaggtgatgtcgtccaataagatcacatttaaaaatcaaggacaagagtgaagaaacagtctgagacataagagaaaaacagccaccactggagagggaagaaatgactccaacaatgatcctatgagaaagctcagggcaaaagaaaaacaactgaaattgggcctggaggagacgccaaatgccaattctctccaagcctgattcttctaatggctgcactataagcctagaaccaccagatggagcccaagctcagctcctcaaaaacaccaacgcttgaaggtgttgaaaaaaccaagccttccgcttccattcagattctgcccaccccgaatactgctccctgtccatcactctgcttctctgggtacatctttctctgtcctctcatctttgcctcttttggtcccccttctcctttccccagcctacctgcttcctcattctcaaaaacggagagggaaaaaacctcctatagtttatgtttttaaaaagaaagcttttcccttttaaaaactcttgcatttggccttctgcccagtggtacaattaaaatcttgtcaatgtatacacagggttggtttgggaggacttaattaagtttagaccacacaccaattttaaatgagtgtatgatacaaagggtctgtgttgccatcgtagtcattggaagacaaatgatatatgattcatctataaagtgctttaaaacagcatatcctcataaatatgcttaaaccattaaattgtgtattttaaagagataaacttcatgataaataaagcatatctcaataaagctgttaaagaaaacccagcttatcctcaaactgtagcattctctcagcacatcttatttgtactagcttatactatagttttcacaatctctttttcaaaagaaggaaacgttaaaccttagtatagccccatctataaattatcataattctgaattcagagagtctgggaattataccaccgttttatttatttggcttttagtgccaattttatatgttttatcaagactctggatgatatgaatcaactagtacaggcaatgaaaaagctaaacccagtaaatatgtagcaaatacttactggaaacatacagagaaagcaggtattacacaccactgcttaaaactctctaaaggtcctggctactattaggataaagtccaaattccccatgatggcacccaaagcccttcatgatgtggccccgccagcctcttcatctacatcctcgccctccctcttccctctggtccctcactagtttgattccttctcatttcttcagatcccactttagacaatacatccttctggaaaattctggagtgccttcttcaaaccccaggccagatctgggcctctcttttttgctttcacagtctgctacatatttcccatcacagaacctatcacactctattgcagctttatttactcaattcttctctccaacttgtgtcaccactatattctcagtacccagcagggagcctagcacacagggaatgctgaaaattcgatgaatttgactgatgagtgagcctcctaattatcaaatagcttgtcggccctttggcaatgaccattaacagaaaataataagaatgtccatgacctaatcatggattacaaaggagaaaacagatggcaagagtgaacagacagcacagaatctcaggccctgtggtaatgctctgaatgatctcatccctagccctgtgccacttgcacaatgtctcaaccacaattctctccccctgacctgctgggaagccctttcttgcaggtctatgccacacaaacaggacatagacatcaaaaaaccacaacactcacaggatgttcagctctagttatcggaccaaatgttggagaagtagtagaaaacatttctggatcttcctccactcctcagaatgagatttcagagccagaaggtagctaaagatcatttagtcaactggttttcaaactagactcagcaaatccccttggggtcatttaggggaaagacaacaggggagatattttgagcaggctgaactccaggctcctttcacttactcaaccaaagcaactgatttttagcttcttacaatattgggcttctcctatatgactttattaaagaattctacatagcttttatttaaaataaaatcacttacttcattcaaaccccttattttagaaacaaggaaacggactcagaagtaaatactgtgctttttccagcagtttagcaaaagtcaaggacttcagtctcctgactctatgttcaggattcttcccattatgcaaaatcacctccttataaactcttaagcatttttacaaaatgaggagttctaagcactactctataaacaaactaacaatgacaaaagagtataaaggaacaaataagtacaaccacaaatagggcagtactatactacaggcaatactaagtaccttatatacatgatttctgcaggtatcaggaatctcagatcatttactttacatgttcctacgttactccacggaggttttccctcaatgtccacacaaaaacaatatggtaatccctggacatgtaaaatgcttagcagaataccttgcacataagtcacaacaaacagtaagctactactattattctattcagctttcacaataaccttatggggcaaggactctcaaattttcccaaagtacgcagctagcaaggacagtcagagtgaatctaggtccaattccaaagtttatattcttttaagaataccatactgtttggccaagtcactgattttctctatgctttagttcctctgaaaaaataaaagaatatcaactaccttacagcaacactatgcaataaagttagcaaaagcactttgaaaagtcctatgcatacctaaagtaagtttcatcagggaaaatcctcctaaaaatagtgattcactaagatcatcccttctccccagagtaaacaaggaactagactgaaaatggggttaggaggtcacttatctctgaccttttggccctaagtagccaggataagaaatgctttgctacctcctggatcatccaaaagcaaagtagacacctctctttctactgcctcccttactctgtgttaagtatgtttatccaggcaaaattcatttatttagcagacatttatagaacacctatgatgcacccagcattttgccaagataagtagaaaatcttacccttgcctttaaggaatcatacagatataaccaatcataaaactatgataaagaagccttccctgaccatcttacataagatagcacccacccttttgcatcctgtcttctatcctgcttttttttttccttagcatattgtatcatcatacatataaccggaagctcagaagaagtgattaaatgtgcctaagggtggggtctgggaaggaaactgtttatattaaaccttgggaaaccataagaaggtttttacaaagggaaggacagtctcacttttcatgccacccctacattagtacctggctcagttctaattcacgctagcaacatacagtgccaactgtctctcattcagggctctttctatcaaagttcctgaacccagttccaagtggccccatccagcattttggagggtggctcttcttcctgtcctggcagatcaggaaggtctgaaatagaacataatcaggcctgccctgccccttctcccaacacagctgccatgattcacttcctgttcccaatagtcatttaaagaggggtcggcaaacttttttttaaaaagtttgatagtatacacataagtatgcaaacttagtttgagagtaaatattttaggctttataggatctaaggtttctattccagctactgaactctgacaatgtagtgatgaagcaaccacatatatactgtacagaagtgaatgaacataactatgtttcaattaaacttgatttaaaaaaacaggcagtgggcagggcatggtagctcatgcctgtaatcccagcactttggtaagatgagcggggaggattgcttgaggccaggagttcaaggccagtcttggcaatactgcaagaccctgtctctacttaaataaaccattaaaaatttaaaaagcaaaagacagtgggcctgtctgccagaatttgccaatctctgatctaaaggataataggagcttttattttattttatatttcatttcatttcatttttcatttcatttcatttgatttcatttctttttttattgagacagggtctaccaggctgtcatgcagtggagcaatcacagctcactgcagcttctaccttctagcctcaagcaatcctcccaccttaagtctcccaagcagctgggactcagacacatgccaccatgcctggctaatttttctcattttttttttttgtagagaaggggtctctatgctgaccaggctggtcccaaactcctggactcaagccatcctcccacttcgcccttcgagccttctaaagtactgggattacagacgcgagccaccgcccctggccaagagctattttcaagcagcttcctcctgaccacttgtagttacctgttttaaaatcttaggctgtctaagcctcaccatcaactcttgcacatttctatctaattacagggcttacattatttttcccagaatcacaaattcatgtattttggatacgcaaactcaagagtgagggacccagctagcatacagagattcttcatgttggaaaggatttagagatcatctagtccaacctcccactcaatgcggacgttatctagcaagtagttactcagcttccgttcaaacacttctaatgacaagaatgacagtcacttcctcccaagacaactcactccatctttggacagctctaaggtaagataccctacttatttttcttcttggcacatttaaccacctgattacttgtaaatttatttacattgattcttcttaccagaaagtaggatgcatgaggtcagaagtgtagttttttgtgtttgtaatttttttattgctgtattccccgccccttgaacagtgcctagtacataaagagtataatatagttgtttattgggaaggagggagggaggaagagagggagagagggagggagggagggagggagggagggagggagggagggagagagggagagagggagggaggggggaaggagggagggagggggggaaggagggagggagtgaacaagctaacaaaacaatgctgtattcggggaatttaattcagcatggctgacaccagagacacaaggggaagagcaattaactggtaaggtctctgtggtaggtttgaggcccctgaaatgtcacagtaagttcagaggctgagggtgtactgtttgaggaacattcccttatctcctttccttccaagcccccacaacccacagccattccgatggtaaacatctttttttctttttctttttttttttttgagacggaatctcgttccatcgtccaggttggagtgaagaggcacgatctcagctcactgcaaccttcgtttgctgggttcaagggattctcgagaactgcctcagcctcccgagtagctgggattacaggtgtgcgccaccacgcccagctaatttttctatttttagtagagacaggtttcactatgttgccaacactggtcttgaactcctgacctcaagtgatccacaagcctcggcctcccaaagtgctgggattacaggtgtgagccaccacgcctggcccaatggtaaacatcttttaatgcatctgttctctgaggccttttcaaaccatccttccccgcaagagaaatgcaccatcctaaattctgtagatgcttctatcactatatccatgatacttaaaatatctgtcatcctctgctgggctctgagagcagggactgtgttatcttcatttttcagtcctgggcactgaatacagtgacaggggcaaggtaggaaccttataaatgttttgtaaataaattaatgtaatagttttattgtattctgtactggccaaatttacataaaggggactattttcagatctaggcactacattctaggaaagatgcttagcctttatgccagaggctgaaatgcaggtgccaaagagatcaggccaatgatttaaatgagttaaagggcctagaaggactatggctaagaggggctatgccctacttttatatataatctcttaaatgtagccaatgaattcagatttcaaaaaagaggaaataaaaagaataccactgtatagtccctccaaaacatacatgcctgcaagtggatatgggaagcaaatttgcaacctgtattggacaaagggattaagtaagagagtaacacaatcagaactgcagtttttgaaaggccattctagcaggataaactagggtgctattgtaatagtcaaggcaagagatgggataagggcctgaaccaggacagtagcaatggggtaaaagggtgggatggatgaaagatgacctggtctgcccagttctaataatgaagtccaagattgcatgaacgaatctgatagccacagtaccaatttgtaggttcatactggctttgtttccaaataaactgttaaatctcatttttaataattgaaatatggggcttaattcttttgcaggcaacgtgatacaatgattaaagtttacgaactctgaagccaggcagcctaagttcaaaccctgactttattagctactagctgtgtgaccttggataagtcatttgaattctctatgcttcaatacctataaggttatggtatgtgtaaataagttaatgcaagaattgcttagactagtacctggtctatagtaagtgtcatgtaagtttcagcttaaattattatttattatttttggatttcaacttcttagtttcaatcccttgactaaatattctctacactgtctagcctgcaaacattcgctatttaagtctcataggcatgtcttttctatatcttcatccaaattgatgttcaaaaacaaaatataaccaaaatcattaaaaacacctcctatagattaacactgatctattacaattcctgagtgcaactattcaagaagctccaaagccaggtaaaatttttttttttgtcttgggatcacatgagaaaacattaaatacctaatgttagcacttaagacacattacctttgtagcacattccaatcctccagcgacctaggaatctttccaaaaatgaaatgctctgatatatatatcaaactgctatatggtaattatctctggataatgtgctttttttctgtttttgcttatgtctattctctaatatttttatactgaacttgtaccgatcgtttaaataaaatcatggcaaggcttaaagaaaaaaaagaattgttatcagctagcatgatttattcttagtgaacacaagctggcttctagggatcactgttctcattctttgatcaatcaattttagaattttaccagagatcactgtcaagtttccaatgacatcctcaaacccctgtgacccagacgttaactccaaataaatcaaacacctctcaaatgggcacagtggctcatgcctataatcctagcgcactttgggaggctgaggcaggcagacagcttgagcccaggagttcaagaccagcctcggcaacatggtgaaaccctttctctacaaaaaatacaaaatttagctgggagtggtggcatgcacctgtagtcccagcttctcaggaggctaaggtgggaggatcaactgagcctgggaggtcgaagctacaatgagctgagatcacaccactatactccagcctgtgtgacagagtgagaccctgtctcaaaaaacaaaaccaaaaatttaaattaaaaaaaaatcaaacaggtctatggggagaattagaatttgagagccttcaaagtatgtctagaagccattgctttctggttagccaccactaccacccaggtccaacctaccatcatccctgccctggactactgattactgcaaaagcttcctaacttgtctccctgctcccatcagtgtccatccttccccaccctccacagtctgttctcccacaacaaccagagtaggccttttaaaacatcagtcagatcaagtcactcctctgctctaagctctttagtgcacctcacttagaatacaatgcactccaaaggtgtcacatggctgtaaggccctacatgatctaggtcccatcactcatctgctgctccttccctactactccaatccagccacacggcctccttatgggtccttatacatgaccagttacactcatccctcagagattttatacctgctgttccctctgcctaggatgcttttcccccagatatctccctagctggactcctcacttcttttagatcttagcttaaaatatcacctcatcagaggccttccttgattgctgtacataaaggagcaatccctcagctccccaccactatcaccttacgctgcttttttgtcttcttagcatgtactatctagtggatgttatttgtctactcacctgtttatttatttatatctaattattcatttttatctgtttccacccattagaatataatccttgagagaaaggactttttctattttgtttaatgcagtatacttagttccgataactaaagcgtgtagtaagtggccattttttgtcatcagaacattagccccagtatatagcaaaatattttatgtgtaataggtatgtgtaggctgggtgcagtggctcacacttataatcccagcactctgggaggccaaggtgggcaaatcacctgaggtcaggagttcaagaccagcctggccaacatggtgaaaccctgtctctacaaaaaatacaaaaattagcccaggcgtggtggcacacacctgtaatcccagctactcgggaggctgagacaggagaatcgcttgagcccaggaggaggaggtttgcagaggcagtgagccaagatcgcaccagtgcactccagcctcggcaacagagcaagactacgccttgcaaaaaataaaaaaatacagggcaagagtttgccttgaatttttccactccttcgagaagagttctgtattatccctaactacacctatttcctcagaggggttgacatgagagcaagaggctttgttaagattcctttcctatgcccagtcactgctatgacgagaacccatttcccactcattctgagctaccctattgctctactttcctagggaagctttctctaactatcatccagctatcaggagcaaccaagaccaccaggtctcttggccactgaccgttcaagttctcacttctatctcttctatttcattagtgctctcctctgccttagccaacaccaaccaataaaatattggcacataaaatccataaatggctaggaaaagaacctaattgttgatcaaaaggttttgtattttgctttgcttttccaaggttaaatcagtcacagcctcaaccaaaaagtaactttcttaaaagggaaacattatagtgtaatgaaaataacccactagggtggtggctcatgcctgtaatcccagcactttgggagactaaggcaggaggactgctttagcccagcagtttgagaccagcctggacaatacagagacccagtctctacaaaaaaattagctgggcatggtggtgcacacctgtagtcccagttactagggaggctgaggtgggaggatcacctgagcccaggaagtcaaggctgcagtgagccatgatcacgccaccgccctccagcctgggcaatgggagcgaaacccagtctcagaaaaaaaggaaagaaaataatgcaggtttgaaacctagttctactacttgtgtgaacttggaagagttatttaacctctttaagcttgtttccttgtggtgatgacaacagtacttacctcacagggttggtagggcgataacatgtccaacaggactgcgcccgacatagagtaaatattcaataaatggtagctacttcttaagggtggcctaattcttacggttgctaacttcatgcaaggatttttcaccctcatcaggttggttggttaagtactcagcatagtatttggttcataataggccatcacaaatactgactttcctccccacttccagtagtggcaaaattatagtggcttcagaaaccacccaattctattggtacacccaggtttcactgtacaacatacttaccatgtaggtaattcaagctttccgtcaatacttccggcggctctccctatgcttgctgttttggaaacagtcactcactctctttcaaaggcagttgtctcttgacctggatagaatataaacagaatggaagagataggtaatgcatgaatcataccaagactgaggtgacccagagggctgtcccaaagactttcacatacaattcactgtcagcaaggggccaaggtaagatctgcatctagatcctgacactaaaggaacctggctaagctggctatgtctctctcaggaaagtcaagaaagaatttggctgtaggagacttcccctttcctataagatgatatggtcctagggtagaacccactgtctttgcttaaattaaaacacccgaacattcctcaacagtctaaaaatgtacatgacatcttacagctaggaagcatctcagaaatcagctacaggttgagcatccctgatctgaaaatcccaaattcaaaatgctccaaaatctgaaatgttttgagtgcccacatgactccacaagtggaaaattccatacctgatctcatctgataggtcgcagtcaaaatacaggcacacaatactcaggtttattcaatgtcccctggggaaaaataaaattaccttcaggctatatgtataaggtgtataggaaacataaacgaatttcatgtttagacttgggtcttatcccaagacatgtcactgtatacatgcaaatattttttttaaaaatctgaaatctaaaacacttctggtcccagggatttcggataaggggatactcaaccttcagttaaatgtccttgttttacagaaggaaactaaaacttagaaagggtgagtcacacaattatttagcagaaaagcaaggattctactaaaaataagatgttctagaagataggaaaaaaacatctgcggagtatttaccaaccctgagcactatgctttatgttttatataagacaataagaagataatgttacctctactttacagataaagaatttaagtttcaagaagtgacttgtccaaggtcttacagcttgttattaaatgacagagtttaaactcaagtctgtctgactttgaaagtcccttcaccatgctggctctcattttgttgccctctagactcggtcctcaaaagagccctgaaccacccaatatcaattaaaactaaaaatagagcttttctttctgcaaacttaccctccagttttgaaacaagcaggcttctacaggagagttgaaaagcctaccatcccattgaatcttacccctaaaattagagaagagctactacagatggaagatctgggtcaaacttcttgtgttatcttactcttgaggaaaatggaaaggtagcttctaagctagtggtaaacctaaagcttttgtacatgatcttacaaactatcctcccttctttcatcacaactgcctcccttacacatccctgcaagccaccttgtgactgccttccaagactattggtccctttaatccaacttccacacctccaccaaaacatgcacacatgcacacatacctgcacctgcgcgcatgcatgaacgcgcacacatacacacacacacacacacacacacacacacccatccctgcctctatcttcccagagagcaaggcggctagaattacaatggacaaataatgagagttttttaaaaacagcttaaaagatgaggggaacagtagtaactcaagcctcaagagaataaaatttgaaaagaatttttttttgtagtgatggggtcacactatgtcacccaggctggtctgaaactcgtgacctcaagcaatcttcacaccttggcctcccaaagagaagagttactgatagtatcggccaggcacggtgactcacgcctgtaatcccagcactttgggcggccaaggcgggcagatcacctgaggtcaggagttcaagacaaccctggccaatatggtgaaaccccatctctactaaaaatacaaaaattagctgggcatggtgacatgtgcctataatcccagctactcaggaggctgaggcaagagaacctcttcaaaccaagaggcggagtttgtggtgagcccagatcgcgccactgcactccagcctgggcgacacagtgagacgctgtctcaaaaaaaaaaaaaaaaaaaaagttactgataataaaaacagctagaaaataagtataaaaaaggatctaggccaggcacagtggctcatgcctataatcccagcactttgggaggccaaggcaggaggattgcttgaacccaggagttcaagaacagcctggacaacaacaaagcaaggcccccatctctacaaaaaaaaaaaaattttaattagctgggcatggtgatgcacacctatagtcctagctacttgggagactgagacgggaggatcacctggagcccagaagtttgaggctgctgtgagccacagttgtcctactgcactccagcttagatgacagagtgacgctctatatttaaaaataattttaaaaacgatctataccaaggcggcacccaagagatagcttaggtggatgtgggggaagctttagctctccaccctctgcttttaaaaaataatcaatggaagttaaagtaagtgtgattggtattcaaatagttttaggacagttccacagactttccgtcctaccccatcaccacctgtctctttccccctccccacccaccttacacacacaacacccacacacaaacaccgcccccccacacacacactcatcttcttctgcatagcctaaaacctctcctacataaaaattctgaactctaagaaatggtcacataaatctggtctatctcccctaaggtctctgcagccctaacagtgatagcagcgcccctgctaaaatctactgtcccagcacctaccacctactgccaaatttgctgacatgttactaaggcccaggggcttttctcttcaaaacaagacagaatgcactgccaaagggaaagaggaactccagctaatcctgatttgttttcaactgtctacgttctctcatatttctaaggggtagaagtaagcagtaactgatttctttcttctgaatgccatttacttcttgcttcctcagcgtacttgccctctgtccccaaaacaagaggatgactgtaaacatcctcaaattccttagtgatgctgcttcagagagctttccaccatgacagatccatcctcatcacttccctcaagcatctcttctggcacttattgtttctgttactgttggtggtgatagtggtggtagtatgtgtgtacgtgtctgtctgcctagaagcagagactgaaggatccttacagatcacagagtccaaccacctcctttcccagaggagcaagtgggtcccagagaggaaaggagacttgcccaagcttacaaaacaagctcaagtgaacatttttgtcccccaaacactttgataatagataaaaatgtcagtaagaaattctgctttcagtatgaccctcccacagacaacaactatactctggataaaacacaaaaactatctgaagtgaacaagggctggcagattttgaaaataagttgaaagttggaagaaagggctgacatggaatgaactcctcatttttggatctctagcctgaggctggtctagctgaagttccaatcaaaaaacaaaccctaggctttctgtcctgaagaaatagcccagagcagccacagatcatggaagtaagaaaaaaaagagctagaaaaggagagtctcaggttctgtgtgtaaattctacccagtctctggctgaaccctgagccatgcaagcatagggcagaatccaaagacctcagttaaagagaaaagaactgaactgaaatttgaactgcgacccactgcaggtgtgacagagtttgcagttttgagtctgagttattgtctactaaattaaaaacatcaacagaaaccaaagtctccacaatacaacattcacagtgtgaagaatacaattccaaattacataaagaactagaaaaagcatctggacacggtggctcatgcctgtaatcctggcactttgggaggccaagacaggaggatcatctgagcccaaagtgtttttgagaccagcctgggcaacacagtgagacactgtctctacaaaaaatgaaaataaatttaaaaaaattagccaggtgtggtgatacatgcctgtggtcccagctacctgagaggctgaggcaggaggatcacttcagcccagtagtcaaggctgcagtgagccatgtccacaccactgcactccagcctgggcgactgagtgaaaccctgtctcaaaacaaaacaaaacaaaaacaaacaaacaaacaaaaaacacctagaaaaattaaacccatttgcaatttgcaaaggaaaagacaatcagcagagggcaactccaagacaacccagatgctgaaattctcagacaaagatattaacagagctattataactaagatcaatgaggtaaaagaaaatatgctcaaggccggacacggtggctcatgcctgtaatctcagcactttgggtggccgaggcaggcggatcacgagatcaggagatcgggaccattctgaccaacatggtgaaaccccgtctctactaaaaatacaaaaattagccgggtgttgtggcgcgcgcctgtagtcccagctacttgagaggctgaggcaggagaatcgcctgaatccgggaggcagagcttgcagtgagccgagattcagctactgcactccagcctggcgacagaacgagactccgtctcaaaaaaagaaaaaaaaaaaagaaaatatgctcaaaatgaaggggaaaacagtaaatctcagaagagaaactgaaaaaaaaaatttaagtggaaatttttgaacagaaatacagtatctgaatttttttaattcactgaatgggcttaaggacaaaatggagatgacagaggaaagagtcagtgaaatgtggaagcagaacaatagaaatgattcaaactgaaacaactctgggtcattctcagtctctagaaaaaccaccctcagaccctttactaaagtatacacagggataattttctgttatcagaaaaattggtatcagagagaaacagaataacttgggatcacagagttttctagtggtcctaaattatataggaagcaaggggaaaataattttatttttcctcctataattgctgaagtagcattcaggattgttcaggaaaaaagccaggaaggattttaataatttttctgccctgtgcagtctcttcaccaaaaagccaacatggtaaacaggccgatggcaggatggggtggggaccaatcagggggtatggggctaaggaagtgccagcagcttgctatgtatgaaccaacctaggtggttttaaaagcagcttccctgaatgccatcactgactgagtcgcttctcacattcaagtcacttcatgttggagttcagaacactccagataaaagtggaagaaaaaacataagctgcagaagacatgtcaatttctttaaggcctgccttttgctcacttccctcctcccaaccccacttgccaacaagaaggaatgaagagaatccagagccagtgatcttttctgactaaagcgggaaactgagagtaagacaacgcaccctctaagtgtagagaaacttggatggggagtgagaaacccgggtggcggcctctagttctaccacagacattgttggacctcagatgtgtcttttacactttctgggtctcagcttcatcagtcaaacaaaaaggccagactaaatgatatttaacaatgatatactattgtcctttccaataacactatgaatgacatccttaaccatgctatctccatttgcccttgtagaaactataaacaggtccgaaaagatctaagtagaggcataccatttgattaattggagtacctcatgttatataaattattcaaacttttttaataattttctataagtcttgccattaatacttaaatcgcatcaataatagatatttcagtacctatctatgatagaggactgctgtaaaataatgtctttcaactgaaagtgcttctaattctcccagaataactttttaaatctacgtaacctttaggatgagaaggcaaatactcttatctcatatgacagatgagcaaacaaagggacttctgagacctttttaggaagctagtaacagacaaacaaaactagaatccagcaatcccatctctatgtgtcaggttatttttcaccttgccaaagaaaccttaccaaagaagagtataaacaagatcagaattagaaagaacttaagaacttttgtgcactttgggagtgcttattaataaataattgataaaactaggttgagattaatgtatctatttgaaagctggcactcaaagaaccggctctgctacttcctctttttttttggagacaaagtctcgctctgttgcccaggctggagtgcagtggcacgatctcggctcactgcaacctccgcctcccgggttcaagcgattctcctgtctcagcctcccgagtagctgggattaccggtgcatgccaccacgcccagctaatttttgtatttttagtagagatggggtttcaccatgttggccaggctggttctcaaactcctgacctcaagtaatccacccacctcagcctcccaaagtgctgggattacaggcgtgaaccaccacgcccggccctgctgtttccttttctaaccagtggtctacaattgagactaggcttccttgcccatgtttgtgaagtttagcaacagaatcacatctaaaattgttattcacctacggagagaaagttggccaaggccaagcacagtgcctaaagcctgtaattccaacattttgggaagctgaggcaggaggatcactcgagcccaggagtttgagaccagcctgggcaacatagcaagaccccatctctccaaaaataaaaccaggccaggtgcagtgactcacgcctacaatcccagcactttgggaggctgagatgggaggatcacttgagctcaggagatcgagaccagcctgggcaacatagtgagaccttgtctcttaaaacaatttaaaaattagccaggtgtggtggcgtatgcctgtagtcccagctactcgggtggctgaagtgggaggatcacttgatctaggagactgaggctgcagtgagtggagccactatactccagcctggacagagtgagacactgtttcattggccaggcatggtggtatatgcctgtagtcctagctactcagtaagctgagacgggagaattgcttgagcccacgtgttcaaggttacagtaaactatggtttcatcactgctgggtgacagagcaagaccctgcctccaaataaataaatgaatgaaagaaagttggccaaatcagaaggtgtaaaaaagtaaaagaccactggactgttaaaaaaaaaaaaggcaaagagaagaaaaaagagaaaagaaaaggaaaagaaaagaaaagaaagaaaagtttgcctgtgtgaaagtgataaggaaaatgtagagttgaggatcagttttgttgttatttttgtttaatgagggtactatcctagcactgtctgtcacatgtacgagctgcaagtcttaggaggtgcaagtcacccaaaggtttcgaatctttttaccttcacactcaactcagagaatgtgacttcccttgtactgactgttaagtgcccagagcatcaatctagaagttttttgttttacatgcatctcatctcccttaggagaagtgtatctcatctcttaaaatggaagattaaaatgcccttctatatacttggtggtatcagaagaagaatactaagctgtacctattagagagcctgagtgaaaaaggttttctgctgctattttaatttgaaggcatattttacagggtcactattatttctaccccctgtaacaagtttatttccattttattgcttctagggaatttccctttgtctctattccacactctctctccatcctgcctgctgccctggcaacatgctataagggaaaaccacacatgggattgaaagtcagattatctgggttctattctaattcagtcacatattactttaagtgattaaacttcacaacctcagtttccacaactgtatatagagattacatctaaacttcatgggactgttgtaaggattatataaaaatatacattaaatgcctaagcacataatgcctgaacgaaaatataccctacacatattaattcaattttcttttcatcactgtacacattctttttttttttcctctctctctctctctctctctcccccccccccccccacaatcaggaagccctgggggggggggcggggggggggaacaccttgagaaagtaacttgcccagttacagcagaaataattttaaataagtactaagagaggtggatgggtggggccagaggtataataaggcagcatccaaaagggcaaggaagatgcccaagtcagaataatcaggctctgtgccagttctgcctcccacccctaagccctaagttccttcttgtagctataactatgtctatctccttcttttactaagtcacacttgccaacatgtctcacgtcaaagtctacattattaaaaacaaacaggaggctgggcacagtggctcacggctgtaatcccagcgctttgggaggccgaggcgggcagatcacgaagtcaggagttcgagaccaacctggcaaacatggtgaaaccctgtctctactaaaaatacaaaaattagccaggcgtggtggcgtacgcctgtagtcccagctaatcaggaggctgaggcaggagacttgcttgaacccgggaggtggaggctgcaacgagctgagattgcgccactgcactccaccctgggcgacagagcgagactccatctcaaaaaataataataaataataaataaaaacaaacagtcatggtggcttgcgcctgtaatcccagcactgtgggaggccaaagtgggtggatcacttgaggtcaggagttcgagaccagcctgatcaacatggtgcaaccccatctctaaacacaaaaattagctaggcatggtggcacacatctgtagtcccagctactcaggaggctgaggcaacgagaattgcttgaacccgggaggcggaggtttcagtgaactgagatcacaccactgcacttcagcctgggcaagagagcaagactccatctcaaaaaaaaattaaaattaaaattaaaactcactcacattcacacaccaggtagtacaatgggcagtagaatcctgagttctactcttgtctctccaacttactagaatagtttcctcatttgtaacacagaaatgacaatgtgtcttgactacaagattataaggaccaaacagaagaatgtatgtgaaagtactttgtacacaataaaacatggttattgtcataggtacagtgggtctacctttggccagtttaggtgttaggttttactttaaaaaggcctcagttctacaatactctatttctgtgatccaaggctgcctatttccagttcaagtcctcttcttcctggcagctgaaaattttatattgtcatcctaatttcacttgattccctgatttttgcaaggttcctcaaatttctctaaccaaatgggctccatgtctccaaaatggtaactaaagaccactagaactgatcacctctacctgtccttttggttctaatattctaagattcttgggcctatgttcccaatgcactttgtctgtatctctacttgagcaattttcttagtctactttgcattacaggtttatctgacaccatctcctaaagaaaaagccacaggtaggttgtcctatgttgttttatattccccgtagcaattaacgtggagcttcacaaaagtattagttgaattgacttgatgctaatttctcatttttttatacttactatccctactacaccataattatagaccaccttattcttttgtactgccattggcctggtacagtgtgaaataaacagtcaacattttttttaacgacctgatgtgactagctctttttttttttttttttttttttttgagacagggtatcactctgttgcccaggctacggtgaagtggcacaatcacagctcactataacctcgaactcctgggctcgagcaatcctcctgcctcagcctcctgattagctaggacataactgaaagtgaaagcaagtatgacaactcagatcttagttttagctttaaaaataacaagctatgggtgtgaccttaggcaaactgcttcatttctccaggcctcattaagatatctcttacaacttttaaacaaagtctggagaggatgttgagaggaatcaagtaagaataagcccttctgaaaaaccctaggtttatctctagtatagcacttatcattctgtattataattgtctacttgttactctcctgtaccaaaccccgagctcctgaaaggccagaattatgtatttcatctctgaatccaagcatgtgcatagaacgtggcacacagtaacagttcagtaaatgttcaatggccaaactactgaaaattataagtgcctatacttacgaagactcttatgtataaatggacttatataaacttataagaaagaataattcatctccctcatgtacaaccctttcaaataacattaaataaaagtatttttcttattatcaccagctcaagtccaggttttgttttttgttggtagttttttttttttttaaagacagagtcgtgctctgtcaccgaagctggagtgcggtggagcaatcgtggcttcctgcagtctcaaccccctggactcaagcaaatcctccccgctcagctcccagagtagctgggactacagggatgtgtcaccacaacaagctaagttttgtaagttttgtagagatggggtttcaccatgttgcccaggctggtctcaaactccagagctcgagcaattcacccacctcagcctcccaaaatgctggaattatagacatgagacacggcaccagcctaggaagtccaattattgaatgcccagaatcatctgaaattcaggatccctagaagatatcctgacaagggcctcagaagtgcatgcctcctacgctctaaataatatacctcctaataaataaataaacatatatatatggagacaggtctctctgtcacccaggcaggagtgcaatggtgcaatcatggcttaatgcagccttaagctcctgggctcaagagaccctcccacctcagcctcccaagtatctgtgcaccaaaatgcccagctaattttttttatttttatttttttgtagagacagggtcttgctatgttgcccaggctggtcttgaactcctggcctcaaacgatcctcttctctcgacctcccaaagtgctaggattacaggcatgagccactacgcctgacaataatacctaatgcttatacattatttcatagttcaaagcactttcacatccatactctcaatccttaataatgaccccataaggatattatcaaattcattttatatgttgaagaaattgaggctcatattttaaatactttgctaacctaaggcaagctgatatcaactaaaggagggctttcatatttagcctctcttgcttcagtgcccaaaagaggcagaaacaagaacaccaccatctccactcccctggcctctacaaacgaggtggatcagaccactatctgctattgctttactgagctgactacctcttaagtttttctcgtctccataaaaatcagttacccagagtattttattatgtcttaagcaaaaaataagaccagcccagggagaaaaatccccaagattacaaacaaccacatttataagctgctggcttatatctttataaacaaagctaaaaaaataaggggaaaacctgctccaatggggagctgtaaaccctactgaccaaacagccccttggcacttaggtaggtagttatatacagctaatttagtctgtaatagtttttgtacttcttcaataatttgtactgcctattgttttctccataccattctaaatgcctcaagagcagagatcacatcttctagttaatttacatctgttcctgtacaatgaccatatagtacccaaaccaaaattggtttttctggcctagaaatttatataaagtcttatccaaatttaaaaattaaaatacataggctaggcacagtggttcatgcctgtaatcccagcacttgggagaccaagacagaaggatcacttgaggccaggagttcaagactagcctgggcaacatagtaagaccttgtctctataaaaaataaaacaaaattagtcaggcgtagtggcacacacctgtggtcccagctacttgggaggctgaagtgggaggatagcttaagccccagaggtcaaggctgcagtgagccgagatcaagtcactgcactccagatgacagagcaagaccctgcctcaaacattaaaaagtagtctgggcatggtggctcacgcctgtaatctcagcactttgggaggccaaggcaggtggatcacctgaggtcaggagtttgagaccagcctggccaacatggtgaaaccccccctctactaaaaatacaaaaattaactgggtgtggtggcgcacgcctgtaatctcagttactcaggaggctgaggcaggagaattgcttgaacccaggaggcaaaggttgcagtgagctgagatcataccactgcactccagcctgggtgacagagcaagagtctgtcttaaaaataaataaattaattaattaattaattaattttaaaaagactttaagtaattgacattcttcaactgagtaacatttataaaatcaacagtttctaataaagaaacaccaaaagacacttaacacctacaatggtgccaggcatacatttgagtgggcactcaataaagttgtgctgaatgaatgataactgagagcttaaaatccattaaaaaccacttaaggcagaataaaatatccaggacaagagccaaaagaaatgactagagactgtcaagttaattggaaaaataagattctaaggtagttccactcaaagtcatacttagggtaccacaagtgaacactctggattcaagcaccacattatatgtacagccagagtgaatgcattagggcagtgacttagcacgagggttctctctgctcagaccagcagcatgcaaccagcagcagcttgccccttcccccagttagtccccattaccaacgccctgaagcctagtcacagaactacagcagttaagccaggcagtactaaaagttagaaggaaatgagcatgccacctgacacttttctggcacaggctaagccgattagtttaggttacaaacacaactacaagattccaggacactgaagaaactactctttttctgcaaactaaaaataacttattaaaacgggagtgttcttcaagtatttctgccctgccagcaacccaaagttccatttcctcaaatccttcttagtcttattggatccaagtctccacacctcccccatcttcccaactcttcatcctaatgctatgaacacagtaaaagacctaaactcctttcctaactcatgcttttaacgtttcttttctaataagcaatcgtgcagaacttctatggctcctgccttgtgtagaaccacaactggaagacatgctgagcttcagcaaagaataatgaaaaacaaagaaaaactgaaggacaagatgcagcatgctcgggaagtcagctaaatgcttttcattcaggcaggaatagaaggagcctcacctacctagaagaatacagcataaggacaaatggtgtctagtatagagctagactatactttatcactttagaacaaagccatcaagcgtgttctagagacagactcatgtccaaatagctttagtatcctataagaatcattaggctggccgggcgcggtggctcacccctgtaatcccagcactttgggaggccgaggcggggggatcccgaggtcaggagttcgagatcagcctgaccaacacagtgaaaccccgtctctactaaaaatacaaaaattaaccaggcgtggtggtgcatgcctgtagtcccagctactcaggaggctgaggcagaagaatcacttgaacccgggaggcggaggttgcagtgggccaagatcacaccactgcactccagcctgggcaacagagtgagactttgtctccaaaaaaaaaaaaaaaaaagcatcattaggctatctcaaggttgaagtgacatttttcagggttaaacaaactcccatcatttaagccaaataaatcaagattgaattgcagactttctggtcatacagagctgagagaaggactcaaatcctactactaggaagtggaaattccaaggaagctagaaaaccctgtcctcagtagctctccctgctctcaggccctgaggtaagccagcatttcctttccaaggtcaaaaattaaccatagactttgaacatctctgtgctttgcaacagcaccaggaaaatgccacaatgctaagccaccctatatagacctaagacatttgctattcttgattattcccaagagtagtcacttgggatactcattaatgtactttctaaagatccaactttcaaagtagtcttttctcattcttatttttaacctttcaccatctctctttaaaaaaacaaaaacattcagatgtcttagagcactgaagaaaaagaaaacaaaaattggcttatctatataatctacactctcagaaaaattcctcctgaaaaaaaaaatttttgccctaagaccacccaaggtacacaccatggtaaagtttcaatgcagaatcatgctgtgagcaagagcaaatggaaagctgcagcccttcatcaaacagcattagaaccttccaagattcgtgaaatcaaagaatatcagagctggaaagatacttagggtgcaataatctagtctagcctttcattttaaagatggggaaaataaagcccaaagagaggaaacggagtcttgaagcaaagctggacctaggacctaagtggccagactcccaactctggtatcttctgccacaccatacctcttcacaagactgactttaagggagtcaagtggctaaggacagggtaggcaaaagaaagtaaacatatggtaccaagcaaagaaaccaactctctgtgaattctcctctgttgctttgtggtgtgactcagggagagttattcctcctccatatgccttaatttcaagagtttttctcttaaatatttcataattttactaagaagcaagatacaattatcactcatgccttaatggtgcctcccaaccactacacaggtgaagtcaaaaacaatcgactactagaatggaaagactacaagaacccttaaacagaaagattaacatcattttggggcaaggaggtacatttttttaaaagattactcaactagatggctccactgaaggaatccacatcacctgacttcatattctagtatctagacttcaaggaaaataagttcacttttctgactcttggtttctttaacagtaaaatgaaacctacagactttcgttcattctaatgccctttcaaactctaaatgacctaaccttgacaggagccatgacagtaaaaaaaaggcaaggtacgaaagtgttgagcttgcccaggtttggaggtttgccccatcatttaagccaaataaatcaagcttgaattgcagattttcccatcatacagagctgagagagggactcaaatcatactactaggaagtggaaattccaaggaagttagaaaaccctgtcctcaatagccctccctggaagctggcagatatgcttgggtatctgctggcctagtcctacgcatgagtcctagcagatatgcttacaacccgacagtatcagtggcatcgttaaaattaaaatggagaaaacagtgcatactttcttcaaaagtatgcccactaaaatgatggctgcgacccctgtaaggatctagctggaccatctgcagatggtttaaatttgccattgctgattttttttctatcccctaccttgatatcaagtatttagtgtcttactatgaagtaaatcatatactttctcaatatcctattctctttgtttttctctttcattttaagtgcatgttagacatttaaagatctatgaaaaataaactcttagtaacaggtaaataactagaattttcaataaacacggaaaaaagtgttgagtgtgagcaagctttttactaaagcacatcagtctatacagccaattcagcattctccattcagaggctgcctcttcccagggatgtggctaatagtgaaaacacaaaataatgtaaggaaagaggacaaaggtttcattttctgctgtctcatcgacacatcttaacatggaggacacagtatatcagagattaaagccagaagttaaatcaatgcaaaaggaaatgcaagctccaatgtcaattatgaaaagtaacgaatcttaaataagcaagtacttgcctgcctgcctgcctgcctgcctactaagactgggttgaagattatttctatcgacaaggttacaaacagtaattttcaacacttcatatggatatacaattacctgggtacttgttaaaattacagattcctcggtaccattttcaaatcttctgattaagtggatctgttacagagcccacagactgtgcattctgatacagatagtccacagactatactttttaaaatactgtgaagtgtgtatgggagggcgatcattaggtctcctggacacataaatatacgtcttctggaatggtataacccacagtaaaatatgtgttccaaggatggcatgcaggccaatttttaactgtaccagacccactcccctcccttctacctcctaaagcaacttctgaagtcagtgctctctcaactcatataaagggcccttctaaatagtgactaaaacacactatgttggctcctattttagatcctattttaaaacaagcaaggccgggtgcagaggtcatgcttgtaatcccagtacattgggaggataaggcaggaggatcagctgagcccaggagtttggggccagcctgagcaacatagtgagacccaacatacttgcttctcctgttttacttctcttcatggttctcagtatttcctgagattcattatattttatatttacttacactctctctcactgaatgtaagctctattagaaaaggggcttccccaccactaccactatattcctagaacccagaacagtacctggcatatgacagatgctccacagaagtttaaatacgaagaaggcaccattttagaaaacaaaataagttcttagtcttacaccctgttcagtttattgaccatactgtcagctgtacctttcatcctggatggccattcttgcttttgatgtttacagaattcaggaaagtgaatataggtaccagcccagagaggctctctgctacctgactttcactactctatggtaatgtgcaatttctcccgcaactgaactacaacagaagtttaaatgtctagcctacagatagatgtttccacatgccttaaactccacaggaatgagttgtcttttactatgtgagaagtcaaatgtaatgttggcaaataccagtgtgagagctacaagtttcaacaaaagcagcacactgtatattggcagtcaaaatcacttcgctctattctgcattaggtcagccaaacgcttcctgtcaagactcagtaactctcaccatacatttttgtctattcattggtctatgggcagtaatgtcttataaagcacacattactaagtgctttatatacatcaccctattcctcaaaataattctataagagttattattctcattttagagattacaaaattgaagctccaaggcacttagcaatttgcaactaataactaattagcagggctgggatttgaattcaggtctacctgactttaaattcttggtttttttcactgtattagtttaattcttaaggcttctcccaccaccttccaccctctgcactaagcctggcacacagaaaacatttgatatttactgaatccatgagagttaaaaaggataatttaattcaaactcaaggatctgtctaggatcaaattcttcagctccaattttagttttgttttttgttttgttttgttttgttttgagacggagtctcgctctgtggcccaggctggagtgcagtggcacaatctcagttcactgcaagctccgactcccgggttcacgccattctcctgcctcagcctcccaagtagctgggactacaagcgcccgcctccaagcccagctaattttttgcatttttagtagagacggggtttctccatgttagccaggatggtcttgatctcctgacctcgtaatccgcccacctcggcctcccaaaatgctggaattacaggcgtgagccaccgcaccaggcccaattttagttttaaaaagaaaaaaagtggccgggcgtggtggctcatgcttgtaatcccagtactttgggaggccgaggcaggtggaccaagaggtcaggagttcgagaccagcctgaccaacatggtgaaaccctgtctcaactaaaaatacgaaaattagctgggtgtggtggcacgtgcctgtaatcccagctactcgggaggctgaggcaggagaatcgcttgaacctgggaggcggaggttgcagtgggccgagatcacgccgctgcactccagcctggtgacagagcgagactctgtcccaaaaagaaaaaaagaaaaaagaaaaaacttaagttcattcaactcccttttaatttttaaaaaagtggaaaatacaagtttctcagttaaaaaaaaaacaaactgggtttattccaaaatggaatccatcataacataattcattactatgggaatttggatataaagcaagtgaaatcataaaaagcagcatagcttagtgtactaagacatggatgtgaagtaaaatctgaatttattaataagtttcagctaaaagagataaatgtacttgcctccccatctaacaatcatgctctaaagttcaaatgtgttaatgcttataaaaacacttcataaatgtaaagtgttatacaatattaattattagtgttaattgagccttgaagacagaataaaagcctctaaggccagcattattaaaaccccattatatttggagcattataaggtaaacatcttaaactcaaattagtttatccttaagaaagaaaggatgtggcttacccattactaacctttttatatgtctaagtgctatgtctccaattggcactattaagtctccaatagcagagaactgggatacagacctcaatatattgtttcacttttagaaggattataaccctggcctcattgtgggggagggacactgggttctataactagataataattccctcctttcatgctaaggcacttatctattcagaacattagatgtcagatctgtaatactgataaaaaatattccagattatttcttccagctataaaagctgtgcttcttaggcggagccaataaacattaacagcataagcctatatattgattagtctttcctaagctaaagagaaaataaacagaaaatatgcaacaatctttaaaggctatagcatcactcctaatgaatgtcacaaagtgcatttatcgatgacattgctgagactgatatgaaatgataaaatatttttaaagccagtggatctgggtagataagagactgtttagaagctactgggattgtgtgtatgtggtggggcatattttaaataatgatcaagataggacaatctcatcattagactcaccattctcttattttcagccctcaaaaattaatgaccattgccttatcaaaacccagattataaagatggcaatgaggccaggcgcggtggctcacacctgtaatcccagcactttgggaggccaaggcaggcagatcacctgaggtcaggagttcgagaccagcctgaccaacatggagaaacactgtctctactaaaaatacaaaattacccaggcgtggaggcgcatgcctgtaatcccagctacttgggaggctgaggcaggagaattgcttgaaccggggaggcggaggttgcggtgaaccaagatcatgccactgcactccaccttgagcaataagaacaaaaactccgtctcaaaataaataaataaataagacaatgaacttcagaatcttgcaacacattttaacatgcacatagccttcttataattcaacatttcctccaatccatctcgcaacaaaatcctccaactattccactcctactagagaaacaaattccatcccatcaaattttcctaaggaaataagatcacttaaaagattttcctccccagttcattcattttctgcatctgtatctatatttatatacgtaccatgtgccagaatcacaatggcattgtatatctgccagggctgagtttcaaagaatacatgtgcacttagcagacaatattataaatattataaataaataagcagatttagaatacaggtgactaacacataagtaagatgtataaagggttatccacaataactacagattagtctaaattccttaatgcatcactcaaagccctggcaagctggaggttatcttttttccttctatggacagactgatccactcatttcctgaagacaaattacttcatgttataactttgcccagacattttccctgcctggaataccctttccatctcatcaaatctattcaagaaattcaatgctaatctctcttcagtggaacctttccacattcactattttttaactctacctttgttgataacctactgacattcggtatataagcatatattactatgatagatgtactgttcttttatacaggacatgcataaacatttgtgtatgtgtttatgtcataatactccaagtaaaacacaaaactccttgaaggtgcagaactgtcatttctttgtatttttacctgtacaatattatgaatataatggttattcaatagagatctgtttaagaaaaaaataaaagagggaaagagaggcggggttatccttaggatccaccaagttaacagttatctttttttttttttttttttttagagatggggtctcactatatagcccagtatggtcttgaattcctaggctcaagcaatcctcccacctcagcctggcaaagtgctgggatttcaggcgtgaaccaccatgctcagtccccaaattaatagtttcttgaaattaagcccttatcaatggtctgaatccttccattgttttatggagtactatttgtattcatcaatggtttcctatcacttaaaataaaactctacagaatctggttattgccacccctcctacttcatctcctatcatattctaccattctctctgagacctctcactcaatgttccatatacatacattggcctcctgggtcctcacgtcagccagctcatttccaccttaaggtctttctacctgggggttgggcacagtggctcacacctgtaatcccagcactttgggaggcagaggtgggcagatcacctgaggtcaggagtttgaggccagcctgggccaacatggtgaaactccgtctctactaaaaatacaaaaattagccaggcgtggtggcgggcacctgtaatcccagctacttgggaggctgagacaggagaatcgcttgaacccgggagatggaggttgtagtgagctgagatcaaccccactgcaatccagcccgggcaacagagtgagactccatctcaaaaaaaaaaaaaaaaaaaaaaaaaaaagatctttctacttggagcttcctctgccttccctcagatcttcccatggcagctactgcctcctaattcaagtcacagttcaaatatcattcctcagaaatgccttagctgacaatcctagctaaagctgcactcctctcacattacttcctagtatatgaaacttctctttttctccatctcaatctgaaattattctgttgatatgtttactacttgtctctcccaactagtatgtaaactccatgaagagaagaattttgagttctgttcaccactgtaccccagtgcctagcctggaatactagctggtatgcagaaggcagtcaataaatattaatccaaaaaaaacgagtttgtttcctctcacctaatactgtagttctcctcaggagcaagaacattgtttcctgctcctatttattcatttatttattttattttattttattttttgagatggagtctcaccctctcacccaggctggagtacagtggcgtgatctcggctcaccgcaacctccacctcctgggttcaagtgattctcttgcctcagcctcccaagtagctgggattacaggcgcatgccatcacacccagctaatttttgtatttttagtagagacgaggtttcgccatgttggccaggctagtctcgaactcctgacctcaggtgattcacctacctcggcctcccaaagtgctgggattacaagcatgagccactgcgcccggcccacacctggcttatttttaattttattttcatggagacagagtcccactatgttgcccaagctggtgtttcctacctttaatctcccacagcatctaacagactaaatgcactgaaatcaccaaataactgctcaacaaatgaggacagaaatatggtatttccttttctgacaccccctccagttacatctttaagtcaacaaatactcattaagtacctaccatgagtcaggcagtgagctaggcatcattctaatttcttactttttcaatttgtcatactcatcaatgatattctgaaaggtcaaacacctggtcataagctaaagaatccttgacactgccatccccagtcaatctcattttattgaacaaagaaatgcaactaattacagctacctgcagggcaccatataaacgtactagttactgtttatgtcaggagaccacacagaaaactttactgtccaattcttaatatgcgtctcttatctactattgttcttcaagagaacacttcttgtttaaaaaaaaaaaaaaaactataaaagacattcctgagaaatctggagacatctgaatatgggctgataaagaaaaacaattttttaggtgtgataatggtatggtggttacatagcagattatccttattatttagggtgacacatctgcagcttgtcaaattgttcagaaaaaaatttgttgtgatatatatagagacacagatactaacagcaacttaagtataataaggcaaacagttgacaattactgaattccaatgaatagtctaataagtattctatcaacttttctatgttttaaatttttcataagaagttgctgagaagaaaatgtttattttaagaagattattaggtgcaattttctagctataactacttgatggtctttaatacaagcttttacatataattagaccaaaactgatccagaaaatactacaggactcagaaactgaaccactaaaacgcaagaaatactgacataagaagtaaggaacccaaggcaaaaacctgggcaaaagcctagactaggtcccttcttcttaaccagccttgggctcagaaaagaaagacactctattttggaagcctgcttctagaaagcacaacacatgaagacccaatctttcagccttatcctcccaaggagataagtctatgatgggaaactaaactacaaaatcacagtgacgatatatacgaacagatctttctaagctcacaagcatttttaaaaatattatttaattattattgctattattacttaggcagatattaagaactataatcacaaccgccagtgtaataattgattcaagctaagattatcagtggatgctaaaaccatttggttggaaaataggatatttatactctctcaaagtcaccgtacagatttctcacaaagggaagtagggatccctacaacggaaagataaaacttaccatcaacaatgagacagactgggcgcagtggctcatgcctgtaatcccagcactctggaaggccgaggcgagtggatgacttgaagtcaggagtttgagaacagcctggccaaaatggtgaaaccctgtttctactaaaaatacaaaaattagccaggcatggtggcacacacttgtcatcccagcttcttgggaggctgaggcgggaggatcacttgaacctaggagggggaggctgcagtgagccgagatcgtgccactgcacttcagcctaagcaacagaacgagactccatctcaaaaataaataaataaataaataaataaataaataaataaagagatagactgacattatatgactcccagtacaacacaaggggaagtacacagcagcatctatgtaatatttcttcccaaaaatgtctaccctgaatctaagtacaagaaaacaatcagacaaatccgatttatgggacattataactggcctggactcttccaaaggagaatgttattaaagatatacacacaaacaagttagaaaggactgctctagatcaggggtctgcaaactgaagttttataggaacacagcaacgcccatttgtttatgaataatttatggctgtttttccctcacaagagacaagatggcccacaaacctgaaaatagtatctagctctttacagaaaaagtctgctgactcctactctagattaaaacagacacaaggccaggcaccgtggctcacacctgtagtcccaacactctggtagcccaagtcaggaggatcacttgagcccaggagtctgagaccagcctgggcaacacagcaagaccccatttctataaaaaattttaaaaattagccgggtgtggtggtgcacgtctgcagacccagctactcaggaggctaaaacaggaggatcacttcagcccaggagatggaggctacagtgaagtatgaacacaccactgcactccagctttggtgaaaaagtgagacccagtctcttaaaaaataaacaaggccaggtgtggtgacttacccctgaaatcccagcactttgggagatcgaggcaggaggactgcttgagcccaggagtttgagaccagcctgggcaacatggtgagaccctgtctctacaaaaaaatttttaaaattagcctggcatggtggcgcacgcctctggtcccagctacttgggagaggctgaggtaagagaattgcttgagcccaggaagttaaggctgcactgagccatgatcaggccactatactccagcctgggggacggtgtgagaccctgtctgaaacaaacaaaaatagcagtggaaattagttgccatgcttttttttttcccaacttttaagttcaggggtacatatgcagaatgcgcaggttggttacacaggtaaattgtgtgccacagcggtttgctgcacagatcatcccatcacccaggtactaagcccagcatgcagtagctattcttcctcatgctctccctcctcccacccctgccatgctttattaaccaatgaaagctcaatacaaaaactcaatcccctggagtatgtttcaagaagaatctgtgtgacaaggaactatcaccaacaaaacaaataccaatccacaattctttgtttggggctaaatgtgttttgaaattcaaaatttttcaaactttggaaacttaaggactggggcagcacccaataggcaaacacattaatatttctacagttaaatatgtgaataatcataataaaaagtgaaataaagattataaatagcctgcttcaattcaggtcaggttttgccaggaagcaaattactttattcattttaaatgcattttggcttttagaattacatacaaagaactatggattccttaggaatattctacacttgtattcaaaccatttaatcagcctacactagtacctacttatggggtggagttgggtagacttcagagattttccaagagaattgtatttgtgattccaacatagttgcatattctattgaagattcagaaaaaccacattaatatgaacaagtggttaggaacaggcatggtactggaatacatcattttaatcaggattcaaagcaaccagagagaacacgggttgggatagtgtaaaagcactcacattggaccggagttgctgtacatatatcataggtagccaattcaagagcttagagatacatgtaactgtttaaggctgcaaataggtctttaaaggaagagaatattattaaaattttaaattatgcatcaacttatacctaaaatatgtaacaaatatatgttggttttacttgatgctataaattattagggatcagaatttggagacaaattactataacccttagttgagaagctggtaaattcttgatataactccttaaccagactaacttagtaacccatgacaaagtagtatactggaaatagtggtgaactgaaagtccaggagacctcaattctcatctcaattctgctagtacttaattatacaacctgacccagaaacatagtagacacccagcaaataggttgctaaatcaatgagcttttttgtgcctctaattcatcatttgtgtcacagaacactagattaaagaaatttaaaggtttggtttagctataaattcttaaataaaaatgcaggtttattcaaatgattagagttagtcagaattaataacgactaattttaaagaaacagacagggccaggcgcagtggctcacacctgtaatcccagcactttgggaggctgaggcgggcagattccgtcttaaacacacacacacacacacacacacacacacacacacacacacacacagagggtccttcattaaagaggaaaaaacaaaaacaattttccaacaaacgtaaaacagcattacataggtcctgtagtaagaacaaatgagagggagtataatctgatctataacatgtgccccccaggaccttatcaactcaaactttagtattgtgtgaccttaaagattagtccaaatcattcactttacagatgagaaaactgactctgaaaaaattacataatatgcccaaggtcatactctctggccgcgacaatgacaggactaaaacccaaagttccgacgggcacggtggctcacgcctgtaatcccagcactttgggaggccgaggcgggtggatcacgagatcaggagatcgagaccatcctggctaacacagtgaaaccctgtctctactaaaaatactaaaaatacaaaaaagtagccgggcgtggtggtgggtgcctgtagtcccagctactcagggaggctgagacgggagaatggcatgaacccgggaggcggagcttgcagtgagccgagatcgtgccactgcactccagcctgggcgacagagcaagactccatctcaaaaaaataaaataaaagttccccagttcccagttaaatgcttacttcctttcttgtaatcaaaggcttctagaactgcataacaacaatggtgctatctgtcatatggcaatcacttcagtcaacatatgctctgtcagaacctctagttccactatatcatctttatacatggcatgggcaatgaactctaggcaattaaataaaaaaacccacatagaaagtatttccaaatcctatatccagtaagagacgagtatccagaatatacagagagatacagagatcttacgactcaataataaaaaatatccaactaaaaatgggcaaaggatttgcacaggcatttcttcaaagaagatatacgaatggccaataagcatatgaaaagatgctcaacatcattaactgttaggaaactgcaaatcaaaaccaaagtgaggcgaggcatggtggctcacacctgtaatcccggcactttgggaggctgaggcaggtggattacctgaggtcaggagttcaaaaccagcctggccaacatgtcgaaaccccacctccactaaaaatacaaaaattagccgggtgtggtggtaggcacctgtaatctctgctactcaggaggctgaggcaggagaactgcttgaactcggaaggcagaggttgcaatgagccaagattgcgccactgcactccagcctgggcgacaagagtgaaactccatctcaaaaaaaaaaatgagatgacacttcatccccactggtatggctgtaataaaaaaaagacagacaataacaagtgtaagagaatgcagagaaactggaaccctcatagattgctattgagaatgtaacatgatacactgtgaaaaatgtctgacagtttgtcaaaaagttaaacatacaggtactatatgacccagcaattctactctaggaattacatccccaaaaatgaaaacttatgtccataccaaaacttgtagaagtattcatgacagccaaaaattgaaaaatgtccatcaactaataaacagataaacaaaatgtattactgttactattaatttatcttgagatggagtcttgctctgttgcccaggttggagtgcaatggcacgatctcagctcactgcaacctctacctcccaggttcaagcaattctcctgtcttagcctcccaagtagctgggattacaggtgcatgacatcacgactggctaatttttttttgtattttagtagagatggggttttaccgtgttgcccaggctggtctcgaactcctgagctcaggcaatccacccgcctcagcttcccaaagagctaggattacaggcgtgagccaccgcacccgaccacaaaatgtagtattattatacaatgggttattagccttaaaaaaataaaacaaagtactgatagatactacaaaatgtggatgaacctggaaaacactatagcaaatgaaagaagtcagatacaaaagtctacatatggtatgattccatttatacaaaatgtccagaataggcaaatccatggagatagaaagtagattatgattgccaggggctagaatagcagagaacggagagtgactgctaatgagtatgggtttcttttgggggtgataaaaatgttctgaaattaaataatgatgatggttgcacaaccctgtgaatgtattttttttaaagcaccgaattatacacataaaatgatttttatggtatatggattatgtgtttgtgtgtgtgtgtgtgtgtgtgtgtgtgtgtgtgtatatatatatatatataaatgaggccaggcacagtggctcacgcctgtaatcccagcactttgggagactgagttcagactgcctaagctcaggagttcgacaccaccctgggcaacggtgaaacctcgtctctgctaaaaatacaaaaattagccagggatggtggcacgtgcctatagtcccagctactcgggaggctgaggcaggagaatcgcttgaacccgggaggtggaggttgcagtgagtcaagatggcaccactgtacttcagcctgggtgacagagcaagactccatctcaaaaaaaaaaaaaaaaaaaaaaatatatatatatatatatatatatatacacacatcatatgtatattttgtatatataatgtgtgtgtatatatatagattatatatagatatagattttttttttccacacacacacagacaccaaagcgtacttcccactcatttcccattcatgccctctctggttggaaaaagtaaaatgccaacacaaggtgaaagcatcaaggtctcaattcagtatctattgagcaaggcatgtactataaagtgggaatacagagatagtctgatcttatgatattcagtttattataaataaagtacgcaaataattacaacacaatgtgttaagtgcaacaacagatgtacaaagggcagaaggaggtataggtgacccttgaacaacatgggtttgaactgcacaggtccatttacagatggattttcttctaccttcactaccccaagacagcaagaccaagccttcctctccctcctcagcctactcaatgtgaagatgacaaggaagacctttatgatgatcctcttccacttaatggatagtaaatatattttctcctgcttatgatttttgtaacaatttctttagcttaatttattataagagtacaagtatataatacatacaacacagaaaatatgtgggtctaatatagtggttcacacctggaattccaacactttgagaggctgaagcaagaggattgcttgaggccaggagttcgagaccagccctggcaacatagcaagacctcgtctctacagtgaaattttaaaaattagctgggcttggtggcacgtacctatagacccaactacttaggaggctgaggtgggaggatcacttgagcctgggaggctgagactgctgtaagctgtgctcatgccactgtataccagtctggagggcagagcaaaattctgtctcaagaaaaaaaaaaaaaatgtgttaactgtttatgttattggtcaacaggaggccattaagttttggagaagtcaaaggttacactcaggccttggagagagtaagggctgggtgtattttcaagttgagggaccaccctactactacccccacatcatggtgtttcctccaggagtccaagagccttgccattcctcttggtgcttccttcaggagttgaagggcctggctattcttctcactcctgtagtagcacctatccagactctctgctgttttctgacttagggcaactacaaccatggctgacaaatggtagctactcacatgggtggaagaaagggtactacacatattacacatatgtaatacacatattacacttacaccaagctcctggccatctcttgtggcttcaagcagaaccccaagcagttcatgatcacctggatcttgcagatgcacaaccagtgggccacgccctgtccttgaactcctgggagctggtggtgctaatgggcaacttgactcacaatgccatcttcaactaccactgcaatgccttgtgggaaagtggcatggcactgcttgcctggctgctcagagcctggtgccagcgctaaaagtccttcctgccctttgaggccaccgagctgcctttctagccctggaccaccaaggaggagggcatccagctggtgtgcaagacaggcatgctcgactggatctactgtgagcccctctcggcctccttggaccccttgtccccctcacatgagccagtggcacccaaggacatgcccttcactcagggcctacagcagtgtctgctgctggcaacacctgctgctggcagcaccctcagagctacatctctccctggtcactctgctagaggccatgatggagctcagaccatctccaacgttggcctgctctggcatcagagccagtcacgccacaccaggctcatgctggagcccaatccaatgctcaagcacctcacaggctggctccttagccacagtgtgcccagggagaaggtggataaagagctcaccaaggtcctcctggagctgtacggcaaagaggccaagtacaaccacagctacctggtctgtgggctgggagacgaacagtccctaccacccctctactctgaccaggccagcaggttggagccacccatgcgtgacaactagccctcagcctggctcttggagaacgggacacggcctggccccacattcctggaaggtgggggaaaggaggaaggctagatttcaggaaacctgctttctgctttgagttcaggggagccaggcaagggagcctgggaccttgtaggggagacaaaaagccttgggcagtgccctcccagtgtatcccttgagcctcctgtgggcaagccacaccctcatgccatgttcaagggacccaagaagacaggtgtgtccttgccctcaaccactcacatgggtatcactggtcagagctgatgaggggagcaagccacatcagtggccaattgcaatgagtctctggtgtccctggagggagtgagagcacccaaggacatagtattcagtgtgttacattttggcctgggcagcaaggtgggtgggcacagcggtgcagccacccctctgccacatgggccaccaaagcactacaggccaagcagggagatctcatggtccataacataaaatcatcttgaagtttttactctaatttttgtgtttttttggaaacagggtcccaatgtcccccaggctagagagcaggggcaagatcatagttcactggagccttgacctcctgggctcaagcgatcctctcacctcagcctcccaggcagctgggaccacaggcatacaccacaatgcccagctaattttttttttttttttgagacagttttgcttttgttgcccaggctggagtgcaatggcgccatctccggctcactgcaacctccgcctcccgggttcaagcaattctcctgcctcagcctcccatgtagctgggattacaggcatgtgccaccacacctggctaattttgtatttttttagtagagacagggtttctccatgttggtcagagtggtcttgaactcccaacctcaggtgacccacccgcctcagcctcccaaagtgctgggattacaggcatgagccaccgcatccggcaaaagcccagctaatttttaaaaatactttgtagaaacaggatcttgctacattgcccaggctggtctcgtactcctggactcaagtaatcctcctgccttagactcccaaagtgctgggattacaggcataaaccaccacacctagcctactctaaattttcaaaggtctttttaatgcattatttttagttaatattttattttgtggatacatgacactttaattttggtgacagtcatttctctttttgtaatggttcttctcttaaggcaatgtttttctttttggcattgcctcccactttgaaagcacatttttgctgtttgatcactgaggaaggagctgccagtcccttctgatgagtctggtttctccaggggcatatgtggcctcgggataatctgagttctgaatcggactttagggtatgatggggccagaattacacattacagcttgcgagaacagagccctggtggtctggcttcatacctgaggtgctgggcacacaggcatccaataaatggtgggtgcataaaatatatatatatatacacacacacacacacacacacacacacacacacacacacacacacacacagatttttgacagcaccagagggttggcacccctaactcccacattgttcaagagtcaactgcaacttactatggatcagggaaggtctcacagaagagaagatacctaaaggtagattttaaagaatgaataggccaggcacggtggctcatacctataatcctggcactttgggaggctgaggcagcaggaggatcgcttgagctcaggagtttgaaaccagcctgggctacatggtaagacttcgtctctattttttttttcttttttgttttttgatagagtcttactctcttgtccggggtggagtgcagtggcatgatctccactcagtgcaacctccatctcctgggttcgagcaattcccctgcctcagcctccagggtagctgggatttcaggtacctgccaccaagcccagctaatttttgtatttttagtagagacggggtttcaccacattggccaggctggtctctaactccttacctcgtgatccacctgcctaagcctcccaaagtgctgggattacaggcatgagccaccgtacctggtcgatggtaaaatttaagctgactcttttaaaatgagtagaatctatgtataaaaaagaaaaatgactagattttcagatatactaaggaaataataaatagtgggcaaaatacaactggaaatgcacatacttagtttggcacagccagagtaacccagattgctgaagcggcactgactagttactggtgatggtatgactttagtagaaacactgtctatagtgttttagttgcttcagttgttttttgcacatattcttaccataaacatccctctaggattgttatgctggataaaacctttgcgccaggctaactgtttaccatccttatttcatttttacaacaaatctgagataagtattaatatcccaattttaactagaaactcaacttcagaaaggttcataacagttcacagtaatacatcccagcattctgttaggtgttacaaatttattatctcatttaactcttcaaacaaccctaagaactaggtattgctggtacttctgttttacagatgagaaaactgaggttcagggaggttatgcaatttgctcagggtcacagtggtcttaagaggcagaactgagaattaaaattcaggactgccttatcctaaagctctcttccattacagtataatgctttatctaccttcaatcataactcagtctaatccaatatgctttgattgttatactctctgcatttccagtaactaatatggtagtagcctcttgcaaggacaggtacaatacacatttgctgaagacagtgcttttacgtattaaatataagggaaggctacagccagagaaatgctagccaagagaagccccaacacaaggtgacttctcaaagactcttcttttcaggtttttccaaaggatatggaagagtctccaatgctatatcttttcatcgaagagatggaaagagtacatctgaccaagatctggttacagcaatgcagagatcttgcagtacatactgcagcaaaatcaggtgctgacagctgagagatatcaagtggcataaggctgtaagaagggaaaaaagccctagaaatacttagattccaaaaatgtctctaaacgactgcaagaaactgacacacaacaaaagagtgggattctattaaatccatttaagagttaaattggtgaaacaactcacataacaccaacagatcatactggtagctcaggtctcctctcattttaccttttttcacataaaaaggtaagctgtcttcccagttcctggcagatgtgatatccttcaaatatggtttctcagcttcccagatggctaggctagactaggacataagaaatatgcagtaacatgctccccacctcccatctaacagcaggaagagaataaaaaaccaaaagaagaaaggagtagccagcaatgatctcttctctcattccaaataccacaggttagtcctgcttatataagagaggtaactattagaacacatcccaagcctttttatttttctctttcaggttggggttaaggaatgttttaaattgtatttcttttcattttggtgggggttttggggggattttttggttgttttttctttgctctgtcttgctctgttgcccaggctgcaatgcagtggtggcatgatcacagctcactgcagcctcaacctcccagactcaagtgatcttcccacctcagcctcccaagtaactgcgaccacaggcacatgtcaccacgcccagctaattttttgtattttgtgtgtttgtaaagacagggtttcaccatgttgcccaggctggtctcaaatttctgggctcaagggatcctcctgcctcagcctcccaaagtgctgggcttacaggtgagccactatgcccagcctatttcttttaattttgttctggtgtgcttaaataagtttcttcatggatttctttgtaaaacaagacttactataacagactctagaccctacctctctcataggaacgctatttgaaggaaatgttaaagtacttgaaaaacttaaaagcataacacaataataataggtaatatttattgtgtttgttttgtgtcatttaaagccctttgcgtgaactaacgtattatctcacaacaaccctatgaggcagatactattaatctcttttttttttttttttttgagacggagtcttactcttgttgcccaggctggagtgcaatggcgcaatctcagctcactgcaacctccgcctcctgagttcaagtgtttctcctgtctcagcctcctgagtaggtgggattacacgtgcatgccaccacgcctggctaatttttgtatttttagtagagacagggtttcatcgttattggtcaggctggtctcgaactcctgacctcagatgatccacccgcctcagcctcccaaagtgctgggggattaccggcgtgagccactgcagctggccaacctcatttttaagatgagtaaactgaggcccagaaaaacagagttcctttccctagtttacacaaatattatatggtagagctggaattcaaactcaattcatttgagtcaataaatttgagtatatattactcaaatatacttatgtaatgaaaattatgttagaatattactacacatggattaaggaagcaaacacaataacctagtaaaacattcaacaaataatttgaattctttgtcctcaccatcgtaacaccaccatcttttttttcaagacagagtctccctctgtcaccaggctggagtgcagtggtgcgatctcggctcactgcaacctccacctcctgggttcaagcgattctgctgcctcagcttctcgagtagctgggactacaggcacatgctaatttttgtatttttagtagagacggggtttcaccatgttggccaggatggtctcgatctcttgacctcatgatctgcctgcctcagacacccaaaatgctgggattacaggcgtgagccaccacgcccagcccatgcaccattatctttatgcattctgagattaacatgtaacagataaatttatgcggaacataggctctggagtcacacaaacctagtcacatgacgtcacttaatagccgtatggacaagttacttaactgcgtctcagtgtcctcatgtgtaaaatagggataatacctatcacacagaatttaagaactaaatgggacccccatgcggtgcctcacacctgcaatgccagcactttgggaggccaaggtgggaggatcacttgaacccaggagtttgagatcagcctgggcaacatggcaaaaccccatctctatcaaaacaatacaaaaattaggtgtagtggtgtgcgcctacagtcccagctacttgggcggtagaggtggcaggatcacctgagcccgggaagatcaaggctgcagtgagcagtgatcacaccactgtactccagccttggtgacagaatgagactctgtctccaaaaaaataataataataggctgggcgcgatggctcacgcctgtaatcccagcactttgggaggccgaggcaggcggatcacgaggtcaggagctcaagaccatcctggctaacatggtgaaaccccatctctactaaaaatacaaaaaattagccaggtgtggtggcgggcagctgtagtcccaactactcgggaggctgaggcaggagaatggcgtgagcccgggaggcggaggttgcagtgagccgagatcgcgccaccgcactccagcctgggtgacagagtgagactccgtctcaaaaataataataataataataataataataactacatgggctttaagaaatgcttaatgctggcctggcacggtggctcatgcctgtaatcccagcactttgggaggccgagacgggtggatcactttaggtcaggggttccagagcagcctaaccaacatagtgaaaccccatctctactaaaaatacaaaaattagcaaggcatggtggtgggagcctgtaatcccagctactcgggaggctgaggtaggagaatcacttgaactcaggaggcagaagttgcagtgagccgagatcgcaccactgcacttcagcctggggtgacagagcaagactctatctcaaaaaaaaaaaaaagaaaaagaaatgcttaatgctttaagaaagttggccaaagccaggtgctcacacctgtaaaccaagcaagcactttggaagactgaggtggaaggatcacttgaggccaggagtttgaaaccagcctgggcaacatagtaagacccagtctctacccaaaaaaaaaaaaaaaaaaaaaaaaattaaatggattatatactcatcccagaatagttgttggcacatagtaagtgctaagcaaacaccattagctactactgttaatatttttatttcatttttctttgccattttccatgtaaacaagtatctaaaaaatgtttgtctcaaagctatcaagtaatcttgaaatgggcatatgttttacatttcacatttcagtgtctccatactttggtaatattttccagtaaatttataatccatgtaactaatattgctgcctatgcaagcatctcttctaccattttgaacttaagaaatacaagaatacaatagctacattgtgtttcttatgtgtagtgataatactgcaaacccttatctcttaatataaactgccacatttctaattacatgagagtcactctgtatggcttttcatcaaatgccccaaattaaaataggtagtgtcttcttaaaattacttactttttcatttgacaaatctcagacccaaaaggtaaagggacttgtgacttgctcaagttcatataggtagataatgataaagaccgacccggaaccttcagactgagttcaaagctctttttcatctctctgggctgaataattccatttcttgtcaggggaggtgataaacatctgaaaatagtgaatgactcaaatctcccaaggttaaaaaaaaatttcaagaagacaatcttcaaaggtcatttaatgtagcacaacaaaacaacaacgaccaaagtggcataactcagtactgtttccttctcaaaaaatcaggtcatctcgaaaatttgctttactaaatttgtattagcctaacacaaatctcatgctacttcttcccagctatctctgcaactttctgaaactgggcaacttcagctcaaaattcaatgacaaactccagggaactgtcacagtgcaatgttataggaaatattcctgaaaataagtggtgcttgtgaattctattctactgagattctcagtgtaattatttttctgtgacagaatctgatttgtttcatgaaaccatgctaaaataaaaaagaacacaaaaatgttctcatttaggacactaattgatataaaatttcccaaaaattttggagcagttcaaatctaacaagcatttaccaaaggatttaatccatatcattctttcaaaaagtctggcctataatcccaatgctttgggaagccacggtgagaagaccacttgatcccaggagttcaagaccagcctaggaaacacagaccaatctctaccaaaaatgtttaaaattagccaggtgtggtggcacatgcgtatggtcctagctactcaagaggcagaggttggaggatcacttgagcctgggaggtcgaggctgcagtgagccatgatggcaacactgtattccagcccaggtgacagagtgacaccttgcctaaaaaaaaaaaaaaaaaaaaaaaaaaattaaattaaaaaataaaaattaagaaagtccactctgaaaacaacataagactttttacttgttatagatttaaccagagtcaagaccagaagtgaccaatccattttacacacgagccacagcaggactgaggagagaggaagagaaaacaggaagactagcaagtcaaatcaattatttacttaaaagtccacagagtacagagcactataagatgtacagtgccaacatgctccaccctttctctgctagtcagtacaggccacaagatgaacaccagagtccaacaaccagccaaatgccaggcaaaatggccttatcaggctagatggggtcaaacacatatatttttaacttatagtcaaagaggctcaaggaagatgatcaacaacttaaatattgcagcgatattaaggaaaacaaggctaggaaaatgtctgaatatacagacattgggtcttttgaatgtgcatttacagtagtgttggggacagaaacaagacaggaaaagtcttaaaaagtgagtgagtgtaaaagcaaaagctgcatacaaaatgccattttaaaaatgtttagaagtaaaagggccgggcgtggtggttcacgcctataatcccagcactttgggagcggatcacgaggtcacgagatcgagatcagcctgaccaacatggtgaaaccccgtctctactgaaaatacaaaaattagctgggtgtggtggcacgcgcctgtaatcccagctactcgggaggctgaggcaggagaattgcttgaacccgggaagcggaggttgcagtgagccaagattgcgccactgcactccagcctggtgacggagccagactccgtctcaaaaaaaaaaaaaaaaaaaaaaaagtttagaagtaaaagaagaaaaagatggcaataattcaaaaagctgaaaaggcagaaaatttttatttgttttaggatagacaagacctctgtatttgtagtctgaaaagaaagactcaatagcgaaggtgaagatggaagagagaaagataactgatgagagtgaggtactggatactagagaatgcaatgaagaagaaaactgatccatgtggatcctggaagtcatcagacaaaagcaaataaagcaatgggacaaaagacaaaaagcaataaaaatggggagagaacagatggtaaggactttttgaaaaatcagaagctgtgcaaaaatggcaaaacaatggtctagagggacagtgaatgactagaactacaatgattgctcccctcgtccaaggagttgcagagtattcaaccaatgaaaacagaaataatagcattcattacagaaaaagccgtgttttcacttatgggttaggagatggaagaaatattggaagaaaaaaaattaagaacttaggactttgctcacatttgtgcacaggttctaccagacccagcagaaacaggtagtaaagggacatcaagaatgaggtagaaaagaatgggactgagcttttaaaatactgaggcaataaggcagacggaactttgagataactttttaccaacagtgaagatgaagaagagtaatctaaagaactttatggctgcagaggatgaggggaatgaagacaaacatatcaaaaaactgctggataccacagacaacaagtcttcagcactaactagccctaattttcaagtggaatcatctccaaaacccactttcccagaagctggacctgaaatatcctttaatttcatttgccaagactagcaagttgctgaactgtgtcaacagtttgtttgtgtttgtttttcgaattggacatttgtttttaataacgatttgttgtgttctacaaaggcataggagggacattccccaaaagataaatgaatgccacatgactagaactgggtcttctatttttatgatttagaactgggttttttgtttgtttatttttttaggcagagtctcgctctgtcgcccaggctggagtgcaatggtgcaatctcggctcactgcaatcccctgcctcccaggttcaagcgattctcccacctcaacctcccaagtagctgggattaaaggcacccgccatcatgcctggttaatttttgtatttttgtagaaatgtggttccaccatgttggccaggctggtcttgaactcctgatctcaggtgatccgcctgcctcggcctcccaaagtgctgggattacagacatgagccaccgcacccagccataactgggtcttctaagccccctttgcatgctcagacaggatggaaaaggatagataacaccagttaatatttagttagcacttcactgattcaaattactatctaatcaattagctcaactgacccactctttattcctgttcttatggtgcgtaatccaaggatagaggagcagaaagaacatggactttaaagtcactgacctagaattctaactctcccggttcccccagggatatttcttaaacctctatgagcttccatttcctcacctgtaaagtaggaataacagtacctatttcatgaggcagttgtaaagattaaagtgtaagtcaagtacctactacacagtagatgcttaagaaatggtagataatggccaggtgcagtggctcacgcctgtaatccctgcacttgggaggccagggcgggtggatcacaaggtcaggagttcaagaccagcctggccaatatggtgaaaccccatctctaataaagatataaaaattagctgggcatggtagcacatacctgtagtcccagctgctcgggaggctgaggcaggagaatcgcttgaacccaggaggcggaggttgcagtgagccaagatcacgccactgcactccaacctgggcaaaaaagcaagactcagtctccaaaaaaaaaaaaaaagaaaagaaatggtagataatatactccacatgttgcaatgaaaagaaatggaagaccattttaactaatgtcattataaactaaaccatccaagctgaaccacaatttattggttactgttgttaatacacacagggcaaattatgttaaaaaaatcataaaataacaaatgttttccaaaaagtcctctctatctaacagttaacctaactaaggatgacagtgtttattaaggtacgattttcataactaggaacttatacaatgtttcatggtttgaaacgtactgtatttttttccaaatgattacttccaaaataaactaaacttttaacttccagcttaatcctggggcaattttagagaatctcaacatctcacaaataaatggaattgaaaaagcatatggatataatgcagtccacagagaatttgagggcaaaagagaggctatgtcttgtaccctttccaacttcagttaactaataccacaaatgttcctcaattctaccaatttctttctttatttttttgagacacagtttcactcttgcccaggctggagtggagtgacacaatctgggctcactgcaacctctgccccctgggttcaagcgattctcctgcttcagcctaccgagtagctgggattacaggcgcccaccaccatgcccggctactttttgtatttttagtagagacagggttttgccacgttggccaggctggtctcgaactcctagcctcaggtgatccaccagcctcgacctcccaaagtgctaggattacaagtgtgggccaccgttcccggccaattctaccagtttcataagcttaagagctatcttcactttcttttcttctttctctacgttattaagtcccatctcttccttctccaaaatctctccaatatattcctttttcttcccattccacttgctaaattcatgcctgcagcataattttatttctttaaaaaaattccttaactggcttcctttcagataatctatacaacacttcttgattaatgtcataattccaagttcatcaagtcactgctcaacttgtaaaccttcaatgattcccaaatgttagcaagatcaggtccaaattcctcagtatgactgttaagactgttcataatctcaatgagcattacttcactatcttatctccttcctagtccataatctaaactctattactagaccagacaagtattcccagttcccatcaataatacgtctaatctctatctttgcccttgatttgctcttgcctagaaaaccattccctcatccttaactttctcaaatacaaaagaaaaaaatttaaaaagtaaaagaaaaacaaaaccttctctttcctttctgcctcttcaacctctatccatccaccactgaaaaactctagtctaactgcctgcatgaagccctcacagaccacttcagcctaaactaatcccagtaaactgtaacctgtcatttcaacatacactattagcataacaacagacctcctagggcagtcattttagtcaatggtattttcacccaagaatagtaaatttttcataaggctaaattattcaacatgaaaaacccctttaatctgagatgatgccctttctcttacctgtttttgttttgttttgttttgttttgtttttaagacagagtcgcagccagtcatggcactttgggagttcgagaccagcctgagtgacatagtgagacctcgactctactagaaatcaaaaatattacccacaaacggtggtgcacacctgtagtcatctcagctactcaggaggctgaggtaggagaatcattgagcctgggaggttgaggctgcagcccccgcctgggcaacagagtgagactctatcacacacacacacaacccaaatgctcctcaactggtcaataaacaaactataatacatctatacaatagaatactactcagcaatgtaaaggaatgagctgctgatacatgcaataatgtggatgaacctcaaaaatacgatgctaagtgaaataagccagactaaaaggctacagactacagactaccacttacagaacattctggaaaaggcaaaacgataggaatagaaaacaacgcagtggttgcctgagggtaagaattggggtagactacaaaagagcagaagggactttgcagaggtgatggaactgtgcaaaatcttgattgtggtggtggttgttggacagtatacatttgtcaaaactcacagaactttgggaggccacagtgggaggatcatttgaggccaagagttcaacaccagcctgggcaacatagccagacccccatctctacaaaaaaaaaatttttttttaattaccaggcatggtggtttgtgcctgtagtcccagctacttggggaggctgaggtggaaggactgcttgagcctgggagatcaaggctgcagtgagtcatgatcacatactgcattccagcctagggaacagagtaagaccctgtcttctttttcttttcttttttttttgagacggagtcttgctctgtcgcccaggctggagtgcagtggcatgatctcggctcactgcaagctctgcctcctgggttcacgccattctcctgcctcagcctcctgagtagctgggattacaggcgcctgccaccacacctggctaattttttttttttttttttgtatttttagtagagacggggtttcactgtgttagccagggtggtctcgatctcctggcctcgtgatccgcccgcctcagcctcccaaagtgctgggattctttcctttattttccttttctctccctctaagttaccttattatttccgtattaattctccctgctccattaactgtcctcccatctatttttccatcacatgtctttaagattctggtagtcactttaaaactgccctaggatctagtctcaaaacaaaattctaacataatgataagtcctcaagttcctacagaaaatattttcgcatatgttggaaaatgtctaattttatcaaattacactaagaatatatcatattatactccattacagctgtggcaagaagcataaaaactggtattcctgatttaaatctaccagggaccattactttgtttacacaccctaactacattttctaaatatctctataagaatcttctatatttaactagtttctgtatacttctgtaaagtcttccatttaatgaatctttaagtccatcaagatctaaaaatggctttctttcaatcctaggaaacataagacaatgttgacctcatttacttacagggcagtacacagttcataaaatcattatgtgttaaaacaatgtaatgttcaagagtaaactcaaggtcaaatcctagcttggcactgaccttgggtcaaaccgatctcacatcttagggacttagttttttcctctgcaaaatgaggataataatagttatcctcattaatatctaccctaatgggttgctgaaaagagattaaataaacacataaaaggtacttaagtactgtagctgtcatatagaagtcagcaactggtttcatcattagtcctcaatgactaagaattcttcaaaatatctgaattataaacttaaatgggccaggcgtggtggcgggtgcctgtaatcccagctactcggaaggctgagatgagggaatcacttgaacccgagagccaagatcgtgccattgcactcactccagcctgggcaacaagagtgaaactccatctaaaaaaaaattaacacttaaatgagctgctcattcactggtgaatcactaaaatggcctaaatcagataaatacccgcagataattgggaaaacagcacatttttgataaagctgttccaggacttaaccaaaaattaactttatctcaacagttaacgttaccagttaacttgaaactagataaaaacagagatttatgtttagaaacagaaaaatgctgtcagaccaaggtaaatgataccatttttctatttgagttcttcagcatctgtagaaagcctatgcaaataaagccggccaggcacggtagctcacacctgtaatcccagcactttgggaggccaaggcaggtgaatcacttgaggtcgtagttcgagaccagcctggccaacatggtgaaaccctgtctctactaaaaatacaaaaattagccaggcatggtggcatgagcctgtaatcccagctactggggaggctgaggcaggagaatcgcttgaacccaggaggcagaagttgcagtgagccgagatcatgccactgcactccagcctgggcaacagagcgagactgtctcaaaaaataaaaacaaaaaataaagcattggaaagtgggccagaaaaatacatttcaccctttaattatacttcagttcgaatctgttcctacacagatttgcctgtcagcagactaaacatgttcctttcttagacaaaatttaacaatattaatttattaacgttataaataaaatcacagtgacattaatacaacctaatgttttcattaagagaattccaatttaattgtaatatgggtcatattcataccatgatttgttttatagaggtttcagcactgaaaacaagtgctgttattcaatggcgccatcttgggaggtaagaccttccaaggattgggatgactgggcgcatcttccaatcatgtggccaagactcaaaacttttttgacgtgccatttataggattctcaaagacaaacctcacacacacacaaaatgctagtctccaccttttagaataacatttcatttgtggccaaaaacaatgctgaccactcacttccttcaccagactttcctatctccaaaagttaaatataagcacctgcacaatgatgacttaccagaattaagaacacgtaatatgctctaaagacaaattcaaaagaaatataccaaatatttcagaatttggaaatgtcactaaaataaatacataactttccaaggcagggagcagtggctcacgcctgtaatcccaacattttggaaggccaaggtatgaggatcactgagcccaggagttgcagaccagcctggcaacatgccaaaatcccatttctaacaaaagatacaagaattagtagatgtggtagtgcgtgcctatagtcctagctactagggaggctaaagtgagaggactgctagggcccgggagttcaaggctgcagtgagctgtgatcatgccactggagtccagcctgggtaacagagtgagaccctgtctcaataaaaaaaaaataacttcccatttggagagttctgatgtttgtttttaaaaagccgtcctaggccaggcacagtggtgcctacctataatcccagcaccttggaaggctgaggcaggaggatcgtttgaggccaggaattcaagatcagcctgggtaacatatcaagacctgtctcgccaggcacggtggctcatgcctataataccagcactttgggaagccaaggcaggcagatcacctgaggtcaggagttcaagaccagcctggacaacacagtgaaacctcatctctactaaaaatacaaaaattagcccagcgtggtggtgggtgcctgtaatcccagatactcaggaggctgaggcagaagaatagcttgaacccaggaggcggaggttgcagtgagccaagatcgcgccactgcactccagcatgagccatagagggagactccatctcaaaacaaaacaaaacaaaacaaaacaaaaataatacataaatcttgcccctaccaaaaaaaaaaaaatttaattagccaggcatggtggcatgcactagtagccctagctactcaggaggctgaggcaggaggatcgcttgagcccaggagttcaaagttgtagtgagctattattgagccaccgcactccagcctgggcaacagaatgagaacctgtctctttaaaaaaaaaggcagtcataataccttacagttgccccagagatgactatgaaactacatagtaacaaaattggaaatgtgaaatatcataccagatctgtgtaaaagcagtcaaatgatactgaaaagtaatgaaaaacaactgaaattgtctaatttaaacatttaaactcatacttccattatatttgcttccagagtgcccctgaaggcacagtatttaatatggttatttatatccactcatctttttatactcggttcaccttggtttgaataaactgcgattttccaaaataaagactttccatattgtttgttgttctgtgaaatttttcttgtaaaagatgggttaggctaggcgcagtggctcacgcctgtaatcccagcactttggaaggccaaggcaggcagatcacgcggtcaggagttcgagaccagcctggccaacatggcaaaaccctgcctactaaaaatacaaaaattagccaggcatggtggcaggcgcctgtaatcccagccacttgagaggctgaggcaggagaatcacttgaacctgggagatggaggttgcagtgagccgagatcgtgccattgcaccctgacctgagtggcaagagcaagactctgtctcaaaaaaaaaaaaaaaaaaaaaaaaaaaaaagggttgggtccaggcatggtggctcatgcgtttaatcccagcactttgggaggcggaggtgggcagattacctgaggccaggagttcaagactagcctggccaacatggtgaaacaccgtctctactaaaaatacaaaaattcaccagctgtggtggcaggtgcctgtaatcccagctattcagggggctgaggcaggagaagcccttgaacccgggagacagaggttgcagtgagctgacagagcaagactccatctcaaaaaaaaaaaaaaaaagagatgggttgggggtaagagaagaagtaatctcagtttagcttatcacattctgttctaatcattttgactacagtttaccagagacttcaaaatttgattactggccaggcacggtggctcaggtctgtaaccccagcactttgggaggctgaggagggcggatcacgaggtcaggagattgagaccatcctggctaacatggtgaaaccccatctctactaaaaatacaaaaaaattagccaggcgtggtggcgggcacctgtagtcccagctactcgggaggctgaggcaggagaatggcgtgaacccgggaggcagagcttgcagtgagccgagatcacaccactgcactccagcctgggctacagagcgagactctgtctcaaaaaaaaaaatttgattactgctcccctcccaaagataaaaatctagcatagaattaattcatgccaaagatgtcactaactggcattcttttaaaaaacctcagtatctgaccctcaacagcttgtgacactggatatctagcttctgtgtgtaccagttcctcatctgtaaaatggggttaaaataataaactatatacttacttcatgggtgtggtgaagaatacatgagattatgagcttgaaacatgataggtactcaataaatatttgttgagtgaatgagtaaataaactaatgtatgaaaaatgcttaggatagtgcctgtcacatagccaatggctaataatatcagtatcacgccagacgcggtggctcatgcctgtaatcccaacactttgggaagccaaggcaggcggattacttgaggtcaggagttcgagaccagcctggccaacatggtgaaacccctgtctctactaaaaatacaaaaatgagctgggcatggtggcatgcgcctgtagttccagctactcgggaggctgagacagaagaatcgcttgaacccaagaggtggaggttgcagtgagccaagatcacgccactgcactccagcatgggcaacaagggtaaaattccgtctcaaaaaacaaaaacaaaaacaaaccaattactacattaccctgtaatattctgatgtagtttcatcagaaaagccaaaataatcactgatttaaaatacacagtaggtacctcctaaaaactaatttaaatttaccacttaatttgaaatatgtactgagttaaatcaactaagttgctactaatttaaatttgcatttaaattggcttatagaacattcttctgcctttaacacaagaggaagagtaactactgagagagcttacccatcagacaaagcagctttaagcagatttaattggctcaagatttgctttgttgacatcaaaataaaatgttagtcaacagaaaattcaaataaagtactacctagtgtcttgtttctgttagtaattccaatctgagaacattaaacaagcactgataaagcattttttctaagaaggaactctgcatagttaattctacaccagtgacaagttccaaaggagaatctgctttgtggcattaggactggactcctgtactttcacaccctaatagtctctatatcgccggaagcagttggtgcactcccggcctttagattagagaaaatactaagcaggattctaataaaaagaatccaagttaataagcttaagaaattaaaattgctacctatacataaatatcattggtcatcaaaaactctactaaagacctactatgtgccagtgaaaataactgaggagggcattagctaaaacagcttctgatcgagaagcttccagtcaaattagctaattaagatattaatagaagctggtcaagttaaccaaaaatatgaggggtactggcataacaagctacaagatttctgagaaaataagaagcttttgatacaactaggtaaaataagatatgtgatagtgtgattttccatgaacacaaggtggtactggcaataaatgctataaaattttagagaagaaagattaactgttgcaaaaccatgatagacttcaaagagggagaactgagctcagtcttgaggggtggaaaagatttaaatagttaaacagcataagaggaaaggacaaaagataatgggaccaaaggtgctgaattgggaatatggccattaaatatttattaaatacctactctatgtcagtcactgtgttaggcactagagatacactggagaacaaaacagatgagttctctgctttcatggaatctagcagggaagacataataatcatgcacgcagatatataatcataaattgcaataggtgctatgaaaggaggcaacagaagccagtaatagggaataatgggaaaggactagcaagacacgatgatgagaaaaagtatccctgatatttatacataagctcaggcatgaaggcagccatgcaaagagcagggaaaagaagtgttcgaggaagacagagccatgcatacaaaggccctgaggtaggaaacagctcactgagtttaaaaataaataaggccagtggctcatgcctgtaatctcagctactctggaggccaaaggacagcttgaggccaggagtttgagaccagcctgagcaatattgtaagaccccatctctaaaaattaaataaaataagaataaaaataagaagttagcgtaacagaggcataatgggcaatgagattggcataaaatgccaattgcctacccgaaaagtagccaggagacgggctatacagggcattataggtcaaaataaagaactgaaatggccaggcacagtggctcacgcctgtaatcccagcaccttgggaggctgaggtgagtggatcaagaggtcaggagttcatggccagcctggccaacataacatggtgaaactccgtctctactaaaaacacgaaaattagccaggcgtggtggtaggcacctttaatcccagctacttgggaggctgaggcggagaacggcttgaacccaggaggtggaggttgcagtgagctgagatcgcgccactgcactccagcctgggcgacagaacgagactgtctcaaaaaaaaaaaaaaaaaaaaaaaaaagctgaaatttgaattttattccaaatctaaaaaccactaaaaatttttgcacggtcacattagtgttaaataaaaggagccagaccacaaacaatatatactatatgattcaatttttacaaaagtacaaaaaaagagcaaaataatctatgctgtcagaagtcaggatggtgattaccctgggtggtagaggggagacaggaactgaaagggaactggataggggcttctaggtactggtaacgctgtttcttgatctagatctaggtgctgcttacatgggtatattcagtttgtgggaaaaaaacatcaaattccacttttacatgcatttttctgtatatgtattatatacttcaatcataaagtttttaataacgtaatatacttttattttttttttttttgagacggagtctcgctctgttgcccaggctggagtgcagtggcgtgatctcggctcactgcaagctctgcctcctgggttctcgccattctcctgcctcagcctcccgagtagctgggactacaggtgcctgccaccatgcctggctaattttttgtatttttagtagccacggggtttcaccatgttagcccagcccataatacatttttaaaatactattttgtccagataaaaacaggaatagagtgctcacttccacaacacaaatactaaaattggaatggtacagggaagattagtatgtgccctgcacaaggatgacatgctaattcataaagcagtccatatttttaaatttttttgtaaaaataaagaaacaaacggtataaaggggcacatgcaaatacggcaggtcttgaatgaaagattacccgggtagaagctttcagaggagtaattcaaacagccagtgatacaaagtaccatgttaataaagaataaggctgggtgcggtggctcacacctgtaatcccagcacttttggaggccgaggcaggcggatcacgaggtcagcagctcgagaccagcctggccaacatggtaaaaccctgtctctactaaaaatacaaaaattagctgggtgtagtggcaggcacctgtactcccagctacttgggaggctgagggagaagaatcgtttgaacccgggaggtggaagttgcaatgagccgagatcacaccacttcactccagcctgggtgacagggtgagactctctcaaaaaaaaaaaaaaaaaaaaagcatgttggggccaggtgccactcatgcttgtaatcccaacactctgggaggccaaggtgggagaatcgcttgagcccaggagttcaagaccagcctgggcaacaaagcaaaaccctatctctacaaaaaaaaaaaaaatgtttcttaattagctgggcatggtggtgcacacttgtagtcccagctaatcggaggctgaggaaggagaactgcctaagcccaggagttcaaggctgctgtgagctatgactgccactatactccagatcgagagaaagagtgagatcccgtctcttaaaaaaaaaaaaaaaaaaaatgctgagtctgggaaggaagttgtgcaatactaaaggattaactatcaattccttagaacataaggaggaatctccagaaattaagaaagtcatagatgacaacagcaatgcctaaaaaggttagcaatgcttgtcatgttgtggctcatattttaatatggtattttcaagctcttcccttgaccctccactcccatacaactgagagtgtaatgacatagaccccaaacctgagcatcaatcatacctgagctcgaatcaatggtctgcccctcacttgctctggcagttaactgctctgagctcagttccctcatttataaaataaggataatgactacctcatagagttattattttttcaaaggtgaacagagtagtcacttctgcagcacaaatactaaaactggaataatacagagaagattagcatgtcccccgctcaaggagggaacactattatagtcacccctttgagtagatctaaagggttattttaattattatttcctaatggtatacggaggaccaatggtggatttaacaagaattcctttgcttcgggcagagcaaaaaaaaaaagtttccattctcagacaaatccatgggtgagagaagggcttataaaatagtcaccggctgggcgcggtggctcacgcctctaatcccagcactttgggaggccgaagcgggcggatcacgaggtcaggagatcgagaccatcctggctaacgcggtgaaatgccatctctactaaaaatacaaaaaattagccgggcatggtggcgggtgcctgtagtcccagctactcgggaggctgaggcagaatggcgtgaacccgggaggcggagcttgcagtgagccaagatcacaccactgcacttcagcctgggtgacacagtgagacaccgtctcaaaaaaaaaaaacacagtcaccatacagaaacagaatgaataaagataaaatcaaaaaataaagagaaggtagaaatggggcttcttctagaagctcactagcacaggttccaggcattttctaagagacagagacttgagctaaagcatactgggagaagttcagtgacttgagaaattatgaaaaggaagaaacaatcttccccgcaagccacaattgctacctaatgtattcttccctttgtggaatattacttaaaacaagttagagatcaacactaaggatattctgtcataggtggaagggcaaggccttcaaccactttacaccatccccacccttaagtattatttgaacaaccataatttgttaagcgcttcttaagcacagccaaagatgttaagttttatatttcaggagctaccatttcaaaagaaaaaaaataaaaagttcaactccttaaatcttttggtaactttttccccaaaatgtatcctctgtcttaaaagtaactaaaatctacttcctcctgaatttatttatctttcccctaatccaataaatgtctctccttattcttcctatttacctcaccattaaataccgaaggttttcctatttcctcccaagttggcacattaacactctaatattcattctgatctcacagtattgaatctgagcatagaaacctcataacattcccagggataaatctgctacccaattcctaaaagataacacacagtttaaaaaaataaacacagtggtggtaattatacaactgtatacatgtgtcaaaatttgtcaaactgtacacttaaaattggtgaattttattgtatgtaaattatacctcaataaagctttttttttttttttaaagaatgcattccgggcagggcatgatggctcatgcctgtaatctcaacactttgggaggctgacatgggaggatcccctgaacccaggagttccaggagaccagcctgggaaacacagggaaacctcatctctataaataaaaaaaaaagttagccaggcatggtggcacacacctgtggtcccagcttctcagaaggctgacgtgggaaaatcacttgagcccaggcagtagaggatgcagtgagacatcatcacagcactgcactccaaaaaaaaagggaatacattcattacattcattcattcactcatcaaatatttgctatgcatctattatatgcatcaaagtttataccacatctttcagcctggactatccgggtcctacctgtaacagcatgctttactcataagttgacactgtccctaaaagctgtattacatgaaaaatgattctgtttctgataatgttaccttaatgatggccgctttacactggaagggccattagctatccatcaacttccattacataaatgaaatatatgatcacttaggtactccccattttaacagaaatgctttcatcataagaaataagtaagcacctagaggcatatagtacataccactactacactactacagccttatatgtttgtctttttaccaaaaaaaaaaaaaaaaagaaaagaaaaacagcacacttcaagtgcatatttacaacactgctgaaagaaaaggcaatactattggagaatagacttaaatgacttattctagggcccacagtcacccagtggctgagtcaaaggccaaaaaactaggtctcatgattcccaaggcagtgggcaaagtagagagacaaccacagacctgagaaacagacctgggtatgaattccagtgccacttcttactagttgtgtgtgtgaacttgggacagccactttactttctgacctttggcttgctcatctataaaacagggatgctgactgggagcggtggctcacacctgtaatcccagcactttgggaggccgaggcgggcagatcacttgaggtcaggagttcgaaaccaacccggccaacatggtgaaaccccatctccactaaaaatacaaaaattaaccgggcaaggtggcacacacctgtaatcccagctactcgggaggctgaggcaggagaatagcttaaacatgagaggcggaggttgcagtgagccgagatcgcaccactgcactacagcctgggtgacacagagcactccgtctcaaaaaaaaaaaaaaaaaaaaaaaagggatgctaactaccacctcacaaaattcttgggaagactgcctaagatctataccacctagcataattactgggtacagaataggcaactcaacaacattagttccttttcttggtcttaaattatttaagattaagaaaacacctcataatcaacgaaggctaattaacaatccgcattattaatcactggtcaacaatgaacctgtgtttgctgccttcttcatactccaacccattcccttcccagctcactatttccagcttttcaaactttagttactatgtttagaaaagtgatttaattttagaaacctggaaaattcttctaggagtaaattcttctaggagtaaattgagcaaaaccttaatctgcccccaggggaattctgagcaaaacaattatttctgacaaaagaagaattttctatgggggtaattcaatttaaccacatgaatactaccaaagttgcaaacaaggtgacagaaggcaatctggaacacaccttccagattccccaaaaagaaatgtcctcctaaaatccaaacccctccctccctaatttgaggtagtcaaatcttattaggtgatctgaattctcccggctctgacaccagtccagctccttaggccagaactgcagccgtctgtaaaagaaataccctgagcaaaccccacccctcaaaacatccccaaaaggcagggaggtccagagagtattttctcctccaacgacagataaggcaccaagggctcagcagcgcaatccttctcccaaggtcattcaagtcagtgaaggtgcgacggtggagctgcaggcagtctggccttctggaaatcacactacaggggttttgggggtgcctactctcttcccctctcccacccgcaagggtgagcactggcctcggcattcccgaaacaagccacaacaagctctgcagtgttaggaaaggggttgacgcgatgaagaaacagatgctccaaagcaagatggtctttctcggctcacagaggctcctccaaggttatgcacagaaaccgcagccacctccaagagctctaaaccgggctccgaagccccagcgcggccgctgcgggtcgccaggttccctgcaggcaggctccgcagccagaggccaccagccccagaaaccgcacttcattcctgcgctccgggaagccatggctccttccctgcccgggcggctgggcgggggccgggggtgcgccgggaggcgggccccgcgctgcggaaagttcaccgcggcgggcggggggaggccccggccccgctcgccggcgtccccctgcagattccaccattaattagtcctaaggactgtctactggcaacttaaacaaagcgaatgcctcgaattccttcccggcccagcggtctggctgcgagaccagcagagcgcccgggacgcgggccggcgcggccgacagctgcggcggccgcgggacccctccccgcccggcccgcggcccgcgccccgcgcccgcagctggccccgcacgccggcccgacgcgctcccaaaccgccctcctcctcctgctgctgcagctcccgggcccttcctgtctgatcacttccttcctccggtgcccgccgggccccgcgcagccccctccacggccgcctcgtcgccccccgcccctgtcggcccgcgccccctcccccaaccccaaactctacccccgaaactcttcgccgccccctcgaaaatgtctcctccgcgtctctgccccaaacatttctcctcagagtctcgctcccaccaagaagtctcctcagaaccttccctccccctcccgaggaaaaatctcctcagagtctcttcctccaactccacaaacatgtgctgggtctcgccccaaaaggtctcctcctgagcccttcctccaaaatccattccaactctcccccaactccacaccccatctctcctcggctgcgcccgcggtttcttctgccccgtggccgcgggtgccccgacctcacccgggaccggcctcccaaccccgccgccctcccctccccgcgccgcgctcccgccgccgccgcctcacggaccctcacctctgcggccccgaaccgcgctcccgccagcgaagggttccgccgctcagctgccagcgaccggcgcctcctctggctccgcgggactgacaatgaggggcggggccaaattgtgacgtcagcgttctggaaggcggggtctttgtgatgggcggggttgtctgtaggccccgccccctccgtcctttttttcccttcccaggacttagactccaccaagtttttattgcctccgtagctgggtcctgtgctaggcgccctgggaaatcgaaatggaagacaagacttctcgatttcaggagggacactttcggcccgcgtggtggctcaagtctgtaatcccagaactttgggaggctgaggcggacggatcgcttaaactcagaagttcgagaccagcctgggcaacatggcgaaaccccatctctataaaaaatacaaaaattagccgggagtggtggcgcccgccggtaagctaaagtaggaggatcgcttgagccgagggaggtcgaggctgcagtgagccgtgatcgtgccactgcactccggcgtgggtgacagagtgagaccctgtctcaaaagaaaaagaaaaaagcgggacactctcagtagggttgtgaggattaaatgagataatcaatggaaaggtgcttagcctagaacctgatatggaataatcactcaacaaatcctatttctattactctgcaaatgcagagaaggaactcagctcagactcgggaggcatgggttcccgtcccccactgtgctattaattctttgtgtgatgctagacaagtactttcccatctatgttcccgattttcatcttctttaaaatgggaagggggaataaccagatgatctcaaaatcccctcccatacttctatgacatacttcctttaagtctactatctaaaaggcacctagtgccctgagaagccaggaggaaggcttcaaagacagcccaagacccacacccagcatagtacaggacacagccagagactgctctcgctgcggatgccctcccacacgctggcacgcagcagcattcacaagccaggacacagatgggctgagggctgcttcctctctgactacagcagcatggttggtctcttgagacatctcttgtgtaagctctttattgcctatggaataaaggccaaagccctggcctggtatgatcacttcctacctttacacacacacacacacacacacacacacaaagtttatccaaacttctcttagcacacccactgctttcccacatttgaccctttgctgaagctcttcccctgctgtctcacctcccagcttctcccagccagaaagcaatcctccctgttctgaataaccaataacattgtgtttaaccctcacgtgggcatgaacactacaacttataaagaactgacctcccatttgtttcttagcacttcctggaggtcagaacccacacatgtttgtggagctcaagctctgatgccagaaaaccctgggatcatatgttctggggtcataatagccatctctgagcctgtcttctcatctataaaatggggataataatatagtcttgtggtgtttgttttaaaattacctaagatactgtatggaaaacatcaggcacagtgttccacaaacaatatgaacaatatgattgtcattcttattttctttttctttctttttttttttttttttttttgagacgaattttctctcttgtcgcccaggctggagtgcagtggcacgatctcagttcactgcaacctctgccttccaggttcaagagattctcctgcctcagcctcccaagtagctgggattaccggcacttgccaccacacctggctaatttttgtatttttagtagagacggtgtttcaccatgttggccacgctggtctcgaactcctgacctcaggtgatccactcaccttggcctccgtaagtgctaggattacagacgtgagccaccacatcaggcccctgtcattcttattttcagtagtattatattgaccaggcgcggttgctcatgcctgcaatcccaccactttgggaggatcacttgagtccagggggatggatcacttgagtccaggagtttgagaccagcctgggcaacatggcaaaaccccgtctttacaaaaaatactaaaaattagccaggcctggtggtgcccgtgcagtctcagctactcaggaggctgtggtgggaggatcccttgaacctgggaggtggaggctgcaataagccatgataatgccaccgcactacagcctggtgacagatcgagaccctgtctcaaaaaaaaaaaatatatatatatatatataattactgtatgatttatatatgtatttttatatataactactataatcagtattatttctagttattaacaccacacagcacctcataacaatccacctaatcatttcatatggaagactttagggtcttgagaaaggaagaggcttgctgaaagtggccctgcaaagcattcccattggaatggaaaccagcactccagtctgcagaccccagatggattcagcagagtcacatctgatgatgccccagggcatctctgccattcagcatgcctccaagctggggtcagcgtgtagttctctctgagagttctttgcagcacagctgacccatttctgcttcatgcctttctcctctcaccttctttacagagacgtggatctgtgttaaaccgcccttggcatctctgcaatcctctaggagaactgcaatgaggcactgggcatttctagagcactggcctgtggaaggaggggaggaactttggggttctgattaatttcctatgctgcaggcaggcacatgggtgtcctgaaatgcctggcccggtcttcaaaggcctctaataaattatagcttatttttagaaaaaatattcaaaaacaccacttcctgtgaaaagtaatcatggctgtaagattgctggaggcaaaggaagggcctttactgagttgctcctaagggctaatgctgattccaagtaccacaaacccttggaaggaagaacccaggacatataagggaggttctgaagaaagaactttctccccaggacccatgatcccagcaaccacttattgatttattcatagcaaaagctttggcacaggaaagatcgggattcaaaacccagctctgccacttactagttatgtaatcttgggcttttaggtctctgcacctcagtttctcatctgcaaaatggaaataataatactacctttctcacacagtgcctgtgagggttaaacatgtgaaagagctgagttcagagcctggcacctagttcatgccaggatatagtggttgctgttactatttgaacatgtcctcatcctcccagcaagacctccattagtaaaaggaaaggaatagatttgtatgattggacaataaaggtctctattgggcattgttaagtgaaaagagtaagagtaagttgccgaattacaagtgtagtaggatcctgtagttatagtttgtaatatatgcttagtatatgcatagaaaaatatggagactataaagaactaaataggccaggcgcagtggctcacacctgtaatcccagtgctttgggtggccaaggtgggaagattacttgagaccaggagtttgagaccaacctgggcaacatagtgagacccctgtctttacaaaaaaaaatttttatttttttatttttttttttttagacagaggtcaccctctgtcgctcaggctggagtgcagtggcacgatctgggctcactgcaatctttgcctcccaggttcaagcgattctcctgcttcagcctcccgagtagccgggattacaggaatgatccaccacacccgggtaatttttgtatttttagtagagatggggtttcaccatgttgcccaggctggtctcgaatgcctgggctcaagcgatcctttagctttgtcctcccaaagtgctgggattgcaggcgtgagccaccatgcccagccaaaattttatttatttatttttatttttattttttttgagacagagtctcgctctgttgctcaggctagagtgcagtggtgcgatctcggctccgcctcccgtattcaagcaattctccttccccagcctgctgagtagctgggattacaggcctgcgacaccatgcccggctaatttttgtatttttagtagagacggggtttcaccatgttggtcaggctggtctcgaactcctgacctcatgatccgcccacctcagcctcccaaagtgctaggattacaggtgtgagccaccgccaggcatggtggctcacacctgtggtcctagttactcaggaggctgaggagggaggattgcttgagcccaggagttggaggctacagtgagctatgatctctgcactgcactccagcctgagtgacagagaaagacactgtctctaaaaaaataaataaataaaaaagagctagagaaccttcagttttttttcttttttttttgctttgctgagtttcattttgtttttgttttttcttttttttttttttttttttttcagatagagtctcactttgtcacccaggctaaagtgcagtggcatgatcttgggtcactacaactcctcttcccaggctcgagtaatcctccaacctcagcctcccaagtagctgggataacaggtgcctgccaacaagcccagctaattttttttgtatttttggtagagatggggtttcaccatgctgcccaggctggtctccatcttctgagctcaagccatccacctgccttggcctcccaaagtgctgggattacaggtgtgagacactgtgcccagcctgttttgctgttctgtgtgtgcatatagtgagaacttccaaaaaagactttgctatggaggggaaagagggtaaaaacacagctacaaggtataccagcagtgggcatctgagccacctgtgcatactgcaatagaaagttccacagatcccatctcctccttcgtggggttccaagaaagcccatgccgagatgattttcactttctcccctgaccctagcccttggttgcatttgaactttcaatgctagaagccaaaagtaagacacctaatagaagtctcaggaaccatgacaaggccaggacaaaaagaattttaagcagggagaatttttttttgtccctgtctgtattagtcagagttccccagagaaacagaaccaataggagtatatatatatataatttacttattatgagaattggctcacaagattatggaagcagagaagtcccacaatctgccttttgcaagctggagaaccagaaaagatggtggtactaagaatgggggtttgtgggcagggaagtgctggtataagtctcagagtccaaggattgagaaccaggagctccaatgtccaagggcaggagaagatggatgttccagctcaatgagagagagcaaattttccttcctcctcttttttgttctgttgggccctcagtgaattggacaagggcccttgttctttgggccctcagtgaattggatcatgcccacccacattggtggaggcaattttctctactcaatctaccaattcaaatattaatatctcctggaaatactcagagataatgttttaccagctatctgggcatcccttagcccagtcaaattgacacataaaattcaccatcacactgtcctatgccccctccacaccttccaaagaatcacaatatgtcagcaccttgtgtctaccatgtctaaacttgcactttcactttcactcattatatctttctgcaatttaattttttacatgtagaagtattactgtgtcatcagaaaaaaaggcaataaagatatacataaaaagaaagctaaccaagctggagttggctcacttttgctggtttgcaaacaacaaatgattacccagtatgattgaggccagtgcaaagtctgccaagaatcatagaaagtcagaataggaaggaataaaatagccctcaattctcctatcatccccaaaatggcatgattttaagttccctctattcctttcctccctcatgtttcagggcaaccgttactacatgcatttcattcattcattcattcattcattcattccacaaacatttatagatcctttattctgaaccaagaatcatgctgggtactttacatatactacctcttaaaggttataggggtcattattgctagtatattgcatatactatctcttaaaggttatagggggtcattattgctatcttgcagactgggaaaacaaggctcagacagggaaagtcacttactggtcacacatctagtaggatctaaaccaagacatgtgcaacatcaaagcccaagtccaggaggaaatggactgtattccaaagcaaataagctatgcactcaggcagccattattggctgggtggctttgggcaagtcattgaactcttctcagcagcagttttcccacctctgcagagtaagtgtatacccacctatttcatgtaagctaagtgctttgtaaatcgtaacacataatacaaaggaaaggcatctcagctcttcagggactaggtctcactcgtctttggaccttttggtgctttcccccctagtgtttgcctccattagtgttcatcccccattagcgcaattaggacagtcttcctctcatgcatcttatttctccctccagcctgggacttcctcgacgacaggaatgatgcttattaatttctgatccctttctgtccctagtacagtgtctggcctgcatccctccattcctttacatttttatgcatttcataagaaatggctgagtgcctaacatgtgccaggcactacacagactgtaatacagcaaaagtcccaagtttcctggactggaggagtggagaaacaggacaacattaaacacaattacttaataacaattccattaagtgctgcaaagaatcaggtgatatgccaggagggattgggggaatgcagggtggggacctaactgaattgaggagccagagaaggcttcctagaagaggtggcatggagcctcagagagggtaaggaacatgctcaaggtcacacagctggtaagtggcaaaattgggattttaacccaggaatgcctgagtacaaagcccatactctactagaaaacactgtctcttatctgtcttttatttcctccaccttttacttccttgacttttttttttttttttttagatggagtcttgctctgtcgcccaggctggagtgcagtggtatgatctgggctcactgcaaccaccacctcctgggttcaagtgattttcctgcctcagcctcccgagtagctgggattataggcgtgcgccaccacacccagttaatttttgtatttttagtagagacggggtttcaccatgttggccaggctggtattgaactcttgacctcaaatgatctgcccacctcagcctccccaaaagtgctgggattacaggtgtgacccaccatagcccagccccctacttccttgacttttattgacgagaaaggagtaagacctgtccaaatgaatgctctaaagcaatattttttcccagcttttgggggatcacagattcttttaagaatctagtgaaatccatgaaacctgtctccagaattccatgtatacagacagacccacaaaatcttgcatacaatttcagggagttcataggcattctgaggcccaggtttagaattcattccatggaggaccatccgaccttatagtgagatgtcagaacctcagaaagagacaccaggaccccataaacagctcaaatccccagagagatctcaagaccctatagaaagagtctcaagatccagtagaaagatctgggatcctgtagaggcccccaagttgctacagagtaacagctggggctttgcagaaatattctcaagaggctatagacatagaggaacctcaacctctcatgaagctggggtcctcaaagcagacttggagagctataattttggggggttttttgttttttgttttttgagacagggtctggcctctgtcacccaggctgcagtgcagtgacacaatcacccctcaccacagtctcaaactcctgggctcaagcaatcctcctgtctcagcctccacagtagctgggactagaagcgtgtgccaccacgtccagttaatttttaaattttctgtaaggatgatggggggggggtctcactatgtttcccaggctggtctcaaactcctggaatcaagcgatcctcccacctcggcctcccaaagtggtgggattacaggcatgagccaccatgccctgcagagggctataattcttaacccttgttggatcactgacgcctttgaaacttcgaagaaaaatgcaacacacacaacatgttacacaattacaaggggttcacagacctctgagaggacatcggtagccccagggtacagaactctggttcttgaggtgcggcaagaacgtaacccccgccccccaaacaccccaaaaacctggagcagaaccacagacccgaggcacaaactttaggatgaaacagaccccgagttgcatcctggccctgccgtttactagccatgaccttgaacactcacctagaaaccctcaggcctcagcatctcaccacccaaaagagagggctggacacccttccctccccagcctggcccccgcggcgtgcgctccgtgacgggtggggcgctggcgcttgacaggactcagcctctctcccctcctgcgccagtgagccatgaatccggctgcggcacttcatgaaatactcatgggccgactgcaccaggcttgcgggcggcgggggagggggccggcgcgttcgccgtttgccgcagtgacagctccgcgccgccagccggccgcgggcctgggaagccgccggtgccgggcgcgctctcggcctttcccacccaccaggcagggcgttcccgccagccggcttcctgcagccgagggccggggaggagggacggcgctgaggggccgcagggcctggcaggcctggttcctggctttctctccgcgtttcctgagcaggaccggccgggggatgggacccagcgcaaacctcctaccccgggagcgcagccaggaaatcgcgtccttgttaattcaggttcctcctttgcgctgaacggggctgctttccgtccgcgatcaagtgggcatgatgcgacccacttatcccaggaggaagcggagagacgaaatggcagctcccgaccccacgacacagcaagattccaaccccatgatgtcagtgttaactccatcctatggatgagaaagctgaggctttgaaaaatgaagtgacttatccaaggtcatcataaaaatattactactaataaaataacatgcttactacataccaggcactgtgctacaaatactccaggtgttttttgtcattgggttcctgtaatctatgaagataactgttgttcctagttcataaatgaggaaacagaaccagaggccaagtggcatctccagtgatgcacagctacgaaataacagagctaggaattaaactccagcctcctgtttccagagctcagcctttctctatcctgcttcagcacttcagttgagtaaccatgaccttgtctcatttgtttctgggtcctcagagccttaccgagaacttgacacaaagtaagtgctcagaggtgactaagggaaccttacatggaagttcacacttagaaggactgataggaggcatctgtcacgtcaccctttctagagccttcagccaagtgaaaacttagcctctgcctgaatactcactatcatgataaactctccccctctccacacccccatcccattcccttgttggacaaatagatttggtttaaacgtaaatgctcctttttttttttgagacggagtttcgccttatagccctggctggagtgcaatggcatga

SEQ ID NO: 445 - DNA, 80924 bp, Homo sapiens
atctttgaaatggtttacattttgttttgggtgggtttaaggaaagtttcatttagcttaaggaacttaatcttcacaaagttcaacttcattggctgttctcagtacacattatgagtcctatttgatggacacatgcttaaaacacctcctcagaatttaatgtgcttattcatacacgcaaaaaaatgaggtgatcaatatataggggcaactaagccctcaccaaatgcaaaggacaatttaatacttaactacgtcatgaaatttttaaaaatgcattttgaagtaaaaagtaattttttaaaaatctggttgtcacttttactaattgccttttgaacagtataaagagtttagtttttgtccataacaccggtttcttcccatgttttcccataaaaccccttgcaaactgaccagtcgaaatcaatgtgaggaagtgtactgaaatgtaataaaaatgacttgttttgatattttattgcctgagacttgactcattaaacaccgtagagtctgctgccctgcaggaagaaggctcctgtgttctaatacttactaaataataagcattttcctcagtgaaagtctgttgagtgaaaccaggttgatttctgactagacccaaaacaaaatcactgacctgatttctcttcaagtcaagtatttcttctgctctcctacactttccacaatgtattatgaaatttttctcttaagagaatgtaaacgcttagatgtcagggtggcttttataacaaccacgtatttttttagattttttttattattatactttaagttctgggatacatgggcagaacttgcaggtttgttacataggtatacacgtgccatggtggtttgctgcacccatcaacccgtcacctacattaggtatttctcctgatgctatcccgcccctagctccccaccccccgagaggccctggtgtgtgatgttcccctccttgtgttcatgtgttctcattgttcaactcccacttatgagtgagaacatgtggtgtttggttttctgttcctgtgttagtttcatgagaatgatggtttccagcttcattcatgtacctgcaaaggacataaactcatccttttttatggctgcatagtaatacatggtgtatatgtgccacattttctttatccagtctatcattgacgggcatttgggttggttccaagtctttgctattgtgaatagtgctgcaataaacatatgtgtgcatgtgtctttatggtagaatgattaaattcctttaggtatatacccagtaacgggattgctgggtcaaatgtatttctgattctagatccttgaggaatcaccacactgtcttccacaatggaacaactatgtattttatattgtgagactcatgtgtaattttggaaatatcaccaatagcattttacccctcaaacaacacaggaataaaacttgaatacacattttatttttcagggagttctttggagacgaatttaatttgattaactaattcactgatggtgctgatataatttggatgttgttcctgcccaaatctcatgttgaaatgtaattcccaatgttggaggtggggcctggtgggaggtgattggatcatcgggacgaatttcttgtgaatggttcagcaccatccttttggtagtgtcctcatgatagtgggtgagttctcacaagatctggtcatttaaaagtgtgaggcccatcccccatcactctcctgctcctgcttttgctgtgtgatgtgcaagctcccacttggccctctgccatgattgcaagcttccagagacctccgcagaagcatatgccactatgcttcctctacagcctgcagaaccgtgagccaactaaacctcatttcttataaattacccagtctcacatatttctttatagcaatgcaagaacggcctaacacaagtgttttctcaaaagacctcaaaacaaatttaaaggtaaaagaggtagttatcctgtgatgggatgcttattaagacatctaaaacaatctcagtgttgttttcttttaatgaaagattcagtcaaaccaaggttataggcttctctcctcactctatattaaggcacatgtactagcttccaaatgggctgtgaaagagatcattaggtctggcaattccaactaaagagtcctttgcagaagcaagttatagatcagaaaacaactgcaggtatctaggtgctttccaggattccttgagcttcagtatatggaagcagacttttttagggtatggaagcatgcactcataaacatggctatctaacctttgaaactgctttcattgctatcttacagatttgagtaaagcaacttcttgagcaaaacattgtactctggctctggtcagatctccctctttctctcctctctctctcaaagagagaatcatgaagtaaggctgaaggtaaacattaatctaaaaatacttatggtgcctttaggagagtatcactgataaatgagaggaaagttattttcaatgtataattgacgttataccaaactgaagaaagtatatgaatgaatttaaggttgaatatttttaatgtggaatatacacaagtgcatttacatcgtaagtacatttacaatgtaattaaatttctgaagaccttaaagtgaaattgctgctatattttagagtaatacacatttatagtctaataaaattaagacagtacagttacatttgtaaacatatacaaatatagcattcatgtacagttattaaaatattaaatgactataacagaactcagcattgttttaaatgattaaaatctctagtttactaccatgaaattaaaacactttgtgcagagtgacatcattattcaagaatttcatttccctaattctgtcttctaaatcacagtattagcaaacaaaataaatgtattttgatttcattctgttgttgcagaagaattaagtgaaatatcaagcatatggacactttaatgagtaacttataaatctaccatcaggaattccagcaactggacattagaagatttataatttgcaagtacctttagataaaatacaattggtttgccatacagattgttccatcagatgataccactggcataatctgtgatcttcatacaatatataaacctaattgaaagacaaattacatgttatatagctattgtgtttattgttttgtattaaccaatcacagaaaaacatgcacctaatatgcaacttgaaagtccaactcacaattcatgattcaaaaagcagaagtttcaaaccattgttttcagaagtccataatataaaatactccaaacataaattcaacattgcatgcaacaactggccatttgcttcaaaagaagtgatcacagtgtttatatatttaaaaaagagaaatctatatatgtattatttttaaaaaactaagaagaaatacaacttcagaaaatcttttctagaataaatttttctagaaaattgaaaagtaaagacattgaaaagcagagctttattaagaaacatctgtggtgccgatatgaatatttaacttaaagctgtgacatgtacctaaacttcaatgcataaaatttaaagtttaacatatcaaaacgacaggatttttagctttggatcatcttaaaactataagatggctctaacaaccctaaaggtcagtcagcatgcaaaagagatccttcagaacatatctctttggggcattataatcacatagatagcacataattaaataatagactatcaattaacacaggagtttaaatctctgattctctctcttccctctttgaagttttgttactgaaaagttacccaaaaaatacaagtaaaactttttatctgtaaaagttcaaaagaattgatttcagattttcaggtgaaatccaaacagaggctgtaaaaaactttaattggcaacaaaatagcaccgcacttttgtgttggggtaatggaagatgcaaagatgcttcttgcaagactgagaagctgcgaataacgaagttcaactccatgctgaggaaatttctgtagatgtcatgggcagtgtaggataacctgactatggtgctgtttatctgtaacccttttaggaaatataatatagttcgcaccctcaaagaaaatattatttttagaaagtctattcaatctccttgaattcaaggggaactcggtttccttgtgttactcagaactgcatctccaaaataattaagaatgatgttaacactcaaatgacttttaaagccaaaatgttatctgtgctataacttctcaggcttagtgtgaggattcaaaaggtccatcataaactcaaggtgatgtcttctggttattaattttaatatgaaaggtcttcagtttcataattattaaaggaatttattttatagaagagatagcttcactgaaagcaaaacaaaataaataagattctcttcttctacaatcaatttttataaatattgtactaattatgtcatatgcatgaagataataggaaacatgttaaatgcataatatcagagagatctttacattctatttgccagattgtaaatgaaaccctctaacttattttttaaacctaatgctgttgacagttgcatagtcagttataatgtcctaatccactgatggacacacatcacaatgtatttttataagccacaatatactatttcgctctgtgcaatgtaatgagaggatagatctcaatcaagactcacttgatattgtagcattcaaccaaaatctaccgtgaagtattaatttgtcatttcaacctaagtcaaaaatgcatgtcatttgaaagtaatatattttaataataatcttaagtcaggggcttccagagaacacagatcaatgggaccttgtcctcttatctagtatcatgccacacaataataaatgcttaaaatgctgatgatatagcaatacattacatttcaactctcccaatagcactgcaaaaaaagaagaatattgaaaaagtgcactcacagtagaaataaagtggctagaaaggaataatgtgagtttccccccaaataaaatgtattacattgataaatgtataggtaagcccttcactgcctgaaaaataagcacagacccaaagtagactgaaattgttgtttttccatacacttttcaaagggtgctaataagccataaatctactgggattagttaacagtaatagaataatttcaaattgaaactaatcaaatatataattttatatgtcctgcattacaattagctaaaaattaatgtaattaactttgtcctgaattaaatgtgaggagatctggctctacttaaaatgatgatgataagtgatggaaaatatactctgtgtcttcttaatgttgagtacaaatgtttatatggaagttagatgagtacactttgtgttttcacttttgaatcttggagatctgagcacaagaaggaaatttttttctagtatatacattacagtattattttatggctttattgggttttttaaattgcttcataaaaaacaatttatttaaaacactgatttatatgtcttgattcaaacagttatttgagcacatattttaagtgacccatgtttcttatttctgttctctttctgtgtctctgcctctctctctctcttcattgaccatttaaataagcatgaaatagttggcagaaagctggctatatttattttcaaacttaacaactcttcgatgcgatcagttaattttgattaattagaactatttggcttttgaaagtgttcaaaatgttactgtcttagattttatccttttctaacatgtatatatttttttaagttgtaaactgctcaattcagcatgtgtaatgtttctttgtatttgtctgatactcttcttttatggctaccgctttttgtcttttttcataggttattggggtacaggtggtatttggttacgtgagtaaatcctttagtggtgatttgtgagattttggtgcatctatcacccgagcagtatacactgcaccctatttgtagtattttatccctcgccccctcccacacttccccccaagtccccaaagtccattgtatcattcttatgcctttgcgtcctcatagctttttgtcttgtataagaaattgttaactattcaaagtcatgacaacatcgtcctgtttggttttaggagatttattattttagcttttaggtttagatctgtgatccaactcaaaataatttttgtgtatgaagtaagatatagagatggaggttcacttatttttccatatggatacccagttgccaagcatcatttgttaaaacaaccttcctttccccattcaaatgacttgaccccttgattaaaaatgattatgtatatgtgggactatttatgaaatcattatttttctatacttacactaatgccatattgtattgattactgtagtttataaggggtattgaaatcaggtgcttaagtcctcccaatttttacgattcttctgtactagatcctttgcctttttacatatttttcagaataaatttgtcttataaattttcaaaaggagttgctgagattttgattttgatttcattgaatctataggacaatttggggataatgggtttcttaacaaaattgagattcccaaatcatgcacatggtatagctctccatttattaggtcatcttaattatatctcagcaatgatctgtagttttcagtatggaagccttgtgatctgttattagatttatttctatttattctatatcttatgttgctaatataaatgttcttttgaaattttatttttaaattctttgttgctaggatatagaattataatttatttttgtaaagactgcacattgtggccttgtaaaattcacttattagttctagtagggacttgtatgtaaattccttatggttttgtacatatacatgatctgctaatcatgacggtgcatcttcttttttaatcttttagttctttaatgttttccttgtgttatggaactgactaggacttacagtataatgttaaataaaaatggtcagtgactatccttggcttgtttccaatcttagggagaaaacttccaatagttcaccattaagtatgatgctaactgtgggttttcataatgtgttttatcatattgaagaaactccctttattccttgtttgctgatagtttttgtcataaatgagtatgaagttctatcgatggctttcttgtatctattgaaatgattatataattttcttcctcattatgttaatatgatgaattacattgattttcaagtgtctaatacaggtatttaaagccatacatttgcctccctctttagctgcatccagaaattttttgatattttgagttttcattttcatccaatttgaaatagttctaatttcccttgtactttctttgtctcatgtattgtatagatgtgtattctttaatatcaaaatactttggatttactgatttctaagattacatcctgagactatatgattccaatcttttgaaatttatgaagacttgttttatgacacagaaggcagcctatcttggtgaatgttccatgtatacttgaaaataatgatgcattctgcagttgttgggtgtagatttttaataaatgtcaaatggttcaggttgtcagtatactagatttcggattactaattaagtaattcaataattatctaaataatttaacaattagtgcaaaaagcctttgaaagatgacccatattagagttatcaaacaaacaaatgagaagtgactccatttgagcagttcccatgtgacccagcatttctattaagcctcattatccctagatttcattttatgttacaaataaaatttggaaccaaataagttacacctggtgtgtttaaacagtctaccattacctggaattcgaacaaacaaaagaccaaaactaggatttcagaggaagtgtgtgcatgcaagaatcatcttatttaacaattcattgattttccttttctgtgctaccttttaacagacaactaagtgtcacttagaggaaaaaactacaagaaaacgggtttatatacagaaatgttacatactatgggttaagttaatagaaatgaacatcagattagctcccaatgcttcatactaccttcacacataagtcttgggtatagacacaagtgtgtttgtgtatgtgtgtctgtgtgtgtgtagcagagacctaccataaagaaataacatgctcctaggacagtgtagaactacatactagtaaagtattcttgggcagtaaggcaggtaccttaaaagcatatcctcagtatttaattctgaagggtatcttacaaaacaccatagtatcttcaatctctttcaagactatcaactttatagggaaaagtctaatgtgcctttaaaattttcattcataaatttaaaactattaaagaaaaaaaataaattctagctaacataatgtgtttgctgctttatttctaactgcagagaggtcattactctatgccaatgtcctctttggtgaagctttaacatttttagtcttcaaattgtgtacagtttattcatattgtacctgtaactttggcattccgaaacctatggtcaccaattaaaatatgtaaactgtttcctagaatcaggccttcttttcttctgtttagatttttcaccaacctaaataataaatgaattagtagccaacaatggtaatactaagtgaattaaaacaaatacattacgttgcagctcaaactttcacaaggctactgcatgtgttcaaagaccttcatgacactgtgcatgagtcctttaagtaatctacaaaggactttggttattagaaaaaattattactttaatgatccatcattaacttttaattctctgtgtacactcttccacctaaagggttagagtacacagtcaatgtagcatttcagttcaagttattgacccaatgaagacagaaatcttacatttagaatatccaaaagaattatggaagtttcattcaatccgaacaatattttcttcctgctttgggttctctcctacctaaacagtatatttggcagaaccatctttacaaccagtactatataaagtcaaaggcataagggtagaatgagaaagtcaatatttgacctgataaacagaagtgtagctatgttgtaaagtagtaaagtgtggtctctggcacacagtaggcgttcattaaatatgtggctaatgaatgatttaaatgaccagatggaatgtgatctgtagccattacaaagcccagacgtatcagctaaaacatctgagccaaaggtaaactacaaaagaacatgcagactcatagcatgtcattcgttcaaagcatttttcactcaccaaaggttaatgttcctttcagtgagctttataggcagtgctgaagcaatgaaaatgaaagccatcgctgtgatatttctgcttttggagactgtataacaaagatacagataaagcagaacatttgattagctatctatgtgccccagctggagatcatcacaggctttgcaaacacacctaccattgaccctcagcattcccatggagaagctgaatgacatctccatttctaatcaggaggtcttctgagcctctcttcctgcagtctgctagggatctatatttgcttggagactgtaaagttgttttaaaaaattatattacaaacttgattgcaaaaccacttgcataactgcctgctctgcaacatgaagaattaactcttttcttcactggtaaatgtggtagctgcagcagctttgcaggaacagacagacatgaagcagtatgtgatggggaacgaaaaaggcagaacaagtttatctaacctgaagaattaatttttatttgaaaaaaagaattacaacatgaaatatacagaaaatagcagagcacaactaatttaagttacattaattataagcagaaatccagaaaaaaagtgtgaaaatattaacttttaaatacggcttttgtaaactactctcatgaaaattttatctgggcacatacagacagtagccctgaacaaaatttactcatgccccgaaaagaatttctgggctttgtattgtttcacacaagttaaaacaatgggcacaaaagctgtggtttcaacaaaagcatattaaatcataatgttgtgctttacttgaccttagccattttgcagccgtaattttgacttaattcattaataaactaaataatccaaggcacaccgattgcatttggttacaaagtagagaagaaataattttcaagtccaaaagtattctgagatgagaatctttcaagcacaatatctgacacattaaatacatgattttaaaaagacagcgtaccataattaaaagctttattaaatgaaagaaaagaagtatgtgctgtggtttctttgcgtgtccattaacctgaaaacaacatctgcatcatttgagctcaatgtcttttgcgcagtatttttccaaatgagctgagaagcaggcaggaaagagctacttgccatttgacatagtagcttcatcaatataggagagccatctccgacacaggtctctacaagggaagcagcacccattattgctcagtttacaacttgaccaagtgaagccaaaagagcaggtcattccagcttcttgttttggcagggaagaagggtgtatggaatacattgtgttgctcttttatatgttttccttagtagcacatctcagagaattattggacaaagagagagaaactaataggtttttctatattcccatcctctgtgattaaagcattcttcaattttgcatatttactttatcttctgataccatagctagaaaaaaaaatgcctacttaaaactgagttctttacaatgccttcatagatcatctacagcaaacggttaaacacaaactggcttcctctgactttttgctcgcatttaacaactactactatccattccatccccagctaacattaattaaagaaattaaacttctttttattattagtctaagcctgagattcccaaagtgtgggagacagactgttgtgggttcctgagaccctttcaaggggtctgcaaggtcaacctacattaagacactatttgcctttttcactctcatcctctcacaagtacacagtggagttttctagaggatactaggtgtatggtagcacaacaaattgaatgcaaaagtggatatgagaattcaccttttactgagccagaagttaaagtgatttacaaaagtatttcttttgtaagtatttaagtatttaaatcagtcttctcactgatttttattttgaaaaatgtaactttttaaacaaaaatcttattgatataaacttacaatgggtttattaatatttttaaacaattattacattcaaaattttgtatttcttagttttatcacatggtaaatatcaatagatgtaacctatataccatggaatactctgcagccataaaaagaaatgcaatcatgtcctttgcagcaaggtggatgcagctggaaaccgttatcctaagcaaattaacgcaggaacagaaaaccaaataccacgtgttctcacttataagtgggggctaagcattgggtacacgtggacacaaagatgggcacaatgaacactggggactactagagggaggaaagagggttggcagaagggctgaaaaactacatgttgggtactatgctcactacctgggtgacaggaccattcatactccaaatctcagcatcacgcagtattcccatgtaacaaaaccttacacatgtacctcctgaatctaaaataaaagttgaaagtattttttaaaagatataacctacataaacaagagttctttggggttttcaattttcaaggatgtaaaggcttctttcattaaaaagtttgggaactgcaggtatagacaattaactctggacaaatatcttaccagatctaagtctcagtttcctcctctgtaaattgaaggtaataaagcccgctctttttcatactaatactgtgaatattaattgagaaatcatttgggaaacggtaaactatcacacaaatatgtattatggtcatcatagtattaggagaaacaatatctacttttttaaagactgcatttcagagtcaatgctgtacagctttgtgattatccatgccattatccttttttttttttttttttttttttgagacagagtttcgctcttgttgcccaggctggagtgcaagggcactatctcagctcactgcaacctgcacctcctgggttcaagcgattctcctgcctcagcctcctgaatagctgggattacaggcatgcgccaccacaaccgcctaattttgtatttttagtagagacgaggtttaccctcttatactaacagtagaactgccaaatgtaattgattcctctgaagggcaccaaggagcactctacctccaagcatcactcctaccttccaagctggtgactttagaaaagtagggatttactcccaaacagtcctacctcctctttaatagcccactggtatcctaccaacttgcaaactattccttctataaacactttaaccttaaagcaacctcctttaattttacagggtgctcccttgctctaatatgctgagattttatatcattagtgtatttttgagaacacactaaaatatatcccccagatgttattaaatcgtttttaatgtataatgcttatttcctttattttctaatctggaatccaaactggtttttaaagtgtatttgaagcccctttgttctctgattttatttcacatgcctggatggaaaacacagtggtgaagctctactaaagataaaactgggattttagagatttggaaagattgactatctatttcatcaacatcagcagaagctctatgtataggtcaaacaggttctacttaaagacagaagtgcttcctgatgttcataataagatttatttcaactattttagcaatggcttactcctaatggcctcaaggatgctgacaaaagattgcccctatgtgctccacctatatttcatcagtaaaactgcctcaataattttaatttactatattattactaaccatgaggggcctattttcttcttcattttcatcataagtagggtagaaatagttgcttgaccattccgcaggttcttcagagatttctgcagattgtgatgcctcagtccaaactataagaaaagtgtggaatgtggcagttacttcatggtgctaatttaccacaaggtgagaagtaaaactagctgtaatcctttaaaaagttgaatttaaaaaaatggattaaccaatctaatgtaagcagcaaattaacagatctcatcctggccacattaaactattcatgcaacctgggaaaagtcattgtcatctttttctaacttggtttcctcacctgtcaaatgaaggcattagtactatgctctctccttacttctttgggggccacagcatagatgacctgagggaagtgacctttaattggataaatggaaactctacaaggctatcattacctttttctcctcaaccagtagagaactcttccatattaaggatcatcatattaaagtgttgagtatcaggcactctgttaggcatttctccaaagaagtctatgctgttgatcctagagttgtttaggtgatcctcatgtatgcttctacagcacttcgtacttccctgctgtaacactcgccaaatttacttttaattgcttgtttaactatctttctattctcctagcttcatgaggatggcagctgagtgtatcctagttagactatatgcctagcactttgcataactcctggaatgcagatcatgctatgtcaatatttgttgaattaaataaagtatttaaaatcacttcaaataaaaccattcacagaggaagaataaatatttcggctgttaatgactcttctctattcattaaaccaacggtaagtgaaatgcgcattccttgaagccagtatatatgttttattcatcactatatcctttatagcaggggttcccaaacttgaccatgcatcaaaatcacagagagagcctgttaaaactcaagtggctgggccttgttcccagagtttctgatccagaaggtctgaatagagcaagagaatttgtcttctgtaaaagtttccaggtgatgttgattctagtggtccagggaccacactttgacaaccaatactctctagtgcccatcagagtgtcctgcatatgcaagacatgagagccttataaaaatgggttaactgtattttgtttatacaaaaataccaagtgggtagatttccaaattaataatacgaggtaaaaatttgcacacccatgagtctcgtcttaagatgaccatgacacatacctgtatttgcttctgcctgaactgacgcaattgcctcacagacctccaccacagtgctggtgtgttccaattcagtttcctcagtacttataaaagctccctgttgctttctgaaatagtgatgtataaaactaagtgagcttttgtacagtttacaagtaaaaagaaatttaaagtggtatttcttccattgataccaagtgttaagaacatgctgagaatccatccaaacagccaatactccctatttaaatctgtgtggcaataggttataatatacaaaagcttaaatctcagatccaagccagcaggttctctattatgtaaggagaaaaactactcccttctagacccaaagtaagggtattgtatacaatccccgttgctctgtggacttataacattaatgaattaggtaagttgttgtatataaatgaagatgaaaccttcaactgattcatattgttgagtatgtaccagctactattaagtcaattactgcataaaacctaaagatgttactcctataatgtacgataaaagatggagctttttgaactctgaaagataaagactttatctgcaacttttaaatggttctcctaaatctccacgtgaaccaccatatgtttcatctgattttagctacctcagaaagatgacatgcagcgaaggaaaaaacagtatttctaataagtcattcaatgatcaccacagcaagcagatgctgtgtggtgaatctctgtgccaggccttcagaatcaatgagagaattctttctgtatatatgcaaatgttcagcgagaactccaccttttggaatttctagaggcttccttaatgactcctggttgtgtccaggctcagttccctcccaggatccataccttctctctatgtagagagaggccaaatcaccagcaagaggtccccatcaagggactgtaaaactgtgagccagtccttcatttgctctattcccatattcttacaaccctctttttccagtcagatcaaaggtgaccaaaaatactttgaaaaaaaaagcttatgagcacagcctcctttcctgtcagcctacatgtaattcttccaatgatatattaaaaataaagcattttcaatcatgtttagaaatcaacccaagggataactattaagaactatcagcctccagtataaggctggacctcagaaaatgatgtttatggaatttgatgagttattgctaaattggtggatggttcttgtcagagatactttaattacattgcttcatgttacatacagaaaacaaaagattgcaggagtggtatttcttaaagaataatcacttactcatcattctgctgaagagaaatctgaaacttatcccgttctgttaattgatcctgttgctttctttttttaactgagaaataaaacaaagcatattatcattcagaagtcacacttcttacttccttgaaggccaatgactttctctctctcacacacacacacacacacacacacgcatccttgccattagacttaagcttcacagacttgaaataatcagagggaaggccagtctcaagtttgaatttggaaaggtctggaccatataatattttattcaagaagttcaagtttagaagtagaactggctcccattccatcattatagagcaatgattactcgagatattaagcagagtcacctcatggaaaggactggggattaccacaatcagttcactgtgttgcttctcaactgcttcttaagcacaagggttcattttctagtgtaaagttcattcttcaaaatagtttaaacaatcctctgaatctcaatctcctactaattaaattaacaaatcttctcattgtaatagtataaagtaaatatcagccccattctctggaaaaataatttaaaaatctgagtcaataagctgttactatacttcttgttctgaagaatgcaggcttgaatttacctgtcaaaagttcctgctgcttcaacaaaatatttcttatttcttttagccacgtcatcttcacatctacattagaagcctaaagattaaaaaaaaagcgggagggaggtggtacacatttccttttaaaaaggatgtactataataaaacaaatgtaattgtgtacataaaatatgatctactccctataacaccatactcaaatcttaaccgtttgattgttaaaatttttatgaagcaaataatttgctatcagattagatgaaataatacagtcagaaccatttttgctgtaatcccaggactttgggaggccaaggtgggcagatctcttgagcccaggagtttgagaccagcctggggaacatagggaaaccccatctctactactactactactactaataataataataataattagccaggtgtggtggcatgtgcctgtagtcccagctacttgagagggtgaggtgggagaatcgcttgagcctgggaggcagaggttgaagtgagccgagatcacaccactgcactccagcctgagcaacagggtgagacgctgtctcaaaaaaaaaaaatccattttgaaattgcccttaaataatggtaaaataatgcttggatgaaactgtgaaatataatttcacttattttgtctttacaggaggattctttttaaaatataacattttgatgtttaattttagtaaaataaaacaagctctactatttctgaaaaggccatctattgcagaataaccttggtgactgatggtaacatgaaatcctccttaaatatcctcccatcacttacaagatgtttgttaaatgataccaaatattatatcttaagcaagccaagaaaacatatttttatagattgcagtcacctagtaaagaattacaacaaacaaaaaacactgagcatttttaacagataacagcacattgacaactccagatacaaatatttattgcaatgacaacatcctcttgaaatgttctgattcctcttcccttccctgaaacatgttggaccctatacaactggccagggctttaaccatgttctttagaagcagaaagcaagtctgaactgtcacatccccatgtctcataatcaggtacccctagaatgcttagcataagaggaactcagaactattataattccataacttggaaatttgatggggacagagaagtacctgccaagctgtcagctctagttgataagtctcttatgtagttgtgaaaacttgaagccctagagaacaccacaggcatatctcaatgtaactactagaaaacatttaaatacatcacaaagaatattcaaataatatttaactgacctacatgaaaggggtggaaattttgaaatgcgaccaaaattatttttgtttataaattcgggcttttgtatttcaatgcaggtttgggtttctagaagaattttcaaatgaccaacctggacaatataaacttcttccttttcaccataccagatttcaaacttgcggttatcaccttttacatattcagtgattccaacttcatccatctataataaataagtcaaaattttcatgagcattttattttgaatatgaaattacattaaatctaccctatcatattctaagtgaaacagaatttctcttgggcagaaaaatacatgttatattaaatgaatatgaaatagtaattacaatcatagacgagagtatttaaatgttttcattgaactatgcactttatagttcagattgcacgcttcatttcagtggttgacacaaatgttataaatctgaacatccaagtagcccatctaagatctaattatgttataaattaatagtacactattaaaacaaattattgagtcaaacacagaagtcattaaacatcaataaagaaaagccactgaaaattaatttaaatagttatttagaataatcatttgacagaccacttaatcctacaaattataatttattttgatagaagtcctacaagttataaacatctaattcatgggacaggagagaaccagccaggtacacaaggatctctctattttccaccaatcccttggcctttctaaaaaaaaaataataataataatatgtaatgggacattgttgtctttttgtacccagtgaaacttctgtacacaatatctcttccttattccttaccacaattttttcttttcctcagcgtgattgtgcaagtcataaactcttccattttctttcatcattttctgctaacagcttggctaattgcattttgggcaatctcactcctttgcacaaacattcttttagttcctttctgccttcctcttttctttcaattcttaacctaattatctaaaggagtatctcactctctgttctagttatgagccccccaaatggcccttattagagctaataagcattaaagatagtgctagggagatcgccataccaaggagaagaaaagcacttatgcttagaaatgtaatttaacataacatattaatgaaagaacctgtaacatccaccctgaacgtagtaagaagttattttcacaatgtcccaaactatctttatattctcactccatcattccaactaacctacttctgctcaaatatcacaatttaagatgaatagtaatctcatattcaatatttttaaaaattaattttgtttcattacatggttttgtcttaataacatgataagctggaaggcccacaggctttgaagttagagaggtctggattggaatacatctctaccattcactagctatgtgtcttggtgcaagttgcttaacttttctaaacttcagtttcctcaactataaaatagaaagaacacctatttcatagggttgatataaggactaaatagcatggagtaaatgcttagatcctataatgagctttctaaagtgtgagtttgctttctactctttcccctatttaagttgcaattgttttgttatttttttattgcaaacatatagtacatcattatcaattaagtgaacttttctaagttgccctggaaatctaaccattatgtgttgcacatagtaaggactatgtgcaatttgtaaaatttttaaaaatcgatgataataaacacatgaactaaggaatctgaaggactcgaatctccccatctggtcaactttgactttagatagggcctttccttgcatataagcagccaacttaaaatataacatataaataattagaaagtacatggtcaggccatgggatcccagctttgtatggtgcagtcaaaacaagagttcatttaaagtgagagacatagacaaaggcaacaacagacactggggactaccagaggagggacggagggagagggacaagggttggaaaactaactcttggggacaatgctcagtacctgggtgatgggatatttgtgccccaaacctaaacatcatgcaatacagccaggtaacaaacctgcagatgtaccccctgaatctaaaataaaagttaaaaaaaaaagtgagagagaaggttcagcagtggaatatctgcaatgatcctctctaccaagggtaagactgtgaaactaataacccagattcttaaataacacattgactaggaatgctagcaattgcttaatgctggaatctcatgataagcaggcaagcagaagtgagcgtagtgaaccctaagaaatatcctaatttttagtggtatcaccattttccaagtaatcctggtctaaagccttgtaggcatcactggctaatattgtttattaaggatacttggcattactggggaaccaaagaagaatcagaaagattttcttccttcaatgtcaggtattatttaatttttgtagctagtaagtcatcaagcccatctgtctaccttctattgaaatgtttcttgaatctatcccaccttctctgtttccatggtacctattgcagtttcagttttcatgacttaatcacctaatatcccccttactttaatgtactcaagaaacattttgttggcatgtccatcattgtaacaaattaaaggtaaaatagaaaattaatatgaaatagaaatactatattaggtagaaattaggtcacctcatgataaaatgtacatcaaatgcatttgggtcaaatatgcctatgaaggtaaagtaccttcccaaggaataggtatacagacagcaagagatttgaaccctctctgacatggattacaaatttatggttctcaatctatgtttattaattacttagaaggccctttgagatttgggggcttagaggtggactgctaaaatcaaaggagcaactggccctttgtgacgaaaccaagagttttaaagaagctgctgtgggttcagagtgaagcagggaaaatacacaataggaagaactacttctttttgacccgaccctgggcaggaaccttgttgggaacaactaggggctgctgatcctatgggaagaatcaaaagcaaggcctgcttacaggtagtctcctaatacaaatacctcatgcctgtctcaaaacatattgcctgtcctctttataactgctactgaaaatttcatcaattgtcaaatatactggtgatgagaactatgaaagaacatgctcatgaaaagtaactaacatgatagtggttggggaattaaggacaatcgttttctctatttttgaaattttttgtgacaaatgttatattggttttagaatttaaaattcaaggaatttatccatttcttctagattttctagtttatttgcatagaggtgtttatagtattctctgatggtagtttgtatttctgtgggattggtagtgatatcccctttatcattttttattgcgtctatttgattcttctctcttttcttctttattagtcttgctagcagtttatcaattttgttgatcctttcaaaaaaccagctcctgaatctctgaatagaccaataacaggctctgaaattggggcaataatcaatagcttaccaaccaaaaagagcccaggaccagatggattcacagccgaattctaccagaggtacaaggaggaactggtaccattccttctgaaactattccaatcaatagaaaaagaaggaatcctccctaactcattttatgaggccagcatcatcctgataccaaagccgggcagagacacaaccaaaaaagagaattttagaccaatatccttgatgaacattgatgcaaaaatcttcaataaaatactggcaaaccgaatccagcagcacatcaaaaagcttatccaccatgatcaagcgggcttcatccctgggatgcaaggctggttcaatatacgcaaatcgataaatgtaatccagcatataaacagaaccaaacacaaaaaccacatgattatctcaatagaaatattatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgaatgaactcccattcacaattgctacaaagagaataaaatacctaggaatccaacttacaagggacatgaaggacctcttcaaggagaactacaaaccactgctcaatgaaataaaagaggatataaagaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcaccgccaagtcaatcctaagccaaaagaacaaagctggaggcatcacgctacctgacttcaaactatactacaaggctacactaaccaaaacagcatggtactggtgccaaaacagagatatagatcaatggaacagaacagagcactcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggattgaagacttaaatgttagacctaaaactataaaaatcctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcgcaacctactcacctgacaaagggctaatatccagaatctacaatgaattcaaacaaatttacaagaaaaaaacaaataaccccatcaaaaagtgggcgaaggacatgaacagacacttctcaaaagaagacatttatgcagccaaaaaacacatgacaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttagtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatgtatttattgcagcactattcacaatagcaaagacttggaatcaacccaaatgtccaacaatgatagactggattaagaaaatgtggcacatatacaccatggaatactatgcagccataaaatatgatgagttcatgtcctttgtagggacatggatgaaattggaaatcatcattctcagtaaactatcgcaagaacaaaaaaccaaacaccacatcttctcactcataggtgggaattgaacaatgagaacacatggacacaggaaggggaacatcacactccggggactgttgtggggtggggggaggggggagggatagctttaggagatatacctaatgctaaatgatgagttaatgggtgcagcacaccagcgtggcacatgtatacatatgtaactaacctgcacattgtgcacatgtaccctaaaacttaaagtataataataataaaataaaaaaataaaaaataaaaaaaaatttaaaattcaaaagatgaaatgcattagatgtaaaaaaattcaaatttgtcaattatgggtctcatgtgaattggaagttcttcttctctattggagaaaccagctgtaagtatcattgggttgtcaataacttccccaaacaatactgttctctttttaataacaaactaatattaggacaaaatggggattttgtttataggagagaataaagtaattttgaaagacggaacaggacagataaggaaaggattcagctataggtggctttgaacacccaggtagggtggagctagggagtggaggaggaacacagaaaggaaggtggggacatgctaaacacaaaagttacccatttttaaattgcattgaggaaaaggaggaaactctttcctccctgtctctcctgtagcataaggctcctttctaacaagaccaagaactccacccagtgtcactcgaaagagagtgcttatgaggaggctgggacactccttatcatttcaaactgtgctcttcaggacgctagggagcccccttggggaatacctaggatcgtagtgagaagaaagggaggaatcaaagctctgaattacctcaccttcacttcaagcagagaagttatgattcatctgacttctacataagacttaagattttttaaaaaaaacaaagatgtgcagcgaaagtataaaacctactcatttgaaacaaaaaaaatgtacaaactgggagacacacacacacgaaacaatactacattacccgatacaaattgtcttactttccaacagtgtttaaaactgtatgacgggtatctgtcagagccttctccactttcaacacgccttttgcaaaaaacaatggctttttcatacaagaaaaggtgtcgctgcattggtttgaatctagccaaatccttcatttttgtagcacctttcttgtgccctatccaaacgctgaatccaccttgcattatcatcttgcccagttcatttaagtttccctagaatggaaaatcaaaacccattagtagaaagcaaagctacattcagctctctgacaccaacatgttagggttcagcttaagctactcaaaccctgaagaataatttatgtttttttaaaaacttaactttgtatgttaaaacatggcatgcaccacataagtacaaaattactgtgggggtgggggacaaaagaaacttccttttctctggcttcatatcatctggaggtatttcagctagggtaagtctccccatctcttcttcaatcctgattggtgcatgatatataccagttcaagttttcccactgggtggagctaacctgttaaaaggctacacaagtgctaaagatttgattcttttctttcctatctattcctatctacaggggcaagcagcaattatggagcaatacgttttcttagctgactcaaacattccttaagcaggatctcccaggtctgggattgggggaagactgttggggacaagggggatctcataaatccatttggctgctgatctgaagccaattctccacttagcattatcagtagtaacatcaacattttgatctccagttatctgattcttatacgttatttctcaattggttccaggaggggaaaagggatgttgagatgccgaccctctaaaattccaacaattattaaaatgtgcttacaatatagccatttattgcaatctgatgcatagaatcattaactgacttcagtaaatccagcattgcatcgagtgccttcttcaacagagcagatccttcacagtctttgctatattttaatagctcctgtaattagaaatcaggaattaatattaggcagatattaatatctggttgaaatgaataagtttttggctaacatgctttcaagctggaatccaaatataatgtcacattttggagtaattccttttacatgccctttgctgcagtaatatttttaatggctgtcaaaatagaggaagtagaatagtgactgaatagtataaaacaaaggacatttaatgcttctggagttgaagtataatagctattaagacacatcagagatcaatttttaaagccattacatgtagggttcttttgtcctctacatacagtaatttgttttagccatgatgcactcataatgcatatagcatagaatattatgaaaattcactttaaaacaagccatattgtatttatacttaacacaagattctagcaatcctttcgcattatactaggggagtgccattcgcatttttcattaggaaggcccctatgaaatgcagcctcaaaactataagaaatatttgctttgtttagttcttcttactaatatttaaagttcttcagtaaaacattgtgcggaaatcaacacaacttgtatgaaaaattaaatagctaagatcccagatattctcagcctgatatctatgcctatggcatttgtagccacagtgaattgatggagcacactgcaaaattctgccaaatccagccttcccagtcattgagcctacctatttctagtgcttcctagtaaactatttcctttttaatggctctgtcatatctgactcaaaaagtaaagaaacaaacaaatgcttcatataattaccttcaacaataactgatatttagtgattcgttgcactggtttgagtaaataggaatccagtctaagtctgtgttttaactttctttgacattcctgtcattaaaagataaatatcaataaaattaaattaagacatgtacctgtgaaaatgccaagtgttcattgattaaacctaatgccccaatgtttcttacatctcaaagaatatttattggaaaaatcactgttatagtacagaaattataagacacaatatatctgaaaaactaccataaacactatttcaaggattggagaggtaaacaatttcaacatttcaaagatttaaaagttttcaaatataaattcatattgatgtggaatgcttaaaaggtgtgaaagcagggaatgactatagattaacatgattaaaacgttctttaatatattcaagaaaattcacgaaagaccaagctctacaagccaaggctcagaaaagaaattggttgtgctgaatataaatcagactggatatgagaacaaaatttttaatataacaagaaaaagccatcatcaactggtgctatacttcagtaattggcccattgccactataaatataagggtcatgatgttgggttccgggaacattgtaggggcccatagttagggcaagatgcagatatttaggatgaaatgtgcatagagaaagtatagaacacaaagggattggggaaaaatacgcctgaataagaaccatggctctcctctgaatatgggtaaaatccaacatacaatctaattcaaatgagacttaaagatgggggactgctattaggttggtgcaaaagtgattgtggtttttgccattactttcagtggcaaaaaccacagtaacttttgcaccaacttgatacatgcgtttagatctcctcactcatgacaaccaactaaaatgatggaaaagttattttactaggcaaaatcacaaagttatgaagaagataagcaaggggaaaacttccgcaaaatttggaaactggaaaccaaacttagaagtggtcaacaaccaagcacactggagaaaagtggatttcaagttggtggaggaaaaagccaaggaacaactcaatttatgttataaacatctcttccctgccctccacaaagtctcagggattatagacaccaagtacctctgaaagtgggaggtaaaggtgcggttcaagaaaggatgcttgttgaaagtctttttaagaagtaattagataataacaagtgttggtgaggatatggagcaattaataccctcatacactgctgttggaaatgcaaaacggtgcagtaactttggaaaagagtccagcagtttctcaaaaagttaaatgtagagttactatatgatccagcactttcactcccaggtgtatagccaagaggaatgaaaatatatgtctacagaaaaacttatgcaaaagcattctcagcagcattgttcataataatcaaaaggtagaaacaagccaaatgtgcatcaatcaatgaatggataaataaaatgctatacatccatataatggaatattattcaaccataaataggaataaaaaactaatacatgctacaacatggacgaaccactaaactattatgctaaatgaaagaaagaagtcaaacacaaaagaccacatattgtatgattccatttatatgaaatgtccagaataggcaaatctattgaagacaggatgcagattagtgattgcctagggctgcttagattggggaaaaaagggagggtaagactggtttctttttagtgataaaaacatggttgtacaaccttgtgaatctagtaaaaccactgaattgtatactttaaaagggcgaactgatggcattttagttatagctcaataaagctgttacaagaagaaaataaatggcatgaaaatctaaacaaaagcaataaggctctcagataaccacaccactttgcacagctgggtgccttctcttcccttcctttggcagaaaaatggatgtttatctagaaagagtaaaacacaggccctatggaccaaaggatacaaggttcaacttagggcagagtaccatattgaaaaatattcaagtactctccatgttatatctcaaacaagtgaccctcagccttttctcccaactctgctaccacaacactagcatccagatcattatacacaaggtagcagttcaaggaatctgaccagcctaatagaaatgctctaaagatacaggtatttgggaatcccttcaagcaaatagcttgagacaaataactcaacaatgaggatcatggtcaataaacccacatatgccctggaaacttccaatgagctttttagtgtttactcctaatgtaagtggacagacaagtatcaccagacatttgaggagagcatcaaacatgggtaataggaaccaaacaaagagaaatagaagaaaaaaagcaaagtgaagacaacagaagatgtgcagggagaagaaagccatttttaaaagaaaaatctattatcatctttgtatagatgaatgaagatactgaattcataaaatgaaaatagaattctattaaaagaaacattgaaaaaacagtaaaaggatgagggctcttcaaaattaaaaacacaatggcagaaatggaaacctcaatggaagaactagaaagtagagtaataagacaaagaatggaaaatagaaaagataagataattagaggaccagtccaggatatccaatatccgtacaacagaaattccaaaaagagaaaatggagacaattgggtggaggaaatcaaagaaaacctccaagtaaatttgtacaggaggttccaaattcaaagttatcaccctaatactagcataatggataaaaatagtgccaacatttgaacactgaaaataagttttcataagctttcagaggacagaaactaagtcacctacaaaggaacaacaattaaaatggcatcagatttctgaatagcaacactggaagctagaagacaatcaagcaataccttcaaaattctgagtataattatttcttacctagaattctatacacagccaaactagcaatgaagtcttagggtagaataaagatatttgcagacacatacactctcaaaaacttttatgtactgtgtacactttcttgggaaaactactggaggatgtgttccaccaaacaagggaggtaaacaagaaaaataaagacatggcacctaggaatgaggagagcctatgcaatagacaggtgaggagaattccaaaaattatgttcaccaagatccccagatgacagctgcgcaacaagcctagtgagtctagacaagcaagacagaaaaccccaggagatatttctttaagaatatgaaattcagagaaaatagaatgtgtttaaatgtaataagaagagatttttgtaactcccacatctgggagaggttggggtagaataacgataagtatctagaaaactgagtaaaaaaaccactgcaagacaaacagaagggtaggaaaagcaaccctattataccacatgattcatctgagcaaagaaattacgtagtcttaatttaatactgtatatcaatctaaccaaaattacgatatgactatagtggagattttgaaagaaaagaagtatatttgtatatgtggtagttgggtgggtggaggggcgtgaaagagagctaaatcttcatcttccatagtataaaggataaagataagcatgtcatttggagctatggaggtaaataccaaaggatgtagctaaaagtgctgaaagtgtttgcctctgggaagttacaaatgtgtttgtgtgtgttgggggggagggtggatttgctctttaactcatatacgtatatgcacatgtaacgtacttaaagtagaaaatgaatttataattaagaaataccgcaatatcttccagaaagaatatatccaatacttgaataattactgtacctggaaaaatgcgcattctgaatacttcctccaaattgtttctgatctgggcttattctgacaatattttgcatacatctgaaaatcatccttctgtgataaaaaacaaattcaaatgtattactaatttgtgaatatgacttttgccatcaagaaaggctaaacaagagtgtaaccaagcatcctaggaaatgtggcctaaagggcctactgtactagcagctggtcaaaagccttttttatattccaagaacagcatgcccattgcatctggtgggaggacacataattatctaagtaatatcagagcttccacttgccaagcttgaggcttagatggaggcttctctgtctgaactataaaaacctactttttgcataacgatgaactaataggctgccaagaaatatattctgttattagtctcttgattccctagtgaatgaacttgtagctgacttccaagttagagcctacagtcctaggttcatcactgggactttatcactgtagcataatccatttaggcacttatgcaattctctttccctggaatcctctttctctgaccctcatgaatgggctacctcctactcattatttaacatttatctcatgagttatctcttctatacaaccattgtttatacccccattctatgcaagacgcccctcttctggattttcccaggaccatttgtatatttcaaatctaatgcaactcatcttctacacaattaataatttccctgtttttatatctaaatagatttgggcttggtatccacattatctggcacaatgcttggtgcatagtaggtgaccagtaaatggttgttgaataaataaacaattcatcaataaacatttattaaaccacaactggttgctaagaacgctgctaacccaatgagagatacaacaatatataggatatggactctcgttctaagggctgtccattaagtttgggagaaaattcacgtatatatgtaaaggtgcacaagcacagtaaatataaaatctcccatgagtaggatagacattacatactatggagtctaaaggaaggataaactgctattgcttgatgaggttgggaaagaatttggtcataatttaaatatgcttaaagttagaacatcttagccggacacggtggctcacgcctgtaatcccaacactttgggaggctgaggtgggcagatcacgaggtcaggagatcgagaccatcctcgctaacacggtgaaaccccgtctctactaaaaatacaaaaaattagctgggcgtggtggtgggcacctgtagtcccagctactcgggaggctgaggcaggagaatggtgtgaacccgggacgtggaggttgcagtgagccgagatcacaccactgaactccagcctgggtgacagagtgagactgtctcaaaaataaaaataaaaaaataaaataaataaagttagaacacgttgagcaaggttgacacacagttctttcttatccttattctcttctcatttcataaacactttctgggataagacatctattttgaagctttcaacaatcacctctattgaattaactcttaaatcaagacaaaactgatctttcaggaagaagagaaactgcataagcagagaagcatacacaaaaaatattctaaaagaaaactaatggaggagagtatgatcactaacctgggaagtcaattgtattaaccatacttgggacacagaggaatgggcctccctaaatgcttttgttgaatgaaaagaactgacagctctctgtttctgtgaagttcctgtgatagatgccttgatggctgaaagtcagactagatccaattctaaaactttacatgtattttaataagacaaataatataaataataaggtgttttttaggcaaaaaaaaaaaaattaaccaagccccagatggttttgttatcatgatcccaactcttacatcttcatagtcaggatggtccctggattactaggattacccaggagtcagtgttcaagagctgagccactgaagcatttgataccacagaatggaaggggtatttttatgctctggatatcccagtgcatccatttctgcagcaaaacttggtttggtattaaatacttgctggagtaatgtgtcctctccaaaaacataaagacataaagtacctatcttgtctccaaatctgttcttataagtgagttgctattttggtggtgcatatttatatatatttaaaaaataatttaactaaccctttccaggaaacaaggtcccactctttctggagcatgagcacaattttccaggctgctcaagaaaatgctgtgaaaatttcagagaaaaaaaattgcatgattttatgtgaaatataataaactggtaaagagagcactttaaatagttttataaaaaataaatattcaattcagcaattacatactcgttatggaattcatatatttctgccatgtttccaaagagaatgtcctttttatttctcaggagaggtggcataagatcaaacatctctggattatccatctccgctctataaccctacccaaaataaatacattcatgcattttaaaataattacatgcacatttggttgggctactaatggtgtaggtacagcagaatattaagggatttgatggtgaagttttttgaattttatttcaattttaattcaattcaaatctcctacttcccaaagttatccatgacttttttttttttttttttagaaggcagggcaaggaaaggaagtcaagttttccaatcaaataggcagaataaagtaatagctctttggccttcagagtagcttgtagtgtaggaaacaagatagaaaccaagataaaaacatagactacaggtcatcagcttctccttaaattggcaatacgtgcttaggttttttcagaccaaattaatatcatgacatttttgtcaaaagaatattttatcccattctcagttttttacatcacgatctctaaatagcaccctgggaataattgtaacaatcggctgtatccctaagagaacattttctcttctgtaataaattctgaatcaatcattcccattactgagggagagcctgaatgtgcacgtttaaccgacatgctgcatcaaacaataaaagaaatgcccactgctgccatatgacaaccaaggaaggagacggaagtagaagattgcccctaaacactttctaatgaatgtagcaagggatcattcgggaaaagatagggcaaatacaatttgagtcgcttaccaacaaaacagtatacagttctcgaacataaactctctcagtctgtatcagttcatttagtacgtggctaaaatgaaaagaccatatttatcagttattttattactgagatctatattgcaatgtttcaagtattatcatcatgagaaggtaaaaatagctaatgcataggaattatcaatggttttcgttttagcatcaaaatatgaaactacttttatggtttctagaataaaaactatatatatatatagtcttatgggtggtttttatacattgtatttatattcattatatatataacatatatatatatatatatcccgctttctttcatatatatacacatatatatgctcaagggttactattagctttaaagaactttatttctaactcactgagattaggaataaatgtactaaaaactcacaataactattcctaaatgtctgaggtttttattgtttgggggtagcatagtttatgaactttaataccctttttttccctaaaaaataagtattagcattttaggcactatttttcccttttcaaagtaatgttctgaaattttctaaaggaggccgcagatttttttaccctggtctcctcaagtgtaggtcatacttatatttccgtaatgtatataaatatatttttgagacggaatctcactctgtcacccaggcttgagtgcagtggggtaatctcggcttactgcaacctccacctcccgggttcaagagattctccttcctcagcctccctagtggctgggattataggcgctcaccaccacacctggctaatttttgtattttttggtagagacggggtttcaccatgtttgtcaggctggtctcgaactcctgacctcaagtgatccgcccgcctgggcctcccaacatgctgggattgcaggcgtgaataaccacgccccacctgtttctgtaataattttgtttactgtctctggaaaataaagtatattttcctttcaatgtgatttccaattgacatcatatttaaaactcatttcccttgtccccagtataagtaacccatttgatttaacttatacttttggctttttttctttttctttttgcatattaaagcatttaacatttgagagtcttacagtataaatatgtgtctgtatatatatatatatgtatctcatacatacatatgtatacatacaacttgctgcaaaatgcttgctaattacaactgtaacatcaaattaaaaagatgaatattcttatgtctagaatattaatataccattataacaatgaacaaaacaattattaacatctataaaataacattgtatcaatctgtataatcctttgtaatttttgatgtaccactctattcatttcgtatatcgaaatttgctgagagaatagatcttaactgttctcaccacaaaaaaaaaatggtaactacgtgaggtgatagatgtgttaactaacttgatatggtaatcatttcacaatatatacacatatcaaagcatcacattgtacactttaaatatacataattttgtcaattatatatcaataaagctgaagaattaatagataagctaactaccatgatttgatcattatacattgtacacatgtatcaaaatttcacactgtattccataaatatgtacaatgattatgtgtcaatgaaaaataataataaaactttttttaagaatgataaacgaaaacctccattttatttcagtctggggtaaaaaaaagaagataccaacattctgaaaaagtttagttaattttcttcaaatcacataaataggctataggttggccaggcctaaatcctggacttctgacacccagtaaaaccccattctgtgaactcaaatttctaatcacattggccttgaacactgaaccagactcccacagttagatgtgtatgtgagtttatattaataaataaaggatacttctttaaaacatccaagctattgccattgtccaaactggaggatggaccagaacttctcttctcctgacaatcaggcaccacttcaatctgaaatacagaaaataaaagttaaattagcacctctgtaggtataatttttcttcaaggcgatccagctcaaattaagtttattctaggtcctaactctgaagataaattgaaaaataaaactatgatttttttcaaaataactttgatacgtactagtaaaaagtgatttaagttgcctaagaaaacagatttaagatactaattagaacttattttatgtattaactctttatttatttggcattcttggaaaataaggttgattcataaaaagttaattttctagataactaaagggtattcattgaagaaccaaacatctttttaaccatagtgatttttgatggaaacctttctagaaaatattatatgcatccttgaattctttaatcaaagacacacgacataactgatccttttcctttttttttttctaagatctggggcaagctagaagatccttttcctaatgattcgatggcatcatcataagcttgaatatgataaaatctaatgatgtgctgcagggatacctgcagaactctattctttcttgaaataactgtaacctgtacatctctgtctctactccctgccacatgttagtcgctataagttgcctccctaattctaataaattgccttattttacagactctaaaggacttggactggcctaccgagtcaactgcaaaagatttgtgatgattatttcttttaagaagcatttgaagtgtattcctggtatccaatctcagctgtattggacagctgagcttgccaaaagcctgacctccaagtaaatgtaacatttctttgggacaactagaacccaaaatgaagtacagtatctatcagctaaatatttccccaaaatgtgacctacttattacaaatgaaagaaacaagcatgtattatgactttctatatattaggcaaccacagtcctaggtgcttaacacatattatatttaatccaaacagcatttagcaagcaatggcattcttttcctcattttaaatatgggaaaactgaggctcagacagattttacaacatgtaatactacagaatttggcattcaccctgtttctttcttgaaaccagaagttgtggccgtacagaataataaccaggcttcgtgtatcagtatagaccattcactaggctgctattaattatattaaaacttagagcattatcatatgccacacatgttcaaggtgcttcacaaatattagattattttatctttaactccatgatgagagtgttctatttttatgcccattttatatatggaaactgagttccagagaacttacccaagtttatatagccagtaagtgatggaactgggattataagccaggcagcctagttttacaatttgtaccactatgctatactgccccttaaaaatatgttctcatctttatttaccacaaaaaacacaagaagaaaatgtggggtcttggggactgggagcagtggctcatgcctgtaatcccaacactttgggagaccaaggcgggaggatcacctgaggccaggagtttaagatcagccttggcaacatagcaagaccctgtctatcaaaaaaagtgttaaaaatattagcctggcataatggcccatgcctgtagtctaagatactcaggagcctggggtggtaggatttcttgagcccaagagtttgaggctgcagtgagctatgatcgcaccactgtagtccagcctaggcaacagagcgagaccctgtctcaaaaaaaaaaagagagagagaaaagaaaatgtgggatgttgtagctatgatgagtctacttctttacagatatcagattatcatggataactgagaagaacagaatcttgtatctaacaataagtaagtagattgggcacagtgatgcacacctgtagtcccagctactcaggaggctgaagtggaagggtggcatgagcccaggaattagaggcagcagtgagctatggtcacccctgtgaatggccactgcactccagccttggcaacatagtgagaccctgtctctaaaaaaacttaaaaacaacaacaaaaaagaatggatatcttttttgagctaagagttagcctctgcatggtccattagaacctgtcctgtgtgcttcatacttgtaggactggaattgctcatgaaagaaagtttattctgcacaaaggtgcaacgcttacttacgattattgaagtgatggtgggtggtggtaaaaagaagctggaacatatacaagatgttctacagaaatgattctaaccttgagccaggacttgagaaacagctcatactgagaaactggcatatctggggatatgccagtaatgcagtgaaacacaatgcagcagcagctttttttcttttaaatagtctttcaaagacacaatatttgtctagtgaatgaaacatgtgatttaaggctcataccaactctgcaactaaagcaataaagtcaattttgaattaattaatgatatttacttttaagttgctctgattttgtctccaagtcttcttccctggtagagaaatgtgaaagaagaatttcaaaccagaattaaagtcagcacttttaatagaaatacatatatatttattaaataacttgagttaatattccaatatgtttatattagtattttaaaatcacactatagaagataatgtttggttggacttactcacatgatttcagcttcttactgagcatgattttgctatgtattcacccattctctcattcatcaaacattcacttacttgccaagcattgaggtaggtgttagtgctcataattatttgcagatttagtattcattctgacacaaaaacatttaatcaaattgtagctcattgattaactcaatcaaaaagaattttgaaaacaatctaagtttaatctactaattagagcatctacacttgtttggcactttctacatattgagcactgttctaagagctatgcatatatcttcttttttaatacccaaaatcatcctaagaggtaggtaacaacttctatccctatcttctagataaggaattaaggttaatatcttgtccaagaagcagaggtggtattcaaattcatataatctactctcagaatgtttctaaccaccatataaacatttccaaagcatgataaaatgttaaacatgtcatcaaaattcaaaactttcatctttattttttaaatgtttagtttaaaaagggtgagccactgtattattaagcaaggaatccagacgttcctacaaagccgaaggcatggtccaaccaaagactagattgtttagatcctaattctcagggctgctgaaaaggctgttactcacacaggctgcatgagactcctctctccaggaaaggaacaaaccttttgtccttccctcctcagcaggagccagtgacaggcacactcaggaaaacgaagggctgctatgttctctagactccatacttcactttcacttattaaaatatattttctacctaaacttcaagtttatatcatcatatatgtaaatatatattaaacagtgggaattatacaaaattaatttctcaatgaatactaatatgctccacttcaaagaaacctgttctacagagatccaaacttatttttaaaggtaacttaagaggcaattgttagttttgccaattaattctttgcaaatacgttaagagatacaaaataaatatgtgcacaacttatgagaaacacatcttattcttcaaagcaaggtagatgtattcatttttaacaatataaatacatacaaaatgattgagcacctacaccatatgctaagctctgtgtttagggatacaaagatgaactgcacacagtttctgcccttacagagcttagtttagcaagagagacagaaaacagacaattctactaaagccaagaagaaatttgggggtacttgttatcacacagcatgaacacctaagcaaacaggggtgcagggaaggaggagatctggggaggaaaagcttacctgaaggaagtggcctagaaataggaaatctgatagaggagtagaagctaacatgtgggaaagggagaggaaaggaaatagtgttccagagagagaacagtgtgtgtaatgtccacaaagtaagacacctaggaaagggaagaagaagtgggcagggtaagtggaagagacagaaagactgtcacagttgccaaggccaggatgatgttagctcggattaggaaagtggcagtaaggatagcagtggggatgaaaaaaaaaagtgaatggattcgagagagatacttagtaggcacaaatccacaggatatagaatttttgatcaattagaggtagggcataagtgaggaggaaccaaggtcccaggcttgggcaactggggaaatcatagtgccattcaccaagatgaagagtagaaagattgcaggagagatgagttaatctgaggtatgttgagtctgagttgcctatgggaaattcaaaaaggcaaattataaacagagatccaaagcttagaagaaagatctaggctaaagatccagatttaggagctcaagtcacattttacattttattcctcgctgtcaatatctcccattctcaataactacactctatattcaatgttaattctacaaatatttattacatcttgctaagtgccaggccctgtgctaggtgcagaattatatttaatgcaaaaagaaaaaaaaaaactaaaataaaaccaaagaacaaaaaaacagtttgactcatttttatgagaaattaatacttatgttttgagttgaccaaattttatatatttggcttagcgattaaaagtcttaagaaattgtttggaatggattgttataatccctattactaacagagcaattaggtaaatgaacaaggtttgtagcatacataatgttttgatttaatttacaaagcatgatgtataatagataaaaacatttatccatccatgtcacttatttattaagctgccttcatcctcatacatacattaggcagtctcaaactgaagcaaatccaagctactcctaacaaaaagttggatcatgaagtatcttaaacaaaagaaggcctgattcattttagcatcgccaattgtttttctttattctttttgcggggtcactttatgaaagacattgaatttagaaccataatctacattttatatagtcattttccaacataagcataatacaaagagaataatggatggttattatgaaaaacaggaaaaagttacttgcaggtagaatgcaacaatgaactgctgctgtttttagatgccaaactggtttttcacatgtacacaaactcagaaaaatgtattggcaaaagtaatataataaagatgggtaccttttgaaaaaagtttacatgcttgaaagaaagagtatccaactcccactgcagaaggaaattgtaacgccattaaataagaatatcagaaaaaaatgaaacaatacaaaacaaaatgtgctaatgagtgactaatgacttgcatggatctgtaacagtctcctcaaaactccgttcctcaacccaaggtgtaccactttaagaacctctagaaagagttgagattttagaggacaattaagcaagcagctttaaccagaggaaaggactagtccagtttatcaagtatttttttatagtcttcaatttttttcaccctatctttacaataacctgttggagtcaataggtattatcgtccttattgtccaggtaaggaaactgaggctaaagaggctaagtgaactgttcaaggacacacagccagtacatggagccagaaatctaaccgaggtctgtcttctgctcaagaatatcaacctatttcagttttattctcatagctatcgggttttatccccttactgttttttattttgttatctttactctttttccagtagttttaatattccctgtatctttgctatatctttgatattgtatttaagacattgcttatagttttatttgtaaatatatttatatatttcataagtattaaacatgtaactttcataatcttagcctagttacctgctttcatcaccttttgaaaatctgatccatgctagatataagctattatttttatgctcattatccttggctcaagccttctctgaattccaaagcagttctcctacactaatgaagcttctgactctatttagatcagacagaccaaatttactcccatcttcacccattccacttacttagggccctaaagaccaaattactctcctctaagaagccccaaaggcagctcaagggaacccctgagccatccatatccagagtagttcaacacattataaggacaattattatttccatagaacttagaaagaaaatagatcttacatggataaaactaggagattaaaactagaaaatgaactctgtaatagtaaattaccaacaaaattattctatttaacagcatttatttagaaaaggcaatccattttattatctaagccattcacttactagaagcttataagaaccaagtcatatttcaccactatgcaatatattcatgtaacaaaactctatgtacttgtactcccacatttatacaaataaaaaggaaccaaatcattgcttatctagagtagcagtaaatatgtgtgtgtgtgtgtgtgtgtgtgtgtgtgtgtgcatgcacacatgtgtatactagcttcatatactttccttcacctgctggaaaaaaatgcaagtttgatgctggtaaaattttcatactcattttcaaggctggagtactcagtactgagacgttcacaattccttgtactgtactatatcactactatgttttagtactgtacaataacctcaatctgactcttgccttgcacaatataaatatgaccaaagatgctaaagtgaaattttcatctatccgcattgaagaataaactcagtatttacatcaagagtaacaatataaacaatagcaagaaaaaaagagacagagaaagtaagacattttaccttgtttagatgaaaaaaatggtgtcccagatgtgaccaaattttcaggtgtgggtaccacaaattggattggcctcacatgcttatctgccaggttcctgaaaccagcctgctggttctcaaatatacttcgaatgttttcaagcttgagttgtatagtcttcatttgaacctgcgagttgtataagaattataggaaatattttatgaaatgaggtcattacaaaccccattacatttctcagactcagatggtcaaaaaaataatttagagtttaaaatataactacaagacatttagaaaaataacaagacagattaatgtattatgttcacatggatataaaaccaaaatctcaaccaaaacaacctgagggaaaaaattaccaagaagcagtcatgaaattggtcactgcatagagtgatttgcccttcattggttcattggctgaatcagataatggctgggaaagaaggcatattgctctttcctgtttagcataagaaagccaccaagttataaaaacaatcaaatgaataacatcggtataatattttgttacattttaccctgtaggacattcttgttatagtcttctatgttgcagcaggctcctcagagccaccaatggataatacacctttgtacctctcctagatgctttgaggcagctagagttaagcttggttgcttccagagaatcacttggctattgccatgactgcatttctgatttcctggggcatcccctaggatattccgctaagcatggatctagatactgctccaatcttagagtcaactacacattttagcagcaaatagcatcacaaatgctcttatctacaatgtggaaaattcttcatgtcatttccaagggggcagtactgaactaacctatagctgtccaccctgttaacaccaacttctgcctgctcctccttctccaagaagacccaaatcctatctttatgctttcattctcaaactgagtaggaaagcaacatcatccacagagcatctgctgatggtcactgcagcacaaaggaaagatgtctggggtaaagtgctcttgacatggacccaacattctgttatagaagagctttgggcctttctccagtgatgcacaacaaaatatgtgtgagaacacctagcacataaaagagttttaaaataatggatttggagctcaaaaaggaaattattcttcattatatagcaaacatatgcctttgaattatttgatgcttgacagtggcactactatcacccctaagaggacaatgtaagtgcaatttgacataaagttagctgtgaggtagtaaaactcctcctacccacagtactgcaattataattttctttaaatatttatttgaaaataaaaaagcctctaccttaagctcaggagataatattacatcaaattcatactgcagtgtttcaggttcataatttataaagggtagagccatttcaagaaaattttcaatgtcttggagagctttctgagcatcttctttagactgaaacttatctatttcctgattagctagaagacattccccttcatcacagcattgacgagcctggtaagaaaatcaagaagaaaaaaaaaaaatatgaattaataaagagaaaacatatttgtccaataagtgagtggttctcagcctctggcttccgtgagtcagaaatgctttcagagctgttaaaaaaaaaaaagatatctgggttctgcccccagaaattctgattcagtagctctgggccataagttgggcatttatacttttacagagctccacagatactgctgatacacagccgaggttgggaaacactgcatttatttcacaacaactaatttattctgcagcaggagtccgaccattttctcagcactaacacttagttgcatgttactttcccaaaatcagtaactgaaatatgaaattcttagaaaaatataaagtgtaatacaaatgcttaatgatggctaaagacaagaataaagtttccttcccaaagaatgagatgtaaagattaaaatgtttatgttcagatataatgtctgtaagtgatacccctattttatattccactgccaacaccaggtccatacggtgacctgtcaattcattgcctaatcgtgaaaagggtcaaacccacaagccatggaggaatattttccagtcactgtttaatattttatttctgtactatgaaatgtgaaaggagtttcaggctttagcaaaatgcccccccaggtttttaaaaatgttccaagtacaaaccatcaccagtgaaggcttcagagatgtatcgaaaatacaaaggaagccattactccacaatctcaatatttagaacaaagggtaaaatttgaactatattggatctttcatgaatagttcattggtagatggatgaaaaaatcataatcaaactcagtccttcagacttcttacaaatttaattccaaagctataccagtccctgaccatataacctctgagaagatgaaaagtattccatgcgacaggagggcaaggtgcttcaggctagcaggacctggaaaaaaatgtgtgttccttttcagaaatggatcatttcccattacactacctgctgtaggagtttatgcattttgaaggtcctgctgagttgtatccgttttgcttttatctcattaaccaaaatatcagaaaggtaacgtagctcattgcacctctggcagattaaatcaagtgcataatggtgatttgctgcaagcttgtgtccatgtaatatcacaaactgggcctttgataatagctcctgattataacaaagacaaaaaataatgaatacatgatctctgttcctatagagaaaaaaagaagaaaataattaagaagcaaaatgtttgagcaagaaggatacattgccaaaaatacaatttgatgtctacttcttcaggctgcaaaaaaaaaaacacaaacaaacaaacaaaaaaacaaaaacaaaaacttacagttataataattagctgcagcagtgatgtcattagaagctcatgcatttctggttatagaaactgaaaattgcacatcacacacagaatgtgggtgagattttttctcctaatatgtgtggatttagaatagaaccacctatattaaatgaggtatacacaccagccaagtgtatttcatatcatctcagccttagaaatctcatcagagttgtcatgtacctggactacttcacatacctgaagtcacagggtttctatgtcaaaaaatgacctttagtggccttgcctccactccatcaactactcactccccccagtgtagagactcgaacatagtaggggttcaagaaatgcttgtcaaaataaaataaataaaactcaaacacagaatgaggaaatgactggcctctctatctagtgggaaaaccaggtttaaaatggagagctgttgtctaatgggtatacagtttcaattttataaggtgaaaaagttctggagctgttgcacaacaacgcgaatttacttatcactactgaactgaacatttaaaaatgattaagacggtaaatttcatgttatgtgtttttaccacaattagaaacgaaaaattattaaatggaaaaaaattaagtctcccttagtttccaaaccagtttgcctcctctttctactataccatagggctatgtaaagtgtcccatgatcacacagatctacaagcataattccagaactagttatcataactgttgcttcttcaatatttgttttcacatactcatggttcacccataaatctgtttgtatgctgagaattcatcttaaaaagcgtggccttgctctcacataaaaagcatggccttgctctcacataaaagctaagagttttttaagtattaaagccactagtccaaaatttaagactagcagggataatgaaaactgcctcttttgagtggttactatatagtccagtgttgtgccaggtgctttatatacacctaaatgaatattcacaattgctctgcaaagtaggtcattttatccccagtttatagatgaagacactgaggattagaaaccaatttactcaaggtcacagatagtaagaataagtagaaatatctatgtgagtctccatttggttaaactgcatatatcctaaagtgggcatttaaggaattatgttcttgtatgttcccatcatttccaagcaccatatatcattcttcatacacatttttctagcttctccaaaataatttatgcccttgttcttattggtgggcttgaaacagttcacgccattgtctcagtgacctccttttacaactaactacatgatatatctgtagtgtcacctctggcctgcattgaacaaaacagaatatagaccaatataattgtgcctgatatacagaatgttgttatgatgggaggaaggcaagcgataaaaggctacaaatagggtgcagtgtatactgttcgggtgatgggtgcaccaaaatctcacaaatcaccactaaagaacttactcatataaccaaataccacctataccccagtaacttatggaaaaataaaaataaagaaattaataataagggtttatactacctactcccgccaaaacatgactattatactgtataatatagcagacatctaaaatacaatcttacctgagaattttcatctaagttttccaatttttttattttttgttttacttgagctatagtccctgttacatcagccagttctgcttgttggtttaatagaaattcaacttcagtcacaagctaaaaatacgaaacaaagaggttttaaaaacataaaatttatccccttatgatcaagttttatacaaaatgcttttaaacaaaaatattgacatggagaaattacacatataaaaaatttggttattttattcacagaaatagctataatctgttaaaatttaacctcatagatatcaatgtgtactcttgatgtataaaagatcaccatgtacatgtgtaggttcgtatatgaggacatgtatttgcataaatgtatacgtgtgaggtatgtataggtatatatacatttgtgtgtgtgtgtgtgtgtgtgtgtgtgtgtatatatatatagcaaatatctaaaacaaaatcttacctgagaattttcatctaagtgtttttttcatcattccccagctctctggtgaattatcctaaaagcaaaagccctccagaagtaataagcacatctcccacccagaccttggtctttaataccatttcccagaaaaagaaaccagggctcctcaaggaaataactgattccagggttgaggcagaataggtacaagatgaacttggaatatatttttatgccagaaagtaagaaagtgatttatttaaatgttggagtatgtcacaaggacacagcagcagtttgaaacaccacaatagtcaagaacactaataaattataaacaatcaaaaaactaggaatcagaaaagaagtcaaatcatctttctttgctgacaacatgattctatacctagaaaacactaaagactaccaaaaggctcctagaattgataaacaacttcaggaaagttttacgatacaaaatcaatgtacaaaaatcagtagcatttctatacaccaataatgttcaagctgaaagccaaatcaagaatgcaatttcatttacaatgaccacaaaaagaataaaatacccagtaatacatgtagcccaaggaggagaaaaatctctataaggagacctacaaaacactgctgaaatagatcatacatgacacaaacaaatggagaaaacattccatgctcatagatttgaagaatcactatcattcaaatggccatactgtccaaaataatctgccaattcaatgttattcctatcaaactaccaacagcctttttcacagaattagaaaaactattctaaaattcatatggaaccacaaaagagctcaaatagccaaagcaatcataagcaaaaagaacaagggcagaaataacatattacccgacatcaaactataccaaaacaacatagtcctggtacaaaaacagacacttagaccaatggaacagaatagagaacccagaaataaagccacgcatctacaaccatcagatcttttaccaaatcaacgaaaataatcaaaggggaaaggactccctattcaacaaatggtgctgagatagctgactaatcatataaagaagagtgaaactggacccctacctttcaccatatataacaattaactaaggatggattaaagatctaaatgcaagacctcaatatacaagaatcttgggagaaaagctaggaaacactaatctggacattggccttgggaaagaatttatgactaaaatttcaaaagcaatttcaacaaatacaaaaattgatacgtgggacctaattaaactaaagagcttctgcataaccaaagaagctatcaacagagtaaacagacaacctacagaatgggagaaaatattcacaaactatgcatctgacaaaaatctaatatccagaatctgtaaggaacttaaacaattcaacaagcaaaaaactaataactctcaaaacacagatatagatcaatggaacagaacagagcactcagaaataatgccgcatatctacaaccatctgatctttgacaaacctgacaaaaacaagaaatggggaaaggattccctatttaataaatggtgctgggaaaactggctagccatatgtagaaagctgaaactggatcccttccttacatcttatacaaaaactaattcaagatggattaaagacttacatgttagacctaaaaccataaaaaccctagaagaaaacctaggcaataccattcaggacataggcatgggcaaggacttcatgtctaaaacaccgaaagcaatggcaacaaaagccaaaattgacaaatgggatctaattaaactaaagagcttctgcacagcaaaagaaactatcatcagagtgaacaggcaacctacagaatgggagaaaattttcgcaacctactcatctgacaaagggctaatatccagaatccacaatgaactcaaacaaatttacaagaaaaaaacaaacaaccccatcaaaaagtgggcgaaggatatgaacagacacttctcaaaagaagacatttatgcagccaaaaaacgcatgaaaaaatgctcatcatcactggccatcagagaaatgcaaatcaaaaccacaatgagataccatctcacacaagttagaatggcgatcattaaaaagtcaggaaacaacaggtgctggagaggatgtggagaaataggaacacttttacattattggtgggactgtaaactagttcaaccattgtggaagtcagtgtggcgattcctcagggatctagaactagaaataccatttgacccagccatcccattactgggtatatacccaaaggattataaatcctgctgctataaagacatatgcacacgtatgtttattgtggcactattcacaatagcaaagacttggaaccaagccaaatgtccaacaacgatagagtggattaagaaaatgtggcacatatacaccatggaatactatgcagccataaaatatgatgagttcatgtcctttgtagggacatggatgaagctagaaaccatcattctcagcaaactatcgcaaggacaaaaaaaccaaacaccgcatgttctcactcataggtgggaattgaacaatgagaacacatggacacagaaaggggaacatcacactctggggcctgttgtggggtggggggcgaggggagggatagcattaggagatatacctaatgctaaatgacaagttaataggtgtagcacaccaacatggcacatgtatacatatgtaacgaacctgcacattgtactcatgtaccctaaaacttaaagtataataataataaaataaaaaaaaactaataactccactaaaaagtgagcagaggacatgaacagatacttctcaaaagaagacatacagatttccaacaaagaggagaaaatgctcaatatcactaatcatcagagaaatgcaaatcaaatgagataacatatcacatcagtcagaatggctattattaaagagacaaaaaggaacagatgctggtgaggctatggagagaagggaacgctgatacactgctggtgggaaagtaaattagttcagccactgtggaaggcatcctgaatatttaagaacttaagacagaactaccatttgacccagcaatcccattactgagtatatacccaatggaaaataaatcattctatcaaaaaggcaatgcaattgtatgttcactgcagcactattcgcaatagcaaagacttggaatcaacccaggtgcccatcaatgatggactggataaagaaaatgtggtacaaatacatcatggaatactatgcagccataaaaaaaacaaaatcatgtcttttgcagcaacatgatgcagctggaggccattatcctaagcaaactaacacagagactgaaaaccaaacacagtatgttgtcacttataagtggaagttaagcattggttacacatagacataaagacagaacaataaatgctggagactaccaaaagggggaagaggaggaaggcaagggcttaaaaactaactattggatattatgctcactacctgagtaacggcatcattcacacctcaaatgtaacagtatacccatgtaacagtatacccatgtaacaaacgtgcatgtgtatgccctgaatctaaaataaaagttgaaagttttaaaaaccaataagtaaaaatctttgaatcaaataaagaaataaatggagagaagggaaggctcttgcttcagtagaatgcctagtgtggactgataaatgtggactggacatgggagttgaaaataatcattattttgcaaccatcacagcaaagatttgtccaggcaaacatcatcagttgatgctaaatttacggggaaatttttatgagaaggaggatatttgcataaccttaaattttctccccacacatttcctactagttagaaggggagtaaaagtagctttacagtggagaaattcaacaacaccctgaataggtaatcagaatccacatcaacaataagagggaggtaggcttcattcacctgcagatatgattccttaagaaggacacttcactaatgtggtattctagctggtcatatatactaaatagaatcatgagaagatgtccaacaaactccaaatgaagaaaaatgcatttcaaaagggactatggctgggcatgagtccttatagctcatgcctggaatcccagcactttgggaggctgaggcgggaggattgtttgagcctaggagttgcagaccagcctgggcaacacagtgagaccccatccccacaaaaattaaaaagttagccaggcatggtggtgcatacctgtagtcccagctacttgggaggctgaggggggaggatggcttaagcccaggagtttgaggctacagtagctatgattgtgtcactgtactccagcctgggagacagaactgtctcaaaaaaaaaaaaaaaggactatattcttcaaaatgtcagagtcataaaagacaaagaaaggctgtggaaatgttctagattcaagggcactaaagacacaagacaacttaatgcaagactggaccctatataggatccgattctgaaggaaaaataaatgctataaaagacttgactgagtcaactgacaaaattgaaataccaatggtagataatataaaagtattgcattgttaaatgtactgaatctgataactgtactatggttatataacagaatatccctattactagaaaaaatggaagcatttagggggaaagggccatcatgtgtgcaacttacactcaaatgggtcagaaaatatattatttgtcagatcagaaaaaaatattatctgtatatatatgagggagggaataaaaataatagagcaaatggagtaaaatattgtcattaagttaatctgggaagaaggtatatgggtatttttatttttcttatatttgccatttttctgtaagtttatgtttctacgtgtttttttaaaaagtcatgtttctagacatacagaacttgtcgacatgtcactatgagacacaccatgtcagtgagattataatctaagacaaacaacaatattgattaaagacaggaattaatgacttggggaaacagaacataaccacaggacaagaatttggtatgcatgcaaattaatatgtaagtataagcataatgggtatgttcaggaaaagtgctattttctgtgtattcagttggagacgagggagaaacacaaatacctagaaggaccaagagcaacctgacctattctttctttagggaaggtttcatgcagaacatttcaaaagatgtttgaatcaaaggagagaaaacgctagtggtaactgagccccgcgtccagagtacagtgctcctccgaaacctaactctgatgagcaagtgaaatacaaagcaagtaagccattcatgggcagaaaacaagctgggcacatgcaagaggaacaagtgagttttccttggatcctctggtgaagtatatactgtgagagagactgtgataaggttgaacatgaccgcaaaaggaaaagaaactaaatctatgcatcttgaccatatatgatggattttccaggaaggtccaattggaatgtatttttaattatttattaaacttatttaatttcatctctcaggcttttcacaggaataaactcctggatcagaaataaaagcttgttaggtcttattaaatatggtcagcataggtacatgggatttaaaaaccaagaaggaagttggtattattcccttggaaagctacctcataaccttgaataccctttagatctaagataaatttgaataacaaaccccaaagtagagagtaactttgtccctgtcatatatattggcagtttgatactttctcaaaggaaacgagtaagctgaaaaagtagaagtctcagaattttagtagagattttcttcagtctaagccaaggttcatttacatttgcctccttttttttctttgtaggtataaatgggcatcttgcaaggcaggatttctcatgattaaggagtaaaaacctctggtgtaatgaaaaaaggtatacaaagaaatgttttaactgacctgttgaaaatcctgctcaaacttccatagttgcagatactgctccatttttaattgatgtttttcccaaaatccatcaaaagctgtttccatatcatgtacttgagtcagcaaccttaagaaagaaaactccaataaattcctaaaagcaactatctgttttgtaagtatgtagataagtgtggtctggacattaagaattataggcaaagtcatagcccatgacacttggttctacctatagagacaaccaatgtccacagactctcttctacaagcaaaatcatctctgtaggacaacctagaaataagttctcagatttccagaggtccaggaatactttaacacttaacatattgcagcaaaaatgtataatttcctttcaaaaatataaaataagtaactctaaaccaaaaagagagtactcacttattaatagtttgccagtcaccacttatttgccgatgacattctagtcttgaactgacagctccttcagtgtcaggcacttccagatttgttagcagaatttttccttctttggttacagctgtaatatcattctgtccaaagacacaaaaggagtatcacctaattagtaatccaacctgaatgatgtgatgggaagggagcatacaactatggcatgaagaatcgaaacagttaattctagaatggcctttgctttcatagctctctgaaaattcacaaaatttcaaaatctcagtgccacaaaatctaaaagctgtgaagatccaagaagcccttgccttagagatggacgttgcaattaatgtttttataagatcatcatgggcagaagtaccatgtgctctatttgtagcctccttctctaactggtagaaagttccaatccagtccatcctattctgctaatattttatttttatttacttttttagagatgggatcttgctatgttgcccaggctggacacaaactcctgggctcaagcaattctcctgcctcaggctcccgcgtagcagggacaacaaatatgtaccactgcacctggcactgttctgctaacacttttaatgagctcaaataaagcagtagtagcacaataaaaaccaccacagtagaaagcatacaattgcaaataatacttaatgcatattcagatacagttaaatgcctttgctactaatccttaattgttaccaatcactccctgccttaagtcttattttacttcacatttaggtttaattaactcatcaagaagtatatgcctctattcagaagggcttaacctcagtgggtggtgtaacaatatagacctttctcagacatctaagagtgatttaagatttctttcaggtggtccaagagtcccttgaaattgtaagcaaaagttttggtgtacatttattctgaggacagattccatgacaccatcaccaatatgggtaataatatcaacattaaaagccaatatttacgaagtaccaactatgtacggaacattgttatacatagatcagtttctttgcctcatttcatcttcacagcaatcctaccaggtatgatgcatcatcatcatcaccaacctcactgtaaagatacagaaactgcaactcagaaaaggtaagcaaattgcctgacaacatgcagtttgtgaaaaacagagctttctttccttggacagagctttgtttttagattgtgattcaaaaggtcagtttcttgcaaatcaaaccacaatgagataccatctcacaccagtcataatgactattattaaaaagacaaaaaataacagatgctggagaggctacagagaaaagggaacactgacacatacttgttggggatgtaaattagttcagtcactgtggaaagcagtctggagatttctcaaagagcttaaaacagaacaccattcaacccagcattgccattactgggtttatacccaaaggaaaataaattgttctaccaaaagacacatgcactcatacgtcattgcagcactattcacaacagcagaaacatggaatcaacctaggtgcccatcaatggtggactgtataaagaaaatgtggtacacatacaccatggaatactatacagtcataaaaaagaacgagatcatgtcctctgcagcaacatggatgcagctgtaggccattatcctaagcaaattaatgcaagaacaggaaaccaaatactgcatgttctcacaagtgggagctaaacattaggtacacatggacataaagatgggaacaatagacagtggggactactagaggaaggagggtgggaggaggcagagtgttgaaaaactacctatctggtactatgctcactacctgggtgacaggatcattcgtacaccaaacctcagcatcccacaatttatccatgtaacaaacctgcacatgtaccctctggacctaaaataaaagttggaaaaaaactcagtttatctttttaatttaaacacatatctctatatacagctttaatcttctaatgcacacagtatgtctattatcagatgagagagacaagttatatgaatgcccagtgcttgttcagattattcttaaactttctgaagaaagtggatccaaaaaatacttgctgattatctgaattgcacttcagaatccttcacaaaacaacactccacaaagacctggataggagagcacaaacaatttgcaacccctggtctactgtaggaaacatcaagacctagtattctgcagagaagagaacttacaatcaattgagcaatgttagccttggtcacaatgctagctcacagcagagatgggactagaaactcggcctcctgactcctcctcaaaaataaaaaatacagccatgcatcacttaatgttggggatatgttccgagaaatgcattgttaggcaatttcatcattttgtgaacatcacagagtgcatttacaaaaacctagatggatagcctactggacacctaggctacagggtatagcctattgctcctaagctacaaacctgtacagcatgttactgtactgtatactgtaggcagttgtaggcatactgtaggcagttgtaacacaacggtatacgtttgtgtatctaaacatgtctaaacatagaaaaggtacagtaaaaatatggtacaatcatatgggactactgtcatatatgtggttcatcattgatcacaacaaccttatgcagtacatgaccgcacatagtaaaacaaaagactatatttctttttctgcagcatttataagatgtttttaaataacttctcaaattaatgcaccatttacggaggggacacttaggtctaacatatccaggacagtcttctcttataaagtataattttttttagtttttaaatatattacataaatgtcttttatctccccttatgcaacagtcagtgtaaaatggagataataaacacctctctagataaagaccatggaaatcttttgtttgtcaactctatcagacataccttcaacagatgatacctttcagcacgaattgccagaatttcttctattgagggaatatcatctggtagttctgtctcagccagttcagttccaaaggactgtaacatctgagccatttctttcactgtgagggcaaaattttctatagcctgcaaagagccggtgattactttaattatatggtcactctgtgagcatatcaaaaactggatcagtaagtgtatttgtttttattgggggtataacggcaaacacatatactatgaactctcctctgctagagaaatatggcattgctcttggcaatcaactgtaactcttcatctaaaactctaagaaactgaaggaagattaagagtcttcctgaatatcttttatccaaatttcttgacttatttcttggacactaatgaaaactatttcttaaagatgccatgtattgagtagtttgttttattttcttgaaaattacagtattttccttattctataaactctccaattggcaaaattgccttataataaccttacttctgaagagagatgagaacagtaaagtcactttatatttgtttattatcatttgtgaataagcattagcattccaaacaaggtgataattgaaggaaacgggggaaaaactagtcacaacaactcatttcaggtactatagaatatttggaatggtggccccaaagcctttgttgccataaaatggtaagtacggttttgttgtttcttttgtttctaaaatcaattactctgagaaagaagggcaaaatgtagagaccatatgaccatctgttaaccatgcatatcaaaatatttgcttgtttatttatagcattacaggttattaaaggctaggcattgctaattttggcaatacatcttcatgtgaatgaatgaattgttgaatgaatgcattgttaaatgaattaatgaatgaaatgttgagtgaagaacaagtatgaggaaaatggaatcctaatttaatgggacatcattaatttcttcagaagggttcccctatctctgggattagaagtcaagatactcatataccacagacatacttgggaggtgcagggcccttgcctatttgtaaatttctaaaacagaagtacagtctttgctacaaatttaaatgcctcagaagcatcactagaataatgagattaataatactatttgcacttattgacggtttgccatatgctaggcactgtgtaaaacattttacttttgctatctcatttagtctttttaagatccctgtgaggtaaggtattattagtcccattttgcagttaggaaaactaagactcagagaggttatgtatattgaccaaggtcatataactaaaaatcagcagggccaggatttgaatccaaacccttcatttcttcaagttactatatagccacaggaggggatgggcagagtatgatctccttattccctaggattctccttcaattgccatcctcagtgactgctcatcatttctagatattgcctatggaagaaaaccaagatgttgaatttatatgtatgtgaaaaatgagggcccagaaagctggggtttttttgttttgttttgttttgtttttttcaaataggaaagaattctagaactagatttaaaggctaacatgaagaactataggctctacagtaagggcaaagacaacatacatttctgaagatgatccattcactgtggcagtactgcaaggtgccgcctaactcaggggttaattgcttgtcatcaatgtatgtcagcaaatcactaactgagctcagcataacaacctatataaataagcaaaaaagatactgttaactgcccttcatgccatccctccattaaactgtaaaatgaactttggcatacatttagcagaaagttacctctgataaatggttttaacagttctctcctgtacatgcccccatacatgtatgcgctaccttcttcagataataacagtttctatttacaaaacattttctgtaaagctaaatcaatctccacagaaaccaaaacgcctaattttcctccatctaaaagtttgcattgttaatggtccagcttctaaaagaatgctatgctcacaacaaagaaaaggactttatgtagtaagttataatttatcaggaggggctgaccttttcaaaagtatcaaaatttatgagcaccctattcctaaccttaaaaacaaacaaaaatatttttaaaaagtcatggtactctggactagctcaggatgtaagttcacgggagttcaaatacataaaacatacactcaattttactaaaaataaaatttcctgcttatatacacatacacgcacatacatatacacacatgcacacatacatatatacacatatatataacatatatgacatatattttttgcaaaagtaattgctttgttataaattgatgaatcgatttctttttcaaatggtagaagtgaaagacttttgggcatttcaaatgtatacttttaaaagacattttaatttttttcttttaaatgacacatgggcacatgtaaaatataaacagcatggtacaggtcttcatgagaattagaggaacaaaacatttaaataatatactcttactggtaatttaagcataaaatcctcctgactaaaccaaaatccaatgtctgtgaacgttcgttgaagaaagctggtaggacgtaaaaccaaaaccaagtgcaagttcccagggaaggaagcctgtagaaagaaagaacaaaagaaattggaaaaaaaattgtcaacacacactcaactgagcacatatcagaaaatatgtaactgaaggaaacaaattttaaattcataaaagccagtaaaaggccaacactttacaaatggatattgataaaatctaaaaacatgcaaatagaaaaataatgtaaggctccaggtcagatccttgcaacacttctggtacgaaattttctcacactaaagaagtagatccaaccttatgaagaaatagactctaaatcttattttagagttatttgaactcaaattgcacttatttcctataaaaacaaatagaattaggtggcagtttcctaggataaccctaaaagtcaaagggtttttgtctgtgtatttacactaaacaatgaaagaaaactttattatgggattatatttttattttaatccaatcaatatttactgaacatcttctatgtgtctacttcatgtatttaaatgaatatcaagctctgttaggcattgaatgttcacaaattaagaaaacacaatctctacccaacagttcaactgcagagtccattactaatcagcaattctttaactaaattgataagtaatcaaaggaattagaataatatacaaggggaaatgatagcacaaactctccgagacataggaaggtcaaaaagatcttgaagcataacgaggagttaactggatcagaatgttgttctagttcaccaatgtttccccagcgtctagaacttgctggcacatagtatgcagtcaaaaataactgctacactaaagaattcaaaagacaaagaaggaggacacattgcaaaataagtggagaacggagtaacatatcccaattttaataacaaatcaccacgtactaaatgcttactctgtgcaaagcattttgccaatattatcataaattcttttcataataattctatgaaggagttaggttactcacttttacaaataaagaaagtgagactcagagagtttaaggataccttcccccagctggcaaagccttcatttgcccctaagtctgtgctcttaatcactaaactactccacctcctgaaaaggccctagtcaagagagctagatgaaatgacactgggggacaatgggagatggtgttgggaaaacgggccagaaccacatcagaaaggatcatgggtttttttttcctggaggtaaggggagtctctaaaaggttttgagcatcagaacaacatggtcaaatttgcattttagaaagatcactttggctttgggaagaactggatttgaacaagagtagaagcagacagatgagctaggaggctggtacagtaatccaagccaggaatgatgagtttctgaactaaagtaatgataccaggaataagagtagaatttaggaggcacaatcagcaagacataactacttgatgtacttgccgagaaaggaggtactaggaggatcaaactccagatttggggcttgagtaactggttgaatagtacaaccttcactgagatgggaaacacaagagaaacaggttttaagaagggaaacaagattctgatctccattcatatacacgttaggttggaagggtcagcaggacatccagatgatgtccttcggatagctgtttgtacaattaagaagggaaagaagtctaggctaaaagtggagaatcaggagccatcagcctcaagatggcagattagagcataatagagcaaaatatatgaaaaatgttccaactgcaattatatttcaggcatattacaatactagtaattaaacaaaactataaactaagaataagatactgtggggcaaggagtttatgggaactctctgtacttcctgttaaattttgttgtgaacttaaaactgctctaaaaaaataaagtctattttaaaataaaagaaaaaagtaacttccaccagggtataaaacatagactctttgggaaatgatgctcaaaactggggattttcctaattcaatttgagatggtgataaaacataaaatgttaagtggcaatgagaactagagtaaatgaaagagaaatgagtgtgataagcacaaataagtaaattaaaagagcataaaattaaatcaataaattaaacaatgattatcaatatacataaattgggatggctgtccaactcataattcccccaggaggccatgactgttactctctcccttcatctgagaaacgactcccccttctattattctacacattggttccaaatgagaactcttattttcctacacggccctgcccttccaacacacaatgattaatagtgattagaagtatgattagggccagacatggtgattcatgcctgtaatcccaacaggctaggagaccgaggatggaggatcacttgaggccaggagttccagaacagcttggacaacatagtgagaccccatctctacaaaaaatttaaaaattatccagtcatggtggcatgcgcctatggttccagttactcaggaggctgaggcgggaggatcacttgagcccaggaagttgagcctgcagtgagccatgatggcgacagagcgagacctcatctttttaaaaaagaaaaagaaaaaacataagtatgaacatttgatgtaagcagggccaaagaagtcctgccctagaattttcaaacgaatactgagtgaaggaaactttgaggatgccattcaaaagcagcagattgccaagagccctgctgctggggaaacattgaaaagaataaagttaacatgtatacagaaacagagagagacagagaaacagagagttccaacggtaatgtatatcctaccttctattatgtacgtaatgtatattttattttatgttaagtataatatgtattttccagctggacacggtggctcacacctgtaatcccagcactttgggaagctgaggtgggaggattatttgaggccaggagttcgagaccagcctggccaacatggtgaaaacccgtttctactaaaaatacaaaaaattagccgggtgtgttggcacacgcctgtggtccccgctcctggggaggctgaagcatgagaatcacttgaacccaggaggtggaggctgtggtgatctgagattatgccactgcactccagcctgggcaacagggtgagactctgccgaaaaaaaatatatatatatgttttccagttattacaggaattaaaagaaataatgaatataaaggcacttctaaaatttttattttaggtttgggggtatatgcaaaggttacagagacaaacacgtgtcacagtgggggttgttgtacatattattccttcacctaggtattaagctcagtacccaatagtgatcttttctgctcctctccctcctcccaccctccaccctcaagtagacccgtgtctgttgtttccttctttgtgttcataacttcttatttagctcccacttataagtgagaacatgcagtatttaaggaacttaaacaaatttacaagagaaaaacaaacaaccccattaaaaagtgggccaaggacatgaaaaggcactttttaaactgtaaaaaatattaataagatagttttaaaattttgccttggattctcggacgtcagaacaagcaggtttgggtagaaaactttagggatatggataaaggctagcttaagggaagaatctgacagggacttgtgggaacttttggcctatttttaagtggaaagcacagattctatttttactcccttaattttaggagttaagcctttcctttttcttcacctgggtaaattcccattatattattatactcacctgccttgaacctgtttattttttcacttttaaatgaaattgaaagcaccctacttttgccaacatttaaagcaaaattacttttattctttcatggattctaagttgatctggtttcatctttctctctctgacttcccttaatctcatattctcttgtatctagaattatctggatacaagaacctggggctgacttcaagccaggggtactcacccatctccaaaattatgtgtgagggaggaggggatgggaggatactatgggaatagagagagctatgtagcaactctctgcctgaggtaaggccctgctctctactctgccattcctaggagagcaaggctgtaccagcagccaggtccagagacagctgatcacatagcagggaacaaagtagaaagaaaggagagagaaggaaaatcaccgtctgcaagatgagtggggaagtgattttaagcaggggtaggggtattcagctgctcataagctagggattttatgttggatgtttattaaacctgttattgctctatttaataaagtggattatcccaaacattgacggctatataagttgcttctaaagataattctatatgctaatcagttcattcttaagtaaaaccttctgattatcttagcataccttctcattccttaattccttcaaaatgtttagtaattcacttgtcacaaaaagcccagaaaaacttgggcttttaaagaaaatgcaccatcaaaggatgaaaacttcatttattgactacataataacatttacaatattttttgttatagtttatagtacaattttataatcttttttgcatatcttcctagagcacatggattctgttaacccaatagttactcccaattttagtagccatttgggagactaaataacttgtaggcaatagctacacaactactaagcaatcagagcaatcaggtggcactcaaacaattcatctgatttgtcagttatttttctagaaaactaaatcatatagtttagaccaggtgtgttgttttcatccctcgtgcccacacgtgaataagacatacctgaatttttaatcccactcccattcacttaacccagaccataacaggtgcctaccaaactgtcacacttttaaagtatgacatttatgactacttttcatagcttctctttagcaaaaaaaatacgtatatttatgtatatttatatattcaggacctctcaaagctttaaggtagggaaaggagattggagagttggacaggggtggaaatgtcatttattgaatgcatactactagaattatgcccataaagagcactattatgacattgtgctaagtatttacatgcagtaggttctatttttgtcctcatttcacaactggagaaactgagtgccattatcctcaaagatgtctacatcctaatccctggaacctggtaatatgttatcttatatggtaaaagagactttataaatgtgattaaggatcttgatatggggagattatccgggattatcatggtgggaccgatgtaatcattaggataagagggaggcaggagagtcagagaagaagatgtgatggcagaggtcaaagtgatgcaggggtataaaccaaggaatgtggacgatctctgcaagctagaaaagtcaaagaaacagattcttctctagagactccagaaggaacacagctctgctgacccttgatttttagcccagttgggtaatcttggacttctgacctccagaaccgtaatgatacattttcactgttttaagccactaagtttgtagtaatctattacagcagcaatagggaactaacacattgaggttttgtgaggtcaggcaatttttcaagaccttctagcacataagtagcagaattaaaaccccgcttcacctgcctgttgaactagactcagtcaacaagaggaatttgcagaagttatagcagggatgacacaagaatcaggttggttgagaatctaaacctgagacctaaagcagaggtgacaaacttgaatgcctaccatgtgttagggagataatgtaaatgtgaagtaggcttaattaaagaacagcctaaattaggtggaaaatagcaattcatactcctcctatatgacgaggagcaacaggaagtggtggggaccatggtgaactggagaacattcaaagcagagggcactcataagtcagttcactcataaatcagttccagctacatgttgtcatgtggcaaggtgggcccagcattgccaactctttggtttctcaagagaagacagaaatccagattgtcatgcaaagcccagatgtttaaagatggaaaacaaattgaaagtttgttaaaatgctgcatactctaaacaaaacgcatctgtgcactgacaatttgcaacctctgaaccaaaaagcttcatagatctgaacatcaatcaatatcaataatatggacacgtccttatctgtgattgccggctatgagaatctagaggggacagaacactcttgagcaattttaacctgacaagccatatacatttaagattagtttgtatgtatctatgttgatatacatataagtatatatagagagtactttttctctatataccaatatttgtaacaactaaaattctcaagataatccattttaaagctagtatttaaatgaacaatcaaacagcatagggtatcagatgcacatatcaaagcaaatatagttcaagaccagtgaactttcccattttggtttgggaatattatatttctaaattcttgggtatgctgctttaagaacctctaatctgtatggttatataaacatgaaaaagcacaatttctttttccccaaaataaaaactgagattttgaaagtataattcatttttgagaacttgtcaaaaaagcaaagggatttgggcaaaggttagtcttgttttatttcaatgtgtttttgcttttttaaaaaaatagtttgcacgagagaggaaacagcattggttttaggttctcgcagacatttttctggagttccagcatgtgactgcttaaagacatctcagtaaaagcgaaccagctgcctatcacataggactcggagccatgtgtccaatcactgtacgtggtcccaccccagccctcagcagcagctcttacaggctcttcaaggtaacgagcacaaaataagctccctctcatctttccctcccagagaacagatttactcccttttactcacacgtacttccagattgcctagttctatgatcttacagcagtaacaacaacaataacaacaagagcaggcgtaaaccaaatacatcatttcactaccgaagtctagaaattaaccttgtttaatactcttgtgtgtgctctctaagggaggcaattcatcaccctatgcacacttttcagttattctagttattatttctagaatgtttaaagtaacttataaaacataaaagtttggttacttactataaaaataatttattttcctatagcttttcctatttaatctttagggtaaagaaaggcagtaacaataagagagacccttgactaaaagccattatgtatgtgtcagacttcttatatatatattatcttatttagccttcaaaacattgcagtaaactggatattattccctttttacagaggagcaaactgaagcacagttggtaagcagcggtagtacggcctatctggatcctaagggcaaactctttctagacacttaacacctcatagactgaatgcacactcggatttactgtttgccattcagggatgatttgaccttgatgtttccaaaatgggacaaataacatttgaaacaagttgctggaaacaatttagcatatacagtccaccaaaaggaaagtatcataatttactgtcagacaaatgttgagatgctgacaggcacttgactttcataaggtctgaaccatctctgcagaatatgttgggaaaaaaatctcatgacctcaagctatagagaatagtttgcaacagtatgagccacttccacactcttccccccatatccccaccttaaaaagtacagacagtatgagttgtcaagcaacttgtcaagtgacgtcaggaggatagcccaaagcaatactccttccttgtggtttgcccttttcgtcacatatatatctattctcctcccctctctctcactcagctacagtcattgaaatttctaccaagtaactagttcaaacatttttttggacttcaagtggcattggaccatccttttagatgttacctgtccacagcctccagaatcagcccaattccagagacccttcaaggtgaaaccatttttttactagctaaggttcaaattctttactctggtcaagtcctatccatataaggaaagcatatgtgtcttctactatagttctaggcttcagaattaatccaattaatcccactcatatctgttcctacatatcacttaattcatttatgagaaaaaaaaacacaggaaagaatcaaggaaaggtaacagcaacatatactcttacttaacacccaaacatatgccatctcctgtataaggccttctccaccagccagaatttcttttcaaaatagtcatttacgaacatgtcttaccctttctattagattgagagttccttcagcccagtagccattccatatttacctttgtaacttatgttgtatatatcacagtgctagatatgtctattcagtgagtacccctgtgctgtatttattgtgtgtatattaatgcatgtgtatagacataaaactaagttcagcactgagaatatatatatatataaatatatatataaatatatgtatatatataattaggaactttctgaaagcttaagttaacctttgataacaaaagtgctaatatcagttgcctacaatactgcaaagtacatacacaaacatttcttgtgcaccataaatcgtctgttaaaagtctgaatctatattctcataatataaaaacatgtatagagccaaagatataattttgtcaaaataaagccaactatagtttttaaaatagcagtctgtgctaagagctttattagaaaataaatcatttacacacctattgatgttcactgtcattcaacaataataaaagtcttactttccttatcataattttaattcaaactgtcatttttttcctatggtcaatttttaccttcttatctgtgtgtgtgtgttatctcgatatttttagtgagcaagtttatattttaaaccataacatcaataacattatattaatctttgaaagaaaaagagtggcatttaaagcctttttgatgattagttttttattaaattagctagtgttatttcaacatttctccaaaatacatctaaagatcacattagaaatttgctgggaatttactatatgaataaatgaatgaagggaaaatttaggcaaaagactgcatgaaatgtacctgagaggagagacttccaaattctagtctatattgaaaagtgagttactgtctttttccctaaaagaaaaaagttgtcagcaggtgacaattttgtacctacgaagtttcagtttggagaagaattgaaaccataaggatttcaaatcattacagattttaaatttattcacttatacggtaacacccaggaaaggctgcatttttaagtgatgatggaatcccctccagacctatccatggcaatatactctacttgatcatggtgaaagaaaggatgaatccttttgttagatattgttttaagtcattatttaaagctatgctgtccaatgattcaaaattgttcatacagtcttaaacgaataacatgactaaggtgctcattcataaacctgatgacatttagattttgaaattatattctaccccctcaattgcctgaaaattaccctatgtcaatatcacagtaatcacatcaatgcaatccatgcaaatataagtctccattctctccatctgtccttaaaaaccctactcagcagtttgtgctatagcaccatgctgcagcatcccagcacttgaacttgggaacaggctttccaggagtgcagacagagcccttaccgcattccttctgaacctcatcttgcctctccggggatttgcttctgccatttcgcctgtacgcaattacacttttcttttccaattgtcaacgcaacgttgatgaaatacgagctgcttcttgggtagtatttaaaaacggcagccaaaaatctctatcaaacaaagctgccgtggctgcttccattagcacagtggcagcaatgctggggaggaaaaaaaaaaaaaaaccactatccctgattagtcagctgacagatccttcccttctgctccttgtaattcagagttaacacattcctccaattacttagcctgattgaaccttgtggattagcttgtgctggactgctcaagaagatcaggcatgtcctaagagtggaaggaggaggaaaaaaaaaccagctctcttcctaggagcaggcttgatgggactggctttctcctctgcgcagtttgatttttaaggtggaatgctaagaatctttgtgaaggtagtattaactcatgctttttactctcgtcctaccctggtatgtgacttaaatttcaattctgttttgttttctctgttattgtattctgggtttaagccttgtgaaaggctatagtttgcaaaattttgtcctggtaataatctagaaagaatagaacatgcaaactttctaagacggatacaattctctcccaaattaacctttccccaaaatgtataactaaaataaagtctcctctcattaattatgaaatacaacctaaatgcttttatttgttttgaaatctacaaataaaggtattcaaattgaattgtatgattatttcacagacacttgtttgaaataatacaccacaggcaattatacctagctacacaatggtagatttcactagaaatcctttctgaatgccaacttttgcacttgaaattagcttgcattcaatatttacctttatttcaaacagtaaccaacagttactaatggttgagatgtaattaatgtgctcttgagtatgagtatagaaactataccacaagcaaaaacatttaacatgttaaaaaagaaacacctaaaacaacctatagccagttacatgtggtcagaatctgtacccctcccttgcccagcacgatcaatttggcagttatgaaaataaagggaccctgggatccaagttctttactgagcataggtcaaaattctccactgagaaagcagccctgggaatacagaaagaggagtatcactccccggtagacaagtaattaccctctgttgacttcaaaatgacaggatcatgacctaatcttatatttctcttttatgaaaaatagaacctctgttacaagccacctattttgaataataaaaataaaactctaccaaaaaaactaacgtcaggtgccaaaccagtcacaaaatgaaaattaatttaatcaggcgggtgcagtgttggccaaaagaaaaaaacctgggtgataaaaaatgttctaatgtaacaagtgctttatttagtataagagaagcaattattagcataaaccaaggtctactcagcaagcccaaggaccaatcctaaaagaccggagcaagggaaatagcttttactttatttagccccactgataaggctcaattgtatatggaggacagatctaatctctcaaaagaaattttacctttatctaaataacattgaatgtatttgtctatttgtaagccaattggaaaatgatagaaaccatcaccaactggaattcttgacatttcaattcttgctctggcttttttggttacttggctatttgagcttggattcatcacatagccattccaaagtataaatatcaatgtgatttcatcatctataagacaattatagtgatacctacttgcagtacttaatcaggaaatgaagagaatcaacaatacttaataaatgtgaatgcttttgaaaaagcactaatatgctatagaaagtcaaattttcttctattttattttagtaatttgagtatatctaatgttaactcttctctccactgctaatgattaaacacctctgttaaataaacaggaaaccactttttgcttatttgtccaaagtgaggaataattcattctgagtattaaaagaataatgatcttacccattttaccttgcaagtgctagaacattggcttggaagtccaacaacctagatttttgttttgcctttgcaactaaatcaagttcttgtggtgggcgtgacctcctcaatcagtcaggagacaaagtaagaatttcagatggctggcaatgttggaatctcaaagaaaaaaaatatattgattcccagctattctagtctgatagaggaagttggccacatggcacttccacagagagcccatatcttgccagctcagaaggagtctgggggtccctcatctccctcctcgtctatgaaagtgaagtgtcaaacaattttgtgatacccttgtgagcctaaaagtgtaaaagattatcttggtcatgggcagaattgtacctctcgttattttaattagagaaaatgtttctctctctgggtcttgggaacctggggactagataccagtagggaagttatatatcattttatatgtgactcatctccctaccctatcctagggtaaaacaaatctagaaagttgtacactgaaatgttaaaaactgcttattttggggtggttggattactattgttttaaactttcttctttatactttttcacatacgagtatgcaacacagctatttccaccaaaataaataaataaataaataattttaaaaagcttccataaaaacttgccttgtcctgaaaggcacatagaaccatgaatctcttctcactcataactggagccacaaactactcactcattcttactaggttttattttgggtagagttatttatctcagtctctgctacaacctctccttctactttccctcctcacattccatcaatttttattgtctccgtcagtaccaaagtaatctatacctcccaaaacagaaagtataatataaaacaaaaataaaaagttactgtataatgcatagatacttaccgagattttttggagagagattttgagagaagaccatgtatccaatcttcgatccagaataatggtaaaccgggagtctgatccattttgcctgaacgataagaagaaataagaactttttcttaataataatgcaaatttgttatatatgccttcattctatttctgattatttcatctacatttgatgtcttgactgaagacagatttggaattggaaagctatcacaaagtcctatcttagaaaactaatctgaatacatattcccttactcactatttaaaatttcttttgcagcattaatgtcaatcttttaaataggaaagtgatagtgtaatgaagataggtcactaaaattgatttagaatactgtaatcttgggtgtgggaaaactcaaaagataagtgtccttcatgatatcagatttaactttccatgcaatccatcatgagtcaatgatccattcactcattcaaaatcacactgctaaatctatttttctaactctagtctgctcctgaggaaatgcagtttaatggaaaatataacttctatttgccctaaaaatatcactttcaagcttcaataggtacattgtaagtttcattttctgagatttgatttttgttcatgagactttgaattttatcatcctagatttgtgtcctcttgttcttcagggttagtaactagaaaattcttcctttgaaaattttgtctttaacacacataaaatctctaagaaacctttttaaactttccattttaaagcattctagttccaaataatttttaatttcaagacattcctcctagtatctcccagtaccactattgaatctacttaagattcagtcttcttgtgttatattcagaagaaatgaaaaatggctgtactcactcttggctggtaatatttccttttaagcaaattaaagcatatatgtatgaccatcgttctcaacctatgttctttttgatgggaacaaatactcctagatccccaattttattttcatagattctcaggataatttttgtaacaatttaggtagctgccagcttctccttctaagttgtacttcttatctactctgaagttaagtcagttggttattcaccatgataataatagctatattaagccattttcatgttatgacattcagatggatatctgatataaagcgaattgaaaaaaatgtaatgaaatactataccttgcaatagatgtcaggtaagtaagtacttttgctattacttcctctggtatacatctaaaattacagttttctggaaacgtaatgatccaagcattgtcctttccccggccacctacaacaatagaaaaataatcaactgaattaaaaatgtatataacaacgaagcaagaagaggattttagatttgaatactgttttgcagcaacacaacttttttgcaaagatgatgatctccacataaaaccaaaatggctccaagttcctgacactttaagtttaaaaggtggcagagtagtttctcaataaaaaaagaaaaagaaagagagtaaaatgaatgaatatagtcagaagaaaatgtcatgaaatgcatataataaatacagtggaaaatagctgattccccaatctggacaaccaaggggttgggaaataactgtttctataccaatgagcctaaatttaaaatgagtgaatgatggcttgacagcaagtggaaaatttgatataatcgatctcttagtgtcatggtgagcaggaaaagatacagagcaccctataggaaataggtgatggtctaatgtgtttatggaagaaacaacaaaaggaatgatggcaggaatgacataggaattttattaatgcaaagaaagatcacaaattatctgtgggtcaaaattcaatgttcagcctgggtaggggtccaggcagaggtgtagggttgtggaagctccccgcagacccatgcagccattaacctggagcagttgcatccagcagtatcttgaccaagtgggtgaccttgactcctggaaagcatggatcccagtgctcataggtgaggctgccctaagcccatttccataggaaccaggaataatggtaactgtcataggggttcttggtgagggaatgattgcaccagctctgggctttcattttggtttctacccgtttctccacccagcccaatagccctctatgcagcctgaaggatgagaaatattgaaaacgaaagccacttaagtgcagagatgagccttacatgtgtttaaggttcacatctgcagccagcctagcacctacacagagagcgaatgctcaataaatactaagtgccaaatagaatctgaagaattattttaggaggaaagttgcaaggtggcctttgaaattagctcagcaatagaaatttttttagttcagttgtaatttttatttggctgaatttaagtgaataaagatgtaaaaatatttttaattcaatctgcaataaaaatatgacaatagaaaaggatacaggccgggcacagtggttcatgcctgtaaccccagcactttgggaggccgaagccagaggatcacttgaggtcaggagtacaagaccagcctggccaacatgttgaaaccctgtctctaccaaaaatacaaaaattagccgggtgtggtggtgcacgcctgtaatcccagctactccggaggttgaggcaggagaatcgcttgaacctgggaggcaaaggttgcggtgagccaagatcatgccactacactccagcctggacaacagagcaagaccccgtctctccacgccccccccaaaaagaaagaaaaagaaaaggatataaaatggaatcacaacaatactcaacgcaaaagaagacagaaatggaggaaaacaaagaacacatgggacaaatgggaaaagctaccatctcactatttgtattttgcttattatatgatagtaagatggtagatttaaatccatccatatgaataatcacataaaatgtcaatgatctaggcactgcaattaaaagtcaaagatcatcaaactggataaaaagaaagactgaattatatgctgcccacaagaaacacacattttaaatataaaagtacaaattattaaaagcaaaggatagaaaaagatataccatgacagtgctaatcaaaacaaagctgtctaatatttgacaaagtagatttcagagtcgaaaatattaccagatattaaaatgatcatttgatcatgataaagtggtcgattcatcaatgggacataatcttaaatgcttatgcacctaataacagagcttcaaaatacacaaagcaaaaactgatagagtggcaagaggaaatagacaaattcacaattttagtcagatatttcaccacccatctctcaataattgatagaacaagtagacaaagaatttgcaaggatattgtatacctgaacaacagtctcaaccaacatgacctaattgacatttctagaacactccatccaacaaaagcagaatacactttcttctctagtgcacatggaaaaagatcaaattaattatttgcctcaatatttaccaagggaaacttgagagacagtattcattcccaaattattttttaatcaaactagtccaaagtattaaatcaaagggttattaatcttcactgtatgatattccagaattagagtagagtgaaaataatcactgagaataatggcatccactgaagagtttttaaaaaactcaaaggagaaactgtacaattctgaaccaagagatttagtgaatctttaagcaaagggcctctatagatacagtatggtatagaactagtaatataaatgatatgtaatatataatgtaataaatatcttaaatataactacatacttgccaagcaagctggtgagcactctagttaaggacagaaccatctagcacttaggcaaactacacttatcaaaggaaaggtggcaaggctcctataagagtaaattatcattgactaatctataaatgattattaccactgaacacctacaagtactgtcctacgagtaaactttatgagaagagatcaaaagagatatttacattccaaatcaggaagttttaattattttttaccattgggaaccctttcttcaaaggaagctataggtagaagcatttttaaaacaaatacaaaaagcagttaaggaaggaaaggtgtagagaggggtctggatgggtgcagcaagccctgaggatggttctatttagaacacggtttggaaaacacagataatcttaagtaaaatctccaaaacttaaaagtgaacgtaacatactgctaaatttactgacactcacacatttctgccacttataaaataaaacataaagccatattaattaagtcatcattaattcacagttaccactaattagaatcatttttaattaagctttatcataggtataattataatcatttaaaagcagaggccaggctgggtgcgacggctcatgcctgtaatcacagcactttgagaagccaggataggaggatcgcttgaggccaggagttcaagaccagcctaggcaacatagcaaaacccttttgctacaaaaatataaaaattagctaggcgtggtggcacactcctatagttccagtgactcaggaggctgaggtggaaggatcacttgaaccaaggagtttaaggttacattgagctatgatcgtaccactgtactggagcctggacaaaagagcaagaagttgtctttaaaaataataataatgataataaaagcagaggccagattgaagtgtctaattaggatcacttataaagtaaaagcttgtttagtaaactgagcatgtgagtgccatttttcagagaattaattaaactatttagaaggaataagatagtttcttgtactcctaagaagcattcgtctttataaaaacaatgtattaatatataccagtaagttttctttatctgtttaatatgctaaatgtaatatttaatgatataattcaaattactctaatacctgaaagtaatttgcttgtttttaagcaaaactttccccaaagtctgaccagaagctaaaggggcaggatggtttaccatagttacgtctctaaaaatgggtaatgctatttagcggcattattcacaatagccaaacggtagaagcaaccaaagtatctatcaatggatgaacagataaacaaagtgtggaatatacataaaatggattattattcagccttaaaaaggaagttctgacacatgctacaacatcgatgaaacttgaagaccttatgctaagtgaaataagccagtcacaaaaagacacataccttatgattcatttacatcaggtacctaagatagtcaaattcatagagaaagaaagtaaaattgcggttgacaggggctagagagaggaaggaatgaaacggggagtaattgtttaatggatatagagtttcaattttgcaagacctgaaactccggagatggtggtggcaatggtggcacaaaaatgtaaacgtacttaatgccgctgaactgtactcttcaaaatggttaaaatgataagttgtatgttaaatttattttaccataattactaaaaattatatacaagtgtatatacatctttgagaaaaatcaactttctttataatgtgtaaatgaaatcctaaaaaaaaatacttagtgcatgctgattatttagtgcaacttgccaccatttgtaatacacatttgagtaatcaaagaagctacctcagctgctcccctcccacccagcctgcaaccacctaggagacatattctactttcaactatcatagatttctgaagactcgtctgaaagtcaaatgtataagagtggtaaggtcggttttactcatatatctaaaatgcttaaaacctccaattattctctaaatgtccatttgtttagcaactaggtgcacaatgtacaaatgtttattgaaatagtgcttctcaaatgaatatatataatagctctatatatagagagcgagctatttatataataggtaccaaactaactgctaatcaagtcatatatctatctggactatatataagaaagtttgcttaccagacaagaaggcgatgtcttgcattaagaaatgactgatgtcctttatacggaggagcagatcggtttctatgacaaacgaaaatagaagaaatgacatacatgttaaggtacagccttacatgattttagacacatgatttctcactgtgtctaaaattattctgggagccccacaggtctgtgtccacagacactgtcgatctctttcctcctctcaactacatggcaaagaaatcacactcgaaaatatcactgaataagtagaaccagtgacctacttctcagaatctatgcccaaaacataaactactctcactcaccagaaagccaaggacaaaggcacaaactccaggacattcggatttatttgaagggtagatggtcatggggagacactgtagcagattgtcttctacttctgataatgcctttcactctacaaagctttattagcaattacaaagtgctttttggattttttaatcttattgaatccttaaaaaatctctaaggtaggtactgttatcccattttacaagtggttaaccatataggcttcttagtctagatagacgtggattcaaatccagcttgttgcatttactggccatgcaaacgcgggcaagttagttagcctctctaaaccttagtttcctcagctataaactgggcataatgatatctacctcacaaggtaccatgcaaactaaatgtgaaatacctggcataatggtaagtgttcaataaaaagtagcatattaactcattttttatcattacagatggaacaatgtccatgcattgttcaatgtgctttgattgtcccagatcttaagtgttaacttacaatgttcaattctagtgaactctataggggccaaaaatcaaagtacactacctgcctctggtccatgaacaaggaaaactttttaaaagaaaacgggtcatcaaactaggctattttggcttgtc

SEQ ID NO: 446 - DNA, 196212 bp, Homo sapiens
ttttcaacagctgtgggaaaaactaaaacacagaaatactgtacagtattagtgtttttttaaagaaattgttagtgcattattgagtatactaaatatctgtgattaaataaattagttctaacttttgattttgggagcccaaaataaagggagtgttgttttcatggttatgccttgtttgtggagtcaagtgttgatatacttgaggcatgttatgtgtcttctaattaatatttttatcaccttgaatttgtgtctcttccaagcattaaagatactatggatcttaaattccttattaaaaaaatgcaagtgtgaatactttgtttagcttacattttaatttattgtggttgaccacattttatggctcctgagtgccttcacccagctacactttaccttgtatctataaaagtgtaatttagagtaaatacattggctgtaaagtcgcgatcaggtgctctccaccaaaagcaaaacaaaactgctgaaatgtggcaaggtttctcagtgcaagcttaaatgtttaaactgttgaccatttggaaaatactggacaaaggggaaggacaaaacatcatttgcaatagttaaaggttatgcaaggcaaggcaacattatactttttgactaagttattaaaagttaaatgcatttcttctttgaagtgtggattataaaagccaatcaaagacaaaaccagtttgaaaaaccttttgtattctacaataccttttatgagtaagagtaaaacatacatttcttatttgtaattttatttaaggagaaatactctttccctttgatacgactataatattataaacagcaaggaatatgttctgctttctgcaattttagaaagtcattccattctgggtgacagaatgaggtaagactgtctctttaaaaaaaaaaacaactcacacctgtaatcctagcactctggccaccgaggcaggtggattgcttgagcccaggagtttgagactagcctggcaacaaagtgagattccccctcctctctctgaaaagtaaaaaaaattagccggtcatggtggcacatgcctgtggtcccagctaaatgaaaatctgaagcaggtggatctcttgagcccaggagctcaaggttgcagtgagccatgttcgcgccaccacactccagcttgtgcaacagagaccctgtctcaaaaaaaagtcatctgtgtgtttcttgcaggcacatctatggcaatgcttgtaccatgaatttaaaacttctaacttgatggcacttttttattttttttgagacaagagtctcactctttcgcccaggctgtagtgcagtagtgtgttctcggctcactgcagcctctgcctcccgggttcaatatgaggcagccctcctgagtagctggaattacaggcacgtgccaccaggttaggctagctagtggcctagctagtctcgaaatcctgacctaaagtgatccacccacctcagcctcccaaagtgtgtggattacttgtgtaagccacagtgcccggccttacctgctttaaaaaacaaaaaaacttaggttttcttggagtctgtgctagttgaatcttgcaaatgcaaaccacatacgctctttaatgaaaacctttccatgcacaccactgttaggaagagcatcattaaatcactgacttctacacccataaaaggatgattttgagtttcaagattttagatttactagagatagcatgtatctatcaatcatgtcacacaaaaaatatttccaaagtgttctctgttcagaaacgtcacaaatgcttctgtttgtcagatcattttgcaacaggttaactaatacttatctacataaaaacctgaaaattggcacaggcaggcattttgaattagtagattacccccatggaacagtattcagaattattttgtcttgtgggctctgaggctctgggaggtagaggtggaccctgacagtccaggtcattaacatccacattcagttgatgcctctcagacacagtccagtactggataccatttatcattctgcaaaatgttgtctacatctttcaggtgctggtcattcttagattagcttcttagctgttctgttgataaacagaagacttcaattttcaggatggatgattccaacatcttccacaagctttcactttcactaaattattttgttataaatttgatctccttcaaaagtgccttgaagtcaattttggttgtaatgtatttgtctctgacgtattcttcaaattctctttgttttttttcctgtcattggagaactgcacccagaatcttatttttactacttccatgtgaatgttaaggtactcacagaggtttcatccagaagtcttccctcttctttctggtaagtgcttcaatgtgctcattaagcttctctttctcttcccttttcaacaaagatctagattcccagtggtgatctttttgatgagttctctatcaaactatgacacatctgaagaacgtacctgaacaaccctcagggataatgcaggatttttcgagaaagttccagggtatctcctggtgtcagtatactttcagtcctacacctcaagagttttttaataacagctttattgagatacaattcataccttacatttaaaatgtacagttcagtggatttgaatatattcaagagttgtgcagcctacaccacaagctaactgtaggatattttcatcaccctgaaaaggaaccctacacccattagcagttactccattccatctacagccagcctaggcaaccactaatctttctgcctattctggacatttcgtatgaatggaatcatcatgtgatcttttgtgaccggcttctttcacttaacgttttcaaggtttatccatgtttagtatatataagtccttcgtttctttttagtgccaaataatggctatgggcatggggtagaagtgctaactcatacagcagctgtttcatcttttgaggaactgaccgtctgttttctgaagtggctacaccattttacattcccaccagcaatgtatgagggttctgtaatttctgtacatcttcaccaagacttattattatttctctttttaattacagccattctagtgaatgtgaatctcagggttgttttttttttttttttttagagactgtctcactctgtcacccaggctgaagtgcagtggcacgacctcagctcactgcaacctccacttcctgggttcaagtgattctcctgcctcagcctcccaagtagctgggactacaggcaatgcaccaccacaccaagctaatttttgtatttttagtagagatgaggtttcaccatgctggccaggctggtcttgaactcctgacctcaagtgatccacctaccacagcctcctaaagtactgggattacaagcatgagccactacacccgacctcatagtagttttgatttacacttccctaatgattgtgtccagcatctactggccatttgttagtggtttttttcttcttttaagaactgctgagacatccataaacattttcaaaatgcagggtatgtttttcagtgttaaggcaactgttctgatgtgtttttcctttgctctctatcaccaaatactgtacatataaatagtaagactgggctttgtgttgtccattgttaatcctaaatgcaacaaaacacatggagactttgaaaatccttcagaataatgctatagttaagattttgctaaagcaagtgttttttctaactccttgagctgcatattgccttgagtaatcatcatccggattgtatcctgtagaataaagtgaaatctggttatagttttacctggttaaacaaggtatagctataccattttatctgttaaaatcaagaaccaatactacctattggaactgctgccttttagaaaagctaaaagagttccacatacatacatataaaatgtacaacataaaagtcaagtgatgatgctgaagagtgtagatactcttttatctacatattttaaaatactaaattttaaaataataatttaaaatcggtaacattacaagcaatgatcaagatataccagctcagtggcactatattccaagatgtctgctaaacttaaaaaaaaaaattcactgatcaataaaaagggttaggatctgtcctcaccatgattttgttctcacctcttcggtggcacttttgtttcttctgaattcttctcttgcccaatctttcaggtatttgcgatcagaatcatttggaacttgccgaattgtttgcaaaatccttctgtagaggagaagaacttgttgccttcttacgaactgtaaaagggaggagtaaatagcaattactactgcacaatcgccagcctggaaagttctacttcagcaaaccaagctgtaaccagagtacttctcgttggtcaattttgaaaaaggcaaagaaaaacttttttttttctttttttggccagatgcagtggctcaggcctgtaatcccagcactttgggaggccaagatgggaggatcacttgagcccaggaggtctaagctgaggtaagccttcattgcgctactgcactcagcctgggcgagagtgaggccctgtctcaaaaagatgttttaaagaaagcatcacgaggttcatctgatctttttgcttactgctctgtcaaacctaagaaccattaaaaaatcaggagctgcctaccgggctgaaaagggctgccggtctcctagaagttgttattacaacgacagcactttttctaaattaacagttgttcaaatctttggtaatctcatttgctgtttgccacagctcagtgcaatagacttttaccgtgggcactgggcagctgaggcaccgggactcagggaaatcaagcgcctgacgctgtctcacgcgatcgcaccaaaccaaggaagcagccagtgcctcccgtcaggccccgcggagcgaagcaccgccccgcaggcatcgggccaatctcagagggcgcgcacgccgcatcaggaccccggaacccgccccgttggggatagggacagatggagaatccagctcagacccaggtaagctgctttggaaggcagagaaccgccggtacctgctttaacgttagcgtcgctgggggtaagcgggaagcagccatgtccaccagaggtccgccggagcctcagcgcgcaggagcggaagtggggttcgaccaaggggtgtggcgagcccggtttcctaggagacggcccgcgggttgctctcggactgagagcgcgaggcttcgggactgagccctagctgctgcgctggccgaagttttctcgtcggtaaaataggataacagtgcaccatagggtcgttttgataaagaagaaaggtagggcacttaacacagttcctggtaaagagagttcaaatgaaagtgaaggaggccgggcgcggtggctctcacctgcagtcccaagcactctgggaggcctgtaaggtgcctgtaatcccagctcctcgggatgctgaggcaggagaatcgcttgaacccgagaagtgaaggttgcagtgatccgagatcgcaccactgcactccatcctgggcgacagagcgagaccctgtctcgaaaaaaaagttaaggtttttttgggggaaagaggtgaaaacgtatttaaatgttctttcgagcctttaaaaatgtgtatagttgaaaatactaaaattgaaagtgttaatttcttttacagtttgtgttggttttttctctttctcgtttttgtcctgttcttttgtagcgcaaaggttttccgggagcggtggccttcatgatcatttgaaacaaagctttgaatggctcacccacttcagtcttaagcacttttcatcactaataacgaggagcctaacatccctaagcctcaggcttttgcttttatttccttatagttgttttatctttcccacaatacacatgcctttgggttaaatcactagaagtggagttagcgaatctttgccatattaattttccaagtggtgttgtatcgaattaaaatagaacgaaaaatgttcaattactagtttactggggacttgcttgcctcgcctgttagcatcctggggctccctattcctagctgtgttctggctatttcccctctcctggcctattacctcccctgtaaagtgaaatatagcatctacctcagttgtgtatctctaatgtactgagaacaggtcctggcacatgtaagaactctaatcattagctcttttgaactttaccaggcattgtatgaatgatgctaactgcatgatcatattatcaataatatatgccaaattttgtctaatacattagctgtaatagttaattgctaactttttaaaaggagtgaagttaaatacccctcgccatttttagttatactgtttttgtgaattgttcatgacttgggtccgtttatgatgaggacatttatatgggctctatattttttgtcatttctttatacatacagaaactttatacaatcatgtatttttgtgccttttgaggcttttcatttcccattcaggcctttgtaattcgttttttaaaaactttaatttttaaaatatttactccatctagaatttactttggtttacagcatcacgtggatctaagttcttttctagatgttaagctgtatcaataccattgattacataactcattcctttttcggggctttatgatggatgcctttttgactgtatgataaattcttttagggtctgagtaatctgtccagaattgtttcatttagggttaagtttttactttttgttttatatgtttttattatctggcaggactctagtttcttgtaaaaaatccattagtactgttctctataatctttagaaatgttttgtatcatttccctccaaatcatcttgtgatcttggttggaattttgaagtagtgttgaatctatacattaatatgtgagaaagacatttttacattatttcttcttcccatcaagaaacactcaggccaggtgcggtggctcatgcctataatcccaacactttgggataccgaggtggatcacctgaggtcaggagttcgagaccagcctggccaacatggtgaaacctcgtctctactaaaatacaaaaaattagccgggcctggtggcgcacgcctgtggtcccagctacttgggaggctcaggcaggagaatcgcttgaacctgggagacggaggttgcagtgagccgagattgcgccattgcactccagcctgggcaacaagagcaaagctctatttaaaaaaaaaaaaaaaaaaaaaaaagggctcactcttgctagacactggtaatgctgtcgtgagtcacatatgctccttgctcaaagactcatgctttgggcaggaaaacctctaagttcaatatagtgctaacaaagaatgctgcagttcatactgtgggaaattattcttcctggagggcttgtctgagctaggtatttgtcagaaacgcagaatcactaagaggattccagacaacacatggaaacactggcaggaatgctgggagaggagggacaggagagtcaagcaagagcctcacaggtcacatgaagaagcttgaatattaccctcttcacaagggagagctttgaagggattttcagctacagaacttttagaaagatcttggatgttgtgaataggatgaagtgaagcaagcaaagagaagttactggcctggccaggataccattgaagtagtccctgctagagattaaaagagtcccagtcacagtgcagtagggggagggggagggatgggacaggatatccagaagcctgactggacaagatgattaattaatttgattggggtatggatagagatggagaaggaagtaaagcagatgtataggttaagtcccaagtttgtaaacagggtggctgttggagtggtcatcccagatggggaatgttgaaggaatgggtttggaataggggaattagaacacagtgacatccagcagatgtctgaatataattaagaataccaaagagtagatttcctggacccctggatggagaattttacagtccttttgcttcagtgatggtggaggccacgggagtggtgaagaagttatccaaagtgagattttattgttgttgttgagatagagtcttgctctgttgcccaggctggagtgcagtggcacaatctcagttcactgcaacctccacctcctggttcaagcagttctcctgcctcagcctcccaagtagcttgggattacaggtgcgcgtcaccacacccagctaattttctgtatttttagtagagatggggtttcaccatatgggccagcctggtctcaaactaactcctaaccttaagtgatccacccaccttggcctcccaaagtgctgggattataggcgtgagccactgcacccagccccaaagtgagatttttaagacagcatggaggacttttgtgttctgctgtccattccttaaatatcagaacttacttacttacctatttggccaaggcctggggggttgggggaggggggggtgggcaggatagcacaaatgtcaactatcaacatggcagattaattgatcactactcctgcaagcccctgttggcagcacaagttgaaaatggcactcttgggttcctgcttcctggaattcctactgtccatgatctcatgagctaacccagggccaagggaatcactctgggcacaccagtttgaggtctaagaaagatggagcttccaaaggcagatgtaatagactgcagcattgtcataatattggtgtctttccctcccagactcaaccctactggaagattaaactccctgccccatagagggctttagccaatgaaatgtgagtgggatgcaacatcatcatttatggaggataattaatttttataagcctccttataaggctacaccaactcatccttttcattctgctgcaaagccagcatattatagctcagcctaccatggacataaatgcaaatgataacctttgtagtaagagcaacatggaagtaggaggggatcatgttagcacagcatcaactagtaacagctgactgactgatccagcagagaagatcagtcccctagcataccttttacaatcctgtcatcttccattaagaagagtcacaaattacatcaacaacagtggtatatgttttaatagttttcagaatataagctgcatagctttttagaataaaaaatgatataacttcaggtacatgctttgggacacttggttaaacaaggaatctgtgtctttgatgaccacctcaaaagggtcgcagacttcacagtgtaacttggaaacagacaaggagatagatgattacatcatgacatactgcctacaaaagaacattctgacagaacattaagtagaacagagcacacagtttcaagtattcagcactgctttctggccaagtaaaaactgcctaaagatcagtttctttcgactggaaaaaatagatggagctgctgagttctggacacagcgtttctttcccagaatgagactggctcagtccagcttgaaagcagtgtgaggaatcactcttccccttgactgttaagaaaaaaaaaaatgaactaaacaaataaattactacaacaacagggaccatggcactgaatgaaataaaggggcaatcaccttcccatcattgcatagtctcccgaagcagcaagtgtgaaagaggatactgaaaagccacttcatttttacacagcccaaggatcgtttttatagatgacctgggcacctataatgtccagttgctttatgagaacacacacacaccacattcttcctaccctctaagagaaggtagttcctttcacaataagaaaacacaccctcatactctccagaaacgagctgtcttggccacttgacagcttttgggcacacactatgggcttggcaaggcagagcttagaacagggtcaaaagggcagctccctttagtcctttatacaaaggactgtcagagtcccatgctcctggcagcatctcctcaaggcacaggtgcccagatcccctgcaaaagaaaacaggcagctgggctccaacggtggggtatgacctcctcccaggccagggcttccaaggcagggaagaaggataactcttctctagttacgagttcaggcacctgctgctgcttccaggtttggtataaaaacctcagcccaggcaaagccgggagccagagagcattctgtaggctgtaagatcacgttgtaaaataaaaatattacaataaaattttttgtagttgtccaaaagggagcacctgggtaagcaatgtgaccttctgaccacagttaagtctcactttggactcttctttctgttctatgggtggtcagaggctgtcaccaactcaaaccactgtctgagggcatcgctgagtgtctcaggaagtgcgtttacatctcgaagaatgatatagtatgggaatgggaactcttccatgtaggatcggatttcaggcatctctccaggtcctttaaatatcggtactttaatgtccaagatagaatcctgtcaacaaaagacattttgaaatggggaggcagcgattaaaccagcatccttagctagctcttctgtgatctcttttgctaacttttacatctcctgtgtcttattcctgcatatgaacctaccttttattactaagtaaaagagaattttcagaactctactaagaaggaggtagatgtctttctgagtgccccttccaggaggatggacactgaaaaaaaggaaaagggatagacaggaaaatctgctttccctacagtggtgtctccccatcatccacttggaatcattcacactaaatctttaccttcctatcaaggccttaatgtgacccacagagacaatgcttccctggaacagaactgccctataggcatatttcactaagatgattgatgcttcttgctgtgaggagctactgagacataagttaagtgtggcaacacctaatctccatttcaaagtggtcagtacccattatcaaggctgcaatacctgcactgactttgcatagagggaaatgatgacccacagaggatggtcattctgaatcttggctctcccactcattacctataacctctatgtgtttcagttccttcagtgtaaagtgggaataatgatccctacctcactggcttattgcaaagattaatagagaaaatacttacaagtgcctacaatggtacttgacagaatactatgaatgctgggagttctcagtatgactgagtgatccaggccatatttcagattgaacaggttgaagggaatccccactttacctccagaaaaggtggcttttagtagtcactcacccgtgaactgggattgtccaatacaacaaagatgacaaagatatttgcattccgggcagcctgaactgctgccaggactctttctttgccctcaaggaaaaggcctcgcccatcagagactaccaggaggagttgtgcagtttctgtagaccatataagacgaagcaagggaataaaatgaacagccatttttaataactcacaactacccaaagtaggacaaattagtgtaggctttctctgtactattaaagctaaacagacctctaaagctgatgaattctgggcacaaacctaagggacctctgatgagatctatcccttagaatgcttgagtcagagacaaggcataataagggatactaagtaagcttctgtcagtatagaagaatttctcaatagtgcttcaagaaatgttaagttctgctcaacttcaaattgtagagcaacatactgtacatgagaattaaaacactagtttatggctataaactttaaaaatgatagtactgagaagggcattagaagaaagtggccaaatcagaaatctggaactgtgtcttccaaatttcagtcgttacatataatcatctttagatttctgttaattccttgtacctaatttctatatttttttgcccttgaaatttgacttgtttaaacaaaaacaaatagaaaggaaacactcaacactgaataaaatgttttaaaatttttgctacatagtgtttccagctaaagattatatagtacatgagttgagggtgggctgttttagcaaatgttgacaggtgtgaataacttgcttccatcaaaatctgaagcttctgcatgatacactgagaacagtgagagatttttggaaaagaactaaataattggcatgtttcaagcccccaaagtaaatgtggttggattagctggtttttatattatgtccttctctactttcctctgttattaaaatattagagaatacagtacttgcagggggctggtttcaggacacacaccccctcacccccagtataccagaatacacacatattcaagtccagagatggccctggagaacccgcatacatgaaaagttggccctccatatactcgggttttgcatccctcaaatgctgaattttcaatccacttttggttggaaaaactccatgtgtaagtagacctgatctgtacagacaaacctgtggtattcaagggttaattgtagcctttatatttaattccacacacaccttgctcctttctcttataaatctgaactcaagtaagtatatactagttagtgtctagatcccccattgattataagcctcatgagtacaggttcaacaaaaatttctgaatgaatgaataaataagtaaaaatcagctccatcaatttatgtcttttcctgtggagcatacctattaaaacacagtgacggggacactgagctgaagcaagcagcttgggaatatagagtacaagaaagcattttgttaatgaagaggaaggcatgcagctcacctgaactgatgttctgcgagagctgctgagcagctgcaaacatgttggcaacagactctagaaactaaaccggaaccaggaatagacaattagaaaactatgtgaatgctcttctcattgtcaaagagactgatagtatttctgacattgaagtgattatcagataaccacctcaggtttacagaccatcaactaactgtcccttctggccgtatgtagttaaaaaaggaggatccttggatacagacattctgttttttaattattattttttgagagagggtctcactgtgtcacccaggctggagtgtagtggcacgatctcatctcactgcagcctcgattcctgggctctgcctcagcctgccgccaagtaactagcactacaggtatgtgccaccacacctggataattatttttgtcttttgtagaaatgaggtctcactatgttgacaaggctggttttgaacacctggcctcaagcggtcctcacacctcaacctcccaaagtgctgggattacaagtgtgagccaccatgcctagatgatacaggcattctcaagcacaggtgagacgtttctctaacatataacccactagagttctggaagataccccaaaggaaaagaagtgcttccctggggcataagaaatcaatactccctcaaataaaccaaacagctgtcttctttcaagaacagaaaacaactgagcaaaagagaaggcaagaaaatacaaaatgtccagggcagcctagaaaaagcaaactgaatcagagcaggacccaggagaaatatgatcccatgctgttttgaacttttgttctcttaagtaagtcactggctttacttcatatcatttcttctctaagcttaatgagggagaaaaataggtcttggcccagctgataagggtatgggagatgggtttgtttttgcagaatgttccaaactactcggaaaaaaaagtagggagctagaaaaccaatgatgcaaagtcaagtgatccttgaggaactgagaaaaagaagtcacaccttgttttataatggatgctaaggaagcttctattccagtggtacacaggctgaggtttgggactatccctgtcctaatactgtatgcggtggagggtggttctcagcccagcatggtggtaatcccaacacttcgggaggccaagaagggaggatcacttgaacccaggaattttagaccagcctgggcaacaaagtgagaccctgtccctacaaaaaataaaaattagccagacatggtagcatgcgcctgtagtcctagctactagggaggctgaggcaggaggactgcttgagcccgggagttcgaagctatagtgagctatgatggcgccattgtactctagcctgggtgacagaacaaggtcctgtctcaaaaataaaaatgttctccctccaacctacaccagtttaaaaataactgtgcagaagacattttatttcatcctcttacctgagcaatcttggttttcttttgttggaatttgcagagacgtagaatctgggacccagagtaatcactgaactgctcatgaaatgggtgtaacagctttacagattctccaaaacttgggggaggaaaaccaaatacaacaggagttattttttggctgtgtgatcaaaataaccaaacaggttgtgaaaagttttcataaaggaattacaaagcaaccttacctacacactgcaatctgacccacttccaggagggttagagcatttccaatcacagccaaagattcaaatgcaagctgtgaattagaaagttaatgattttaggaatcagaatatcctctaaaccagagcctctcaactattttttgcatcaagattcccaaagaaaacatttttttgtttggcaagtagaggaataacatcagtaaggctactatagtcacaacaaacccaaaggctttggtggcctggtaccacaaatgttgaaacctagaatccattacactgataggaatggtctgctgtagacatcgaataaaaagtgaccttgagggccaggcgtggtagctcacacctgtaatcccagcactttgggaggccaaggagggaggatcacttgagtccaggaattcaagagtagcccaggcaacacagcaagaccccacatctgtggtcccagctacttgggaggctgaggtaggaggatcacctgagcccaggaaagttgaggctacagtgagccacctgggcaacagagtgaaaccctgtaaccctgtcttcaaaaaaaaaaaaaaaaacaatttagccgggcatggtgacacacacctatggtcccagctactcaggaggctgaagtgggaggactgtactgcttaagcccagaaggttgaggccacagtgagctatgatcatgccactgcactccagcctaagcaacagagcaagaccctgtctttaaaaaaaaaaaaaaaaagaaagaaagtgaccttgagaaatatggtccatgaatttttctttcttcttttttggacctacatgaagagtaacctcttgtaggtaaaaaattttaaaaaccaatttaaaatccattcatatatatgtagtcagatcagactgtagaactatatcagaaaatttcattaccatttgcaatatgacaaaagcagcagcaaactgagtgttctacatctattatttcatttaatcttcataacaattctgcaagtatgaggttattactattctatgtgtgcttgtaaatatatatattcctcacttttcagaaggtgaaactgataactaagaaataagttgcccaaagtcatgtgttaataaatggagctgggatatgaacccaggttcagaggctacactaactttttccagcagaacatacaaattttaggttgcttattagcccatgctgtataacagcatcactgcccaaaacaaacactctttggcatctgtaatggtggtataagtaattctattaaggctcctaaacttaatattagcactgatagaacaataactctggataatttcagatataaaagaaatgtatcctagatacctacctaaactatctaagactatgcagtaatatctgaaaactttgattttttttttaagagtacactgttgcattttctgcaaaacaagcactatcagatttacttattctgcaactagacagttaagaacaaacagcaaggtcaagaaacaaaacaatgtaaaagacctacaacagtaagaaactaacacatctgagacatcctaaaattgcccttttgaactctttaaatcttaggtcttatcaaagatggttatcacattctcaaaacaggcctaacaggtatttcaaaatgttttagccatatcatatttaaagcattagccatatcatatttaaagcattttggtggcccatggaacatagcttgatgttaatttcctatcaaactgccactgcatttctcttccttacctgcttggtatgattgtctaccatactagaagagtcatcgatagccaaacaaatctgatactggcgtttactgggcttggtccttcgaagccaaatcttgtctttccgaaattgactagcaatgtatggaatgactttccgtatgtttagtcgtttcccagttcgatagtctcctctatttattcaaatgggggcaaaaattagttaacaacttttaattcctgagaatttttattaaggacaaaaatcacaataataccttaaaaccaatagcaagtaactaggaacctggcacaatgaagtgtttctgtcaattgacgactaaggatcttcttgacctctagccagaaaaactggacacgtatgtggcaataataattaggtccttccagacacatttttaaaaattaggaaaaaatgcactaaataggaatgattttggacatctttgaaaagatctaggtgagtaacacctatagcaagtgaatagctcaacatgtaacaaggtgatcaatacagacacccagaaacttttgtgcagagacaataataggaaaacagggtaaggaacagcatactggtgcctgtacggcacaagcggcagcctagaagctggcactataaatggttaggtgccgcgttcaacagaatcaatgaagctgccgtcttctcagggcactgtgaggccttccagaggggaagacttacttcagcttggctgcctgggtaggctctaatatgagacgaagctcttcacataaccgttgtgaaagaggcgctgttaagatcaggtaactctgccacatctcagctgcaaccttctcctgtgacaacaacaaaatgtaagttaccctcagaatgtcagagccaaccaagtcttctagcaagatgcaggctttaagcaaagtggtagaaaatgacctgcatgaactttctcaacagaagcactttaaatcttctcccagcaagctaccatgtaatttacttgattaaaaatgtctctccttccagctgagggtggtggctaatgcctggtaatcccagcactttgggaggccgaggcgggtggatcacttgagaccaggagttcgagaccagcctggccgacatggtgaaaccctgtctctacaaaaaaaaaaaaaatacagaaaattagctgggcatgggggcaggcacctgtaatcccagctactcaggaggctgaggcaggagaatcgcttgaacccaggaggcggaggttgcagtgggtcaagatcgcgccacagcactccagcctgggtgacagagcgagattccgtctcaaaaaaaaaaaaaaaaaaaagaaaaagaaaaaagttggcccgtaatcagcactttgggaggccaaggcgggtggatcacctgaagtttgagaccagcctggccaacatggtgaaaccccgtctctactaaaatacaaaaaaattagtcgggcgtggtggcaagtgcctgtaatcccagctacttgggaggctgaggcacgagaatcacttgaacccgggaggcagagcttgcagtgagccgagattgcgccactgcactccagccggggcaagagagcaagactccatctcaaaaaaatgaaaaaaagtaaaaatgctaagggcaaatccctccagcaacacactcaacacaaagccccatgatttttctgccaactatggcagagcactgaatacatatatgtggtgggagtgattatgacaatagatataaaagtgaaatgtgtatataatacagtaaatttcagatgcaaagtcattaaaaataagactgctggttaatccacactaccacgttaagtcagccagcagtgatctagctggcctcttcttaggatggcacagcatagactcttgcccggtttttcaaccactgtcacaactattaacatccattacagagccagcaacagaaattaaaggaattaagcacaccaatttctgttttaattaagctatagatctaacagcaaagcagccagaaactgatggacagatctgtaggctttaggattgtaattatattctccatatgcctggtcctttttgttaaggtaattgctaagaacctattaagtttgctatatgttgaacaaacaaaaaaaaagtcgagatattttatgaaaaaaacagtgagcagtgacttacctcctctgggtttccagattcacgtggctgccacatttccagctgtctctccagctcctgtcttagctcattgacatcttttaaaaagggctaaaaagaaaaagccatagataagaggtggcccaggttggaatcaccaacttagtatcactgggtgtcttccgccctacagtatgaactcaaagtacatagtcaaatgctcctgagattcaaaacttaattcagcaaatacagtggcacaatgagaagatgccagacaagcattctgcttccctcttagagagacaatatggataaagaaaactttaaacatttataaagccactgtagcaaaacaaaacccaaacacccttaagtcatcaataatgaaaatgttatctgattaatcaaataagtcaaactcttagctcaagaacttaattaaatagctcttcataaatacaggcactaagccaaagattttttacttaaccatcacaaacctaattgtcctgaagattccttacacaaggatggttagaaaagtgggatgtgagtcccagaggccaaggaccagacccaccatcacagacaggtcagggcactgtgaccctgtgattaattgctggaacagtatcacgtgcttgaagaacacctatcataccaatagtattcctaaaaattttgaataagaacatgaaacccctcaacaaccagatgttccataaagttctaaagacaaagatttaaaaccagtttaaaattttattttgttaatttattaacactatattaatgcagtaatttgtgagttttactacctggaagatcgtgtccatgaggaattgatgagctgtatgaatggtagactctcggcttctttctggtttctcattttctgtctccttatgggctttgtctgttctggggtcttggtcttcctctgttttaacagtttggatctccacttccatctcatcaaagcctattttcatttaaggacataattttacttataatattagcctgatgactgaccaagcctttgctattgcctgttaatcctgaaaattaatcaaacttcattcattcactctccaacacatttccacatgttgatttcagaggttctttctctctgagacactcattgccaacccttactctctaaactcccctcctcctcacctgatgttgaaggcagatgttcttggaaagggaaataggggaaattttgggttgtcctaagaagccttgtaaaactgtatgattcttgaaactatatgcatgtaaaactttgacagaaataaaaactaaaagccacaattccattttacagaagaggaaacaggcaaagaaaagatcaataatttgcttcaacttgtgaggtgagaggcaaagcctggcttgtcacataggatagtcaaccgttctaacagttctaacgctcctgagaggacaggaactaagcagaagaaaaagcctctgaatttggcaagttcttttgaatttgcatttattccattgctgatgaagctattttttttgccaagtaattaatagaacttggttagctatgaaagggaaactcctcattctatttcttttaatattttactgcattttatgctaatagcatatacttttatataattgaaaatatcatttctctaatactataccttttcatcatagctgtagtaagtgtactattctggtttcttctacatattttttaaaaactgatgagattttgccagaaattcaagtttcaggggactccttaaaggatggtgtcctgcaacacccaccgctgtccatatttttgttttctggtcccaaacaaaatatagtgaaattattataggcaattcattcatctaagccatggattaggacatggaactgaacaccagactagattatagtgagagagaactgactacttcaagtcagagcgcctgggaagggtttgttcactagcaggactcacccaagggtgctgtggtgcccgacttgatttcctctggcttcagctgctccacgtctgctgctttgaactcctcctgctcctctgtgtccataagggtgtcctctatctcctcctcttcctgatctttgccagagtcttttgcagactgttgctgttctttgctggccacatctgtcaacaaagcacgcacccacacataaaaatcctaggtctttgcagaacaaaataataataagtgggtatggtttctgtcattctagcttccaaaatgctagtgatgcaagttgtgccactgaccagctatgtggcttggagacttgtctgtgcacaagatttcctattgacctattgacataatgaactgcctgttccctaccccctacagaaattatgaggatataatgtaactatacatgtgacactggctgccttccgccctacagtatgaactcaaagtacaccgtcaaatgctcctgagcatttgacaaaatagggtgtttaactgggctatagggtgactctaacaataatttattatatattttcaaatgactagaagagcagatttgaatgttcccaacacaaagaaatgataaatgtttgaggtggtagataagctaattatcttgacttgatcattaaacattgtatacatgtatcaaaacctcacactgtaccccacaaatacatatcattattataggtcaattaaaaataataaaaagtagtagaaaacaaggcacagaaagacgaataggaatcccagcattgtgatcttgcgtgagtgagttcttaaaccacctggcctcagtgtacttaactatacaacagagagactctagctcataggattagttgaggaagtttatgatcacgcagcaaaggctcagaaaagttttttggcacaaagcaaaagctcaatacatggtagctactgctctatttttttttttaagtgggatcaaggagagaaaaatgtaatccaatgtagagcagtcattttcgtaccatcctaaatggtagattattctcaatataagtttacatattaggaatgaaactgaagtcaccaagagaaccagaaggggagactgaccaatgacctcatgctgagacatttttcctcccttttgcacttatggagaaaacacatatttcaaattcatagcacctgtcagtgcagggacctatccagaggtgactaagaagaaagaaatgtccagtactaagaaaccctgatatcggggtttggatgtgaacaacttatttttaactattatatttaaggatatttaaagagtttatactaaaccaagaaatcttaaccatcttcacttggttacagatacctttgtaccaaaaacaaactgtatttctgcacatttcttatgtttacaaagccatttcctctctcccctgatataagtgtatacaatcagctgccaggcacagctgacttgacttgatcattaaacattgtatacatgtatcaaaacctcacactgtaccccacaaatacgtatcattattataggtcacatagcacaagctctcatagagagctcagtgggcaaaggcagcagctttcccaggaccgtaccataggtctgtgcatcgtatgcgtcactgccttgtttaatgtgctcgaatgcatctgcatcctccacctgggcctggggctgctgagctggcccctgctcggcatggctgtccgtatccacagtcctcagcctcttgtgcacacgctcattgtgatcacccatggaacgttcattgtcagcctgcccaggtttcctcttaaaactctgagaaatacaaggaaattcatcagagccttgcctgtcatgacaaaaggactcaaagtaaacataatatccatctataggggacaggataagtaaatcaggtgtagccatacaagaatggaattcaatacagctattaaaaagaaccgggactctatatacttacatagaacaatctctatgatatacttttatatctaaaatgaaggcaaagaaacacactttcacacatccatatatgtcatatatgcagaaaatatctctgaaagaaggaattggtaacaccaatttgctctgaggagggtcccttggggacaggaataggatgtaggcttttaggggattggttttttacactaattttgcatcacgtgcataaattataccctacttaaaaaaaaacttactcttaaaaaagcaaaagcctatggacaatgaaaagagtgagacggtttgtgctgggcagccgcacacagcacttggctcttaagacttcatggccggaatcaggggtcggggagagacacaggcagggaagaagccgtgacgggatcccactgggtaaaccccatggtcgtggtctgctcaccaaggctgctatcatatctgatgcaacaacaacaaaaaaaccaggagtatagctttttttttttttttttaaagcactacgtttggaacatctttttctacatgctgccttcacctaagtttagctgaggagtgatagaaacctgtgtgtttttcctggtgtgcttctgggaggccaactgggcaatgaaattcgattcatggccttctgcctggtttgcatctgcagctccacttccgtgttcctaggaaatccaagccacaaaagaatgaggtgaaagaagctattacaagtccctggttactgtgctgcattgaatacaacttctctcactgctgtcctttattctcagtcatataatcactcctgcctacctgcctgccctggaactcaccgtaactaaggcctggcctacaggcagaaacaggagtgtctaggtacagaccttatgttaacctctcaggggcctttgtaaggctgcttagttctttgcaggaatattatgtctcactccaaagacaggacagacctcaattagaaaccaggcttcatcatcaaccagctatgtacacttgaggttgtcatttaactttactgaggcttatttttctcaaatatacaatgaagaaaatagtacaatatcatctatctcatggggacatagagaggactttctgaagtactgaaaatgcttagcacctaatgggtgctcaatgaatatttgtggtggtggtagtcatacggtataagcaatataaatggttgttattgtcagtaagaactaggactcaaagagactaaagttgtccagaatcaccactgtaaccagcaggtcctgcgttgacatcccatgttctttccatagcacccagcaacctgaattgtggccatatcagaacacatcaccaccagatcaaagaatgaaaaagttatctgctttttaaattagacgtttagaaacctgatgatgagcaaggaaaagcaaaacaccgttaaaggtatacattgcctgaagtctaaattccatgtttccttcctggagagctttctgaaaaacaacacgaacctgattctcccatctagagctaccagtctaacaactttttcttattatgcacaccacttaaatacagccgatattccggggtttgtcctgggaggcatataaaaataagtagcagtcatgtaccacacaacaacgtttcagtcaaggaaagactgcatgtgcactggtggtcctgtaagataataacacgtttttactatatcttttccatgtttagattcacaaatacttacattgtgttacaactgcctgcagtattcagtacagtaacatactgtacaggtttgcagcctaagggcaattggctctaccattgaggtttgtgtaagtacacgctatggtgttcgcacaatgacgaaattgctgaatgaggcatttttcagaatgtatccctgtctttaaaaaataactgttcagtcacgcgttgcttaaagaatgagatgtggtctgttagatgtcaacaacaaaacaaacaacaaaataaccaaacataaaccaactaatgctacacagaatgtgatgtcggacagggagaagagaccctactaagaggcagctggcggctgcagtgaaaccactgatcacctctttcccctgctccttctcaggtgcggccccagccagctccatggcctgtgtgttctgcatgttctccacaccagtctgcccacaggaggcatgctccttcctctccaaagcctctggcacctgctcctctgtatcagagtcctcccgttcttcttcctccttcggcagagaaatcaaacacagcattaaatgctctgggggaacagcataaggtgggagaccttgcaacaagcaggcttccccactcctcactaagggtcttaaaacagaaacctagaactcctcggaagtgccacatgttgatggaggagtatcctaaaagggattctaatgggaataaggtgacttctcctcttcctcattatttttaacataaaaagccagacatctcatgatacctggggctggaaaccttggtcagcagggccattctctccaccttcttcatcggcttccttgtctttttcctccacagactgctgctgctcctcagagtgttcttcaggatgctgagcagcatctccatcttggtcatcagctcctgtgtccatttcctcttccccttctgccttgtcatcttcactggggccttcctcaggctcctgtggactctgactttcgttctggtcggtctcggtctctcctctttcctcagcttcatgacctgcttcttctggtttttcttttatctccaaaggattctcttctgtatagatacaacaaaaaggaggagtgcagaatttttgaaacgtacatgatttcttaagctgggagctacttatgcaagttttgtcttattacaattctctaaaccagcgagtggcaaattgtgacccacaggccaaatctggcctctacatgtttctatgaagaaagttctactggctgggcactgtggcacatgcctatcatcccaacactttgggaggctgagacagaaggatcacttgagttcaagaccagcctgggcatgcatcatagtgagaccccatcttttacaaaaaataaaaaattagccatgcaaggcggcatacacctatggtctcggctactcagcaggccgaggcaggaggatcacttgagcccaggaggtcaaggctacagtgaactatgatcatgccccagtactccagtctgggtgagagggcaagaccctgtctccaaaaacaagtaaagtttttactggaacacagcaacatatattctgtgtttaccccatccgttttgtactgcctatggctgctttcactctgcaacagcagaactgagtgtttgcaatcgagagcttatggtctgcaaagccaaaaatatttaatatctgacactttatagaaaatgttttcccacccttgttttaaaccatactcatacatacagttgttttaatggcatatttcattaaaaaataatagctaatccacccaaaaaaacccccataaacaaacaaacaaacaaaaaaacacaataggaaaattttaggccaatggaaatggcagcttaatgctcaattatcattgtgaataactggtggatgtcatgatcatatacagaaaatacaactcacactgaaatagaaacactcttattttgaaaaagttttatcaaaagagattttctatactttggacacttcaaaaatcagttattagcaaattcttaaaataactcttattatttatttttttatttttttgagatggagtctcgctcttgttgcccaggctggcatgcagcggtgccatcttggctcactgcaacctctgcctcccgggttcaagcgattctcctgcttcagcctcccaagtagccaggattacaggcatatgccaccacacccagctaattttgtatttttagtagagacggggtttctccatgttggtcaggctagtcttgaactcccaacctcaggtgatccgcccgcctcagcctcccaaagtgctgggattatagacatgaaccaccgcgcctggctaattttttaattttttagagacagagtctcgttctgtcacccaagctggagtgcagtggcgagatcatggcctactgcagcctcaacctcctgagctcaagcaagtctctcgcctcagctcctgaggagctgggactacaggtgtgtgccataatgcccaactaatttttttttctttggtagagacagggtctcactatgttgttcaggctggtctcaaactctgagctcaagtgattctcccaccttggctttccaaagtgttgggattacagacacaagcctctgcaaccagcctactgggtttttttttcccattatctattatttaattagcaaacaattttaaataattgttccttagttacaaaacgagtctggctatttaaaagcagacagcatattacattctcagtggattttaattttcttaattttatgctttcttggtaattgactttgtttgcaactagattccaaaattaatttttacataaatggcacctcttatttattcctttgtaacttgctatttttgttctaatacagcattataaaaatatacatatacattttttaaaatagattttataactatgtaactgactcatttatcagcgaggccagctcacatctttctgtctgattaagcagcagcaggaatggggccctctgttacaggggcacctccaacacaatgctttcaactaataccagataacactccctaaaggattcactagggttgaaaaatggacaacaaaggcacgaaatactgtcatatgccatgcgatttctcttgggattatttagtctcattcctcactacacatgacaatcaataactgaaaccatcatttccctaaaaaagctataactggactccacgacagcttggtatacccagactgcacagcgtttacaccatcccatgagatgggatacacagtaatggctgtgaagagacagtgctgtgtgtgaagcaccaccagggcatagcagtgccaaaagcgagaataggacatgacagtagtttgagaaatacctgctggttgatgagctgtagggataatcacatgagaaatactacaaaggaaaggcaaaccattttctcagactgggattgagcctaccaaacgtgatttatcacctggccatgacactgagctagctttcaaaagagaaatcaattactgttcactaatgtgagttctaaccggtctctttgtttctgaaagacgcaccttctccttcttcattgtcggtgtcctcaccaccattcttgtcttcactgtcgaggttcaagtcatctggaaggtccaaagcctcgggttctggcaccttttcctgattgccatggtaagggtccacctcattttcatcatagtccctctttgggacaatggagacaacagggataaaataaaaatacaaatatttttttaaaaagtagaattcccataaaatcagctctaagtatttacactgtgagagaacacaatatctattccctaaaattatctgcacacattagtattttatttttagacctttcatgttggaatctcagatttcactttctgtgcaggttatccaaggacaaatggtgctatgttacttaatctcgaagaaacttacaagaagaaataaacaagggatcacaggttttagcttctgatctatagcatgagcccagacaacatgtggactaccctgtcaggaaccaacagttatatattttatgtcctgttaagagcctctgttgcatattcttttatgaggtaatgggagagcagtcgacgaacaggggaaaaaatatcttgagacaccttgagaactatacagctcaagagctctggccttgagtcaagagagcggatcagtttcaaatcttcattacctcatctatttgttcattaattttgtcttcaccttgtccaccatcatcagcttctgcttcttccttttcttccttcttatcttgctggcttttatctttgtttgaattgccactatccaagttgtcatctttagcaacaagttcagaatcttcctaaatgtcagaggaagaaaaaacaatcatcacactcaatccaagaaactgcttctgcatgggttgacttttagacatgcataatttctgcctattggacctatcccatggatggctgataaagtgccatccgtgacctagagaaaacagtgcaggtctccatgacagcagcaatattattaagtgtgtgaatggtggggtgagtttgataattcattgcttcaccctgggctgttgcagtgttacactcagccctggagttctcccaagctgggagctggaaaaaatcagtggcctataggagaatcagcttagaacatctgcacagggtcttgttcatcctccttcataacacatgggatgactcaggtcaagctactcttagctctgaatgtaatcaataagataggatagaaaaaagaaaaagaggaatagaaaaaagagaacaaaacaaatacagaaaaagaagagaagtaaatgacagagaatggtaggttgtgggcagattacctcctctcagcttgtttgggaggggagaaatctttgaattacctcatccattcctggtcctgtttcttcagttttattgtcttcttcctcctcatcttcctcctcatcatcatcaccccaaagcctctcatctagtttgtcagcttcctcaccattgagatcgcccatgtgtttatccaggtctccgccctcactatctgatttctcatcatcctcttctgaaagggaaggcactgagcttaggcagatctccaaactgacccagtcctgtgtatttaagagaggtgtggacccgcttccctagcaagggccccacctgagatttattgcctttttctacagaacacaccctacgggcagatgcctttagatctactgacatagtcttactgtgttttgcaaagtagaggtacaaggaagtctataatgtgtgaacagatggtaaaaagagtaaggaaatacctatgaggatgtctggttttggtgctgggggaatggccattatgggactcagcaacctgagttttatgtctgaaatgatggggttggactaggtggtttccatgggtcctccccatcttcaatatactgctatgattttttccaacacctaaaatcaggtctcaatcagaattgtcttcatttgtctttgcacagggtatactttgcaaaaggtcatatcctatgtgccttaggccaactgccactaaggtcaactttcatttctgcaagatattcattttagagtaagatacagttatctccaattggacagaaatttggggcaagggctgaattatggtacaaacatatgacagatgatgatgtactttaaaaaatcaaattctcaaataatttttaatgacagggagaatgttcataagatgttaaatgaaaaaagcaggcccagtgcggtggctcacgcctgtaatcccagcactttgggaggctgaggtgggcggatcatgatgtcaggagatcgagaccatcctggctaacatggtgaaaccccgtctctactaaaaatacaaaaaaaaaaagaatcagctggatgtggtggcaggcgcctgtagtcccagctactcaggatgctgaggcaggagaatggcgtgaacccgagaggtggagcttgcagtcagccgagattgcaccactgtactctagtctgggggacagagcgagactccgtcttaaaaaaaaaaaaaaagaaagaaagaaaaaagcagactacagaacggtatatggtttctgtgtgggtatacatgcaataaatggaaagaaatataccactatttattaagtgctatggctggtaggcctgaggggggatctatttcttttctacatgtttgttccaaatcatctacaacaaacacctactatttttctaattaggaataaaaggtattttaaacactacagaacaatttgccttttgttgaaagcccttttccattagggatcatctcctttcaggcttcactactgagccactgcatctagcacacgaggcagctaaaacatcaatgtgagaagaatctatgagacaccagggacttctgcctcagtggaggtggtgatagcacatgcagctgctgaggttttcatttgcacttaagcacagtaaccaacttgtttcaaaagattatattgggttccttattaggaacatgtaatttcctggataaaatatttatgctttcaaaaacaagaatgaagtgacagataatctgaaaccttgttcttcaagctccccatcatgcattttcccatcaaaatcttccgacatctcaatggcattatcctcgcccttaatatcagattttgaatcaggatcctctttgtctttttcttgacccttctgaaatgtatcttccacctacataaagaagtattaaacataaataaatgaaactttaccaatgtttgcttcagctgtgagatataaatgccaaggttaatggtgtaaaaatatatctgggagaggaaaaaaaaagagaaacaacagagacagccacatggaatttgtaaaatttctggagttagtttccacttgttttaatcagagtatagaattttgttcaggttttcttattgggaattgtaaaaatagtcccagagacatttgcaagaatatatattctttgtaggataaaaaattcatcaatcttttattatccaattctttaatactatttttgtcactattatcgctgaaagacagtggcccaagagaatcttggtcattcttccttggtttctatatttcttctataaaaaattattttttatgttgttagacagtgtctcactatgttgcccagcctggagtacagtggcacaatcatggcttactgcagcctcaacctcctgggatcaagcaatcctctgcctcagcctccccagtagctggcaccacaagcacatacaaccacacctggctaattttttattttttgctagagacgtggccttgcaatgttgcccaggctggtctcaactcctgggcacaagcaattctcctgcctcggcctcccaaagtggcgggattacaggtgtgagcgactgagcccagcctaatttatatgtttctatataattgatgtgctatttggggcaaaaagttttgtgattgttacctctttcattatggttgatttttgaaagtcctttttaaggccaggcacggtagctcatgcctgtaatcccagcactttgggaggctgaggcgggtggatcacgcagtcaggagtttgagaccagcctggccaagatggtgaaacaccgtctctactacatatacaaaaattagccaggcgtggtggtgggggcctgtaatcccagctactcgggaggctgaggcgggataactgcttgaatccgggaggtggaggttgtggcaagctgagatcatactactgcgctctagcctgggtgacagagcaagactccgtttcaaaaaaaaaaaaaaaaaaaaaaagaagtcctttttaaaatacaaaagtaatagccaggcatggtggttcacgcctataatcccagcactttgggaggctgaggcgggcagatcacttgaggtcaggagttcaagaacagcttggccaacatggcaaaaccctgtctctactaaaaatacaaaaattaccctggcattgtggcgtgcgcctgtaatcccagctacctgggagactgaggcatgaaaatctcttgaacccgggagctggaggttgcagttgagccaagactatgccactgcactccagccttggggagagagcaagactctgtctccaaaatacaaaaaaacaaacaaaaacaagtttccccataacacctccatcctcgaagcctctcaaagaatgactaccaacaacattctggtgaacctttgacttttttctatgaatacaccaacatatacttaagtgatacaggtgatagttaccaatacctgcctcccaacatctttttaaacaaaaaagagatcatgctttacagacttatgcaatctgcttttttcatttttatttttctgaaacaaggtcttgctctcttgtccaggctgtagtgcaatggcacgatcttggcccactgcaacctctgcctcccaggttcaggtgattctcctgcgtcagcttccgagtagctgggattacagatgcatgccaccacacccagctaatttttgtatttttagtagagatggagttttaccatgttggccaggctgggttttgttttttgttttgttttgttttaattttatagagacagtgtctccctatgttgccccggctggtctcaaacttctggcctcaagcaatcctcctgccttggtctcccaaagtgctaggaatccaggcgttagccaccacacccagcctgtaaaacacatctcttcttaaaaacatctcagccaggtgtggtggctcacacctgtaatcccaactactcaagaggctaatgcaggaggactccttgagtccaagtcatggctgcagtgagctatgattatagaactgcactctagcctgggcaagagagcaagacctcatctcttaaaaataggatcttaggttatttccatgttgatacatacaaaaccatctcattctacttcattaatagttttaccattgttctgcatggatggtgccataatttaattctcttctgatgaatatttggattgtttcacaattttcaccatataaataatgctgtagtaaatatccatgtgtagacatatatacacactcatatacctatttatctttgacactagcatttctataagaaaacatggaatttgggggtcaatgaatacacataatttaaaattcagcagacactaccaaattgttctggaagctttttattccatgtaatgttttttgtgtgaacttttctattagatttgcttttgcttttgactttttttttctactagaaaagtagtatacactgatttagatttgagaaatacagaaggccaaaataacaaagcaattatctaaggacaatataggtccaaaaaaaaaaaattagagctccataacataaatactagcattattcttttggcttttaattgctttccagttttctctgccaaggaagggagggaatttgaattggttttctcctttatttttaataactataaaattaccttaaatacaagtttctgatctgatttaacttagaatataagtgatacacccaatacacataaatcactcacaaatgagacaggcatttaaaaaatccaagcaatgtaacaatcttagttcacagcatctgaatagttcagaaggttgcttgattccaaccaaaaaaggatacagattttttaaaacactctatgccttaaagatatacaacagtaaaacctattaacagcaaattttggcattattgtttaatgcaattatcacttaagatagccaggccttttatgcttaaaaatactatcaaaaatactctagaaaatcatcagtaaatatctgcccatttaaaaaaaaaaagtaaaaatcatttcctccataattatagccaaaaccaatgatggagttgccaggttccttcctgtggattttaggctttttatttacacccactgccgaagcaccaatatatctagggctctgtagatcacagattaaaaattattaacctagtaaaaaccatttttatgtgtaacttacatgttgaaaagaaagagagtgatcttctgtcaactgtatacctatgtgaaaacgtacctgttcttcatttccgatctggtcactcacatccttcatgccctcgccttctccaattccacctccctcatagtcatggaactcagttgctccctctccagctgaatcttccataaattctttgggcaagcaaaatcccttagaaaaaagaaaaaggaagtgaacaattaggcacaaaagcaattttaaaaggagatttcattcttgccacaggaaaacaatttaaacacatactgaattctttttctagctcattatcttaaatccgctggaagtacaggagacttctgacattcttctcctctttggtgctaatagttatgcagtttcacagcttgacatcagatttaacatatgacttgactttgtagaagcctctggcatgtggtcatttgtcactttgccaagacaaaaacctaaatgaagtatactagaaggacagtattttggaaaaagtccttgagtaagggcagaacaggctctggagagaacacagtcagacatagtaataactgtgaaatgttgaaaaaaactattttatacaggaaaataacctgagaagaatactagcctgctgagcagaagtaaaaagaaaaagtagtagtgactctcaatcagaaagtttaattttgtaagagaaaatatatactatgaagatatatctgaggatgggaatgcacaaaaaaataagctgctaattagcaaggaattaagatcccaaaccagtaaacactaattatgacttggttacacagaaacagcttcctgcggatcaagagctttaattacagcctagatctattatcttagcactgtctaacctactctcaagttcccttgaactactcagaaaagatatgaatacaatttggacacttagaaaaatttttaacaagccaaacccacttttaggacatatattctcagaatgttgataggaaaatacagtttggcttacttgcttaattttcccattgaactacattatttaaatgagagacattcagaaatagacaaagaatacgaccacataggagggagtttcagatgcccttaccagagtatatcattgcagctgctacgtctgggatagccacagggctcccaacattctgcacatatcagaaccattcctacccgcaacagacaaaggtttgaaaggccaaagtcattctacagcctgtcagacaaaagctacggtacaaatggacaaatccagctgagccaaatctcaaggcacccgaaccacacattttcctgccactatctttagtatacagtgttttctccaagaagcaatggaatgttaaggctggcctggtgcccaccagaggcggagaaacctgagactcattcttttacttattattactttttattattattattattactgttacttatcattactacagataaacatatttatcctcttgatacaaggcattaggcttggcttccactttttacctctttccagtatttcagagactcggaactaagaactcttaattgtttataagaaatctagaccccatcttcagtttgtaaattcatatcttcctcaagtacatctcatctgtattaagcttggagaaaatcttagaatgctaagaacaaaaacaaaacttatatactcaaatgcaggtggttctcacaaaaatgcatattagtataggcagatctcattttacaaatgaggaaactgaggcttggtgaggttaagagagaccgagagctggatatctctatgactagacctacccacaccatgttgctgttagatttcactgtctactgcccctgagtttcaaggggagggtctacaatctctacaacctcagtgcttttcacaataccgggtacatggctgaatgaacaaatgacttccctgctaaagaaaaaaactggctgggcgcagtggcttacacatgtaatcccagcactttgggaggccgaggtggacagatcacaaggtcaggagatcgagaccgtcctggccaatgtggtgaaaccctgtctctactaaaaatacaaaaattagccaggcgtggtggcacgtgcctgtaatcacgtggagattacaattacaattacaattttggagactctgtctccaaaaaaacatatatatatatatatatatatatatatatattttttttttttttttttttgagatgcagttttgctcttgttgcccaggctggagtgcaatggcatgattttggctcactgcaacctccgcctccccgggttcaaacaattctcctgtctcagcctcttgagtagctgggattacaggcacatgccaccacgcccagctaatttttgtatttttagtagagatggggtttcatcataatattggtcaggctggtctcaaattcctgacctcaggtgatccacccgcctcagcctcccaaactgctgggattacaggcgtgagccaccacaacaggcgaaaaacactctaataataacaggcccattatcatttaatcataattacaccaacatggttaaaagaaaacttaatagccttaagggtttatcctacaactctagttcaagagttatctgaagatttacattggggatgggaagggaagggtgttaacagacggcagcagcttttagacagcgctggagtttagggaactcgtcagtttgggggaaagggtgggttggggataggaggtatcatctgcaggttctgagactttagtggaaacagcgttagcaaaaggatgccagacaaagccctaaataatccacagggagagcaaatcacatcctgctatttgtggtggtccaaaataaaagcctatcacaccaaagactaatgacatgaaatttacttgggtccctgctgctcacagtgcaccatgtgaacagtccttaccttctgggcaagctctgtaaagacctgggcaagcacagagagcagctttgcagtactacggtgagttgctaaagacatggtcaggaagaagaggacgaggtctgagtagctggagaggaccggcaccaggcgcaccagcaaggaacaggattggctgaagaactgagaccaaaacaaaacaaaaggcctgctcacactgcttggcaggtaccaggtttccattctggaactagatagtggtggtaattgcacaacattgtgaatgtactaaatagtactaatggcaagttacatgtatgtgtttgtaacctccacccaccccaatacacacagctcactgagatttcttcatttacatatatcgtcacaaaagtacaatctcaaaccgatgtctcctttggctaacaatgttggttttttaaaaatagaatgttggccaggcacagtggctcacgcctttaatcccagcactttgggaggccaaagtgggtagactgcttgagcccaggagttcaagttcatgttgcctgggcaacatggcaaaaccccatttctacaaaaaataccaaacaaaaaaaacatatagccagaacccatctttacaaaactttaaaaattagctgggcatggtggtgcatgcctatactgccagctatctgggaggctgaggtgtgaggatcacctgagcccaggaggtcaaggctacagtgagccatggtcatgccaccacactctccagcctcgacaacagaatgagaccgtgtcccaaaataaaataagaaaaataaaatgtttataaataaattctgctgattcaaagttagcaccggaggcaatgctacagaataacatacaatgtcctgcaaagtaagttgcttctctggacttactgtaaagactacaactgcttactctgttcgcttattgtagtgggaatggtggttacacaggatggctgctaagcctcagttgataacatcgtctatcagtaacatcagatacttgggagtatgtgaataagatatgaaagaatcctaatataatggatattctgaatggttagcatttctgcacctatgcatctaacaattagctagcaagccctaagctcttcaaagcttgtcaatgactttgcacgtataaataaagagaccaagttcttagtgattttggcactgaggcctgctctggcacttatctacgtggagggaagtaaagcccactctgcctttgctcagtgcattctgaagaggaagaagtttgtaaagaacagttagttaccaggtgctttgctgctgtgccatcctcaccgtacgatttcagcctctccaacagctcggagatggcagaaattattttctgcacgtgcaaagtgctcacatcggcccagaagtcatcctctaagagttttgttagatgtcctgattgcagtctctcaaagcctgctgcctcattcattcagagaaaataacaacatgatgaataacagaaaacaaatccttttatctctatccatgcagttatctgtttctaacatccatccttaactatttagccacagaaataaatcatcaaatacaaaaattaaatcaggcatgaaactaatttctgcctgatttcagacataccataatcttcttgtgggcttgcttggtcagtgttctcctctgctttttcattctttctttcttctaagttctggatggcacagaggatggctcggatggcaatttccatttgctctgaaaaatcttccacaaatccttcgtccaacatttgatttcctagcaggtaacatggtgcaaaacaaacatacaaacaaaagacaccaatcatttgctttagtgcctctggaaatcattaaaaatactcatttattgatgagccactgtgtcaagctgtgccagatacaaagaagagacaaattccttgcctcgataaacctacaagtttattaccttgtattaaaacatttttactaaaataatgtaaaaaatataaaaataacagttaagacagtatgaataaacactaacttagtccaaatatcagtgccaagctttttcaatctaagggaaaacagacagtgagctgatgctgccttcctatgtgtgttacaaagtatgtaacaggcatccaaacaaatggggcaaaaaagttaagagctgtggatttcaaccgcacctccctgcctcagaaccctggacaggtacatgtagaccaaaatataatgtgtcttttggacaatgagacttacatctataagacatcatttctacactggactttcattccctgactgaacaatattccttacctccttggctatctgaagtaagcagatgggtcttccaggtagtaaagtcagccatggctttactaatttctcctcttacatattccagactttcaactagtgccatttgtgagtctctttgctcaacctccatccctggaagaatgaacaaggactctaggccctgcaaatgaactgacacctgggacaagcaactcagcgcagaagagcaaacttcaaaatctttcctgcaacagaaatgccacaatgttgaaaggaatgcattacagttcccacaaacacacacccctccctgcaaccactacaagatatgcaaggtagaactcatcatagctgaaggtttacggctaaacacatgccacaaagtgctgtgcaggtccactgagtaacagaggactgaagcacaattattttcataatttgattctattactaaacacctaggtttagtaatggaataaattactaaatttattccattaatgataaatttattccattaatttattccaataaatggtaaatttattccattaatgatattccattatcattagtatttggtgtgataggcttttattttggaccaccacaaatggcaggatgtgatttgctctccctgtggattatttagggctttgtctggcatccttttgctaacgctgtttccgctgaagtctcagaacctgcagatgacaccccctatccccaccccaccccatcccccaaaccgacgagttccctaggttccagggctgtctaaaagctgctgctttctgttcacacccttcccttcccacccccaatttagataagcacaataaggacctaagcacacagagaagtgtaaagacatagacacacttaccaagaatgaaagagagtctcacaagactgctgtctaattttgtcgacgtcagctttcactgttttaatggtttttagcatctctgttaatctcgtagttgactgttgccaaaggtgatcctgtttccgcatccggcaaccagagggcagctgacttccaggtattggagatgggtagctcagattggaaggaattaggtccagcactactccacaaagttgtcccttgctaagttctggtccttccaggcaggggccaggaggctgccccagtacctggacattgccatggcctggagctggccctacactggggcagcactggaggagccaggagagctgctcaagcaggatctggcactgcatggccaggtgctgcaggcgctctgtccactgctgcacgccatcctgaggggggaaggccacggggtaggcctggggccccatcagcctgctgtgaatctcttgcacacagctgaggaggttcctgtacagagaaacccatgggaaaaacacaatgaatggcaccttaaaccactttaccacattgttttaaaagaaatttgtgtttctgaacaagcatgggctttttcatacagtcaagaaggaagaatcccccagataggtaaaaagtctgttaaaatgcctcccaaagtacttaaacccatccctcagtctttcaggagaagtatcacaacacaaccacaccactacagtgacttcaactagcattatctagtaaatgtgctgtactttgctaaataaaccctaatgaatggagcagaaaatacctgaagctaaagtgaatagtctggaaatactgtccttcagccacgaatccattcaacagatgacgacaaccttcctaactgtcctcatctcttaattatttgtttccattgaggagcctccatgtatggctcagattgccatctgggggatccccaaagcctaagtaacagaagcagactcaaatctcatcggtgcccaagaccatctcaccctaataccatgaacagaagcctaactattggcccacatggacttttggcaatgtatatcctcattccagacacaggtatagttcacccataacaattttcactgcctgacacagccctgaaatctctgcagctccatattctcaggaggttcagagcacggagggagagggacactagaggcatatcactgaaagcaaggggcagagctgggagaaaccctacctgcctctttgggccttaaattcatttcacaattgagagcatgtcttattcctctccccacatgcagcaactctgagctgacttggatctaattcttcccaattcatgccacaagcccaactcatcagctgatacctgaggatgatccactgctcactgagcgtggtcagggagcgccgctgtcggacgagcatcttcatcaaatgtgctgagaaccctctgcacctctccacgttgcccatgcccatttcctggcagaagaaggaaaaacatgctgaaggggctgctgacaaacatcacccacagatgtgcctctagaaagctgtttctactataagcgtcagacatgccacactctagaggtgacatattcatttttttgagcagtgtttctccaattatgcttgcacagatcattgagattccatagacaggaactggatttaactccaaaatgcatttattagtggtcttttctcaattcacaaagggaagaaagatctaaagatggcattctcaatttgaagtttttaatttttcttaaacattaagaaaatctgtcctgctggcaagtgtaactgaatttatttaaggtgttctgattttgcacaaaattacattgatttatattttaagtttaaggatgtactgcaaaaagctcagttccactaacaggctgttatcacttaacaaggtctgagaatacagccctgggatgaacagaacaagggctttccctgagcccctgcaagactcatgttctatcattctaccttggcaggagttgctagtgctgcgttaagcctggcatgccgtgcaagagagcgataaaaatacttctggcatccatcccatgaagacgagatttctgtaagcagcctggaaaagatatcaacattgtttacttaattaaaaccacgctctcccaccccagatcctgaaaactcagatattggtatatttggccataaccaagagtcagctgtctgaataggtttatttctatgaggaatcattcagtgaggcactcattagtcctttacttaactcagcactggaagtatcaggggaaataaattatgctgacaacatggtttcttcaatgaaatcttcctatcttggcagtggaggctagggggtcataaactctgatgcctacaggggccaggcaaataacataagaggactaaggacagccaagcatacaatgatgcatggcagtgacagctgacctcaacgtggggaagacacaggggttgttgagggctcaagtaagctggagagcatgtgtcctatcaaaaggaggaaactactattcagctacagtgctgctgactgaatgggaatgcaagcccacttcgtgaattttcctgaaaaagaatgcttatgtaaaatttcccctttctacaatgttctgttgaattcaaatttaaagccctgggagcaaataaaacacacatgtgtactatacccagttcatgcaaagcatcattcacaacatcctctgctgtgttgtaaacagaggtagctctgcctgtctcaatagtgtatggactcgcaaattcaataacatattagaacttatgaggagtgtatgtatatagagcaactaaaaatataccattttctaataggtttccacatgtatgatcaaatgaagcaagtagacctcaggaaaatcaaaaggcaaaaaaaaaaaaaaaaaagggaagaagaagaagaatggagaggtgaatgcaaggaagaaagagaaagaaaataaatgttttttttctttttttttgacagagtcttactttgccgcccaggctggagtgcagtggtgtaatctcagctcactgcaacctccacctcccaggttcaagtgatactccttgcctcggcctcctgagcagctgggattataagcatgtgccaccatgcctggctaatattctgtatttttagtagacacagggttttgccatgttggtcaggctggtcttgaactcctgacctcaagtgatctgcccacctgagactcccaaagtgctgggattacagtcatgaaccactgcacccagcctcacactttcatttgaatgtccatcaggagtcagatcctgagccaggcacttttgtaagtggtagccacagtggtattgctatccctatttttgcaatgtgcaaatgaggacaaggagttctaaattacttgctccatttataagtagggaaaaaacaaaacaaaaacagacaaacctagaatcagcctcctgagtgctgctgacgatggacaatgcgctctggagatctaatgggtgaagatgaagcatctcttgagggttttttgaacgggcccaagcaagacctttgcgatacgacaaacctaggaaataaacagcatttctttaagcaaagatgcttagtagagaatggatgtgcccccctctcccctgctactcaaagcaaagtcttctaaacagcatcacctgagagcttgttagaaatgcagactctcaggctgcacccacaccaactgaaacaggatctgtagctgcacttccacaagattccccaggtgattcacatgcacgttcaagtttgagaagcactgctctctatgctatgctgcaagcatatggtacagcacgtggtgacagaaattttaaaaatacagattctgccaggcacggtggctcacgcctgtaatcccagcactttgggaggctgaggcgggtggatcacgaggtcaggagattgagaccatcctggctaacacggtgaaaccctgtctctagtaaaaatacaaaaatcagccgggtgtggtggcacgcgcctgtagtcccagctacttgggaggctgaggcaggagaatcgcttgaacccaggaggcagaggttgcagtgagccaaaatcacgccattgcactccagcctgggcaacaagaggcggaggttgcagtgagctgagatcacaccgctgcactaaccagcctgggcaacagagcgagactcagtctcaaaaaaataaaattaattaaataaataaataaaaatatagattccgagaaacctcatacaaagcgggaaatatttgggaatcatggatggctggtcataggattttcctgcatgtgagtggaactcttagacatctggaaaccttgcctgtaccttctgttgtccaccatctcaactgtctatggaatttcccccaaaatcagtcatgtcatttctctccctaaaagttggtgactacatttcattgggtttcaagtgagaaccttaccaatttttgcaaggtgtttaaagaggtctgacaaagctcgctgtttttgcatgagaatgtgcttggcttctgaccgctgcttctccttctctgcagagggttccacctttaagctctgcagctcactcacagaggaaatcacttcacctgtaagggaaaacaaggcggggaggggagacaataagaaaatcccaggggtctggtaatgtgtttgttacccaacaccagggaccttctggagaacaaaggccaagtatcattcatctttataccctgggtacttaacatagtccctagcatttggtaaaatctcattaagtgttttaaccaaactggtcaaggtgcatggaaatagaaaaataacacacaggatttcaaatctcttgacaataacaacccgaacagcagcagtcattcttttgtatttaggggttttataatcaatcaagcaaatgcacttactgagcaccaactatgtgcagtgcattatactagaaatttataatcacttgaaggaaatttcagattaatataatatgtattgagtttccacttgtagctagtacatcgtaaattctcttttcatgtgcacaacttcagaagcacctatttgtagctccattttacagacttcaagaaaggctcagtgaggtctagtcactatctgaaggccatgtggtgaacgagtagatgagccaggacttgaacactggcctaccttactccaaagcccaagttctttctatatagcaccaagctgccttcctgaatacacgtgggtaccaataacacaagggtgccgcctccctgttgcaggcagtgttataggctgggttgtgtcttccccctcaattcatatgttaaagtcccaacccctagaacttcagaatgtgactgtatctggagacagggcctttagagaggtaatgaaggtgaaatgagaatgggctctaatctaatctgactgaagtccttaaaagaagagatcaggacacagaacacacagatgaagagtgaccacgggaggacacagtgagaaggtggccatctgcaagccaaggagagaggcttcagaagtaatcaaccttgctgacaccttgatcttggacttttagcctcacactgaagccacccagtctgtggtactatattaaggcagcactaccagccaaatataggcagtcaccagtgagcacaaggacaccaaagacatcagacagtgtgggagagttagaggatgagggaggctttgcatcctgcagcgcatcccctctccaggagatgcaaatggatctgtattccactcacccccacccctaggcctgagtcaccttgagcaacggctgacaagttttaaaaaggaagagctccctgagattagatgcaacctcattaaaggcaggccaccctcactgacagcacactcactgcagttggggggtagatggggtgaaggaggtagtcagaggctgccaggggcccaaacattctattaaattctgggttcccttcccagctattgctgtgttacactatgagatcttcgctctcaccttccctgagcaaagacagcctgagaaatgaaactgctgtgcctctctgaagtgaagaaagcaagaggatggggatgaatcctcctcaagtgagacaactttttgacagtggggacagcttagacactgggaaatccacctctgtgcccctttactggtaacaccaaccaacaggaactagtatagacaaggctctcataaaagatggcacagtgccaagttacatgagaggacgacaatgtgaaaattatgattgtgtgttctcagtaggctcctgtttctgagctctgtgggtttttaagcccacttgcttattcaatcaactgttcaacactacacaaggtatcaaaaaaggacacagttgccacattctcagccctcctgcgccactggggaaaacagaaagatccacccttgacttggatgctggcacccacctgtgaactgatcaaggccctccacaaggcgaggcagggggctctccttcatgaacgtcaggcacatcttcctcatgcgtttcctgagctttggcaagcgacgcagaagctccccttccaagccggaaggagcagcgccctgacaccactctggaattgtggcctgtgagacaaaagacaggttagcctcactgccaagaatgacaggcagtgtccctgcaagggaactaaatttaactgttgcacacaaaaacacatccctagttcagcaaatagagaacaaatgtagcatcactaaaattaaaagagacatactgtggatatttagaaaaccatattactgctccatatgagatcattataactgaaggacccccatgcccctacatccagcaatgcttgctatgatagccacaaggagactccagttctgaattatgaacagagtagaatgaataatatcactgctgcccttaaggtgctgagccacattgtgtttctcagacacagcagccaggcgaaactggtcctactcctgtgaccagttacccctaattaacagtttaaatttcaggaattcagatttctttcctttttttttttgagacagggtctggctttgtcacccaggctgaagtgcagtgacccgatgttggctcactgcaacctccgcctcccagattcaagtgattcttgtgcctcagcctcccgaatagctgggattgcaggcatgcatcaccatgcctggctattttttgtatttttaatagagatggggttttaccacgttggccaggctggtttcgaactcctggtctcaaatgatctgcctgccttggcctcccaaagtgctgggattacaggcatgagccaccgcacctcagacacaggaattcagatgttatatgaagggaagagctttcgtccatcaagggcatattttcatttttttttccttgaggaataacctgaaactcctatgttgtcattattagcaaatcaaaattgttgatcagaatgacagaagcagtgagctgacaaatacagtcaaaagaaaataaatttggtagccatatcatatctctgcagccatcttatggctgtatgctcagtttctattatgagttttgaaccactaaaataacaaaaatagcttaaggactttcattactaactctgtgagccccaggtaggaaatacagtaagaagacaaagctaattactctttaaaaagtaattttttttggagagacagggtctcatacgttgcataggctggtctcaaactcctgggctcaagtgatcctcctgcctcagcctcccaaggtgctgggattacagccgtgagccactacgcctgcccagaaattactctcctgaggggtgtcttccaatcctggagctccccacacccaaggacatgaagcaggaacatccattctgtaacagacctgctaactcaagatgtatcactgttaaattttcaggaattttgcaagccaaatcttaactgttggtgcttgaaattggccataataggagtatttacaccacagtaatcagcatctgctataaaccagcacatcacggcacatattcacaccctgtgcagtagcttcctcatgtggtagcccacaggcagcttcaacggcatattcttaaactgatgcttcaaatctttgctcatagcagatgaaatgttcacaggtaaaagcacaattatttctcacaggctgacattaaattttaagcagcaaggccaagtgcgatgactcatgcccataatcccagctcgttgggaggccgaggcagggaggatcacttaagactaaaagttcggccaggagcggtggctcccgcctgtaatccgagcactttgggaggctgaggtgggcagatcatggggtcaggagatcgagaccatcctggctaacacagtgaaaccctgtctctactaaaaatacaaaaaattagccaggcgtggtggtgggcacctgcagtcccagctactcgggaggctgaggcaggagaatggcatgaacccaggaggcggagcttgcagtgagccgagatcgtgccactgcactccagcctgagcgagactctgtcttaaaaaaaaaaaaaaaaaaaaaaaaaaaactaaaagttcaagaccagcctgggcaacaaagtgagacctcatctctacaaaaaaaaaaaaaaaaaaaaaaatagccaggcatggtggcatgtgcctgtggtcccagcactcaggaggttgacgtggaaggatcatttgagtccaggaggttgagactgcagtgagccataatcatgcctgggcaatagcacgagaatctgtctcaaaaaaaagcaaaaaaaaaaaccccaagattttttgccttattctgcagggaagtcaggcaaatacatgctatatatgtccaaagaacaagatttcaaaggcattttcttgtctagtactgaggcatgccttgcacataaaacacagatcccacttgactggcttgggaataagccagcactgtcccacaaccaagtacctgcccagctgctggttgggctaacagggtctccctcagtgccctgttcagattctgaatggaagacagttcacttgcagctccatctgttggcctgggcaaaaagtcaggctgttcttccttgtcactctccaccagggatgaccggcagggttcactcaggactgcttcaaatttcttcatgaatttaaagagtgtcctgtccccaggtaatgacagagataagaagaaaaaaactggattagcaagtgaagacatataaaaaatacattatcatgcatccatacataatctaataccctgtaccttttatatacaatgctctccttaaatattaatagttgttttatttttaagagaaaaagtatggcaggtactgttatcctccttttctagaagagaaactaaagccagaaagaatgggattgctttgctcaaagtatacagctagtgggtggcagaagacttgagacatagcctgctttgtctcaaggcacactaatccttactgcaggtagactttgcttggagaagaagggggtggtgttgaaagcaacatcaaaacaatcaaggtgttattttttgagaagtttaacacacttaatattaagttaggttatggtaactatgtcgttttgctccctaccacacaaaattctattctattttggttgtctccagttttaaaagatggattacctgtgtgtcttttctacagattgcttaatggaccagaagctgacatcattccacttggaaatcttaacaaattcctgtaagataaatgatgttcaagaaatggctttataaagctagtgtcattctgtttctttctagatttctgttcagcaaagaccagagctcactctatcccaaacacaggactgtgtgtcagtgaacaagtaaaacaagtctaaaaaagaaaccatgggctaggcgcggtggctcacacctgtaatcccagcactttgggaggccaaggtgggcggaatcacaaggtaaggagattgagaccatcctggccaacatggtgaaaccccgtctctactaaaaatagaaaaaatagccgggcttggtggcttgcacctgtagtcccagctactcgggaggctgaggcaggagaattgcttgaacccgggaggcaaaggctgcagtgagctgagatcgtgccactgcactccagcctaggcaacagagttgagactgggtctcaaaaaacaaaaacaaaaacaacaaatgttttggtctcaaagtgatttaaaaaaaaaaaaaaaaaaagagtgctgctacagtcattaagtcacctgacatatactccagcttaggaaccaccaagttagtcatgtcccttgtaccatggttggttccacaaccactgagaatatcaaaaagagcggtccctccttcccccatggtaattcagtagtgtgtggaccaacacaacatggcatagctctgaggtgggagacaggcctgggcaagaccaggggaacacaaacagatttctgtggcagtcctctgaggaggctctgactggccactccaccaatcgctcacacactctgcaggtgacaaaagaagccaatgccaccgatgtacatattgccatcctccctagcggtggcaatgctcacctctattcccctaggtccctgcctcagtgttaaatggataacagggttaacgaaagagaatttgctgattttgtcctcccaagagtgatcatgacagctgttcatcttactttaagttctttttctaggggggaacgaagttccacaattttggcctggacccggtcaaagaattgcttgtaataatggtacaaattccatagaacactgcaaagtgaatctggaagaaatgaaaaggaaacaaaaataccacacttgctgcatgtgctactggtgccagctgtggccttcatatttcagtgatgacccttcctcattactctctatgccatgagattacagtgagtttcacaggtgcattatttagggatcctgtctgagtttagcatttcccagagatgcaggctgtcaacactcccctatttttcacttctgcttgtaacagatgtttttttgcacttttgttcttgaagatgatgtactcctaggttcttctaaaatcacaatgtcaaattccttctgtgaaacttattgtaaaatcagcagaaactgagctttttttaaaagatggcatattaagcagttcacctcaaatgctcattcatgtacaatctatactcatcttgtagtgagacttttatcccagttgctgtgatcagggatagtacttgacagcgggcagttttagatgcagttccttgatggctggcagtgctctcactggatgaaagaaactaataatggcctggatcaaggagcagcttagcaggacatttacaatgtctagacagagagatgtgctgcctcaacatggtaggtcctgagatcttcatctggcaatttacctctgccagagctcactagtcagtactaaacttataaccatctgcacctcactttgaatgttcttctctatatctaatgtgaatcgcattaaacataactaaatgtgtcttgtttaaaacctagcgtgcaacaaggcacctgtctcatgcagagaattcaaagcctaactcattttagtcgtgcaatgtcaaaggaaaggaaaaaaaaatcctcaccctttccttcaacctgtggcatcagcaagacatgacaatggaaaaccagtaacatctgaagtcgcacatggaactctcccagcgaggatccttcaataaatgcttgtaatgtgctgaccagcaacatcaaggtcatctgtttgtcatctttaaaaattcaaagagaaaaatatatatgttccttcgaccatgactccctattcctaacatgcacgcaatctatttgggatactacggatggccaagaggtagacatcacaatgtgaagctctcaagcaaggaccatggctaaattctaagctgatttaaaagtaacaggccggtgtggtggctcacgcctgtaatcccagcactctgggaggccaaggcgggcagatcatttgaggtcaggagttcaaaaccagccttgccaacatggtgaaacctcgtgtctactaaaaatacaaaaattagacaggcatggtgttgggcaccggtaatcccagctactgagaaggctgaagtaggagagtcacttgagcctgggaggcggagattgcagggagctgagatcgtaccactgtactccagcctgggcaacagagcaggactctgtctcaaaaaaaaataaaaaacaaatataaataaataaataaaagtagcagctgcacatagagcatgtgttaaatgcactcacagcaaattatgaaaatgaattataaggtgcttgtcacaagtataaaataaaagactgttcattcaagcatgttggctactacctaccaaaaagtcagctttcagtttgacttctatcatggacatagagaagacggaaaccttatcctacgactggttctctagacttttggagaagacatttaaacctctcacacttttgttattattctctcagttagataagcacgatttacagttttcttggctgacctctcagaaatatcatgaagtcaaatgggaggcattcccatgaaagccatgtagcgggagaagcgggagcaggaaaatcctacactttgcagcactccatttagccgggaagctctaagtgggcaggaaatgtactgctaggcattaccttcctgttcttctgtttgttcctgcatgtgcttctcaagcatctgatagatggagaaccagtgcttggtggatttctcggtgtggcgcttcatagtattatccaaactcatggaccagcagctgaaacgagaagaagccaaggaggcatttaggaaaacctatttgaaatatctgaaaccaaagatgcagaagctacatgctcacatttctctcctcccaaatggagatggaggagccacccagtttcctccctcaagaatatatgctgttgtctggactgtattcaggtcattttaatgccctacttttaactctgtgattaataactgaaaagcacattctgtagctgtaatactatataaatcctaaagaaatttaaactaccaaaagacaaaagcccttacaacctaagtttaggagagggaaggagagtcacttacttcagctccagtttacgccaccgaatgatcatctgactgatcaaatcaagatgtttccgcaaagacaaagctcgacttgcattttcctcccaatcctaaagaaacaaagataaaatttactacagatattattcaatgccataatcacctccttcctcaagaacatcttgaactttgcttgagtgaagactactgggcccttaaacaacttgcaccaattgtaggaatgaatttacagtgtatcagcttcaagttctttctgttcacatgacagaactccaccagagccaagtttagaggctggcaaaaaagcacagtgtttatagactggagcctgaattcgtgctctttgctatctgacctagaacaaagacatgcggcccttttctgtccaatggggaggcaacagctaacttagaggccatgagggcactgaggggaaccgtgtatgtgggcactcagttggaatgaaggcccacctggaaggctgggaggagtgcaccctcattaccggtagatactgcatcccactggataaaaggcaaggcagctagccctcaccacaggggcaacagcctcacttgcaatgatctcaccccatgccagaaaaaccaaggatgtttacctttttctagcccaaactataattttctgtctaacaacaaaggtgccacaagacgtatcttttgccaactgaccaccaactaaaatgaggaagagaggtattagctcacctgtgcctttgccagaaggatctctaagccattcaggaactttgagatgggactggaaagtgggaaactacgaattctgtccattacaaccaggagctgcagaaataaagatttgggtatctcagtaggaataccagtgatcctaagtcacagggtactgaagagagtcctgaccagaagattccccccagttctctacttttaaaacacctctgaaaaaaaaaacagagcaacatggcagcattttattatgtggtcagcaactcctgaccaacaaataaaattaacagaatccccaatcatttacacaagagaaatacaaaactggtgtgttcatcctgcagttagtaagtaacatctcattgaactgcagttctttaagcctttgtttatatgtatatatgtgcaagtgggtgcccccagggataatggtgaggctgcatcctcattgcagactcagtactgtgagcactccttcctcaacagctgccctacctgttcaagcgctgggtgttctggccagtcctgtagcaagtgactgacagcctctgagaaaccttgaagcacaggttgacactgccgtgcttctggaacattgggatgctggtagaagtcatagggcccatcaggtttcaccatcaggtctgagggtgcctccccaaaaagagtgttatgggagagggtacaggccaaaagttggctgcccaagagtcggtcattcagttcaactcctgtgaagttaacatcacggtaaagtcagtgaattcagtaagttgatctatcaacatgtcaaaaagatgtcagcaacagggccaggtgcagtggctcatgtctgtaatcccagcactttggggagccgaggcaggcagattgcttgaggccaggagtttgagaccatcctggccaacatggtgaaacctcttttctactaaaaatacaaacattagccagacatgcatgtgcctgtaatcccagcttcttgcgggcctgaggcacaagaattgcttgaacctgggaggcagagattgcagtgagctgagattgtgccactgcactccagcctgagaaacagagcatcagcaacatcagcaacaatgaactaattgggactaatgaatgctattctcccctaaagcaacattggcctagagaactgtaatcctaatactatagtagctacctaaagctctcaagtttctggaatgtgcagaggaagtcagaaactgcctaggtataaacaaatggtgtaggggttaactcagtgcatccaaattcccagtttttatacctattctaggtaaacagaaaggaaacttaaagcctccttcctacttctatgaaataatgccaagaaatcatgtaggaaactgcaatgaaccaactattaaaccatattctacaagattggttgctcccaggtatgtgttatttcatttcaaaagcactaaggctatttgacagcagaaataatgctaaggaaaaaaaaacacatacacgtacacatttaaattaagtccttgtccttattttcttaatccctcaccccaaaggatccaaacaataaaaatccatctttttcttggcccatttgtacactgatgaaaatccatcttattacagaatcctaaatcaattttcttgaatcagcttcagttctttaagccaaggaaactccaataaggaattatgcgaaaacaggaaattcatgagtgtgattgttacagagtagcaacagcatctatttgcatttgctttcatttcccaggggcataacaaaagtaaactaccatacccatcagggggtagaagtgtgtcacaagcgatgccccagtctgatagcaagacagaaacaggctgaggtaatgctttgcttcatgtggcggcagagtctgttgataccagagggatcgagcaaagttgagacacaattgctggtgtatcagcattactgcctgcattgaattctgggagaggagagctgggtttgtgcctgcttcctcttcttgcccatctgaagttcctttgttctcctccaacgttggctgcaccaaaatatctgcaaagtcctataaatagcattagagcaattgaacttttaaaaatcagaatctacttctaatcagactaaaaggaagaaagaaaaaagcataagaatgactgaaaaaatgaaataggactaatatatgtattaaaatatattttaaaagactacaggctgggcacagtggctcacacctgtaatccctgtgctttgggaggccgaggagggaggatcacttgaggtcaggagtttgagacagcctgggtgacatagtgagaccctgtctctgtaaaaaatataaaaacggcagggtgtggtagcatgcacatgcagtcacagctacttgggaggattgtttgagcccaggagtttgaggctgcagtgagctatgattgcgccactgcactccagcctgggtgatagagcaagacccagtctctaaaatacatacatacagagagagagataaagaggaagagagaaagccatcagagggaatgtatatggcatcaagggaattcattccaaaacacaccctgccatcactgctctaccttttcatgcagggggaactgttttctgaactcccgttcttcctcctcctcttcactcagggctgtcctagagttcctgctcctgtatctatacaggccgctttcctgctcagccttctcttgggctatgcgttcctgctcatcccactcactgatgatttcctgaaagtcacacagacagaaagaagctgagctttctttgctgaggcattcacaaaggcaagatttgctattaatttctcatgaaaatgaaagtatcatgactcaaaaacaaataaaagccaacatccaagaaactaaattccatggaataaagagcaaatgggttttgttttccaagtgtgtagcctcagcaaccagtttcctaaatcccccctgctgtgtcattgtaattttgaaggtgtaaaacttgccacagtacagctaatgggaacttcctgtcaagaggtaaaggtgctttgtaacaaggacagactcagggttggccatgagagggttgtggttcagacaacacctgggtggcaccccaaggagctggccaaggggttcagaaaagaaacacttagactagggactgggtggtcaaagggcaccaatcaggcaaaactggaatgtgtcttaccagacacttctgaaattccctaccacttctaagattttagatctttaaactggcaaaaattctaacttaaagaaccatccggtactgctgaggttgaggaaataagcacccaccatctaggaaggtaatttgcatgtaaagcctaagaagtgtgtttaatctttgtcccagcaatcctgatctctaaaatttgtatccaaatatatagctgtgagactatttactgtggcattgggttggtttttgtttttttttgtttttttggcaaaacagtaaaagtatatacaaatgtaaatgttcaatgataagaaaatagttaaattacttgtgtcataaacatacaatagaatacttggcagtcactaaatatgaagcaggtgaagaatacagaataacaggaaaataatcactatacatgaagtttttaaaagcaaacagagttatcaaatagaataaactttactagtggtttgttgtacattttgtagcaatttaaggacatgtctcaggggccctggtggggattagaatctaccttaaccggagcaactctttttttctgttaactatgctaagatttgtattttttaaaagctgctgctactacaaaaaaaaatttgtaagccactgggacaaatttttaataatttagagtgtcacagacatacagctacagataaatattaatatatatacacatacaagcaagcctggaatgggatacctggtatgttagcagcgtttatacagctttaagtggtaggatcattagaaattttagtattctcttaattgcatacaatgagagcaaattacttttattaataagggaacatcttaatgcaagttgacataagtacctggcaaaattaccaaaaaggcaaaagacaactgacaaactgggagaaaacacatgtagtgtataataaaggccgctctcatttttttttaatctcttaaaaattgagaggcaaaggtccccaaacatgatagttaaatagggaaaaagaaggaacagaaaacaaaatgcccacgccccaacgacactgtgtatctactaggcatgctaatgtcctgcaggccgccctgctgtgaacctggctctctgcaggaggaagggcagggcaggcctcccagagatggctcacctgacacacatgtctgaagagctgcagggccctctggtccaactctcccttgcataacacgtgggagcgcaggtaaaggagagcattcatcagcagctgctcccgagtgggacaggctttctggcccttgccttccagctcctttcctcctgagcgcttgaggattagcttcccaaggcctcgtagaacctcctcagacttcaccgagcacaaagtgtctgcatgagcatagtaagtcgggaaggtggggcccaccgatgggaaagccagcaaggctgtggccagggtccccagcctgtctgcaccaaccatactgctgtggagtgaggtgtggagctcagaggccaccagcctcatgccatgttgtaactgcaatatggatgcctgcagtgggctcacggcatctggatagaaggtgtactcctctgacagccgcttccggaactggtggtgtgactgctgccaagaggcctcctcctttagaaggctctgggctacttgggcagaccgtggcccatctatgtggagggcctgcagaagccgtgtgagcagatcctgaacagcaggggccttggcgatgctggtgacgtagtggtggatctcctgaaccagggactcgtaggcaggcagctggggtctaaaggcctgtttcttcaacaggtgacaggttaaattatccagccgatccatcctttggcgaagcagcctaacgggaaattaacacaatatgccaattatgtcagaagaagagcagcaaatctagattggatcctcagctaggaaaaccgaaggaagaaacatcagctgctgcgaaataatatttccaatatcatctcagttgtgataatactgacaattagttaatgaaaatggataacatttacacagcagttactgtgtcatgtatgttgctggtgctcagatgcatatcttactgaagcctcatcatgactcactggagtagataactacaattacccttcttatgctgatatggacactgagatgtaagccattaagtgatctacccaatgtctaaaaccaaaggtcaggagtaggactggaactcagaacctactacactatacaggctgagcatcccaaatccaaatatccaaaatgctcccaactttttgactgccagacaatatgacacttaaagaaaatgctcattaaagtattctggattccagattttcagatccgggatgctcaactggtataaatattccaaaatctgaagaaaaaaaacgaaccccaaatccaaaacacttctggtcccaggaattttggataagggatccccaacccgtaccatatttcctagtaacacacctacagccaagaatagcagagaaatatagtgcatactatcacaccccacttcttctatgctgagactaagttttggcttcaaacatcttggccccatgtgaacacacaccttgaatagcccccctctcctcctttcacaaggcatattatttttcctgactataaacaatgctttggcatctaattgctaatgtagtttagaggtgtatattatcacttctactcacaccataactacattacatcaaaaggagagtcaataatccccaaaacaaataatcactctgctgtgttacctgacgtgaggatgagagtagctgacaacgacttcatcttccaggtctcttccagtctgcagctgggatgacaggttccgggtcttccattcacactgcagttggtgtaactaatggaaaagagagaagttagtccactgtgtcccagctatgaccatgcacatgaggacaatgtcctggggacacgtagaggaacaagatggaaggaatctgggttcctgaatgacccaaggagaggtggctctgctccattaatctacaccactcacatcagagctgtgaggggaaagaaacgatcttatttacaccactgaattttttagtctctctgctataggagcttagccttcactccaactaatataattttccttcttcaaaatatgtactaacataccatcatcttaatgtatttagttcctgaacttggttcaaaacttcaaatagcaagggataccacattacccaaatcaacttgactcttttttaagacaaggtctcggctctgtagcctggctggagtgcagtggtgcagtcatggctcaccgcaggcttgaccccgcaggctcaagtgatcctcctgcttcagcctcgtgagtagctggtattacaagcacatgccaccacacccagctttttttttttttcctttttttgtagagacaggaatcttactatgtggtggcccaggttagtctcaaactcctgggctcaactgctcctcccacttcagcccctcaaagtgctgagattacagggtgaggccaccacacccagcctctacttgattcttgagttttagatagcaagcaccaataagttaaaaattcctaggatatagggatactatattctatctaaagaaatatccaaatccaggctggccatggtagttcatgcctataatcccagcactttgggaggccaaggcgggtggatcacttgaggtcagaattcaagaccagcctggccaagatggtgaaaccctgtctctactaaaaatacaaaaattagccaggcgtggtagcgggttcctgtaatcccagctactcgggaggctgaggcagagaattgcttgaacccaggaggcagaggttgcagtgagccgagattgtgccactgcactcctgcctggacgagaaagcaaggctccatctcaaaaacaaacaaacaaacaaaaacccaaatatccaaaactaagctcaggtagagagagtccagagacagtgagaggtaccactatttctgacaatggctcaggttttctacctgccctctgcccattgcacctattggcagagatctcagaaccttaggaagggctcctcccagagcatgagtatagtcaggacaactctcaaaggggaaaatacagtctctaaaacagactcctgggaagtcataaggcaacttatgcaatatcatgcttgtgatgatctgagcacccaaaagggaataaaaggagtaatacaataagcaaacccagcacgtcagggaaggagcccatgctccatactcttgcctcccatacctcttccttgacgtaattgagcttgtactccctcttcaccgcagggtcaaagcgtgcctggggaagccatgtctgaatctggagcaagccgaggctcacccagaggctcccacgctgggctggctcaggcaggctcctcttactctccccttcaccaacaaagtggtgcagggaggtgagcaactggcagagcagttccttgggcagcacctcctgaccagccatgtccccaagtgtctggcccacatgctggaaggcctggctgctcccaagcagcagctgctcacagttctgcatgtactcctgccgccgggactctgggagcagctctgctaggcctgccaggtgccggaacagcacctgcccctggagttgggaatccgtgcgtctgtggggacaaaaagaaagcactgaaaggtttgtactgtatcaaaaagcattccttttcatacagtataattctctcaagaaatgataaccacagaatgcagcatcaatatgtagaggtgaatttctgttctcacatggtcttatttggtttactaagttcaccctcttgatcacaatatgcttaaaactgacatgggaaccagccagctcacggtagcctgaaaacatgctgattcaggcagaaaataccctcacttcaaacaccagaactagccactacagaaggaagttctcactgggtctctgctccatgctgtggagaaaagacaggaactttacagtctgcttccagggcgagggaatacctgaattctgctactgaagagatagccatgttagtccaaagcatcgaactgatgtcctggagctgctgagttctctcaacccactctcctagggtcacgtgagaggaggaaagaatggggaggccactcacatcccagggacttgctctccagctgctggttaagacttcaaagcagcacttagagaatatgggtctattgagattgccggggccctaaaggacaagagaagagtcaataacttttagaaattaagacaatttccagaagcagcattagggaacctgagaggaaagaaacagacagttcaggttgcttggaacaggtaagcatcactcagagactggcctagaaggacagaacaggttagtataccttaaatgaaagtggactccatgctctaggaaatgagcaatggatgctttagtaatgcatgaggaaagcccgcaaacctgggaatcagagagcacattcttgcagaagggaaagaaacacactgcaggaggataagagccaactcagggtgcaaggaaaggagtgagagacagatgtaagagccagggacaaaatatgccatgtctgtgctccttagactgttagatgggacacagtaatagctgtccacagcaaagggttgtcaaagggtgacagccaaatgtgtgtgatagtcaactctgtataatgccatacaaccctcagggatccaaagtttatcactaaaggctttgaggggtgttttacaataaatccattttgatagtgcaaaagaatggaatagagttcaggtaaatccaaaaacatttggggcaataaggcatttcacatgagagtggaaaggaggaattagtcaaaatgatgttattacatcgcttttggatctgtttgtataaaagaaaaaatttgcatccctatatcataaaacaacatatactgatgaaatagatttgaacataaaataaaaatataggagaaaataatggaaaatagttttgaactcgaagtgatggaggaagaaattttttaaaagcatgacactaaagtcaataagtagaagggactggcatatttggagggaaaaaaattataaaacttgtgacatataagaaaacaaacttgagagatgacagaaaactagaaatatacttccaactcatattgggcaaaggcttaatatccataatacataaaaagatcttcaataataaactgacgctgaacaaccctatttttttttttttttgagacagggtctcactgtgtaacccagactggagtgcaatggcacgatcttggctcactgcaacctctgcctcccaggcccaagcgattctcctgactcagcctcccaagtagctgggattcaggcgcacaccactactgcccagctaatttttgtatttttggtagagacagggtttcaccatgttggccaggctggtcttgaactcctgacctcaaatgatccacccacctcagcctcccaaagtgctaggattacaggcgtgagctacagcgcctgaccaacacaattttttttaaaaaaaagcacaactatgactcgaaaattcagagaagaactaaaggggatcagtaaacgtgaaaatatgttcaatcttcacacttatcaaagaagtgcaaatgagttctttttaactatatgacagaaacaattgaaaatgtttataacagctagtgtagcaagcagatgaacaggtcctcatctccatgttaaaggaaactaaacctcactgtggtcatctaagacttcaggacttccctcttcactggctcttcacatctttaaaaaagtgaaaagcaaaaaccacatttccagtctggcaataaccataattttgtttttaatgtgtagacactctgaccaaggattcaattctaattctaacaacttatgcatagaaatgctccaacaagtggacaaagatgtatactaggatagtcaatgtggcatgcttattataggaagagggagaaaatgcaagaaacttcaacactttatcggtaagaaagtgattaaaataaattcaagcacattgatacaatggaataacttttaaaaataagctggaatgacatacacatttctgttacatatatgtgtacttaattcttgtttacgtatgtatttaatataaaaatatatgtaaacagaaggatatagaacagagtggatatttctaatgaattctgtattatatatacatatatctgcactgtttaaatgttttatagtgggaaaaatgttttaattagaaaaaatagactttttcaataaaaccttttttgacttatctcaaaatttcacaaattatttaacatggtatacttttactgacagtacacttatttaacattctgcagaaagtaaagtgttgcaatcacctgtttagtcaccactctatgctaggaataaatgtttattgatagatccattcagaaactcttttgccactatcaaacattttttataattttagaccaacaaaccttcaatgtggagtccaaaacagacttgggtgcctccctctgctgcataccaggcaaagggttccacattagccagtactctggatttgtggtcacagtactgctccagaaagacataaacatggaattaaataactcggaccacaaagatgtaatttcttcaggagacacctagaaataaaggaataattaggtaagagaatacctgagaaagactccataaattattaggtcttctttcttctaaggcccatctaaaactgtcataagtttaaaggtattaatccaaatttttccgtttctctgccaccccagtcaacttggtcaaggaatgtgacatgtttacagttttatttaaagctgtactaatgaaattctattaacaggagtgtaccagtattcatattcaatttattagagaggaaaagtacaaaaaagtataaaaaacactctcacaatatatttttgagcaattgggagattttaagcagcaaatattttcatctcatttaattggaaaccaaatgaatactcctgtgataagagttgtaatataccctcataattactataaaagaatatttaaaattcttccctttaagaggcaattcaaaaaaacctgaggtttccaatatggaattttgagaataaataaaatgtttcccaaccagtctgtcaaagaaaatctaaccaactcataatgtaaaggaggcttatgtcttattgtgatttttaccttctgatgatgcagcaaggaccacagatctcgaagctcttgaggtgtaacaggtgtgtgataaagacaaaatgagatgaggtgacttatctcctcatttatctggggttgttgatttttgctgcatctgttccaaaaataaagagggagagggtggggtatggactatcaatgaactactggaaagctgctacattagggaaggtgtaacataaaacttacagtacatttatctaaaaatgaacaactctactgataaaattctcggtgacttttaaagtagagtcaaaactagtaaaaaaaaaaccttcaataaattttggctttccaaagtggcaaatcacttccctctgcttcggtaaccatccctatcaagtctgtggtttgtttatgggtataggatacacagaataatcaagaaaaaaagttcccgcaaggaaaacaactgaaagcatggtttaccttctgagacaagcttgtgccataaaatcagctgtcactttgtaccgccaaagcatagccaggtactccattgcaggccacaactgaacactcctggtgaggtggattacggaggtcaagtctggatgggacagggaggaagcttcatcatgctttttctccagaaaaccaagtgagagtcctttggctttcagttctaaacactgagcatgcacaaaattcttcaattcatctggacaaaaagacaaatgttgtatgagagcacaatggttaagagtatagcctctagattctcaacaacctgctatgtgactgcaagcttaacttgagctaatcagagttaagctccttaacctaagctttgagattctcatctgtgaaatgatattaatacccacatgattctgatggaattaaaaatatatgtgaaatttagtcctatgcctgacacttatataaaggtatataaactctacccctcacatcacccagaaaagaaaaatctaagggaaaacttattaactaccagcaagaggatattttcagagcatctgtcagctagccaagtgctagaatattttacctaggctgacatcttccaaaatatttgctctgaggatcagtccccaggcttgcaggagacttttctttaatgtccactgagaagcaaccacttggagacggttaatgtcttcctgccatccactctccccaagggcagacatctgctccctgatggcaaggactttgttaaggaccttcagttgtgaaaaacactccaccaccagcttgtcctgaaacaacaacacccacaagagcatactatagagcacaaatgtggttttctttagtagcctatacaggtctcagaataaatttatgatatattcttaatgtttccagaaaacaaaggacttgtttatttctgttgctgtcaagagattttacagtggtaataaagttaactctctacccagccttaacagtctcaggaataagtaagatgataatatgtagcaaattactaaacaggattcatgggatagagcctgccctcttgttatgtgcgggttccgcatcaattcaaccaaccgtgggtcgaaaatattcagggggaaaaatggatggttgcgtctgtgctgaacgcataaggacttttttatcttgtcattattacctaagcaatacagtataatcactatttacacagcgtttatattgtatgaggtactgtaagtaatttagagatgatataaagggtacataggttatatacacacacaacgccattttatataaaagtcttggactttcctggaggtttgtatccaaggagaatcctggaaccaatcacccccagatgccaaaggaaaactgcaagagttatgctttcaagacaaggattaatcttatacaatgtcagttcccaagttccaaaaggacttcagaagtagtagtcacatttcttttatttactaaatgcttccaggtgtaccttaaaaggaaacggtcgtcccaggaacttctgcaacttctttataccagcgaagccaccagtctggctccccagacaattctgaatatgttctgagacagtctgaacttctttgtaatatctttaaaggagaacaagggcacaggggaaataaggaaagggggaaatgctagacagtaagagaagccattaatattttctttctttctttcttttaattgtacattcaccaatatgccaagggaataaaccaaaataaagcaagaagaaacagtttcggttccaaatcttatccttaacatctatctgtaatcattgacattattactctaaatatgaatcttacttgtcttcataattcatcagaagtcgggggatctggtggaccagatgttttaaaacccagtgccaatggagggcaagaagggccagacctggggcatctacttttactgtgtcggccacagtccagaaccggtcccgccaccgcagagaacctaagatctaaaaacaaagtctcttagataagatggcatgaagaaagactaaagcaagaagaaaaataaaaacaaagtgaaccaagactgctcaccaacatctcccgggaaaagacacacaacataggctataattgctaatcaatgctcaatttacatacaccaaaagtctaagactggactggaatatatgtaggaacagtaaggcagacagaggaggtgaagatcttttctcttagtatttgaagcatgaagttattagagaaaatggaattgctgggtcaaagtatagattttatgagaaactactaactgtattccaaagcagctgtaccattttgtactccgaccagaagtgtagaagagtttcagttgtttcatttctttgccaatacttgctgttaatgattttaactttagttttaattttaattctattctggtggatggtaccgcactgcggtttcaagttacatttctttgataactgatgacactgcaatttttaaagttcttactgggcattcatagaacttccaagaagatattctattcagatgtcttgctcattttaaaaactaggttgtattatagctagtttatggaatttatgtgttttgttagcagtttttcccagtatattcattctctcacagtatgttcataaaggtatctatgaagaatagaagttttaaattttgatgaaatcaatttatcaattttttttcatttagaaagaatcctaaaaaatctttgcctatatttagattgtaaagatcttctcctacgttttcttttagccagctcatagtgtcagttctatttttaaaggtttcatccatgttgaggtaactacatataatgtgaggtaggggtaaaggccctttttttttttttttgagacagcgtcttgctccatcgccaaggctagagtgcaatggcgcaatctcagctcactgcaacctccgcttcccaggttcaagtgatctcctgcctcagcctcctgagtagctgggattacaggcgcctgccaccacacccagctaattgttttgtatttttagtagagatggggtttcaccatgttagccagcctggtctcgaactcctaacctcaggtgatccacccacctcggcctcccaaagtacttaggattataggcatgagccactgtgcctggctaggctcattttactttatataaacatctaattcttccatcaccatttactgaatagaccattttttgccattaaattacctttgcatatttaacaaaaaacaaaacaaaaataactgaccatgtatggggaaggggggggggtctatctgtgaatcctctgttttattggtttaaatgtctattcttaagacaataccatacggttttgtttaatacagggttgcaatgcaaatcaggtaatatgagtctccaacatggctctttgaataatgcattttcacagtaacattgtttctagattagtgatttcctatagtggttccatgaagtcaaagctattttcataatatcatgttatttgccattttcactatgatgacatttacactaatagtacaaaaaaagaaggactggcaggcaaattatgactatctgacagacactgtattgaaaatcaatgtgaacctgtcacttcaagaaaaacaattgagaggccaggtgcggtggttcatacctgtaatccagcattatgggaggctgaggcaggcagatcatctgaggtaaggagttccagaacagcctggccaacatggtgaaaccctatctccactaaaaatacaaaaaattagctgagcgtggtggcacgcgcctgtaatcccagctacttgggaggctgaagcaggagaatcacttgaaaccagcaggcagaggttgcagtgagcaaagatggcaccactgcactccagtctgggcaacaagagagaaactccgtctcaaaaaaaaaaaaaaaaaaaattgaggatatatgttgccatgataaaatttcagcttttaagcaaaacttagaattctgaaaaactggccaggaacagtggctcatgcctgtaatcccagcatttacggaggttgacgcaggtggatcacctgaggtcaggagttcaagaccagcctgaccaacatggtgaaaccccgtctccactaaaaatacaaaaattacctgggtgtggtggcacgtgcctgtagtcctggctactcaggaggctgaggcaggagaattgcttcaacctaggaggcggaggttggcaatgagctgagatcacgccattgcattccagcatgggcgacagagcgagactctgtctcaaaaaaaattctggaaaacagagtttgatgacttcctggtaacgatttttctgaagagatttgtgatttttcacaagtgtgactttttacttatttatattgaagaatgaaatgtgccaactcagtgaacagtattttccaagttaccagtgcacgagctataaactaatgcagggtcaaagtctatccaaggtgcaaactaggccaatgaattttctttttttagatggagtgttgctctgtcccccaggctggagtgcaatggcacgatctcgactcactgcaacttctgcctcctgggttcaagcgattctcctgcctctcgagtagctgggactacaggcgcccgccaccatgcctggctaattttttgtatttttagtagagatggggtttcaccgtgttagccaggatggccttgatctcctgacctcgtgatccgcccacctcagcctcccaaagtcctggggttagaggcgtgagccaccgcacctggccgtggccaatgaattttaacacaagaagttcactgattatttgctcagattttccattgcaaataacccttacaaaactacttgtcatttttggtgtgccatcaaataagaatatttgaaattatatgaaatggttactaaaatattcctctcctttccaacctcctaactataggaggccagtttttcttcataaactttatcccaaacaacatactacaagaatccatcttttcacaagccagacatacagagacttgcaggaatgtacaacagttccacatttctcaaattttactttagaaattgctattttttattgaaaataagttattcatattaacgtgaaattctttgctactgtatttttaagcaaatttatgggttttttttatgtttttcagattcagttcttaatatgtaaaaactgacagatataacatcgttggagtttttgagaacctttaagagtatagaggcagagatcaaaaagtttaagactggctgctctactttactagacttactagaataatctggattaaaaattccatttaatccacatgtgacaataatgtctaagaggacttaagtggattaaaatataactgttacaatctaacaacaggtgagcgaataaaaaaactgtagtagatccacacaatggaatactactcagcaataaagaggaatgaactactgatacatgaaaccacatggatgcatctccaaatcacaatgctgagtgaaagaatataaacaaaaaagtatatatactgcataattccacgtatagaaaatacaactgatccacagtaagagagcagatcaatggctacctcgttgtgggtgggagcaggaaagaagaaaatacaaaaagggaatgaggaaacctttgggggtgatggatatgttcattatcttgactgtgataatggtttcacaggtgtatacatgtcaagacttatacactttaaatatatgcagtttataatatgtaaattataccccaatgaagattttaaatatgtgtataggtatatttaaaactgttaagaataagtttcttaaataatattgggcatataacaacactaaagttagtcttagccctaagaatctttatgccaagaaagataaattttgttgtttaaaaataaaacaagatgcagttccttacctcattggcactggcatcagacaccattccctgggaggactgtacccagagcaggactagtgcatcacaaagttcaaaaaaagcagcaagattgaccacaatttcatggggcagagtgtgatagctttctggatctgagagtcaacataaataaaatgagaacatttcatcagatttaaaataatctctggacattttcaaaataaactgtaatctagaatttaaatgttatccccagtacaaaggtcaattttgagagcaaaagcaaaagcaaattctttgcctactacaggttgagtgtctcttatctgcaatgcttagaatcagaagtctttcagattttcaattttttttttttgattttggaaatctttgcatatacataatgaggtatcttggggaaacacatagtccaaattttctattttacaatgtttttaataattttgtgcatgaaacaaagtttggactgcattttgactatggctcatcatatgaggtcaggtataaaattttccatttgtggcatcatgtcagtgctcaaaaagttcctgattttggagcatttcagatttcaaattttcatattagggatgttcaatctgtattattaaactctgcaaatgaggcatgtatacctacagatgtaaataatgtctcacggaaaaatgcagattataaagaaaaaaatgtatattttatacaagtatttaagtataaaatgaaaactaagtacatatgtttagatagatagttaataccaatagatatgagaaaacataaatgaaactattactaacagtagctgatgtaaagatgaactttttcaatttttatactttaatagtttgaattttttccaacaagcacaactatcttttcaattaacaaaaaaaaaacatgggagaaatgctccctcctataataaatgcttatgaatatgtactttttcagctgacagacctagttttcaagtggctctgttacttgctagagacgtgaccttgagcatctccgtgtctccgtttcctcactaacaacatggggacctatatcacaggtggctacaaaaagtaaatgagatcaaggacacataaaaagcatttagctaagcacctggcacaaagtaagtgctcagtaaatgttagtcattactattgagtaaggggacatgtttaaaatcaggccagcagattaaaagaaaccagtaaacaacagcagctgctgaatatgcctctcaactttagcaacattatgcaatcagatgcttaattagagaacacaaaaggtaaatgttcttaccttgatggaattcaaaggacattctcaaaacactctctcttagctttttgctaccaacagaaaccaaatttgcttcagtaaaaacccgtttttcccggtcaagatatatgattgtcctggaatgagattcaaaaaacgtaacaaatagctatcggttaataacattttcaatcatatcctctatttgctggaacacttggaacatcagggtccttcatcctgccattcctctcctgcctctgcaaatcttggactaaagagatggagatgaaagtgacaactactaaggtgaaaggaaagatcgatggatggagaaagctgggtctaggcagactcccaggccttggtctgtcacgatctgacaaactgcaccgtgaactcttcaaagtggccatggtagaaatggaggagttggtggagcagaggagtagggggctggtagcttgcaaggcaccctctgaggtacacactatacttgtggattcactttgaaaattaagtaaattcatatgtgagtgtgtacataagtatggaggtgctattatgtctccaacatttgaggacaggaaatgatgtggacagagagattgctgaggaagagacaagtaaaaacaagtaggtgaaaatgggaggagctgctgggaatcaaacaaaaaccaggctgggcacagtggctcacacctataaccccggcactttgggagaatgaggcaggtggatcacttgagcttagaagtttaagaccagtctgggcaacatggcaaaaccctgtctctacaaaaaagtacaaaaattagccaggtgtggtggtatgtacctgtagtcccaggtacttgggaggctgaggtgggaggatggcttaaggccaggaggcagaggttgcagtgatccaagattatgccactgcactccagcctcagtgacagagctagaccctgtctcaaaagcaaaacaaaaaacagaaaacagtagaaaatatgattatcgtatgataaaggcaatcatgtccaacaccccacaacttctcaggttcacaaaattcaacacacataagctatttgacagattcttaggaaaggtataatccgagaagccagtgaggcaaacagtgcccagagcagcaggtttcacttacttgtttgcagctgattctaaaagggcaaagagctggtcaggctggtccgtttgtgggtcaaagtccatcaaatttctaatcatgtccagagcctgcatattccatcggggatccagagggatcacaaattcatctagtttaaaaacagaacaaaacaaaaatcagaaatattggagaaactccttgcctgggaagtttcagttgaatattttcattgttttactttgagcacattgaatcatgatggggaagaggttgaaccagtaaataccatgagtttcatcccataatactagaatagcagggtttaatagcttttacactctatctttaccaaatgcaaagtatctgtatgtcctgaaagttcatcccaatgcaggatataaaggtaatccctactagaatacaacattccaaccaatgaattcacttcctgagatcacactaatccatgggctaaattacacagtggtcaccattagcttaaaaaaaaaaaaaaatacgtacatggcagaaaatgaataaatacacctcactatctgttttcattaagaaaacaatgcagttttttaaacttaaaaacaaattctctataatcagaatgtggctgctgctgccccacaatcctctggctcacacctgacacaacttctgtgaagcagcaggaggagactgacattctccagaagttgtgaaaacccaaggaagggaggcaagacacaaaaaagggtaacattaatttgaaggtggctggcaggacggttcagtggagcactttaagttttaaaagcatccaccatatagtagactacccagactacccaggacatactgtgaacagcaggtacattaaggagggaacccatattccaacactcagtaagataaaagggctacaaaactgaaaaggacagttggagctaatgtgttccaacagaggacaagcgatgcctgctgaaaatgaaagctgctactgtagaactgtgtttgtaaaagttacaatcctctcatagtggaaagccatgccttagttcagccacaacttgactagcaaagtatttttctctattgtttgatttcttcccattcactccatgatctttagtgcacataaaggaattatttagcacaaaagcatcatgcatattttcttctaaaccaaatggccagtggtatattttgatcaacatcaaatgaagatggaggtagaaaattttaaatctggtgttgtgaaaatgcccattttcttcattaatgcttgtgccaatcaagttaatattactctgttctaggaaatgtttattctctcactccttatttaaaaaaaattaatcttgaatacttcctttgatcagatatcttagatgtctatttctgttatcactatggttttataacttcgtcatcaaggttttctcagagacagggtctggctctgttgcccaggctagaatgcagtcagtggcactatcacagctcactgcagcctcaaactcctggacttacacaatcctcctctctcaacctcccaggtagctggaccacaggtacaagtcaccgcatctatcattaaaggtttatattttcctaaattaaatgaccctgtgtaactttcctttaagtcaaatatctcgtggtttgaaactcttcctactaacgatactggtagacaacacaaagctaagggtggaaggcacctcagagaaataagagcttaattcccctagtttctaaacacaggcagagacagtgaatgatgagccaaaaatctaccaagccagtttgtggcagagttggtaccagggcctagtgttccaactcctagattctttttactccatggcatatcatcagcctccttcagaagctggaggataaatggatagtttcaggccaagcatggtggctcaagcctctagtcccaacagtttgggagaccaaagcaagaggattgtttgaggccagaatatcaagaagaccctgggcaacttagtaagaccctgtccctttaaaaaaaaaaaaaagaaatttcaaaaaaaaagaaggagaatttgcttctgcatatcatgagtcttctaaaaaataccgttatgttgagacctctaacaggtcagatcttttccccataaagtcaaaagataagtttccaaaacagtgctgagagctagaaatcaaaagtgcatacctgttgtatttggttgtaatattttgaaaacattactgactgcacctgagagggaatgtgagtaaaaattcctgagagatgcagcactggcttccaaatgaatttgtatggactctgtggaggaaggagaaaccagtgttagactctaaagcagtgctatccaattgaacgttctgcagtgatgaaaatgttctacagctgcatagaataaccactagtcacatatgaggacctgaaatgtggccagtgcaactaaaggactggattttttatttttttaaatctaatctacatttacattttagtagccctctctggctggctagtggctatcatataggacaatacagataaaaatatttataaaaattctctacatatatttagacagatgaccacatgtgttacaaaatattataaacatccatgggcttattgacaaattctcatgaagtagaaaggctcatgtaaactcaattacttaatctccaccaacaaattccatgttctgtactttacaattcaagcaatgttgttattgttgctttgtcctctcttaaaacgaaagaactacaaagaaagtacaggtggccctccatatctgagggttccacatctgtggaattcaaccaactacagatcaaaaatattcaaaaatttaaaaaaacaaaaaataaaaatacaacaaaaataatataaattttaaaacaacgtactacaacaactatttacatagcatttacattgtattaggtattataagtaatccagagatgatttaatgcatacaggaggatgtgtgtagggtatatgaaaatactatcccattttatataaggggccttagcgtccacgtatgttgatgtccctgggtgggggagggagagtccttgtatcaatcccccacagataccaagggacaactccaagtgtgacaacatggagcactggaactaaaataagattagaatcttatatacttttagaggaaatgcatttatcaaaactaatacctttcccatatagaatggttctgtagcagtagtacagcacaaaaagcagatgttcaaaactaaaaagtaaaataatacagtatgctttccttttgaatttgttaggaaggtgactatatcctgaaatgctaaggataacatggaaacaaaagtttatcttgtgacacatctacaggcagacttgctccttaacagtaatgctagaccacaaatttcttcctaggagacctcccaactgtaattttaacagtgtagtcacagattaacacagctgctgaggcacttaaatagcataagtgtatataaatcacatcagtggacaaattaagctgttctactcaccaagcccctgcggtatattcttggctaaatgataaagccatttaactctgagcatccaatcctgattggttgctctttctatgagcaatttaacagccatgaccaaaacatctggttcatcgatccagtaagtattcacttcgactgcattgaatttcaggttctcagggctgggggactgcataattttctctaagtcttgcaaggtaaaaggctgactcctgaaattcatttgaatgaacaaactcagtactagaataaccttttatttcacattccaaataactgagaaaacctctttcacaaatattggatcaaaggtaagagagaaaaggagagtctcccacagaggaagaaagttaaaacatacctaataaataatcaatagggagcaatatcacaatgaacaataaaactatgacagctacacaataaatggccacagaatgctccagttaaatatattgtgtcctgaccatttccagcaaaaataaaaaccagccaagaaaccagagacacaagctgaaggctccactgaccttgtccagctgctggttttcatgctcatcctgttgagacaatatactaagatctgtccatctcttcggactgtagacaggtgtgaatcttcagtagcaaagagagctgagggcacagaatctggccacagtcccatgccaagaatggagtctccccaggtttcatgtgctcgcaaagaagaaacatgtttctccagtaaagcctgtacaagctggtaggagacaaaaacacaatacagtggtaccaacataaaagtgatattccccaaaaaccagcaaagtaataatagtccatgcgaccacctcacaacaacttttaatacactcttcaatgaaaaacacaagtcaaattctacttttcctgatgacatgtaagtttaaaaaaaaaaaaaaaggaatatttacattcaagctattttccagaaaagtacctggataccagatctctattagagcaaactgcagtggtcaactctcttaggtcactgggttgccacctttaaaaataatttcctcgtactcaagaatgtagggtattacaacttagaaacattctgcaatacttcatagtaccttccggtttgctggtgaatgctgggaacagacatatacttcccagcatgcttcagaaaaggctctgtctaaactcagccctcgctgcaggtactggacaattagtatggctgtctggattagagttgatacagaagatgttggagaacctattaaaaaaaaattgccatctataaacaatagagtctttaaaatctccaatgaaaatggataaattctgccctcccatcaaacctccttcctgtcaaccccacccaaatacttactttacaaaacattccaagtagactctagagtcctccgagggcacaaaggacctgtaggaacctttgtattcctatctcccctgtttctctatggctgtctgtagtttattatgggggactcatttatagatgtgataaagtctggtcacatatatccttaatctaatgctgacacacactgaaggtggcaagttgagtgtaacctcataaaagaccatgggatttgaaatccaacaggcctatttgcaaattccagctgttattattaactgataaattactcaaactctctgagtcttatctgaaaaatgaaaacatatgccttgcagaactaatgtaaagattaaataaacagctgggcatggtggctcacgcttgtaatcccagcactttgggaggcctaggtgggcggatcacgaggtcaggagattgagaccacagtgaaaccctgtctctactaaaaataaaaaaaaaattagccgggcgtggtggcaggtgcctgtagtcccagctactcggagaggctgaggcagaagaatggcatgaacctgggaggcggagcttgcagtgagccaagatcacgccactgcagtccagcctgggcgacagagtgagactctgtctcaaaaaaaaagaaaaaaaaaaaaagattaaataaacaatctgcatggtacctaacacagagtagttatccaacaagcaatacttcatttattatcttgttcctttttgtgtaattgaaagtttagaaaaagtaacacctgtctgctttaaacaactcaaagtttcctctttattccaacttcaagaggctgttgatgaccctggagaaatgatgggcaaacttcataaacctcagtgcgtaaagtggaattactcgagggttagcctctgcttacttgcatcagaatgacataagaagcgtctttcagatactgattcctgtgccttgccctgccctgctgaacccaatctcttggggtgtctggaaatccacatttttaacaagctttcctgataatttctatatacactaaatgtacgaaatctttgatgagcagtccaatggaatgacataaatttcttgaagactaaaactctgcaaaggcccaaaagtcaagcacctcacctacaacagtgctccgggtctctgtgtgtaaagccaagaggatgtcacatacactgttccccaccaatccaaggctgtgcagcagaactttcaaatccaggttgtctggggtgcttgcatccccttcccctgaaatgtagatttcaagtccacgattcctcatagctcgggatatatctccatgaacaggatccatcgagaggaaaagtctagaaaaatagcaattcaaagaaaaaaatgattttaaatcccagtgcaaccaaaggtgtagctcagcatcagtcagtgagggcaaatcctatgtggctcattgtcacagaattcacaccaaggatcttttacttctagcatgcatcaatatagcaaaagattttctctaaacctactttcctaaggaactgtgtatgatatatccagtgtacctttagtgctgagaactttaaaaatttaaccttcagatattccccagagtaggctgtactaattcattattctaactcacctacagacagcagaacaggaagcaagtgtagtctcctgaaacaactggattcatatattgaatgcccatcaacatctccatctagttatcttacacctctgatgtatgtctgaaagtaaacagctgattcccggtagaccctccccacattaaacctgctcctttaccagtcttccctttctcaatgaatggcaaccccatttacccagttactcaagccaaaaacataggtgtcatccttgattcttctttttctcaacccacatgtccatcagcaaaccaacccatctgaccaccctcatctaagccactgtgatgtgttgcctaaattactgcaaaaggatcatgactggtatctctgcttcccaccttcgtcaccaatgcaaggcaaggaccttgcccctcttgtttatgctgtgtttccagagcccagcaatgcctggcaaatagtaaagcctcagtaagtatttgttaagtgaattaataaatgggtgaacttctccatgattcagtttataaataaaatatataaggaagtcctactgaacgtctacctctgctactgaggctgtcagattctgaggcagaaatgtaagagatacaaatacctgaaattgggatttggtgttatcgtgggagtggatccatctatcattcctctctcactaatagtgaggacacctccgggttcaagcaaagcattcaaacgatccaacactgatgggctgcagagacagaattcagatggtggataggctgacatgctgcattgactcttctttccttccatgcacggggctccaaatgcttttgactcacatttcctttcggcacaatcattcacccagatacaacagtgatctctttcaaaagtagattccccattgattttccttctcgcttccctaggcacatagcccagggccttatacacagtaaatacacaagatatttttgaataaatgaaattaaagaaaatgataagttccttgcactataaccttttcactttttcctttcctgccccccatccctcaacattatcaaatccatttaaggcagctggatttcaatttgtaacattcagataaatgctccgtgaagaaatagtcatcatctaacttgtagtagcttctatgttaactgtatatgtacaatagtttcacacttgtcctttaccttactgcaagatcaagaatgatacatggttgaattgctgcatcactgatggccatttaataaatgcctgccctgtgtcagaccctgcattagaaaaaactgcactgaagaaaccctaacaaaaggaagacttctgatattaaattaaaaggcctaactcaaaggacattgccaggaaaaataatccaattttgttagcctttgctttggctgaaaattatcatacagagctgaaatcttataactgtctgatgacgaattaccactgttcaccacagggagaagtctacagaatatggctgaggacgcttgcgtaattaagaaaaacagtagcttcaaaataccagcacttctatctgggtttctactttgacaagcatatcccaaatttcaagttggaccactgattaggcataaggttcttacttgcagaagttaacattgtccatcagaagccagtctccagacttcagggcctgaaccaacatgctgtcaacccattcaaatgtgccatggctatggccactggccaactgcgtaagcttcacaccaaagcttcggaactcttcaacaagtttggcaaactctgaaatgtcacagggaagaatcaccatccacagcacttaacttcaaacaaagaattaagtttatgaaaaggaagcttgatacttctagccaaggtttttaagatttcataaaagaataaatagaagaatgttttgcttctgtttaaacacagataggaaagttaagtttaagacagaaaatacgttttaatggctctctgtattaatagctactcagggttgactctagggtgatagaggtggcaaatgatttttctgtattacggtttctcaaatggcagaaggaggacgtttcccacctatcagtgcatttatactaaatgaaagtgctataacttcacacagtgcaaactgggcttcctttataatgagcatatcatatgattatagtaatatagtaataactggtaattacttgccaaatgctttatagtttatatagcccttccctcgaaatttttcagttgatctttttggttggaaactgttttatgaccatttttcatatcacaaggtaatacacattggatttctacttctaaagatgagggagtaacgaggtttagacttaacataccatagtccaaccacttgctaactgtaaaactgtaggcaagtaattttgtctctttgaatattcacatcctcatctattagatgtagataatccttcctataatgcagtgttgtcacggtgattaaaagtacatatattcagtatagtgtttataatagaaattcataactcaatggtgagttttacaatacccatttaaaaatatatgacacatgactgcatcggatatcttttataattagagtgaatgagtaaaggatttcaagttcaaatggcaggcttaaagtgagaaatgacagatcaaatcaacaatgaagaaagtaaatgagtggcccaccgccacagataaaatgtttgctggccaagaagtgggatgtctgatttcttcggctataaggaatcaacactttgtaatcagttacaagcaggctttggaaataaagaatgacaagcatagtgacagacccagcctgtgggcctttaggttgaatcctccctaagagcatgctcaccaccactctgaaagtggcaccacaaaatgagagaaatttccatgttaattggatggcatacaggatgatatatttcctccatctccacacaaatgaataaacacatcctatgaattcagactcctattcttcagtttaaaaatgctcaatttcctgagaaattattgagtaaaaaaatagccagtaataataaaagttttacatgctgttttatcattataggtgattacacacaaaataaaccataaagcaacgtaaccaatttttttcctatttgatttttcaggatcaactattctgaatactttacctcagcttcattttactttctaggtcaaactttcccacaagttctgattgttaataattactaaattaatacaaaacatttgtaaatctattacgtgtaaatggacacaatataagcaatggtaagttcctgatacagagatccaaatatacatacctgccttgcagtatgagttgattttattgttgagtcgctgcataagcaataacactgcttctagtttgttgacaatctccatcgtgatagctttaccaccttctccaagacacttaggcttatatgtcagaagaaaatgactccaggctcgcagcactacttctgcatcatcagcactgataaggaggctatcccttaacagtgcccttacagttccctccaccttctctagcagcctcctccaaggtcgtataagatcaacctgtaatttccagaggacatgaactcatcatagggtcagagaatactgttatctgtactcatcaccaactcagaagactctcagtcagaccacggggtttattatgctttgccagaaaatatgaaggcagactggttacctgctcaaatccacccagcagctcagtagtatccattgcactgttcatagccatgatctttaatgtgtggccagtaaggtgtgccagaagctggaccaggctggtcttgcccacagaggctggcccgaccaggatgaccatccagctcatctgcacacacttcatgattgactccaggggttggaatgactggtgcaggagcaacaggggatggcgggacgggtgaggaacacagctcccacgggaaaggactgagtagcccaactgaaaagacatgccagtgagatttccataagcgtgcctggtagtgggagcagaagaaaccattaaaaaatgtcaaaggatagaggattatcctagtctccttacctgaacatcatagggagtgatacgaaatagtctggttcccatgtatgggttggaatttgaaccaaacacatccttgaatacagcaatgacctaaaggaagaagataatgcaatgaaaacacaaatcactccacctaattcttaggcaaactttctagaaaacaagcacagtgataagagtcactattctaaaaacactggccacaattcccttatccttttgaattttctcttataaaaaggattgactgcatttatttaattctttggaatgaaagtaaatttgagattgagaacatagcagtcatattccaaactatctgagattccagtaacaatgcaccataaattaaattgaagccatggacactgtagtattgaaatctagagacaaaaaaagagttgtttgctttcatcattgaagatactacctaaaaagaggatagaacagtaatacgaagattataaagaaaaatgaccattcattaaccacctcctatgtaccaaacactgtattaagtactttggtagattatttctgatctttatacccatgcaaaatagttaccatgtccattttatatagacaacagcactcacaagagttatagaatttgcccatggttggtgaccgattttaaatctaagccagtcagcctccaaaaaacatgttatccctccaaacatttatgtagatatgaaaaccaaatttattcctctaaccaattatttacattgttatcctttcattagcagtaatgctattagaaaatgttctgttgactcttttattttggatctctaaaaaatctaagagtaatggtggggggcggatagaggtatataaaaaacattaatttagcccacagaagtagggaaaattaaagccagaaaaaaaataaataaagtatacaaaatagtatttctaaaaagcagcaatacttacataattgaatactacaatgaagttaaaaaataaaaataatatagataaaatcataatcagtgtcaaacattggactgtgagactaaaagcagcataggaaagtgttcctgtcacctacctatgagtccaggtgatacatgacctcatgttccacactaaagtatataatctccaacccctgatgttctaccagagggttaaaattacaaatattgctactcgggaggctgagccaggagaatcacttgaacccaggttgcagtgagccaagatcacgccactgtactccagcctgggcgacagagcaagactccatctcaaaaaaaaaaaaaaaaaattcccaatctagctctttggtttagctttataaaatcaaaattccattcaactggactcttctagcttttacagactttatccttctataacattatttttcttgaccttgtctcccccgctagaaaacacctataaggtccattacaataaccttgaattggaagagtgatggaaaacttccacataccacaatgacccagcacctgactaatcaatcattcaacaactggcatgtgttttggtcataattaatatactataagtggatgaagaaattaaaatactagctgattatgtgaattatatatcaataaagctgttaaaaactactaagactttctcctaatcaaatgattgaaagtcacctacgtatgataaatgagttagtgtgtaattagattctgaataccacactaaagaagctctgggtggccgggcacagtggctcactccatttgtaatcacagcactttgggagactgaggcaggaagattgcttgagcccaggagtacaagaccagcctggacaacacggcaagaccacatctctattaaaagtaaaaacaaattagccatgccttggtggcatgtgcctatagtcccagcttatcagtgggctggggtgggaagatcccttgagcccaggaggtcaaggctacattaagccggcattgtgccactgcattccagcctaggcaacaaagtcagaccctgcctcaaaaaaaataagaacagcttttcgaggtaggagtcgactcctgtgaggtatggtgctgggtgcagatgcagtgtggctctggatagcaccttatggacagttctgtcccaaaggagggatgagaatagctactgaattgtttcttcccaggtcctaaagagcaagcctaactcaagccattggcacacaggcattagacagaaagctgaagttgaaatggtggagtccaacttgtctggaccagcttaacggttctgctcctggtaacgtttttatccgtggatggcttgcttgggtaaggacatgaagacagttcctgtcataccttttaaaggtatggagagttggcttgactaccctgtgtggagcaagttttaaagaagcaaagaactcagaattcatgcttgaagaaatgcaggcagacctgttatcctaaactagggtttttaatgaccacaacaagcaagcatgcagcttactgcttgaaagggtcttgcctcacccaagctggagtgcagcggcctttgaagcttactacagcctcaaacttctgggctcaagtgatcctcagcctcccaatggtctttgtagaccgcctgatggagtctcatggcacaagaagattaaaacaatgtctccaattttaataaatttttgcaatccaaaaaaagaaaaaaaataagaacaaacagaatgggtagcagaatgaaagggctgtgaaagtcacatgtgctatgggccagccacatgttcacatttcaacaaggaggttactgcttctagtgcatgcatctatgtatctattcatttattttcaaacagtgaagtttactagaaggaaacagcagacaaactggagagggcctaaactggaaagctggctctgctacctgtgacactccataactttaagccttggatcttcacctgtaagatgccatgacagcacctcctgcctatagctactgtgagcattcagcgagacaggattttaaataccacaaactaaaatgcacacgttattacaattccttacagtgggaattctagttttacaaacaggtatttttattttcacttaaacacagaatattctctctttatacgattatactttctagacaaaatgctttgtaatttgacatttatttaaaaacaaaacaaaacagaaaaacttcctcttctacggagtatcacctgtctgcctcctcctgcttctcaccttggtgcctgtaaagatggtgaagacttagttctttactactggagggcaatactgctttaaggtatgtgatcatggggatttggatagataagcaaattatgtcctctaaagcaagctactctatattgtgagaccccaaggtaggagaacgtttagtctgttcttttaacttttaaattttgaagcagctttaacaggcttgctagccgggcgtggtggctcacgcctgtaatcccagcactttgggaggctgagacaggtggatcatctgaattcaggagtagagatctgcctgaccaatatggtgaaaccccgtttctactaaatacaaaaaattagccggaactggtggcttatgcctgtaatcccagctacttgggaggctaaggcaggagaatcacttgaacctgggaggtgaagctgcagcaagccaagattatgccattgcactccagcctgggcaacaagagtgaaacccagtctcaaaaaaaaaaaaaaaaaaaaaggcttgcaattagtgtatgtcctttctcacccacaggaaatcaactttcagatggaaagaaatacaaataccaagcgtgaaactcaccttttttttgtcctcttcggttctcattctttcaccatagaccaaaaacacatgctgaccaggatcataacacccaggggactggtcaaccagcatcaactgacaccagcggaaaaggtcccggaggttgaattcccagggtcctcctttttgcccccatttcttctcaacagtcacttcatgatcaatctagaaagaaaacatcctgattgggaaacatgccctgcttactactaggcactgcattaagtactaggaatgtactacaaaagcatatgtaatctgaaacaaaaattaacaggcttgattcagagcctctttctcaagacttccaaatgcctggcttatcctctaagcattaacactggtagtcacaatacagaaatgaattactggaagcctccactacatagtgtcccttccactagaaacctgtagaattcaaagtaattttttttagttagagatcctgataatttggtagaactctatgttgaaaaaatactggttcaaatacagccagaaaaaaaaagaaaccaatacgtgtaggtacttacttggttattgaaagcaaccattttcttaacaatatttttctcaatggctggaaacaaagtactggcaatgaactccatgtcaattactgtaaggggatcaacgaagacctagaaatccaaaaataatatgaagaaatgcctttgtttctctttaccaaacactagaaatgactaccatgtcttattatgcaaaatctttaataccaagtaacaatacatgagaaatataattttcagttatagaaatttctttttttgtgttttgagaataaagaatcataaaatcttctaaatacagctgagtagaggttttgtttttaaggtctattctagtgaattaaagaaaaaagaggcccagtgcggtggctcacacctgtaatcccagcactttgggaggccaaggcaggtggatcatgaggtcaagagatcaagaccatcctgaccagcatgacgaaaccctgtcttcactaaaaatacaaaaattagctgggcatagtggcatgcgcctgtagtctcagctactcaggaggctgaggcaggagaattgcttgctcccaggaggaggagattgcagtgagccaagatcacgccactgcactccagcctgggcgacagagcaagattccatctcaaaaaaagaaaaaaaaaagatacatgttattaaaaatttcctatgtataatgtaaaatgcttttaaatctgggtggtagatacgagtattcactataaaagtcatccaatttttccatatgtttgaaagttttctcaataaaacattcttctttttttaagatggagtctcattctgttgccaaggctggagtacaatggcgcgatctcagctcactgcaacctccgcctcccgggttcaagagattctgctgcctcagcctcctcagtagctgggattacaggcacctgccaccacacccagctaatttttgtatttttaatagagacggggtttcgccatattggccagactggtctcgaactcctgacctcaggtgattcacctgccttggcctcccaaagtgctgggattacaggcatgatccaccatgcccagccaataaaacattcttaaaagatactcagccaattcttaatcataagagacagtgacactaaagaaatctagagacatttccaaacctctggattggccaaactctgaaaaactgatgttaaaacaagtaagcatacacatacacaggtacccctctgcaagtaagaataaaggcataagataccaaaatgttaataatgactgactggggaatagtggatttttattcttcatagtagttttctgttctttcttttctttagttaaaatgcattattttcaataaaaatttttcttatatatttcaacagatcagagggacaattgaaaaggtccaagattggacttcatcccagagtgcagtcacagaatcctgaaaaggctggggaccttactttcttccagctgataacacatctagtcttccagggcaaaagatgaaggacagaagcaatgatgggaatcagtcacattaatattgatcatataaggacaagaaagaggatcattaagctgatcctctctaattctcatagtgaatatccttaaaggcttcataatagtagtcttatcccctccgagtctatctttggtctctatggcaacagcaaatcttacctgagtgaatctgttaaggaaagacctgggcaagcctttcctcccacctccttgtctaaagggattctgacacccaaaaatcttcgtcttttcatgctgcacttgaaagctcattcctaactcaggcacatagatttctcctcggtggtcaaaacaagcattgagtccttccaatacagactgagaagccaggttaagctatttaaagaagaaagtacataatttgtctcaaatatattatacaactgcaacaaaaagcaggggaataatatgcagcaaataaagctagagttatcttcagaaagggaatttcaaacaatattgataaccttctgtatttttggctgagttatggttggtttgtcttcattctattatgcttttgtttttgagacagggtttcactctgtcactcaggctgcagtgcagtggcacaatcacagctcactgcaacctctacctccagggctcaagagatcctcccatctcagcctgctgcatagctgtgaccacaggtgtgcaccaccacatccagctaattcttttttttttttttttggtagagccaaggtcttgttatgttgtccaggatggtctcaaactcccgggctcaagtaattctccaaccttagcttcccaatgttagaattacaggcataagccactgtacctggtccaattctattattctttatttcccatgtatgttagagattttgtctggtattttatacacacacacacacacacacacacacacacacacacacgtatatatacacacatatattaataatctttaaactgaataaatgctcaaattaaattttaaagttaagaatcttctcaaaagttaaactgtatccattacatataacctatattaacctgctctgtaagtaataacttgcagaaaaacttgccaatacacagatatttcattttcacaatctgagtttttaagatgtgtaacacaaattagccaggagtggtggctcatgcctgtaatcccaacactttggaaggccgaggcaggtggatcacttgaggccaggagttcaagaccaggcgggccaacatagcgaaaccttgtctctactaaaaatacaaaacttagacattgtggtgcatgactgtaatcccagctactcaggtggctgaggcaggagattcacgattcagttgaacctgggaggaggaggttacaatgagccgagaacccaccactgcactccagcctgggcggcagactgagactctgcctaaaaaaaaaaagaaaaatagaaaaaaaaaaaaaagaaaagaaaaagaaaaagacatgtaacactaattgtagagaatagataaggtttgttaactctttaaatactttcccatctcaaacactgaacaaaatctccaacgggtttcaaagtcaggatataaagtgagttaatacagctgatttccaccaattttgtaaataagaacaattacaaggggctcttgtgccaggatgaaaagagctgaatgtaggtcttcagatgagtagttcagagctcagggatgtgaagcatgtgtggtttgttggtaacatagaaaaaggagatcgggaaaatacaagttattaaaatgcaaacaggcaaaaatcagagcacactacattagaatttcaagtgtcatgtttacacaagcaccacaaagcacaaacacttctgtatattcccaaacagaaggccgctcttaaatgtgtttataaatctagaatgtcttgtcgtccctgaatgcaattccactaaatatgcaattccactaaatactaagtatggtcagtagccttcagctttaaaactaggctttctcttttcctggctaatatatattctatcagacatcttgttcaaaaaaaaatctgaaaaatggaaaaaaattccctctccttgttatcccaagaataaaaggcagaaagcagctcagcagacaggagtcccacagcaccctctctgatgatcagacccaggagtctgaacctgggggacctgttgcagcctgtgtccaaagtctcacctgtgacacgtacatcactctaatcatttcagctccacaaatatttctagccttttcctgaatattgtacaccccaaactgacccagctccatatctctagttgtcagagattcagtatttatcatgtctcatactctgctctttcttctgatgaataatttaccccatatgcacacataacggatcgtttcctcatttcagtaggtcattttgtatgtctttccttagtctctccggtgcactaataaaacatgaagcggttgacgctatttataaaatgcctctaaaataaatgcagaaacggcaagcctgtcagagactaaactagtgacgatgcagttttcctctgaaggataactttaaacagtgggagagtttgtaggttttatgtacaagggcctctttttgtgtattctgccaagtgaccttcctcattcttaaagaaaactacagaggatcttttcattagagaaaagtcatcagcgggatcttccactgagaaatggattgtgaaatggagctgtgaaaggatgactgctcctcacacacatgatcaccgtcttgggcatgacaaacaggcccctcacctcatccaacaccacccaatggcctgccttcaaagctgccagtaaggggccatcacgccaggcaaactctcctcccttgccaccttcaacaggtagatctgctccaaacaggtctgtgatgtcctttgaaaggggaagaaatggaaagaagccattattactttaaaaatcaactggattctaacaccctaaatctgaaatgataaatacttggggctggcaccactactcttccttcctacacccaagatagaactaaccaatcccagctctctttaccaggagcccaaacatgcccccaagaactttcccaacatgttccatatatcaatcaatttgagctggtgctctagattaacagttctcaacattggctgtacttggaatttaattgacaggcttaaaaaaaaaagaaaacaaaatcctattccaaaggattctcattcaatttgtcatctgtaccatattttccttagattgttaaaagtcattttatttctaccactttttaaaaaaaaatttaagcaaaaaattaactggggttatattacaataaataccaaagtggataattctctctcgaaagagaattagaataaagcatccagagagaattaatattataggtgtcagcaattaacaaatccaaagaagatttagtttggaaggtcatgttgctgtgggctttattatgatatgaaatatctgaggatacaggccaggcgccatggcttacgcctgtaatcccaacactttgggaggccaaggcaggtggatcacttgacataaggagtttgagaccagcctggccaacatggtgaaaccctgtctctaataataatacaaaaattagctaggtgtggtggcgggcacctgtaatcccagtgattagggagactgaggcaggagaattgcaccccactgcactccagcctgggcaacagaacgagactctgtctcaaaaaaacaaagaaaagaaaagaaaagaaaaatttgaggatactgataatgtaatcatttctgattaggcaaatataaattgacacagacattactatctatagctatctccatcagctgtaggatgaccgagcttaccgtttgctctgataagttgattctaacaagggtatttcctgaagcctttgctaatgctcccaccaaacttgtcttgccaacaccaggggaaccctccaggagaatgggcttcttcagtttggtagctcttaagagcctctgtgcattcatagcagtggtccctgcactgagtgcatagtctgcaatattattcctgtgtaggacaggtccttaagtggagaaaagtaaagtcatgtataagcgggacatcatcaaatcacatgtatgcatcaactcaagattttaaaaatctaccacatgggttatcagttagtgaaataccatttgcagtgaaaatgttcaatccctatttcaatatttccccacttttagatccataaaatgctttaaaggaatatccaataacacgttttcttcaacagtgcctactacacagatctctccatctcctatacacatacatgtacatgcaaacacacacctgtcctttcacaacctacaccctgaatcactgtatgtacttgtacaatttaccttcatagttactttcctaaaaaccaagtgtaagctaggcatatgggccacatggttccacataatcaacttcatccaatgtttttggccaccaaaacaattcacactgtgtccttaacctgtaagttaactgatatgcaggactaataacagtcttgtaatatttaacatttgtgccactgtctcttggaagaagtttttgttttgttttcgtttttttttttttttttttttgtacaccagtttgaagggagtgaggctaggaaaacatttattacctcacccttggtagcagaagcaaggaccaccccagttctaggccactagcatgtatctcctacacaggagcactgagtcctatgatggtggcttagagaagggatttgatggttagattatacagcccatcagggatgaagagagaatactgctaaggagagatggagctctgaggacaggggcaagggcaatggaacctggactggttatgttcaccactgaaaccccagtaattgccactgcaactccatatacttcaggcattcatcaatcattaacatagagagggcggagggacaagaaacagatgactctgctacagaaacaacatcctgaaaaagtagaagcaccttagaagtagctaatctaactgcctcatttaaatacttggtagagacaatctagttagatagaaagagagaaagaattagaacacaaacccactatctcctagactactgcatttcccatttaatcattcactcatccatcagaaattttctgagtgcctatgactgtgaggcctaaatgtcagatgccagggaccggatcaggaatgacacattaccagccttcaagggttcacaaaacctgtttctgtaaaagatgatgaggttgtatagttaagatacattataggctaaataggtctttgcaagccacttaaaagtttattgtcaacattagtagagtttagagctttactataggaaagttcctaatgtgggaaccaactaataaaaaaataagcactgtataagacaatctatttatagattgaagtctctatttccctctatttttacatgccagtcaggtattttcaaccattcacacaattatggttattctcaagtcagaatctaactcagttagtgcaaatataatcatgagtattacacattaaaactaagtcacaataaaagccaagtatctatgatctatagaaaaggaaaattcattttttaaaaatcattcttaccccttggtataaaaaatggatgaattccccaaaggttatctattccagtgaattctttggccttcattctgtcataaatcttcaactcatttttctgatattctgtaagtcgtactatcttggcaagcctcttgattagaaatttcagacattcttttcgtgccaaaagggctgtaccaaacccagaggaagttacccctaaaagacagaggatcagtccatgaagcaacagtacaacaccaagcttcaccaccattaagcaggagctctagcacaggttcccggaaaaaagaggcctcagcaaaactgcagcctaaatgtgatttctagtgtaagcagtcctaagaaagaagtccaacacgcatcccccacaatctatggattatcaattaagcagcagatcattcagtaaagcactctagtcactcagtgataaatcagcctacatacagtacctaatatggcactagtaaccatttttatttatatttcaaatcttcatggctgaaaaaccacagtgatttttatgacattaaaataaacttaaaatattcaggcccattatcaaaaaattactactcatgttaaacattggccagtgcttctattcacaatagcaaagacttggaaccaacccgaatgtccatcaatgatagactggataaagaaaatgtggcacatatacagcatggaatactacgcagccataaaaaataagtgcatgttctttgcagggtcatggatgaggctggaaaccatcatcctcagcaaactaacacaggaacagaaaaccaaacaccacatgttctcactcataagtgggagttgaacaatgagaacacatggacacagggaggggaacatcacatactggggcctgtcaggggatggggggcaaggggagggagagcattaggacaaatacctaatgcatgaggagcttaaaacctagatgacgggttgatgggtgcggcaaaccaccatggcacatgtatacttatgtaacaaacccgcatattcggtttctcttcaaataatctgatcaatcttttattctttaattcatagtaccgccccccccccccaccttttcctttttctccttttttcctttgttaaatgcccaggcatgccacaataccaggcgttatcaataccagctcacattcctttccttatttaaaaaaaaaaaactaactttctaactcattacaaacacccctcccccttcctctccactttctttaacatgtccaccttatctaaaaaaattcaaatgtctagccaaccaaaatgagtttaaattatacaacccaaccccggccaataaaagaaaaatacaaaaacaaaacttgcatcaaaaataaaggctctcgtgccctttgttcaagtgtactctcatggcaactggccaaaaaaacacccctctgcacaaaaataaaattgctttgctaaaaaccctttgtttaagtgttcaatttctttacaattttaagcattattcctaacacatgtatcccagaacttaatttaaaaaaaaaaaaaaaagccagtgcttcagaagcaaagacatttcagcagtctttactctactcataatcaccacttcatgtttgttaagtacctggtctaccagctttgagaagttgcagtgtatcctgtgtgccaatcacctttcaaagagtacaaacaaaaggaaagccattctgagttttagaaatgttctgagaagtgattcagtaaaatagctgggtcagaggcctgggcttgctccttttcctatgcccctctatacgagccccttgtccccaccagctaccagacaacatacctgaacctattccatctatgtacaccaggcatgcagcatggacaaaagatgtcacagtggagatgatctctggccttttcaaagcagcttcctcccccattttgttcatgaagttaacccaggacaggatatctctgatactgaccacacactttctgccaaactcttggtgggtcagccagtcaatgaaatccagcatcacttcaggtatgtcagaccctaaacacaagaaacaaaaaaagcatttgctgttaacgggagatcccagaacaaaagttcataaccaggggcacacaaatggcctaaaaggggtctctgctccttctaagcaaagttctgtgaatgaatgtacataaatgctgtttctaacaaaagcagcctgcagctttgatcaaattctgaaaggattcatcaatagcagtccatccctatccaaagaacaaaacaaaaccttgggagttatagttttagatactgacctgaaaactgctcaaagaaatattcatttgatttgagttcggacacagttttgaacttctattataattattttagaaaatatgcaaattttgttatatcttataattttacttgtattttaaataaatttattttttccatttaatgcaataaagaatgtcatcttttcaatggcatgcattcaagtttttttcttttttctttttttttacatctattcagcaatcagaattcagcaaattagggggttcacaaattttgtttcatgaatcaagttgaatattctaattatcacaatttcctatcagataatatttgtctctaaataaagaaaatacttaagtagtatatatagattcaaagtaatcccaattaaattgagcagagtactttataaaacgtcttaagtcaacaacagtagacatttatctctaaagtatgaatatcaaagaatattttaaaaagaaagaaaagattagaaggaagcactgctataatataaagcagcctccaaaagctatatatatatacagcctccaaagctatatagattgtgatttagaagaaatgtaattggttggaagaatactgattacaaaaaaaaaaaaactctttaaaaagagcttaaaatgacaaagcaaaggggaaattccagtaacaatgaggaaacaaattaaatgctatttcaacaactagatagtaaatactagtacttagatctacacttcagagaagaataaattccaggtaaattaaaaaaatgaaaatgaaaaaatccattaatagaaattaaattttgaccatttaagaaacaaaatcagagagaaataggttcacatatgtatttttaaaacaaatatataaaggtaacagaatattaaaacctgtgaaaaatgtaataaaaagtatcaccccaaaagacataatgaataccaaatgcaaaatgattaattcattaaaaataaaggccaggcacggtggctcatgcctgtaataccagcactttgagaggctgaggcgggcagatcactagaggccaggagttcaagaccaccctggccaacatggtgaaaccccgtctctactaaaaatacaaaaattagctggacatggtggcacgtgcctgtaatctcagctacttgggtggctgaggcacgagaattgcttggacctgggaggcagaggttgcagtgagccaagatggcaccactatactccagcctgggtgacagagtgagactctgtctcaaaaaaataaaaataaaaataaaacacaaacaatgttccatgtcactaataacaaaagacaaggaaattttaaacctctgctaaactaataaggataaaataatggatttcactatattttttaaaatgaggccaggcaccatggctcctatctataatcccagttcagaccagcctggccaatatggcaaaaccctgtatctacaaaatacacaaaaattagctggccatggtgggcacgtctgtagttccagctacttggctacttgggagggtgaggtgggagaatggtttgagcctgggaggcagaagttgcagtgagtcaatattgtgccactgtactccagcctggatgacagagccagacattgtctcaaaggaagaagaaaaaaaaaaaaaaaaaaacaagagagagagagagagagagagagaactccctgatggagggactgtggcatgcaggcacattcactacattgctggcagtgttgtaaatgataccatctttctggagagcaatctgaccttatctaaggagaactatacagtttcttatctccacttttagaatataacacaaggaaatcattgtaaatgatagttgtttcttggttgtttttttttttgagacagtctcatgctgttgcccaggctggagtgaagtggtgtgatcttggctcacggcaacctccacctctcgggttcaagcgattctcctgcctcagcctcccaagtagctgggactacaggcgcctgccacaacgcccagctaatttttgtatttttagtagagacgggatttcccatgatggccagtatagtctcaatctcttgacctcgtgatctgccctcctcggcctcccaaagtgctgggattacaggtgtgaaagaaagcacccggccaatagtttgttttaatgaaacagaatggttcattaaagtattgactaatgtaccaatacttggtacattaaccaatgtaatacagaagtattgtttacaaaagtttgagattgtaaaaagcagttcatgtgcctttcacaggtcaattttttttttttttaaacacatcaatatcacagaaccttttttttttttttttttaaagagatggggtctcactctgttgcccaggctggagtgcaatggtataatcatagttcattgtaatctcaaactcctaggctcaagggtttctcccaccttggcttcctgagtagctaagattataggcacgtactaccatgactggcttttagaatcttttgttttggtcatactgtgaatatatggataatattactacagagatttgtgaactaaaaatactagagaaattaagtagaacccacagtggtatttatatactcattaagataatacaataaatataagtactacaattaggatcagaattcaatttagaaggacactattagttaaaatattaaattcggccaggcatggtggctcacacctataatcccagcactttgggaggccaaggcgggcggatcacaaggtcaagagatcgagaccatccttgccaacatggtgaaaccccgtctctactaaaaatacaaaaattagctgggcgttgtggcacatgcctgtagtcccagctactcgggaggctgaggcaggagaattgcttgaacccaggaagcagaggttgcagtgagccaagattgcaccatagcaagactgtgtctcaaaaaaataaataaattcatcaaatcttaactatctttaaagaaaatctaaaaacaaaaagctttgtctagtttcctgttttatatttcacaattttttaaagaagtttttatgttgtgccttcctgatctatttctagaaaatataactgctgtgaattattaagccacttcccttattcaccatgctccccttcaaggtctctaatgcctccctgggaagtctgctgctgtgtagcctagaaagcctggagtaaacaagctccttaaggacaaggtgtgggctcagaggtaagtcctcagggctcccatgcttgcatggagcacactggtgatgcagcaagcatggtcgtgacagcaactgaaccctctgtcattcttatcacaatccaaataacaaaggaataagcacagcccataggagatgaaaaggtaacttcctgaaggaatccagccccgacacagacccaaaagacaaaccatgcttggttaacgatttctgtcttcaggcctgctttggtcttctggctcctgcctagttcccagcacttagggagggcaaagcaggcgggtcactcgagcccaggagttccagactagcctgagcaacatggtgaaaccccatctctcaaaaaaaaaacacaaaaattagcctggcgtggtagtgcatgcctacagtgccaagtatttgggagactgagacaggagaatcacctgggcccaggaggtcaaggccgctgtgagccgtgattccaccactgcactccagcctgggtgacagagaccttgtctccccacaaccccccagaaaagtctgtattatacttcttcttttactggaattctcacagtaaatgtgctgctgcaaacagcacacaagagtcatgggttctgagttctgaggctctgagcctgggccttagaccagtattagtggcatcacctgaggctttgttagacagacaaattctctgcccctgctgaataagaaacactgggtgtggggccctgtaagctgcacttcaacaagccctccaaatgagtctgacaactaactacaggcttagtcaattcttatgccactgggtgactgtgatattggtagagactgtagagaaaaaaggaagttcaacaaggcatggggaattctggccattcaagcagcagtgtgcgtacctataaatgtggcagttcaccgtgggccattcctaaaaagaagtctttgctcagatgactaaagaatcagtcgtccctaaaacaccacaggtgagaatgggttccatgcagattagatgctctctacagctactctactcattttagaaaatgtgtggtagggcacctttaaaaagtgaaacatagccatgaattccaatttccaagaagcagatatcttttttttatattctttaagaatataaaaaatgatccaaaaaactatgtatttagtcttggaaccagatctgggttctaaatttattccattgaatgtctaagataaatatgcatacatcaaaccaatacaggcttcaaaaacaaaaagaaccatatagttaggagtgttgccttttattggatattttaaattgttaattctagattatggatactaatctattttccttgtgcctgagatttttcataataaaaattatttaattaattaattaattttgagatggagtctgtcgcccaggctggagtacaatggtgcaatcccagcctaattttttttttttttttttgagatggagtctggctctgctgcccaggctggagtgcaatggcgcgatcttggatcactgcaacctccacttcccaggttcaagcgattctcctgcctcagcctcccaagtagctgggattacaggtgcccaccaccacacccagctaatttttgtatttttagtagagatgggttttcgccatgttggccaggctgctctcgaactcctgacctcaagtgatccgcccaccttggcctcccaaagtgctgggattacaggtgtgaaccaccacacctagccaaaaaaatttttaaataaagtgaaagaataacatgttcattgatgacaactaaagaaatgcagctgaaattctacagccattgtgtcaagtggtaatgatgaaaatatgaagatgggacactttaacagaaggtaacagaatagtaatattctccttgtctactttgtttcatttacctatctcctttcttcttataacacaccatatacacacagggctgatgtcctgtaagagatccctcaactcccaacacaaacccttctatgacccaatactaccatcaccacctgcaaactctcacctttaggatctattctgcccagacacaatcctggacgaagattatgactgatgatctgaattaaatcttcacggcttgtgctttgagggcaccatatttctgtaaaccggtttcttaaggcaggagacagctataagaaacacaaaacttcaatgtgaatttttaaaactgtaaggaaagctggaaaacaagtcttgaaagaatgttgttagctgttaagtccagcaaatactacacacttttaaaaattatttctactatcagatataattaattgaagatgtactttgtcttgactccttatattccatgacaccttccagtatcatcatcactttcttaatagacgtggtccagaggccttacagactaagtggtggaagcaggattccagccagtcccagtcaaatctgaactcttcccctcaggcaaagattcttccttttactttacctttactttgcatcaggtacctaaataatacttcagagaaaataaacacctgtcttcccacagagaagggcagtctgatgtaggaggaagaaacttcttttacatagctcaatgagagtgtgattttaaaaagtatatattctacctcttgaataacaagaaattgtttagccactccagtcttagggcctttgcccctgtagattccttttcccaccacaaggtcagttgacactattcacaaatgtttgcaatgccacataagcatcattattggtttgtctgattactttgtaattactttccttttacttgatgatcatctatctggtctaccacagaggcccaggaataaagcatacgtgtgtgtacctcatcagtatcatagacaaccagtacctccggtgtccagcatcctaccttgctctgcttgttaggcatgcgaaactaaaaagtaactttcccttgggtaaaagtcagcaagcattgacttgaggaaaacaagataagataatctgacagccaagctaatatacacaaacttgaaatcagacctctctgtggcatttctacttgcccagaagccagtttttatattttgaatgcaatgtattttattccctctcttcagagcatatcttgaagcatagagacaattttcatcttatgatactgaggaaacctaggcccaatatatcatttcagctacccaccaaattaccaacactcttaattgtcttatttaagatcaacccctctgtttcttctcatcatccctgacctgttacatcactctcttcctaactttaacagactgggatccaacacatagtgctgacttctccactgaaaggtttcttgagctggaaaccaacaaggttgttggttcccaaatatatctgaacacaaccctctgaacataggaactaccctctgccctttactttatcagcagtcagaaagtgacacacataacccttacgagaacaaataagctccatctacaaaccagaagagggttcctggttgtgacttttttgtcactttaaaaccacccatgaaagcagaggtgtgtttaagaaagtggactgtaaaaacagaggttaaacttaaatttcagatccaacttttctcatccataaaactacaataataactttcttgcagagctcctgtgagctttctcagggtaacatatgtaaagggctaggcaaagtgactgtaacaatgacatttcaggcacatacacaaagtgagatatcaaataaggagatatttgtgtcagaatttttttctaacccaataattattttaaaatatttttgagtttttacactttttacccactttttacctaacataaaattccaaatccattattacatactatatttacgagtaccagtaagctgaggtcaaaacctagaaagaaaatgtgcatcagtaaagttttacctccttttttccaaagtcacccccagggttcatggttgctagaatacgaaattttttcccagcagtcaacagctctatttcactatccttgtcctctggactgcctttttcagctaataccagagacttttctacttcaaggacactaaaagaaaaattgaagaacagtgaaaagggcttatacaatctttctgttttacaatcttcaatgctctttaaaagaaaaaaaaaagttatcttctttctactgaatttttactttagttaatggtttcctatcacaaattttaaaatgactcactatcccaatttctgtgtaataatggctatttctgatcaagaaaaaaaaacttttcaacttataaactattaaggcattggtcttaaaaatgaataacttacaagaaaacaaataaattgcatgcattatcataatagccaactactagaaagaactcaaatatcattgactggtgaatggataaacaaaatgtggtatatccaatactattcgggacaaaaaggaacaaactaataatacgtgctgaaataggaatgaacctcaaaacatcaatgcaaagtaagagaagagaacttttatctgaaatacccagaaaagaaatctgcagagacaaaaaagagattaatcagaaatttagtgtaatgcacacaaaggattctattgaatgatggaaatgttgtaaaactggattgtaggccgggcgcagtgactctcgcctgtaatcccagcactttggaaggccaaggtggggagatcacttgaggccaggagttggagaccaacctggccaagatggtgaaaccccatctctactaaaaatacaaaaattagcagactgtgctggctcacgcctgtaatcccagctactcgggaggctgaggcacaagaatcacttgaacccgagaggcagaagctgcagtgagctgagactgtaccactaaactccagcctgggcaatacagcaggatgctgtctcaaaacaaaacaaacacaaaaactaaattgtgatggttgcaaagcttgaaaccacctttgcaaaaattatgagtgagaaaaaagtctaacaaaaagttatgacagtaaaaaaaaacacaaaaacctgtcctaactgactccatctttcttctagcctccaagctgcccttgttcattcctgggtataggccaagtaaactatgggagaaatttagtttacagttcaactttaaaagaaaagtaatagcgcccccccaaaactaacccctccttcataaaactaaccaaaaggttaaaattacggctcaggacacagccagaggtcacgagattcataaccttcccaattgctcctataagataacatctctattataaaacctaagattagtgtttaaggtacttttcagaccctgattctgataaaacggctagcaccacctggaatggaaacccataccaagaagtggctcaacaggtcttatgatcccatgaacttatttagggcaaaaagatagctcaacttcctgtgatttcaaccctgtcccaacagcattccccattctctaggcctctgaccctagcctcggccgggcacagtggctcacgcctgtaatcccagcactttgggaggcagaggcaggaggatcacttgaggtcaggagttcgagaccagcctggccaacatggtgaaaccccatctttactaaaaatacaaaaattagctgggagtggtgacacatgcctgtagtcccagctacacaggaggctgaatgaaaagaatggcttgaacccaggaggcagaggttgcagtgggccaagatcgcatcgctgcactccagcctgggtgacagaagtagactctgtctcaaaaaacaaacaaaaaaaccctagcctccaggacgggtgcagtggctcacatctataatcctagcactttgggaggccaaggtgggcggatcacctgaggtcaggagttcaagaccagcctagccaacatggcaaaaccccatctctactaaaaatgcaaaaattagctgggcctgatggcacacatgtgtagcccagctactcaagaagctgaggcacaacaatcaaacttggaaggctgaggttgcagtgagctaaaatcacaccactgcactccagcctgggataaagagcaagactgtgtctaaaaaaataaacaaacaaacccctatcttccaaatttttaggaagctgatttgagtaataaactcctgtccttccacttggctagctctgcaactactaaattatttctctactgcaataccactaactcagtgactcagttctatgcatatagcttgcaagaagaacccatcatgggattataaacttactaaaactcactgaaatatacattttatgatatgtaaactatacctcaaaagaaaaaatgggtgttactacatcaagattcatattggtctgaggtctgatgatggcttatagccatgggtctaggattctgactacagttctttcaaaatattaagagagtagggatataattcactttaaaaaatagttttgactttggctcatgttttagccctaccattccacgatcccattgttctgattattgatagcaaaaaaaacctagaaatttaggaaacactgaatgctaaagccaaaagacatggtaatacatcaataatttcaagcatttactaaggtgcacctatgagaagtattactgtgcacaagattaaatatctataaaaatcacatcaatcacctgagcccagaagtttgaggctacagtgaactatgatcatgacacggcactgcagcctggggtgacagagtgagaacactgtctcagggagaaaaaaaaaaatcacaccaacaaaaatatcaaacacaaggcaaacctctcaggcacgtacctgttgagtctttccaagacagagtcatcggccaatgagatctcatccaagaggaaaaagccgtcctccttcatggcctgaaccagaggcccatcatgccactcaaagagtcttgatgtgtcaatttcttcctataatttgaaaaagtggggaaaattaaagggcaggtggctccacagacaatatacatgcagctggctggtgtttccaggggtgaagtaggcattctgaggaaagtaagaatctgagaacaggagatagaacttgcacaccagaatgcttgtgaaggcccttgtagaccagagaaaatctgcagatatgcacatttaaccaaaccagaacccagctccagaaaccccaccactaactcatgcacagctaactgcagttttttaaaataacaggaacacttgctgctggacaaaccttgtcgtttggcttttgtctcactggccgcaggccacccaggaagtctgatgtctccatgtgtaagtggcagctgacagagtataatttctgatttgccaaggctgcaaatacctgacagatagtagttttcccacacctgttagagatgtgcaactgattaacaaggcatgtgtttcaaatacacatccataaacaccccccctcagcaaaagagaagaaccactgtgggagtctcactgcagcagtaaacagtgctggccaatgtggaacctcaaccccaggctcatggcacccctctacacgactgcactctcccatattcttatccagaaggtatgtactgcacaaactccaacctagttctatcaacaatcaccagctgggcgcagtgcctcacgcctgtaaccctagcactttgggaggctgaggcaggagaatcacttgaacctgggaggcggaggttgtggtgagccgagatcacgccattgcagtccagcctgggtaacaagagcggaatgccttcttaaaaaaaaaaaaaaaaaaaaaaaaaaaaccaccaccaagagagggaaaagaaatctaatccttatagacttgacagactttcaagagacactagtttatctcttctctacacacgtatagaatgaatctcactgtttaaaagaactaaatagacaaaaactgccctcaatgcaatgaagcaaaaaatcattcttgccaggtacagtgtggctcatgcctgtaatcccaacactttgggaggccaaggcaggaggatcacttgggcccaggagttcaagaccagtctggacaacatagtgagactccatcttttttttagtcagggcttcactcctgttgcctaggctggagtgcaatggcacgatatcagctcagtgcaatctctgcctcccaggctcaagcgattcttctgcctcaacctcctgactagctaggactacaggcagatgccaacacaaccagctaatttttgtatttttagtagagacggggttttgccatgttgcccaggctggtctcgaactcctgagctcaagtgatccgcctgcctcagcctcccaaagttctgggattacaggcatgaaccaccacaaccagctgagactctgactttacaaaaaaatttaaaaattagccaagtgtggtggtgcatgcctgcagtcccagctacctgggaggctgagccaggaggatcacttgagtccagaaagtcaaggctgcagtgagccgtatcgcaccactgcactccagcctggacaacagagtgagaccccatctccaaaaataataataataaagccattattttccattaacaaagaacctagtctgaaggtagaggaaactaaacagtaacagatcttagtttcttttttttttttttagggtacatgtgcagaatgtgcaggcttattacataggtatacatgtgccatgttggtttgctgcacccctcaactcgtgatttacattaggtatttctcctaatgctatccctcccccagcccccgacccactcttagtctcttcttaaaaaaaaaaaaaaaaaagaaaaaagaggaaggaggaaagaaggggggattaatactttcatgagttcttcagtgataactcaagtaatcctatggaattgaaatgaaccctcatgagtcactgtcacagatctttacccagtgtctccaaccagcagcacaggttcaccaaattccaatgcccttcccactagcatcgcgagtctccgcatgccctcagtccacacgatatggccaaagttacactccaatgtggatatctgagtagacaatttacctatccaaggaaaaataaatatttagattctaatgagtacaactcaaatcatattcctctagggattttggcctactcacccagcaattttagaacattttctttggagaaaagagattgaggacacaattttttcttgaaatgtttctcaaggacttcttgaatcacatcaatttcctcctgcttcctgactcgacctgccagaagcatataacctgggaggaggaggaggaaaaggaggagaggaatcatcaagtgtctaccgggaacaccaagggatatggagaatatgaaacaatagaaactctcatacgcggctggtgaggtagaaatctgaagaactaggacagcctattacaattaaccatatacctgccctatgcctcagcaatatgacttctagtatccccaaacaccaatgaacatgtgtgtgtcgaaagacataagcaggaatgttcagagaagctttgttcataactaaaaaattaaaatgatccagatgtccataaccaagagaatggataaacaaactatggtgtcgtcatacagtggattaccacataaaaagaaaaagaaaaaaaagaatgaagtcctgatacacataatggcatgactgaatctcacatcaggtttagtgaaaaacccagaacccaaaaagtacatactgcatggtgtcagctaggtgaaactcaaggacaggcaaaatgctgttcaatcagattagtagtgataatcagacagaagtcaattagtagtgacagtagtcagggtagtgattacctccactgtcaagagacctactgagttattggaaatattctaaatcttggtctaggtgatactttacatgggaaaatgctttactgtttgttacacctcactaaaaaagtttgccgggcatggtggctcatgcttgtaatcccagcactttgggaggctgaggtgggcagatcacaaggtcaggagtttaagaccagcctggccaacatgggaaacaccatctctacaaaaaatacaaaaattagccaggcatggtggcgcttgcctgtaatcccagctacttgggaggctgaggcaggagaactgcttgaaccagaacccagacccgggaggcagaggttacagtgagctgagatcgtgccactgcactccagcctgggctacagagggagactctatctcaaaaaaaaaaaaaaaaaaaaagaaagaaagaaagaaagaaagaaagaaagaaagaaaaaaagtttttaaaaaagtattcctctatgtaaatattctttacaagtagagaaaaaatctcttgtactagttttacatactcttcttacttattaactagcccattaatcaatcatcagcacttttcaaatcagaagattccaaaacactttgtatcctatcatcagcacttttcaaatcagaagattccaaaacactgtgtatcctatcacaaacagtaacaaatttttcccatgcattaaaggaaaacaacaaaacctgagtctcaggttatataatttttttctctcagaatgctgatgttttctgacaaatcagctttctgtatgtctgtaaagcactagccagactacctgtggtgacactgcagaaaaatggcccacaaagctaccatcaaccatttgcctaactcccaaagaggctatgtccatatcctgactcccacatgtggctacctgaagcaaagagtaagaaaaccttagcaaccagtccttattagcatggaggcctgcaggaataagatcacttacaaaagctgttagaactggagggaaacaggctctctggaatacctagtcaaatgtatgtatcaatcacaatttgaggcaagatttgttttaataaaaagtttgacatttaacataactatatattgagagcatttgattgaaaacacaccatcattggctaaatgctgtagccagtcatactccttctcggtcggctcagccaatctgtatctttcagcccatcggaacagatcacgaagggtgatgaagccctgctttccagcaaacactgaagaacttctgcgataggactgttgaagtatcaaaacaaatgaaaaggggcatcagctgcaatgcatggtaagtttttagtacaatgcatataaaattcataacaaatttatgctcccatttaaatgatttcattccactgaataagattaattttttggccgggcgtggtggctcaagcctgtaatcccagcactttggaaggccaaggcgggcggatcacaaggtcaggaaatcgagaccatcctggctaacatggtgaaaccccgtctctactaaaaatacaaaaaattagccgggcgtggtggcgggtgcctgtagtcccagctactccagaggctgagggaggagaaccgcatgaacccgggagggggagcttgcagtgagccgagactgcgccactgcactccagcctgggcgacaaagcgagactccgtctcaaaaaaaaaaaaaaaaaaaaaagattaattttttaatgaaaataacttgtaatattctgaggaaaaatgttcaaattcatgtttaaattaagaacataaaatggaattccacatttcttatgccacatagaaaaaagatgattaatagtaatgcaaatgggcgcagtggctcacacctgtaatcccagcactttgggaggccaaggcgggcggatcacaaggtcaggagatcgagaccatcctggtcaatatggtgaaaccccgtctctactaaaaagacaaaaaattagccaagcctggtggtgcacgcctatagtcgcagctactcaggaggctgaggcaggggaattgcttgaacccgggaggcggaggttgcagtgagctgagatagcgccactgcactccagcctggcgacagagtgaggctctgtctcaaaaaacaaacaaaaagtaatgcaaatggtggcaaagatgcaggaagattagtgaaacaatgtggaaccataatggtaggagtcttcattattattagctttctaaaaagaagtttgacaatgtatactttctgataaagaaaacttttaaccccataagataaatggaatttttaaagatcagctgtagctttgcagttgactagggggagccacaaagaatggatctctttaattatgtccattcaaggactatatccatttaaaaaccaaaaaccagttttccctaagccaaattacattctaaacaaaatgcttcaatattatacacaaatacaaaatcctcatatgtaaatatcagaaaaattttaatgatgtaaaattgttgattgattaaaaaaaaaaactaaaaatatatattattgggaagcatttaaaagacctctacttgaaggccaagaactgtggttcacacctataatcccaaaactttgggagatcaaggtgggtggatcccttgagcccaggagttcgagaccagccggggcaacatggcgaaaccttgtctctacaaaaaaaaaatgtagccgggcatgacggtgcacatctgtggtcccagctactaaggagtgagtagtcagagatgggaggatcacctgagcccaggaggtcaaggctgcaatgagctatgattgtgccactacactccagccaggagagtagagtgagactgtgtcttgcaaaaaataaataataaaaaaattaaaaacaataaaaaataaaaaaaaatctctacttggaaaaatacatcaacagacagattcttttttctaacaaaagaagccatgaaattttgatcaccaagtataatcaatacattccatttgaaactaagtacctgaagatccagcatgactttaaccaacttgctgcaataggagggtggcaaactacaccgcttgtgcaagattgtttccaactcggagctaggtaactcatcaaagtgcaattccacaaaccgattcctgaaggctctagaaaggacctagacaaagcacaggaagaatgcagtaaaaggtgccttttaatttccaatatggaggctctgacattcaccataaaatattaaaggagaagtaaaaacatttcattcttactacgaaaaatctactatctgatgtgttaacaaattgaaggaaggagacaaatgctacatacctttctgcctccataaagtcctgggggattttgggtggcaaaaagcataaaccgagggtgtgctttaacaacttcctgtgtttctgttactagcaattcacggttatcatccaacagcctattcagcgcctctaacacatcagtaggggccaaatttaattcatctaaaataatccaatagccttttctcatggcatcaataagaacacctaggaagaaacaaacagcaagaactagtgtataaatcagtacaaagttttaaaatgcattatgtacaaatcaacaaatcctaggttatcatcaaatttcaaagcaaattactttctgtagctagtcttgcctcaaaacaaattatgacactgcagatcaaggaggaacaattttcaattaaaatagtcccttttttccccacagaaaagaagccaaggctgaaaatacctcatatttcttgtgtaatctttcccctgcagtctaatttcatttaaatcaccacattctgttgactattcccaacttccttttggctaacactaaccccattctctgaattcctagaaaataaagcagcagttcaattcccctcttgaaaattggccctagtcctgtatacagccagcaagattagcagaacctaaagaaagccagcaccttatgcatcaccccttaactatcttagctcaggcatcaagaaaagccggctgttacagcaaaggtccatgtgcctcaattggaaaggatgaagaatattacttaaggaaatgtgtgtgaaagaataaacacctatgtccatggaatggaatcttaaccctaccttccttaaagacaagcttccctgaggagtcagacgtgtaacaaccaatgtactcctgaatatccgtgtgttcgtgattattaatacgcacacagtggttgccagtagctgcagccagccactggatcaggcttgttttaccaactgatgtctctccctgaatcagcactggataggttctgtaaaagattagccaattaagcaacttaaaacaacaaaaaattacaaagctgagaaaccagaactgagtattggtttgttttgtttgacaaagggtttcactctgttgcccaggctgaagtatggtggtgcaatcatagctcactgcagcctcgacctcccaggctcaagtgatcctcccacctcagcctcttgagtagctgggactacagacatgcaccaccaagcccagctaaattttgtattttttgcagagacagagtcttgccgtgttgcccaggctgttctcaaaaccctgggctcaagtgatccgaccgccttggcctcccacagtgctgggattacaggcatgagccactgcacctggccaagtattattttggttttttttttttaaaagaatgacgacatcatttaacagcatcattaaaagagcatttttttttccttttttttcccctttttacatttctggaaaatgcaagaagcagaagaacatttttattcctatacactgagaagtatctttgtaaacattattcctcaaaaaatactaaggaaagcaattccaactatgctggcaacatttgtaagaaactgtaagtagaacttttagccatttactgaataatctgtggtatttatcagcaaaataacaaaagataactttaaagatagataaaatcatctgcatccatagtgctccctccaaagttgcacaactagaaacaaagttttctaccaggaaaaagttatagtactgacttttgtaagtaattgttcagttggccaatgaataagaataaagctctttgaaagttaaggaagttagaccaaaatgtcatcaatgcctatgcctgtatcaagttcggggcagcgagaaaaaagcccacacaccctgcagagacaactcggactatatctctcaggttcagcttcacagaagatgtcagaatgtacgtctcatctattgtaggctccttgtctcccaccgcaatccagtagccttcaacctggataagccgacctccttttggctctggaataggctgaaagacacagaagttcaaggaataacccacagttgtacattctttcagagaagggcataaagtaggaaaacagccacttgttgaacaagctgtcttgttctgcatactttcaacattaaaactggatgaaatatgaacataaaattatgaggaatgagaacaaaatggtgttatatattggttttaaaactgaagtggagtaggtgggtttggaaaaaagctgaatcaaaacaaattcccagaaggtttatgtaccagttctcttctctcacatatcaaaatgcccactccaattatttttatcaaaaacatgaatttcatataaaccatgttccccgaaaaagggccagtgttgtagtaaggaaggaggttttgcactattatactctggattgcctagaagacattaaaagtaaacctgacttttcagagcaactagcccattaaggataatattgtggatgatggcatcactttgctgagatatggtttaagttattagtttcgattatacaaattcccatttttataagtaaaaaaatggttaaatggtggtcaaatctataactatggaaaagtactcttctagagcatttggtccccagatttcaagctacacgtctaggccctgcttttaaggcctcctcagttgagttgagaagcaatagggggaggggaggaaggatctttttaagtttctatcacaccctgaggcatacacacacaaaaagaccaactggaagagactggtatttgattacaataatggtaaaagcaaacctgagtctttactcaatgtttttacaatttaccgaaagtatttacgcatgtgttacttgtacgattttttaaaaggctgagtccaaagaaactccaagtcccaagggctctctcttcctaatgaataagcaatcaacaagtaaacaagccaatttacatgttgattgtgagcaagtttctctcagcctctttcagtcccatgctattctgtaatttcctgccaaatccaaaacggctattgtttctaacagtgcccccactactgcctcctcaaaaaagacccaaccatcaatcagaaggtatagattatacctaactgtgtagttaaactatgcaaatagtgaaactatggtgtacccatccagtgaaatgctatgtggcccttagaaggcatgtcacaatgaactctggtacaaaaacaaaaatatatccaagattcagataggttaaaaaggaaagctacagaatattcttatgggccgggcacggtgactcacgcctgtaatcccagcactttgggaggccgaggtggacggatcatgaggtcaggagttcgagaccagcctggccaacatgatggaacccagtccctactaaaattacaaatattagctgggcatggtggcatgcgcttgtaatcccagctactcgggaggctgagacaggagaatcacttcagccacggaaggggagaatgccgtgagctgagattacactactgcattccagcctgggcaacagagcaagactctatctgcaaaaaaaaacaaaacaaaacaaaacaaaaaaacaatattcttataagacagtcccacttacattaaacgcatattacaattttttacaattttacaatttacctcaataaatcaacatatacatatcaaaatttggatatgtaagaaaataaaatatatacattatacaatttatctggaaagattatccacagtatttaaatctccaaagagcacgcttattggaaactttcaccatctaaacatatgtttctgtaatgtttaaactttttgcaacagattacctttataattaaaaagttatgtgaaaaaaaaaaaaccaaacagctgaaaatttggtaattcagcctttcaagtgtaacaagtcaaaaataacaaaagaacatacctgcttcagcagactcttgacattgccagggacaatgtgttgacagatgagcttctgaactattgggtgtgatgccctgtcaagctgtgttaagaaacccaaacaaaaaccctagaaagaaaagacaaatatgcataatgctaaataaccttctgcaatacaaccaaacttatttccagaacaaaatttaacctcttgggtgatgctgcttcccaacttttaaatatagtaaggtggtagataaagggaagggtaggccaggcacggtggttcatgcctgtaatctcagcactttgggaggccaaggcaggaggacagcttgagcccaggagttcgagaccagagtgggaacacagtgacaccctgtctctatgtataattaaaaataaaaattttaaaataaaaagtaaaatatttaatttaaaagggcaaggtaaatctggtaagaggtattatgggctgatctgactaactggaaagcacaggcaacctggcatatgcatccctattccttccttcccatgaacccatccattaagctcatatccagtcaaagagacttcagaaagacctcatagagtgagcgctgaatgttgccacatggattggaggctgcaaatcgcagggcccggcacagagtccgaaggctgtagtgaggtctatggccagtgccatccaccagtttggtcccagactctttccgcaaagctgtgtagaagctacaaatagaataaaggtcaggcaattttatttactaataagtatccagtattatcaattctctacagaaaacccaaaggacattttttagatcagaaatgatcatgcacacaacttcctggggcatgcatcaaaatatcttagtctcttttaaacctacttttcacatactcagagatatctttcaaaataaaaaatgaacacctatctatttccttggggaaactgggaagtgcaatgtgcaattcctctagcaaaaaggtactgataaagagaggtgagaagcttctgtgttccagagtctgttcaagcttaagggacaaagaaagttcctatgcaatcaaaaatggggatgaacaaagacatggcaaacaacgcatggtgttttgaaaggctacgaatatggctataattagtactgacaaaacgttaaaaagcaggaggatacgatggccattactattgtcactaccacactttagaagtccagatgatgacaggatgggaaaagtttcagactgaaacatgaaggtcttgcactttgtgaaattcatgatcaattagcaccacaagatcaaatgaaaccaagtatgcatgcatcacagatgaaattcaagttcctgcccaaatgagctttatcttgcctctttgctacctaacaaaatatttttgtagatagcaaaaatacacaaatattttcaaaatattttcaaaatatttcaaaatatttttgtgtagaaagaacctatgttttggaactgagtttttaatatatggaatatatactacttgtactatcagtattttataagtgcctaattttatcctttatctacctctttagataaaataaggcacttataaaagtttacctttagcatctggaatcttaactatacgtatttacacttttgtccaaatattcttggctaccaaaaagtattccaatttagggtgtgttgtggtaaaccattctgaagcattctaaacacatgccttgttgactaatctatttaatacaggacttcaggaccaggtgctgtagctcaaccctgtaattccagcactttgggaggctaaggctggcgtatcacttgaggccaggggtttaagaccagcctgcacaacaaagcaaagctcctgtatccaaaaaaaaaaaaaaaaaaaatagaactccaagtcttcattttcttacaccctactcagctttatatgttttcacttatcacaacctaaaattacagtacctgactcctctagaattaaagctcaatgagaagaaccaggatttttgtctgccttactcatagctataaccacagcaccagggcactcaataagtatttgtattaaggaagagaaaaaatacacaaacacacagtaaaacattaatatcaccctatttcaatccttttacatgttgtatttctttctggagaacacacaattaagttactggcccagaatgacacaattagtttctcatagaaccaatactagaattgaggttgtctgacacaaaagattgcatgttgtccatatggcatacaaaaaacaggaataacagtctcaaattaaagcacaagccacgtaactactctattatttattaggctaagcttccattaattccaaacctgacacaatcaattatattaacccttttctccttacatcccacatagctagtataaatattgcaaatagaaaagcaaccttcttcaagacagattcaaaacgcaagccatgtacatctccaagaattcaaaccctcagctatgaatatagaggtaatcaggagagcattatctgatggtttatatcttctcataggtaatgattcatagctttctatgtaatttccttagaaaaacctaaaggagttcatatcaggttccaactttacaagagaatctaaataataatcctgccatcagttttctcaagttagaagtaaaaaagaatacatatttgtgtgtgtgcacgagtagcacattttcatgttcagagaaagagcttataaagacatacaaaagggaacctactttatgattccttgcactgtattcttgttcacactcaatcctttcagataatctacaataagaacctgtaagtcttctttgctttctaattcttctacataaagttctgtgaacctgtaaaacaatacataataaacactttttaggaagttaatataactatgttgacaatagaaaaacatgaaacagaagaagctatgtcagctcattttaactgcttgtagtataaaatgtctttcaacctgatatagaaacttagcataattaaaggataatgtaaccattaccaaaaatataccattattgcttcttctatgcaataagtcttctacgtatagtccttacaagaagaaaaagatacaaaagccgggtgcggtggctcacgcctgtaatcccagcactttgggaggccgaggccggtggatcacgaggtcaggagatggagaccatcctggctaacatggtgaaaccccgtctctactaaaaatacaagaattagccaggtgtgttggcgggtgcctgtagtcccagctaatagggaggctgaggcaggagaatggcgtgaacccaggaggcagagcctgctgtgagccgaggttgcgccactgcactccagcctgggcgacagagggagactccatctcaaaaaaaaaaaaaagatacaaaaataagaattaattatcctcattttcaagtgttttttatcataatcgcctatttaaaaaaataagtgcaataaaaaacaagccccctcatcatcaaagacaaaatggttgaagagaaaacaactactttaatgtagtttctaaagcttccctaacaagcttttattgctttataatgaagagagaggatctaataaagttactattttaaaattcaaaatgaagtaaacggttaccaacaataaatctggtcatttaatttattttttcccaaatgttacatacataaaacaccaacaactaagtaccttgttcatgtcagtgcttagtggcgaaaaataaaagaaactttaaaggccttttcaaatcattagcctcacccaaagaggactgtgttcctaaaatatgcgtatactggtatatgttttcctgttatatcgtgttatgaaatttttctaatagccaaaagattacctgaggaaggaaagatttttattttcaacaatatccactgtcatactaacacaaagggaaaaattctccagtgttctgaagattcccatatgcctaccacctacagagagcagaggaatatgacaaataaggtaataaagattcctctatcagcggcaatttcaagcattgctctaaagtccggttacattaatattaccaatctataaataaagagaatctaaaaacgaagtcttggtaatcccagcactgtgggaggtcgaggcaggcagatctcttgagcccagtgagagaccagcctaggcaacatggcgaaatcccacgtctgctaaaaatacaaaaacttgaggccgggcgcactggctcacacctgtaatcccagcactttgggaggctgaggcaggcagatcacaaggtcaggagttcaagaccagcctggccaacatagtgaaacccagtgtctactaaaaaaaaatagagaaatcagccagtcatggtagcatgcacctgtagtcccagctactcaggaggctgaggcaggagaatcgcttgaacccaggaggtggaggttgtggtgagccaaaatcacaccactgcactccagcctgggcaacagagcaagactctgtctcagaaaaaaaataaaaaaatagctgggtgtggtggcatgcacccataatcccggctattcaggattctgaggtgggaggtgggaggtgggaggactgcttgaaccggggacttgcagtgagccaagatcacgccactgcactccaacctgggcaacagagcaagaacctgttgcaaaaaaggaaagtctccaagaaccaaaccctcacctgtttcttattcctggtgggagatttcttttgcctacatcagttgctggattcatacaggcaaataaacggaagtcaggatgccgaaccagtggctctgttaagagaaaattacaaattctcaacaaaggtatgattatctaattccacagaaccccaggcccagccagcctgatgctggctgctcacaccatccttgtcttttctgaaaccccactgaaataactttccagacctatgtattcaatctaatcttatactgcagtcttttgcggtatgtttattcactgttatttatcttttatcaaccattcacctgttattttataagtgtgtctattatccacaactcaaacaccttgtcaaattatattattcttctttgcattccccataccacccaacactttaatgcactttgcagaaaattaatatctaaagaatgaacaaattccattgggaggcccatgtcatccttctaacaacaacaacaaaaaatctcactctaaagtggccacagggcttgacaccaagtcaaatcccaagggattcaagtgctacctgtgtctcctcgatccagcaacaccagggatccagaagatccttcaagcaaaccactcagacattctagtatttctggagcagccaagttaatctcatccaacaagatccactctcctttctttacagcctgagctaatgtaccctagaaaaagataaaataaaatgttaacaatgtgtcaaataaaggcacacttgccaagaacagttatgcaagcagggttagaaatagaggcggggcaaatctttcctacttgatgggcctatactttaactggctgacagcagataggcagagttaaggccaagttaattttttaaatgtccaaaaaggtcaagggaatatctttgagcctaacagagagatgcaataaactaaatcctctcattatgtggatggtcaggtaaatagcttacattgtagtcaggtctttaaaggcacccaagtgactattaaaactcaaaataaatatagggtcaggctataccaagattagacaaatgtctaaatcccagagtgtttagtgattgtcatacactgcctttcacacctactgaagattaaaatgcaacatcccttggctttagtacactggtgttatctcttcaaattctatttcctagatttaattggttttagaaataatcctattaagaataattctgggctgggtgtggtggctcatgtctgtaaccccagcactttgggaggctgaggtgggcggatcactggaggtcaggagttcgacaccagcctgaccaacatagtgaaaccccatctctactaaaaatacaaaaaatagccgggcgtggtggcacgcacccttaatcccagctactcaggaggctgaggcaggagaatcgcttgaacctgggaggcggaggttgcagtgagctgagatcctgccattgcactccagcctgggtgacaaaagcaaaactccgtctcaaaaacaaaaaaagaatagttctggggcccggggcaatggctcatgcctgtaatcgcagcactctggaaggccaaggtgggtggctcacctgaggtcaggagttcaacaccagcctggccaacatggcaaaaccccgtctctactaaaaatacaaaaattagctgggcgtggtggcacacacctgtaatcccagctactccagaggctgaggcaggagaattgcttcaacccaggaggcagaggttgcagtgagccaagattgcaccaccgcactccagcctgggtgacagagtcagactctgtctcaaaaaaaaataataataataattctgatgaccaaattttccacacccataatgtatggttgagtagaccttctctgttactaaaacatcaccaagtaagactcctgcttcctctagggcttcatctaaggactgtcacagaaacaaactttttttaaatgaccaagccacaaatatttaaccaagttgatccttcctacagggtcacaggacagcaaacagtagagatgtccatgccctgggattaaaattggggcaatgaagtgaacgggtccaaatccctctctcacatccacacactctttccccggagacacacatggtgagagaaagaatccagagttcactagctgtcatcaattgcatctttaaaaatagtaatagatccagcaatctcacttccaggtattcccaaaaaaaatctgaaaacaatatgtcgaagggatgtctgcaatcccctgttcattgcaccactatgcacaatagtcaagatatagaatcaacctatgtctccatcaacagatgaataaagaaaatgttgtatatatacatatatacaaacaatggaatcctatggaatcttatttggcttgaaaaaagaaataaattttgtcatttgctatgacataaatagaaccagagaatattatgctaagtgaaacaagccaggcacagaaagacaagtattgcatgttctcacttatatgtgaaatctaaaacaatggaactcaaagaagcagccagcagaatggtagttagcagaggctggagagttagggagtacagagtaatgaaagtacaaagccttggccaggcgcggtggctcacgcctgtaatctcagcactttgggaggccaaggctggcagatcacgaggtcaggagatcaagatcatcctggctaacacggtgaaaccccgtctctactaaaaatacaaaaacaaaaaattagccgggcatggtggcatgcacctgtagtcccagctactcaggaggctgaggcaggagaatggcgtgaacccaggaggcagagcttgcagtgagccgagactgtgccactgcactccagcctgggggacagagtgagactctgtctcaaaaaaaaagaaaagaaagtacaaagccttaattagacagaaaaaaataagctttcttccctttgagatatatattgcatagcatggcgaccatgccataaataataatgtcttgtacatttcaaaattactaaggcagtacatttcaaatgttctcactacaaaaaacggtatttgagatgatgaatattcactagctttagttattccataccgtattcataaatcataacacccttttgtaccccatgaatatatacaattataatttatcaatttgtacttttaaaatttttatttaaataatgatggtgctcattaagatcttataattgccataattaccatgaaggacacttttcaaaatcttcccccaaaatcattatttcattaagacaatacaaaatagtaacctgcctgaaacattgttttgcataaaatcaacgttcccataagctaaataacaaaaacagaaatacctctacaaatgcgaacaataaggtattttcagtcattttcatctgttgttgggcatggttgagtctaagaccaaatgcttcccatttctcttttatgagtaaccctaaaaaagaaagacaagaattcagcacacattttgaattgtaatatatacaacttctaaacaaacaaatacaattaacaaaacacacaaaaattaagcatcttacacaaaacactaagtctaaaaacttgtataatgctaacaaaatgccagacatgacactaattagcccacatgtatgaatatatatgtattaactgcctcatttatccctcacaacaaccctctggactagttatttttattcctgctttacagataaggaaccacacagaagtaaactaagccagcaaaagcctcttggctatagaatctagctccttagaaataagctttttctgaggaaatgtgccttactgaccactaaatagtacttgcacatcagcattaccagtcaactgtttttgtggaaatacgtgaataatggggcacaatacttcacaattagtcacttctgccaaagtcctagaaagctccaatttgtatcgctttactcttccccaaaactaatatgttaactaaagcccagccccatgccctcccccatggcagcctgggtcacatccttaccagtttcactgtcttttccatccttgttaacagcagacttgtgtacatgctgcattagtctcaggagatcatgccaccgtttctgtctgtaacaggtctgaatgtgccccaagaacgtaaagttttgtttcttggaaaatgtctgagcaaagagttcctcaaatgcctcccgtaagggtagccaaataagcttatggtccaccggtttataactgaaacagacacaggtaaatgtgattcacaaacttctgaagttaacagaagttagaaagcatggctcagaaaacaggagtaggtctcagatttcatttaattaacgtcagaaatactactgaaatatttaaaatctacgttacagttttaaattgtaatattttcccccatcgcaagcatttgaagggcccataatgaaggtaaaaactattattagataaacagtgttatgaaaaaaactagcctagcatggctgctcacatctataaccccagcactttgggacactgaggtggccagatcacttgagcccaggagttcaagcccaccctgggcaacatggcaaaaccctgtttctacaaaaaaatacaaaaattagtcaggtgcagtagcacacacctgcagtcccagctacttgggaggctgaggtgggaggcttgagcccaggaagtagaggttgcagtaagccaagaacacgccactgccactctagcgtgggcaacagagccagaccctgtctcaaaaaaataaaagtaaaaaaaaattgaaagtcctacttgaatagtaaaattcacatcatttattttaccaacatgtctaaataaatatgtatagggcataataaaaaaccatccatatttcattaaggttgaccaaaatccaaggaaaaataaatatctgaaattgatttacttatgtaaattaaacacagcccacacattatcagttaggaaaacgaagagtaggagagagcaacaatgatattgctttcaatgggataaaaattagggtagggcacgcaaaaaaaaaaaaaaaaaaaaaaaaatcttagctattgcaatggtttgtggtactccaaagctcaacttgtacttcttagtatttagattctttgttattccttagcattaaattcctctggctaaggagctaggaaattaacttaaatttgaatatttgggggaggtaagagataattttttaaaaggttgaaaaacattgctctagcttaaacatacgatgtctaagaggcactagttattcctagaaaatcttaagtacccaattttgtatggcataccattacaattcaggaagaatgagataaatcttattttcatgaaaaataatttaagttgagaacttaaaaggtaccaaaatatgtttcacaacaaacgtaagggaactgatggattactgctgactcactggcctagtgagggagaaacaatgagatgagtaaaaacccaatggcctgatactgagcatctgaatctgagagtccagttccaaagaaaaaaagttgaagaggaacatcaaactcactttcacttactcatagcactaatacattagtataggcatttctttagtccatttattaaacaaaaaatgtactgaggccaggcacagtggctcatgcctgtaatcccaccacttcgggaggtcaaggcgggaggatcccctgaagccaggaggttgagaccagattgggtaacaaagccaagatcttgtctccataaaaaattaaaaaattagctaggtgtggtgatgcacatttgtagtctcagctacttgggaggctaagaaagaaggatcacttgagcacaggagttctaggctacagtgagctatgataacaccactgtactacagtctgggcaacagagcaagaactcatccctttataaaaatttttttgagcacctgctatacgtgttagccactgaatcaacaagacccacaagatcttactcctgtgtagcttacaatcaaatgaaagtgacaataggccaggtgcggtggctcacacctgttaatcccagcactttgggaggctaaacaggtggattgcttgagctccagagttcgacaccaccgtgggcaacatggtgaaaccctgtctctacaaaaaatataaaaattagccaggcatgccagtgtgcccctgtagtcccagttacttgggaagctgaggtgggaggcttgttcaagctcaggaggtcaagtagtagcttaagtgctatgaacataatgtaaggtaaaagctgaatgggtgatgtgagttttggtaatttgagtatcacagtcaggaaaggctttgttgaggaggggacatttgaaggatacctaagtcaagcaaggatgtgagctaagcattatctgtgggtgcaaggaggccacacagaagaaatagcaagcatttaggtgcaaagcagaagaaagtggttggagctcagcaacacaggggaaggtgagagatgatatcagagaagtaccactgtcagattatgaagggctatacaaaccaaacattttattctaaacctttgtattttatcctaaatggactgagaagttcagtggaggaacctgaggaagagagtgagaccagactgggttacaaagcaagaccttgtctccataaaaaattatactttactgggctgggcgcggtggctcacgcggtggcccagcactttgggaggcagaggtgggcggatcacgaggtcaggagatcgagatgatcctggctaacatggtgaaaccccatctctactaaaaatacaaaaaaaattagccaggcatagtggcgggcgcctatagtcccagctactcgggaggctgaggcaggagaatggcgtgaacccgggaacagaggttgcagtgagccaagatcgtgccactgcactccagcctgggagacagagtgagactatgccatacacacacacacacaaaaaattatactttatctgattgtactttaaaggatcattgtaactcctaaacaaaaaagactataaaaagattaggagtagaagcaaagataagagaccaacgcagtggactagacagtagataaactagaacgacaacagtgaaaatggtgagaaattgaacaaaatatatgtgtcatttaaataagattgctaatctttttatttatttaactttttattctaaagataaagtctcactatgttgcccaagctggtctcgaagtcctggcctcaagcaatactcccacctttgcctcccaaagtgctgagattacatgcatgagccactgctcctggccaaaattgctagtcctgaaaataacagtataaatgggatccaaagttaactgaagaagcagagtaatggttaagaacacagacactcaagactgcttaggttcaaatcctggatctgccattttcttgaataagtgacttatctctctttgcctcagttctctcatgtttaaaatatagaggataacagtctgttgtctcacatggttttaagaagaccagctaagttaacacagaaaaaggactcaaaacagtgcctggcacataatgactgccacagagagttaatagataattaatacaattattaatgtctctgttattattgatctattgaatttatgaaaaaggcagcttaatatttcaaagtagactgagttccttaaagaaaacctcattcaggccaggcgctgtggctcatgcatgtaatcccagcactttgggacgctgaggcaggcgaatgccttgaggtcaggagtttgagaccaacctagctagccaaaatggcaaaaccccatctctactaaaaatataaaaattagccgggcctggtggcgggcccctgtaatcccaggtactcaggaggctgagggagaagaatcgcttgggcccgggaggcagaggttgcagtgagctgagatcacgctgctgcactccagcctgggcgacagagttagactccatctcaaaaaaaaaaaaggaaagctcattcatttaaagctgagcacagtattacctaaagcccttaagtcaatacatatttcaatacatgaaaagatgaaaaaacatacatttcaaaaaagaataaacaaaacaaaatcaactgcaactgcaacacaaatattcaacgggaaccaacctgacacctcagagaactgaggatataaactacaaacaaccaaacaactaaagagcaagattttcaaaccgtcttctgcagaaaggcaccttgggagccacttaaatgccaagaaggtccataacacctgccttcatggaaaataactttgcttatatctgttacatacactggaaccacatgtaagcattcatgtgagaatggctacacaaaattataacatgtgaaacaacaaaaagtgtaaaaagaatataaaatgtacatgctgagtaattagaatgataagccatttctcttcatgtcatggacagggttctgagttcaaattgcatgctcctgccatatgctcttctgggcagtttcttttaaagactgttctatgggtgggtggcaaggaagatgaggattggctgctttattactatttctacaatatctttaattttcctctattttttttcttctttcattgccaagctctccagggtaaccggtccttctcaatatatcactgtttctccctcagaggctgcccctctgaagcccattccctatagtaagtgctatgaacatgcactctgtattttgccctttagtgctagactttctctttctggagtgattttatctgccacatctaagtcttccatgccctctactctttttcaaggattatctttggctgtccccacccgcaactcttcaaatttatgtctctacctacaggtaatgtgagggtctacatgctgcttaccagaagcccatgttaaataaaatgacaaaaacgagtttaaaattaaatgaaggaaaaagacatatcatgccaacactaatcaaaaagcaagaagcacaaaagaataaaaccaaggaggtaatggataatggacactaacaaagagcaaaagacaatttgctataatgtaaataatttgatggtttctaaggcccttatttttataaagtatctttacccataataataattgcttcaaaaatcaatctagggcagggcacagtggctcacacctgttaattccaggactttgggaggctgaggcaggtggatcacctgaggtcaggagttcgagaccagcctgaccagcatggtgaaaccctatctcaattaaaaatacaaaattatccgacatggtggtacatgcctgtaatcccagctactcgggaggctgaggcaggagaatcgcttgaaccaaggaggcaggcgttgtagtgagccaagatcatgccattgcactccagcctggacaacaagagcaaaactctctcaaaaacctaggctggggatggtggctcacacctgtaatcccagccctttgggaggtcaaggtgggaggatcattttagctcaggggaccagcctgggcaatatagtgagacctcatctctataaagttcaaaaaaaattagctgggtatggtggcacatgcctgtagtcccaactactcaggagggcctaggtgggaggatagcttgagccggggaggtcaaggctgcaataagccctgatggtgccactgcactccagcctgtgtgacagagaccctgtctcaaaaaaaaaacaaaaataatttttaaaagtttttaaaattaatctaaaaaggccaagtacagtggctcatgcctgtaatcccagcactttgggaggttgactggggaggactacttgatctcaggagctcaagattcatcctgggtgatatggtttggctgtgtccccaaccaaatctcatcttgaattgtagctccaattcccacgtgttgtgcaagggacaggtgggaggtaattgaatcatgggggtgggtctttcccatgctattctcatgatagtgaataagtctcatgagattagatggttttataaaggggagttccctacacaagctctcgactgccaccatccatgtaagacacgactttgctcctccttgtcttgtgctatgattgtgaggtctccccagccatgcggaactgtgagtcaattaaacctcttttctttgtaaattatccagtctcaggtatgtctttatcagcagtgtgagaacaaatgaatacactgggcaacagagtgtgacctcatctctacaaaaatagaaaataattagctaagcgtggtggtgcacgtctgtagtcccagttactcgggaggctgaggcaagaggatcacatgagcctaggaggtacaggctgcagcaaactatgagggcaccatggtactccaggctgggcaacagagtgagaccctgtccccccccaaaaaaagagttaaaattaaataaataaataaaatccaagaccagctacagtgcctataatcccagcactttgggaggcccaggcgggaagattccttgagttcagaagttccagaccagtctgggcaacatagtgagacctcatctctactaaaaataaatcagctgcatgtagtggcttgtgcttgcagtcccacagctgctcaggaggctgagatggaaggatcacttgagcccagaaagtcaaggctgcaataagtcatgtttatgccgctgcactccagtctggatgacaaagtgagaccctatcttaaagaaaaaaaaaaagatccgaatttgcaaaccaggttattatttaacatactggacacatgcaaaatatatttaacataacttataaaacagatgaaaccagcaacacggcctgaggataggaatatttatcttttccctatcccatctccttacccacagctgaattttgttctccattcccttgcctttttaaaaactttttggtattctcatcttctacaatgattcttaaacaagggagtcacctattcacttataacagaatatatgttaaaagattttatttaaatctctttgtagtaatataagagtacagaaaacaaggcacatttccaaccccacaaaaactgagaaaaggctcggtggctcatgtctgtaatctcaacacttcaggaggctgaagcaggactacttgaggccaggagttcaaaaccagcgtaggcaacagagctagatcctgtccagggtcttgctttgtcatcccagctaaagtacagtggcataaccacagctcacggcagcctcaacctctcaggctcaagtgatcttttcaaatggaaatgtaagtagcgttttcttttaataagtgatgctgacctactaacaaggaaaaacagatatattctattcaccaagttggcaccaaaaccaaattctagttaatcatactttgagtccaaccttttcgtgtcatcaatttgcatcacaaatgtactcctgtttactcactatatttaaaacaacttgcaatggctaacataacactacaaattcacagtagaagagaaggacccagtccatgttcagttagtacaagatcaatgccatttatgttaggactacttaatggtatgaaattactaaagacatatagatacagaatagagagaaatagaccaggcctggtggcttatgcctgtagtcccagctactgggtaggccgaggcaggaggattgcttaaacccaggagttcaaggctgtgctaagccatgatcacaccactgcactccagccttggtgacagaacgagatcctgcctcccaaaaaaacaaaaaaagaattaagaggccgggtgcagtggctcacacctgtaatcccagcaatttgggaggccgaggtaggtggatcacaaggtcaagagatggagaccatcctggcaaacatggtaaaaccctgtttctactaaaaatacaaaaattagctgggcatggtggtgtgtgcctgtagtcgcagctactcaggagactgaggcagaagaatcacctgaacgtgggagccggaggttgcagtgagcagagatcgcgccaccgcactccagccgtgacagagcaagactctgtctcaaaaaaaaaaaaaaaagaataaaggtaaatatatacagcagtatagacatgtctgcttaaatgaaaaatcatatatattaataagaacagattgccaagttcctcaaacaaccaactaaacataagtaaaataaaaccaaggtagaaagcctggagtgcagtggcacaatctcggctaactccagcctctgcctcccagattcaagcaattctcccacctcagcctccctagtagctgggactacagcacaccaccatgcccaactaattttcgtatttattggtagagatgggatttcatcatgttggccaggctggtctcgaactcctgacctcaagtgattcacccatctaggcctcccaaagtgctgggattacaggtgtgagccgccacgcctggcccagaacttacactttagatcaactgtactgtatacacaaacattaattgattatatacttgcctgctttttctccttcttccatcatatgacctttgagaacaagggcctcaagtgttcattaaaatgaagagaaacatctacacacccatgagctcctcaataaattcaaataaataccttgctgtggttggggggtaaggtgcaatcttgctcaaggtgccttagagagactaagatgagcaatgtcccaccataaatcttattcaaagcaccatacacactgatggtgggaccctgaggaaactaaaataagcaactcacaccttaaatcttactcaagggagtttaccctttttcctgcacaaacacaagaccagaagaatgactgatcctttgccttagcttcattgctatactaaaaatcatacccatgctgagacatgggacacatgaagaagcacgttatcaaactgttcaagtgccagaagttccctgcctctacatgcttaaatatcacttccttcccactttagccccttaaaattactttcctgtcttactggggccagccacagaattctctcttttgtgtccctggtaccctgccaaaagctccaataaagccttatctgagaaaactctttttctattgcatcgagcatcctagaacctgtggttgttaacactaagaaaacagtatttcttacctcaagcaataaacacaaaaataagaaaaaaattttaagccacacttaccctccaagcaagtctgcagtatcactttgttgattcatattgacaaccctcaaacggtggccttttataaagaaagtgcaaaagtgttactccaaaaatttaaagaccgataatatccagtgtgctccttaaggctgtgggaatatggcatagggctttattttttgagacagagtcttgttctgtcaaccagggtggagtgcagtggcccaatcatggctcactgcagcctcaacttcctgggctcaagtgatccttgtctcagcctctcgagcacctgggactacaggcatatacaaccagacttggctaatttttgtaattttttgtagagacagggtctcatgatgttgccaggctggtcttgaactcccgggctcaagcaatcctcctacctcaggctcccaaagtgctaggattacaggcatgagccactgcgcccagcaataaggtaaattttcaaatgtgcctttgctctgaatcatgagagcccagaagttggagaccaacctaggcaacatagctagacctcgtctttacaaaaaactttaaaaattagccaggcgtggtggcacacacctgtagtctcagctatcttcctacctcagatctgaggtaggaagatcacttgagcctgggaggtcaaggctgcagtgagctgtgagctgtgggctcgccactgcactccagcctcagcaacagtgcgaccctgtctcaaaaagaataaaaataaaaagaagaaatgaggtataatgcaatatgtagaacataatcccatatctgttttgaaataaaacaaaatctatacgtatatgtatttgcataagcatagattggaaatgaaataatttaataataatctattaacagtagttatttccaggcagagattacatgtggggtgctggcactctttaaactctgtggtctttggatttagtatttttaaaaaaggaaaaaaagtagtcagtgtgaaatatctgggggcagatttatttcctctagggattacctgtaatgtgagccaagtattggatggtagaggttttgccagtcccggtctctcccaccagcaacacaggctcccctttgctgacacacactgcaagctgctcgatgagaacagaggacggccgtgtagcagcgaaagtgaacttctccctgggaaggagaaaaaaagagtttaaaaaccacgctgcaagcttctcctagttttgctctgggaaaccatatattccagattcaacaacaaggatgagaaaacagctcacagtaactgtcttcaagctataccagataatcttacaacatacaaaaattacagaatttagttgctctgcaaacactgaatactcacacatctgatacgatgctaggctctggagattaaaaagatcaataagacaagactacctgtactagttagctcatcttggacaaattacttaatgtgtcttagcctcagtttcctcacctgtaagatgtgggtaacaacagtacctagttgtaataggttaataatctttccccaaactcatgtctacccagatcctatgaatgtgaccttatttcaaaatagggtctttgaagaaatttaatcaaattaagataaggtcatattgcattagggtgggtcttaaatccaatgactggtgtccttataagaggaagatttggtgacatagaaatacacacacaaggcagagcatggtggcacaagcctgtaaccccagcattttgggaggccgaagctggcagatcacaaggtcaggagctcaagaccagcctggccaatatggtgaaaccccatctctactaaaaatacaaaaattacccaggcgtggtggtggatgcctgcagttccagctactcgggaggctgaggcaggagaatcacttgaaccctggaggtggaggttgcagtgagctgagatcgcaccactgcactccagcctgggggacagagcaagactccatctcaaaaaaaaaaaaaaaagaagagaagaaaagaaatacacacacaaggaagaagggccacatgacaacagagacagaacttagagtgatacaactacaagccaaggaacaccaaggactgctgggagccaaagaaaccaggaagaggccaggcaccgtggctcaggcctgtaatcccagcactttgggaggtcaaggcaggtggatcacctgaggtcaggagttcaagaccaacctggccaagatggtgaaaccccgtctctactaaaaatacaaaaattagctgggcgtggtggcgcatgcctgtaatcccagctattcgggaggctgaggcaggagaatcgcttgaaccaggcagctggaggtttctgtggaccaagatcgcaccactgtactccagcctaggcaacggagtgagactctgtcttaaaaagaaaaaaaaaaaaagaaaagaaaagaaagaaagaaatcaggaagaggcaagaaagcattctcccctagagccttcagagggaggagcatggccctgtcgaaaccttgattttacacttccagcctccaggactgtgaaagaataatgtcattgtttaaaaccaccaagtttatggtaatttgttatggcagccctaggatactaatatattaattcacaggattattacaaccactacatgagaaaatatgtaaagcacttagtacaaagtcagacatgtaataagtatttaatgttacctcgatctcagaatcttatataaccccagccttctaggaatttacagactaatgttagacataagcctgacttccaactgaggcatacttcactaaatacactgcagtgaataaaatcaataattcatctttggtagtgccaaatctttaatgactttcatcacctctttcacctattgatatctaatttcacagaacatactttgggaaaacactgctccttcccatatagcatactacagatatcacagttcagacatgtgttttgcacaaagacaagaggctgagctagaccttctgtcaagtttctggaaaccccacagttggcagcttagtttagagccctacttacctctgtaggtgaacagcctcactttgtttccgtagaagccgcactcgacccacttgcaaatctagctcattgatcacaatttctggtttataaagttgacaaaagaattcagcctgtaggaggtaagattttacctgagtaaaaatccacatgcttttggaatatttcctcatccagaggcttattttggccctcaaattagcactctacaaagaattattctctacttcccagatagttgagttggcttttcataaagaaatttcttttttcattttccaaacttctatgtttttcacaacatttatcatgtttccctaaaatggtacttttcaaataagccctacctatatatggagtgaacacactgatatatccaatagagaaagtgaacagtaagtcctcacctaaaaggtaagaaaaaaaaatcagagaaatcttctctagctatgctctcctctgctttaaatttctaacataatgttaggaaatcatggtacatctgactacagccaaagcaaaaagagctgtggcagatgctcctggatgtctacccaacagccattcctctcttctccaaagaacacagattttgttcaggtttggggcagaagtgaaagaagcaaactgctctgggaaaagtgagtccttccacaacaagagaggatgaatattggtggaatgaatattcatggtggtttcattcttctttctcatgattaacatatgtatcatttaagtccctttcagtaggacgttctatgacctccagccaaaaccatcccaactatttcagaagccttataaaaatctctactactgtaattcctgccataagatcttttagagtcattattcacatgagaatgtcagatatctgcttcaagatgagcccagacatttttctagacaccagtgccactgctgaaaggatccctcctcccaaaatacgtattttgacataaaacaagaatggcaaaatattaacaatgtcagcaatgaaacaaagtagtgagtatacaggtattcactgctactactctttgcaacttttttttttgtttgtttggttggtttttatcagagaaagagtctggatctgtcgcccacgttggagtgcagtggcacaaccttggctcactgcaacctctgcctcctaggttcaagtgattctcctgcttcagcctcccgagtagctgggattacaggcatgtgccaccacacccagctaatttattgtatttttttagtaaagacagggtttcacagtgttggccaggctggtcttaaactcccgacctcaggtgatccacccacctctgcctcccaaagtcctgggattacaggtgtgagccaccacactcagtctcttgccaatttttctaataagggaaaataataaaaaagatggaaaaactctgcattaagttatagacaaaggtattactaaaacatagttacattcctgagtctaatgcctacaaaataaaataaatgctcactaaaacactgaagacgacacaggacatgaggaagctccttttaagaatgtggaacatggctgtgcacagtggctcatgcttgttatcccagcactttgggaggcagaggctggtgggtcacctgaggtcaggagtttgagaccagcctgaccaacatggagaaaccccatctctactaaaaatacgaaattagctgggtgtggtggcacatgcctgtaatcccagctactcaggaggctgacgcaggagaatcacttgaacctaggaggcagaggttgtggtgagccgagatggcgccattgcactcgcgccatttgggagttgtatgcccacgagaggctgcaataaaagcaccaacttttacaaaagaggtaccactgcaaaagctgttccaactaaggactagagaccagcaagcaagcaagcaaaaaatcctagcctcctttcaacagggaagtaaaaaaacagcacacataccttttttctagaaatgttcaatttgcttccaataacttctgccattttcagtttgcttgtatgctcagaaagcattgctgtgaaacagtctagagcctattaaaataaccaaggtaaatgctgactgatttttaaaataatatattaatcacagaacatcattttcctggccacaagagggagaaacacaaaatccagcaggaacatttctctaaaaatgaagggagtgcaaataaggtaccaacccaggactgaggacctgaccataatggaaagacaggacaccaataaatataaataattgactattgaaatacttgccaaataaaaaaaacaaacaacaaaacaccccactttgcaaatcctagcttcgggcaaagaagagcaattagtgttgaccactgggtacatggttcaaggagaactgactcatatagtgctgaggtaatatcaaaagactgctttctaactgcaagggaaacactaggtgtgcaatacctcatggtcattatcttaacctagtactcaatcttagcaactaccagtgagccaaccagttatgtcttctgatgtgatgaaatataaaataccaccaaaaatggactgtaccccaaatatgttaaacttgaattcatcaagcattttttgtattttctatttacagaaaatatgagagataaaacaatgtaaaggacaccatgagtgtgggattgaaaccacctttgcaaagattatgacagagcaatctaacatggctgactccatcttacttctaagcctcataggctggccatcttcactcattcctaggcataggccaagctaaccatagtaggaatttagtttatagtttaacttggaagcaaggatgataatagtcccttcctaaaactaaccccctctttgctcagggaccgaaacctaatgaaagaccacaagattaggattatgggaggggcctgaattctgctaaaatgtaggtgtagtttctataatcccttagtgctcaggagtcatgtggccagaggtcacaagacttgtgacttccccagctgctcctatagataacaccactatcgtagaaactaaaattggccttttgaggtgattttcagatttttgcattccagcaactaactaaccccacctgactcagttaccccacccagaagtagactcagtatacaagaccattttccacatccctatgagttcatccccaaccaatcagcaggcacccattccctagtaccctgcccaccaaattatccataaaaaccctagcttctgagttaacagggagattgatttgagtaacaattccatttcccatatggctagcctagtattcattaagctctcttgaagactgctttgagtaataataaaactggtctcccatacagcaggctctgtgtgaattactttattgcaaattccgtcatgataaattgtctctgtctaggcagtgggcaaggtgaacctgttgggccgttacaatctgatctattttttcatcctttttaaaagtattttatatttttgtcctgacagttgaaatactcagaatacaacacttaatatacagtattgtctcaactaataaaaaaaaaaaaaagagaaaacaggcccccaatactgcaaattgctttcgtctcagtggtagagttagtagttaagtttcttccatcatcttttctattgttttttaacaagaagaatctagtccttttaaaattaaaatatattttaaagccataattctaagtaaagtcagtttacaagatgcaaaaagacccaaataatggcacccctaaaattcagtaataagcaggaaaacttatacccagaaatctaaagttacaaacattaatattaaaaatacaggatttactattataatacagttatccctacatattcctgggggattgattccaggacctctcacggaaaccaaaatctgaagatgctcaagtcccttatataaaatggcatagggtgactgggcgcagtggctcacacctgtaataccagcactttgggaggctgaggtgggtggatcacgaggtcaggagatcgagatcatcctggctaacagggtgaaaccccatctctactaaaaatgcaaaaaaaattagctgggtgtggtggtgggcgcctgtagtcccagttactcgggaggctgaggcaggagaatggtgggaacctgggaggtggagcttgcagtgagccgagatcacgccactgcactccagcctgggtaatagagcgagactatgtctcaaaaataaataaataaataaataaataaataaataaataaataaataaaaaaaaaggtatagggcctgtgtcagtatgtactaaaataagccaaagaaaaaaaaaattttacaggtgtagaatctgcatataatctatgcacaccttctttatttaaatctccaggttatttataatacctaatacaaattataatacctaatacctgatatttcataaaggtatttggtctgcatggaataaggggggaaaagagctggacaaaaacaatttgccagttctcaaaagaatataccctactcatttgaaatggctggtctcaaattcagtagaaatatattttagagtagaagagaacaattcctctggttaccatagtatagtttaaaagagttacttctaaaagaacatccaactccttttgttcttattccacctttaccgctatgatttggtcttctgtaataatatccactagaatggttaagtcctgtgcacatacatgctcccatcatagataataacaatggaccccagatgaattagtcagaagagtccaccaccctcatcagaaacccatcctggatttatggtgtcttacaaagaggttcagtcaaccaacatcaaccagccctactgagaaaagtagagggatcggatagttacaaatttatcaaacagactaagaaattatatgtaggaacaaacattgctttattattacccgggagtttctttcattttacctttaatttcactacctgttttactctatatcaaactatacttcttctgaaattaataataatttgtttcaaaaaccacaaaacatgtattacattcaattagctttaatgccacgttagttgagttttaactagctaagaataacaaaccaggccgggtgcggtggctcacgcctgtaatcccagcactctgggaggccgacgtgggtggatcacttgaggtcaggagatcgagaccagcctggccaacatggtgaaacctcgtttctactaaaaatacaaaaattagccaggggtggtggcaggtgcctgtaaccccagctactcgggaggctgaggcaagagaatcgcttgaacccagaaggtggaggctgcagtgacctgagatcacgccactgcactccagccttggggacaagagcgagagacttcgtctcaaaaaaaaaaaacaaaaaaagaataacaaaccatacttggaaaaaagaaaaaagtctgatggcaatcaaaagacagaaaataacaacggaagtcaacagccttacagaaccaagacaaaaaagactggaaaactatatcttacctcttgaaaaatatttaatgatgctgataaagatgaactgtcaaagctatgggcaatcctattacaccaattcagcagatccctttaaaaaaaagaaagaaaagaaaaaacaaagaaaagaccacaggccaaagacatcaaaggcatcagaatttattgacccacttaagtctgggcatacctgataactttcttctttcttctgacaatgcttagataaaaggtatttgggaaaccagtaagggttctcaatccttcccctctttgtatttgtgtgtaaaatttaaaaacaaaacaaaaagagttcccaatcttcacccattccaggaagtgacctaccaactcattactctctgccatccatgccagacaaggtagcaggaaaggaggggagcaaccaatcagatcagaatgaggagatgccatttcctttttttttttttttttttttggagacagagtctcactctgttgcccaggctggagtgcagtgcgtgatctcggctcactgcaacctccacccgggttcaggcaattctctgcctcagcctcccgagtagctgggattacaggcacctgccaccgtgcctggctaatttttgtatttttttttttttttagtagagatggggtttcaccatgttggccaggatggtctcgaactcctgatctcatgatccgcccacctcggcctcccaaagtgctgggattacaggcgtgagccaccgcgcctagcctgaggagatgcccatttctaattctcacttctcaaaggggaagtcaaccactgagaacacagagtggcacagaagtcatagatagcgaaatccaagaagacttatttaagactccaagtgtcagaaaagggcattcagtgaaagaattatgttaggagccactcccaagttggtctttaaaagttattttttaaagttaaaaacattaccctaatcgagccttcccagtcattaattataaatctgaaaaagggatctgacaccatgaagcaacctataatttcaaaacctgactatttacttctagctggtaagaactttgaacctaggaggcggaggttggagtgagccaaaactgcaccactgcactccagcctgggtaacagagcaggaatctgtctcacaaaaaaaaaagaaagaaagaaaagaaaaaactgtttagtccagtaccttagagataattctcttccctcaagggttggtcttttgttttctcttctggcttctgaaacttcttcaggtgcctgttcacatccaacagaactatcactccaagagtgatgtttctctccagtaagttggatataaatgtcaagcaggtgatcaaccactgccaataggctaggatatctgctctgaagaacctgacagagggggaaaaaaaagaaaatttaacagccagcatggtaatttttgaaagcacacaaactactgctgaaactggtcagccaaaaattgtatttctctatgaaatttgttcactgggggacggtagctcacacctgtaatcccaacactctgagaaaccaaggcagaggaattgcttgaattcaggatttgagatcaacttgggcaacatggtgaaacatcatctctacaaaaaatacaaacatgggcacggtgccgtgtgcctgtagtcccaggtactcagcaggctgagcagggaggatcatctgagactgggaggttaaggctgcagtgagcagtgatcatgcctaggtgacagaacaagaccctgtctcaaaaaacgtaaataaataaaacataaaaataaaaatgaaaagaaattttgtcaactttaccaaaaataagaacttcccccttactcactcctgttcccacccacctatttcactcaatcatgatgattttcttcctacccagaactcagttaccagcaatctcaccatctacaatacagtttcagcggtagaagtcatgttaaaaggttctccaagtaaccaaaatataagcaaccaactctaaagaatttattcattaaagaattcttaaattactatttaatttcaaacacagctctggtaaggccattatgtaatttctcaatgaaaagcatgtaaaaggagcagggtacagtggatcacacctgcaatcccagcactttgggaagctgatgtgggcagattgcctgagtccaagagtttgagacaagcctgggcaacacggtgaaaacctgtctctacaaaacatttgctgggcagggtggcacacacctgtagtcagtcccaggtacctggcaggctgagctgggaagatcacctaagcctgagaggttgaggctgcagtgagctgagcaccactgcagtgcaccactgcactctagcctgggtgacagagtaagacctttcctcaaaaaataataataataataataataataataataataataagatataaaatcagttaagctgggcgtggtggctcacgcctgtgatcccagcactttggcaggctgaggtgagtggatcacaaggtcaagagatcgagaccaacctggccaacatggtgaaaccctgtctctactaaaaattaaaaaattagctgggcatggtggcatgttgcgggaagtcagggaccccaaatggagggaccagctggagccacggcagaggaaaataaattgcgaagatttcatggacatgtatcagttcccaaataatacttttataatttcttatgcctgtctttaatctcttaatcctgttatcttcataagctgaggatgtacgtcacctcaggaccactgtgacaactgtgttaactgtacaaattgatcataaaacatgtgtgtttgaacaatatgaaatcagtgcaccttgaaaaagaacagaataacagcgatttttagggaacaaggacagacaaccataaggtctgactgcctgcagggtcaggcaaaaagagccatatttttcttcttgcagagagagcctatcaacagatgtgcaagtagggaagatattgccaaattcttttcctagcaaggaatattaatattaataccccgggaaaggaatgcattcccgggggggaggtctataaatggccgctctgggaatgcctgtcttatgcggttaagataaggaccgagatacaccctggtctcctgcagtaccctcaggcttactagggtggggaaaaaactccgccctggtaaatttgtggtcagaccggtctgttgtttaagatgtttatcaagacaatacgtgcaccgctgaacatagagccttatcagtagttctgcttttgccctttgccttgtgatctttgttggacccttatcagtagttctgctttatgccttttgccttgtgatctttgataaacccttattagtagttctgctttttgccctttgaagcatgtgatctttgtacccactccctgttcttacaccccctccccttttgaaacccttaaaaaacttgctggtttgaagctcaggtgggcatcacggtcctaccaatatgtgatgccaccccagacagcccagctgtaaaattcctctctttgtactctttctctttatttctcagccagccaacacttatggaaaatagaaagaacctatgttgtaatattgggggtgggttaccccaatagtggcatgcaccagctactcgggaggctgaggcaggagaatcgcttgaatatgggaggcggaggttgcagcgagccaagatcgtgccacagagtactgttctgggcgacataaaaagactccatctcaaaaaaaaaaaaaagaaaagaaaatgtaggaaaaaatatttgaagtttgtggccaggcacagtggctcacacctataatgccaacactttaggaggccaaggcaggcaggtcacctgaggtcaggtgttttgagaccagcctggtcaacatggtgaaaccccatctctactaaaaatacaaaaaaaatagccaaaagtggtggtgggcacctgtaatcccaggtacttgggaggctaaggcatgagaattgcttgaaccaggaggcagagattgcagtgagccaagatcacgccattgcactccagcctgggcaacaagagcgaaactgtttaaaaaaaaataaaataaaataaaaataaaagattgaagtttgtttggtgtcacatatttacctatatacctacatcaataaagggaaaagcatctcttccatgtctgaatgaccactgacaatgctttgtctgccactctcctagataaagcactggggaagggaaatcttccaagtgagacataaaagggaagtggggcatgaacggagtcaagtgtaatatacttcttactgatctaggataaccacaatactagaaactgaatcaatgtagaaaacctataaagtgatttacctcaattctcattaatgcctagatcaaaatgtccattaagtgtgaaagacattacttcaaatcaacttagtaaaatgatcctctgtagacaactgggaaaatttgaatataatctaagaattcaatgatactgaggaattactgttcattttattgtgtataataatgttattgtggttatatatgaaaatgccattaaattttaagagatgtatgctgggagtttgctttcaaatatattagcccagaaaaaataacagatgaagcaaatacagtaaaatactagcacacagactgcaaaatttaggttgatgagggttctggtggtttattatactatttcctatttcacgcgggagccactgcacctggccagcattgatactttccaagacccacgtacctcattcagttctctcttatccaggttatccaggtgaattttggtccaatatttgtctagcaaagtagcatgactgtttagcggtcgataccaatttcctccacagctcaagagtctacgtttcaaaataaaaaacacagtcacacaaaattccaaattttaatcctgaattgtgcctctggatattacttgctgtacactgtctcacataggaaaaatattcataatcccttctgtttccagatactacactgttgggcttacagggcagatgacaaatgaaaggctgacagttaacccatgtttggctcttctcctaagtagtagtgatagtgctttaaccaaatattttcaaatcactgcaaataattctacaaggtaaatgtttttatttcaatgacaggttcctcttccttaaggcataaataacttcaggaaagagaaagcataatccaaggctcatagcattaacattaagttcactgcttgttaccagaagctacagtacttgaaaaccattaaaaatttccagaagagaaaaaagtagagaaggaatatacattaaacatacactctggggaaggtacatgcttatgcataggccacttagtcctcacaactgtcccgagaggaagatgccattcttttcttctgacataaatggaagagaaggaaagaatggcccttatacactcaactgtgactgaaaatggcagaactgaaaattgaattcaagtttatcagatcacaagtttgtctaacatctttccacgatgtcccaggtctttctgggaagtgtttgaatctaccagggaagaacttcactatctctataaataaaatcaaggtcagccaggctcagtggctcatgtcggtcgttgggaggccaaagcaggaagatcgcttgagcccaggagttcaagaccagcctgggcaacaaattgaggcctcatctctaaaaaaacataaaataagacaggtgtggtggctcacacctcccagcactttgggaggctgaggcaggtggattgcttgaggccagaagttcaagaccagcctgggcaacatggcaaaaccccatctctattagaaacacaaaaattagacaggcgtggtgcgtgcctgtagtcccagatacctgggagactgaggcacgagaatcgcttgaacccgggaggcagaggttgcagtgagccaaatcatgccactgcactccagcttggatgacagagtgagactcggtctcaaaaaaaattaattaaataaaataaaaaatcaaggtctatcaaaactaacagtgccaggtacagtggctcatgcctgtcattccaacacttaggaggccacagtgggaggactgctcgagtccaggagttcaagaccaacctgggcaatgcagcaagattccatctctaaaataataataataataaaaaaaatttgtttttagccaggcatggtggtgtacccctgtagtcctagctactcaagaggctgaggcaggaggatcacttgagcccaggagtttgtggttacagtaagctacgatcaagccactgcattccagcctgggtacaaagcaaaacactgtctctaaaaaataaataaatgtttaaaacaaaagtaacaggattgggccgggcacggtggctcacgcctgtaatcccagcacatcaggaggccaaggcggaggatcatgaggtcaggagatcaagaccagcctggccaacatggtgaaaccccgtctctactaaaaatacaaaaattagcccgtgtggtggcaggtgcctgtaatcccagctacctggcaggctgaggtaggagaatcgcttgaacccaggaggtggaggttgcagtgagccaagatcacaccactgcactccagcctgggtgacagaatgagactccatctcaaaaaaaaaaaaaaaaaaaaaaagtaacagggtcagctgggcacagtggcatgtgcctgtagtctcagctacttgggaggctgtgctgggaagactgcttgagtacagaagttcaagaccagcttgggcaacacagtgagaccccatttcaagaaaaaaaaaaaaagagtaattgggtctagggaggtattccttgaatactatcgggttagctccacactccatgcagaagtcaatgttaactgaggtaaacactaatataatcattaactatagaatgatgttagtttcactcatgggcatttaaagacattgaagaagctgtgcaggtatagactagcagtaagaaataaaccactgccttcaggtaattttaaaatgtaggcaggaatatatactaagcacgctcagtttttgtgcctttgttcatgcttatatccaattaatttttcaattgcctgaaatctacctatcattatcaccatcatggctagccattaactgggcatttattgtgacaggtctttagtacaagtcatttcacttattctttacagccaccatttgaagaaggtattattaaccccatcataaccagccaaggtatacataggtactaagtagcagtgtcaggactcaaaccctgggctatctaacaataacctcacctctgattattttttaaaacatgaaataaggtgaagtgttttaaactggttacttatttttaagtcgggggggggacctcttattttataaattatcttcattaaaaataatcaggaatgagaaggttagacctgttatcacttccaactaaccttgcttgaagtagacccagagaactctattacaggacctctggctcagcatgcagacttacgagtaagtggctccagagtgaaaacagaaaggttactagtacatacctcctggttgcaaaaaactgaaatccaggtgccactttcagacagtcacctcggccaggaatcaagagctctccattctccaagagagggatcagcacagaaacctaaatcagataacaacaaccgcactgataaagtaaagctattaagacagaaataatcaaaacaaaacaaccctctctcaaaatgacagacacacccttaaaggaaacgtcagctctcatagtccaaactggggtcagtatgcaggtgggaacgtctgaatcacctacactccagcacaatttacacactcgacattcacgagtgcctcctgtggatcacaaccaagcaagacacaagaatacagacaggaccaaggctttagagcctagaggctgatgggagagggcaggcatgcaaattcccacacagcataatcagtgtaccccaggagtatacaaagtcatatataaagatacagggggttctgaatcaggatagaatgatttagaagcagggcagtgaagtcttcccagaggtagtgacatttgctaaaccttaaagaagaatgagcagaaattaaccaggtttggtgaaacagaaatggtacatacacttcaggcagaagtatgcaagtgtatttttaaaaaactgataaacctaaaagccatggcacaagaattctgttatgtgtagggtagaatgtgcagtaagaagcagcagaaagatgtaaggcttagaggtaagtaataaaaggcctcctgtgctgagctaagggctttgaactttttcataagagttatcgagaggcttttaggctgagaagaaaagaaataattccattttttattttagaaaatcaactgtgtagcaatttggaaaggagctagactagaggaaaaacggccaaaaaggacactattcaggtaacaaaggcaagagagataggtagacaaaataagccagtgctaagacaatgggataagaacagaataaagaggtaaggaaggccgggcgcggtggctcacgcctgtaatcccagcactttgggaggctgaggcaggcagatcacgaggtcaggagttcgtgaccagcctggccaacatggtgaaaccccgtctctactaaaaatacaaaaattagccggccatggtggcacatgcctgtaatcccagctactcaggaggctgaggcaggagaattgctggagcccgggagacggaggctgcagtgagccgagatcgtgctactgcactccagccgggtcaacagagcaagactctgtctcacaaaaaaaaaaaagaaaaagaaaattaaaaccaatctcgggaaaactctgtccaaaggaagaatatttcatcctgcaatacattttttgtcacttttcagaatacaaaggcaacatggattgtctcaatggctaatttcttacacacagaagtggtctttttacaaaccaaaatacaaatccagcatatttttcttaactaaacaaaggcaagcacactcttattacatcatctcctccttcacctgtcctcagcccactcctctgtagctgccaccactaagaagcaggatctcaaagttctcaatgtacatgtaacatggctgagatgttccaaaccagacctgttcttggaaaatgttgatctcatattcaattaagggaggaaaatactactatgaaactggtcacatattcaactactataggaaacagcacaaccaaaattttatagaaaatctctatcaaacaagaaaccagtcaagtaattcaggaccgcaaatcagatcaggtaagtaaccatgaagtacctgcaacatagtacgtctaatcaaatacatttttgtttaaatcatcaccagaatcactattaacaaaatgcttttccaagacaggaaaatatattaagggacaatgaatttcctgagatgacataccacgtctaagggggcatagtcaatatcctccagaaggatccagtggcccattgtggctgcctgtgtcagggtgccaggctgccacacaaactctccaggaacatctgtgcagcgatacatccccaaaagcatctgcagaaagaagataaagtaattactgaaaaaccatacctgtagtggcaatgctacatcctttgattaactgttaatcttctataggtaggtgtaagtaagtaggcacttgaggtttacataggttggccccaacagttataagcaagaccaataactattgttatattcccttagcaaaagcaatattttaatgcaaatatttacaagcatgacaagccaccaaaacttaacatttccttattaccttactgtcagtctgatctccaagctggactttgagaagctgaggaggctttgttctacctgtcactgcagctaaatattcaactaaggaagttttgccacatcctattggtccttccaacaacacagcattctgagaagcaaccgccatagccagggtctgaagacttttgcagacagactcaaccagcacataagacctaagggccagctcctgttcacgtgaagaactcctattaccaccctaaagaggcaagacaaaagccatgtcaagaagagttcttcccccaaggaaccgaagttaatttccacagtaagccttctactaaccttacacaaacctctgtaagtaaattagtagtaccaaaactataataacaacaggtatgtcatctaaagatctcatgggcattgtggcccatgcccatagtctcagctactggaagtgctgaggtggcagtatcatttcatcccaggagttcaaggatagtaagccatgatcacaccactgcactccagcctgggtgacacagagaccccgactctagaaaaataaataaatttttaaaaataaagcaaagggccaggtgtggtggctcaagcctgtaataccagcactttgtgaagccaaggcaggtggatcacctgaagtcaggagttcgagaccagcctggccaacgtggtgaaacaccatctctactgaaattacaaaaacattagctggacatggtggcatatgcctgtaatcccagctactcgggaagctaaggctgaagaatcacttgaacccagaaggcggaggttgcagtgggccaagatcgtgccactgcactccagctgggcaacaagagtgaaactccgcctcaaaataaataaataaataaaaataaaaataaagcaaggatctgatttttttttctttccatttttattgggggtgagggatggtgggggtattccatgggaagtagggaatcagaatttgttggcaaatgtaagaaaatcttccaaagtttaagtagccaaaaaagctgatgcacaaaggtagggaagagcaaacctcatctattactgttggatttttcttttattcctttccccatattctaggatttcccatctaagatcacaaatatacacaatacatttagaagacaatcagggaaatatggacactgagaggatatcttatgttgtaatttttttttaggtataataacaatagcagggatttttaaagtttgcctcctttagagatatatactgaaatattttcatataaaatactatgatgcctggtatttgcttctaagtaatataatgtgaggtagtcatgcagaaatataaatgaaatgtaattgataattattgaatacccaggtctatcaggtccatgggtattcactataccattctttctactttggaatatgtgcgacattttctgtaacaaaaagtaaaaaagaatattaaaacacacccagtaagtttaatgagaaagaatttcagctttgtaagacaaaaacattctcagtcagatgtggtggcttacacctgtaatcccagcactttgggaggctgaggagggaggatggcttgaggttaagagttcaagactaggctgggcaacatagtgagactctgtctctacaaaaaatgtgaactaacgtgtaaagtaaaaaatgttaacatggtaaatgttgtatcaaaacttttaattttttttttttttttttttttgagacagagtctcactctggagtgcagtggcacgatctcggctcactgaaagctccgcctcccgggttcaagccattctcctgcctcagcctcccgagtagctgggactacaggtgcctgccaccaagcccggctaatttttttgtatttttagtagagacggggtttcaccatgttagccaggatggtctcgatctcctgacctcgtgatctgcccgcctcggcctcccaaagtgctgggattacaagcgtgagccactgcgcctggccttaaatgtgtttaataataacaatgcatccaatatacatgggggaaaaggggaatgatttataaccttaaaggggtagtaagttctcaaatatggctggttccctaaaaatacgtgaggattaaatgagaaattcagagctggaagctcttgaactttcctcagggttgtcctctcataaatttagcaggcaggctgcaccgcaactctaccctgcgctttggccccagggtccccactgctaaacaacagcaggtccattctaaccagaatccttccctatgttaaaatcctaatgccctaaacataatctaggttgggatactggttacaggatacgtggggggtaaagagggaggagggaaggggacgggtcttcacaactagaaaaaaacacaaagagctttggaagtactgggtgtttggtgttatttatatgaagtttatgaataatcactgactacacttatgacaatgtgcattttcctatatgtatattacattttaatttttttttttttttactactactgaccagaacccaactgatgggttcaagaaatgacccagaacttattccaagaagaaaagtgggtggcctgggtgtagtggctcacgctgaggcagggggtcacgaggtcaggcattcgagaccaggctggccaacatagtgaaattccgtctctactaaaaatacaaaaaattagccaggcatggtggcaggcacctgtaatcccagctactcaggaggctgaggcagaagaatcacttgaacctgggaggggggaggttgcagtgagccgaggttctgccactgcacttgcactacagcctgaccatcagacaaagtgacaactgactgaagactgctatggaaaaagagactggctcccactagtgccagacttatgatctgcaagcctgttcaagtatggtctcaagccattcgtggaaagaagcttgttgcatatgggagagaggaagttcactagatactggactctctacaatgagatagttctgaaagaagaggctgctgggagtcatctctagacctaggcctgtctttgccacagagcagtccaagggtctccagcaagtaattctgcctttgaattacatcaacataggatcgtaacatgtgctacagaacttcacacagtttttgcagcaagcaaacaagaagatatacggaacagctccgcgcaagttaaaggcatcacacaggaaccattagtttctaatttcatattaaacagggacaggctgggtgcagtggctcacgcctgtaatcccaacactttgggagactgaggtggcatgatcccttgagtccaggagttccagatcagcacagacaacatagtgagaccccgtctctacaatttaaaaaattaacaaaaaataaaaacaagaacagtgggaatatcaggggaaaagcccaagatgaatttctttttaacttccaaaaatgaagcagcaatttaacaaactaaatttagctcacacctggtacatagaacccagccaaagacagagcacactcagtgtttagtagggggaaggggacacaccccctactgataccaacataccagctctccaggggctggcagctgcccaggcagcaccacaccacaaacagctgtcaccctaggggagaggtcagacgaaacaagatgtccctgtaagtactgcagctccttctgcttacgccaaagggagacttctggattggccaaaaccaaggccttctccaagtcctgcaactgggcctcttctaataacctgagagaaaggagagtctcgtcaattaccttaccactcagaaatgctatcgcaagacctgcagtcacctctggcctgtcacccccagaaaagaaaaaaaaaaaagaaatgctatagcaagacctccacgaaggttcctgcttacctcaacctgaaatggatcaattcatcactattaaatatcttcttaagaaatgataacttgtgctcttcattcatacaggtaaccaaagcaagacaattggctgtatacctagggaaaaagaaagtatgtaaattcagtttatctgcagttgataataaagaataaataaaatccactagccaactgaacactagaaaaggaaatctcaattattacaacacatttaagaacagaaaatacaaatcaggcacaatggatttacttgatggaacatgaaaaaggtgaaactccattcatatcatctcattttcctctgcaatgacacatgattaaagaaaggaagtaaaaccccaaaagccacaagaacaaaaataacaaattttaaatggtttcctttccctcctgacacacacaactccacacatgccctgtaccatccccacactagaagtgcaaaaaagtctaacagctacgcaccagcgaaccaaggtgtcatggcttctgaggagagggacacacacactccagtcccagagctcccggaacacagactgctcctgctgcagaaacttgaaggctgcttccattaggtcccggagcttcatcctcctacgtccatagcgtactggattagcatctgaactctctaggaaaagtctttgaaagactggggatgtgtccttgaaatatctcagggcaaaccttcaaacacaaagaatacagacatccccaacttaacaatggttggacttaatttttctgctttgtaataggtttatcagagtattaaatgcattttcaacttaagctattttcaaaaaggagtatctatattttcattgattggtgggaatatcatagaacgcaattctctactctgaccaaaccacaaaacagaactcccaagggtctgagaacataggggaatgaatgctgaatctacttagtcgtaaaattgtatcctgttcaatttcaggaaccaggacaatggcatgagataattctgactaagaggatacaaaaatctaaagtaattacctacaaaatcggggggtacttaatgtaagtgtttacaacggaaaaggcactcatttccaacaaacatttattcagttctatgagccagatactgtagtttaataactgggattcaaaaccaaatagatactcttcttgaggagtttgctgtctagtaaggaagacagccacttttagaaacgctaagagacatacacacacgagtcaactgaatctggggagaatcaagaagagatgcttaagttacaccttaatgaatgaagacgacaagcctgggcaacatagtgagaccttgttcctacagaaaaaaaaaaaattagtggggtatggtggagcctgaagcctattcaggagcctgaagctggaagatcatttgccaggttccaggttacaatgaactatgaaggtgccactgcattccagcctggatgacagagcaagaccttgtctcaaaataagtaaatgaactgcaaacccttcgctagattaagaaaaaaaagattcaaataaactaaaatcagaaataaaagacagggctgggtgtggtggctcacacccgtaatcccagcactttcggaggctgaggcgggcagatcacctgaggtcaggagttctagacagctggaccaatatggtgaaaccccatctctactaaaaatacaaaattagccgggcatggtggtggctcatgcctgtaatcccagctattcgggacgtcgaggcgggagaatcgcttgaacccgggaagcggaggttgcagtgagccgagatcgcaccactgctctcaggcctgggcgacacagtgagattccgtctcaaaacaaacaaacaataaaggtgggggggacatcatattatataaccaatgccatggaaataaaaaatattattaaaactttgaacatggccaggcacagtggctcacacctgaaatcccagcactttgggaggctgaggtaggcagatcactttaggtaaggagttcaagaccagcctggccaacatggtgaaactccgtctctactaaaaacacaaaattagccaggtgtggtggtgcatgcctgtaatcccagctactcaggaggctgaggcaggagaatcacttgagcccgagacacggaggttatagtgagccaagatcgcgccattgcactccagcctgggcgacaagagcaaaactctgtctcaaaaaaaaaaaaaaaaaaaaaaaaaacaaaaaaaaaaaccaaacactttgaacattataaagaaatggaaaatatgtacagaccaataagtaactagtaaggagatttagtcagtaatcaaaaacctcctaccaaagaaaagcccagactgcactagagaaaagctagatgattacactagggaattctaccaaacattaaaagaagaattaacactaatcctaatgaaccttaatgtaatcaggtggaatttgagtaggctcatcaatgttaacaaatgcactactctgacgggagatgctgataatggcgaggctatggatgtgtgggtacagtgtgtatatgagaaatctctgtaccttcctctcaattttgctgtgagcctaaaatggctctaaattaagtattaaaaaataattagcatgcattagatgtttgtttttaattttataaaaatttctgggctgggcgcagtggctcacacctgtaatcccagcactttgggaggctgaggcgggtggatcacctgaggtcgggagttcgagaccagcctgaccaacatggagaaaccccatctctactaaaaatacaaaattagccaggcgtggttatgcaagcctgtaatcccagctactcaggaggctgaggcagaagaatcgcttgaacctgggaggcgaaggttgcagtgagccaagacagcaccattgcactccagcatgggcaacaagagtgaaactccatctcaacaacaacacaaaaatttctggttgggtgaggtggctcacgcctgtaatcccagcactttgggaggccaagggaggtggatcacaaggtcaagagatcgagaccatcctggccaacatggtgaaaccccgtctctactaaaaatacaaaaattagctgggcgtggtggcacacgcctgtagtcccagctacccagaaggctgaggcaggagaatcgcttgaacctgggaaggaggcagaggttgcagtgagccaagatcacgccactgcactccagcctggcgacagagcaagactccatctcaaaaaaaaaaaaaaaaaaaaattctatcttaaaaaattgtgtacaaatgctcaaaaatggactgtagcgggttctgttcttgtggtcggcggctgtgttgctctctgataaaggtatgtggttgttggctgcaacccctgggctgggatgattcacgttcctggtggaggcaggggagcccagctggagctgtggccagtacagtagtagcagttggactgatttgctgccatgggattcgtaggccattatgttttgcaagccatgaagcatatgaagcctcaagtaaaacaagtttttcaaagtctaccaaaatctgccttcagtggtggctattacagaggtgggtttgaattaaaaatgacaaaacagaaggcagcatcaataccaggtctaaggcctactgccaataaagggaaagtatgagatgctcattaatgaatgatgctcttaaacaatccaagtgaaagaggatctccttacacagcagccaaaagaagagaagctaaagatttattagaaagtcggccaggcgtggtggctcacgcctgtaatcccagaattttgggaggccgaggcaagtggatcacgaggtcaggagatcgagaccatcctggctaacacggtgaaaccccatctctactaaaaatacaaaaaaaattagccaggcgtggtggcaggcacctgtagtcccagctactcaggaggctgaggcaggagaatggcgtgaacccgggaggcggagcttgcagtgagccgagatcgtgccactgcactccagcctgggcgacagagcgagactctgtctcaaaaaaaaaaaaaaaaaaaaagaaagaaagtcaagttaaaaagtgaagtaggccaggcgcagtggctcacgcctgtaatcccagcactttaagaggccgagacaggtggatcacctgaggttgggagttcgagaccagcctaccaacatggagaaaccccgtctctactaaaaagacaaaattagccatgagtggtggtgatcctagctactcgggaggctgaggcaggagaatcacttgaacctgggaggcggaggttgcggtgagccaagattgcaccactgcattccggcccgggcaacaagagtgaaactccatctcaaaaaaaaaaaagtgaaacaaatctatgatgaattttaagttcatattagtttatgtatgagtagcaagtttttataagaaaatgcctaaaagttaaaatttttgaaaataatttagcgcaagctaaaaataaacaaaaaataaatacaattgactgtagtgatgactgcatatattgatgaaaatactaaaaaccactgaactgtacacttttatataaactatcccaataaagccatatttaaaatgcgtgcatatcaatgtacttgtgtgtatactctgatgtgtgcaagagaaaagacatttgggagaaaacataccaaaatattaataccagctatctttggagggtatgatttcagggtggagaggacctttagcttcctaccattctgtattgttgaatgttatttgaatatatcacttctgggactaaaagaagaaaaaggaaaataggtattatactattaggacattattctcctcacagggatacagtgagaataaagtagttcttggagaggaagaaaagtctaaaaacaaatacaagatgttacctttaaggcatttctagatacagtttttaactaaaatgtgtaacagcaactattttggtccctcattctgctgtatggccgcatgactggccaaatacggtaccttacacatggaccatgtctttgaaaagaaagtgcatgctccaccacaacaatccatctgctattcttcataaaggctgtgactgggcccacccactattgctcttaccaatcaaaagacagacagcactgatgtggggcacgtgcccagcacaaactagcagcagatgcaaaactgtaaccaagaaattaagctaaaatgcaatccaaataaactgcacacttagaaatagtaaagttgggccgggcgcagtggctcacgcctgcaatcccaacactgggaggccgaggcgggtggatcacctaaggtcaggagttcaagaccagcctggccaacatggtgaaatccccacctctactaaaaatacaaaattagccaggtgtggtggcacatgcctgtgatcccagctacttcggaggctgaggcaggagaatcacttgaacctgggaggcagaagttgcagtgagccaagaccacaccattgcattccagcctggataacaagaacgaaattccatctccaaagaaaaaaagaaaagaaatagtaaaggtgatcagttttatgcattttcctaccacaacgggaaaaagtgtatacacatttttaagaatgaaacttaaattttgttaaaaacttgagcttatttgtgatatatgtttagttttcaatctggttccaggacagagctccaggaattgtaatttccgatgcagtaagagctattcttttgttattcaaccccctttcaatcacacctgagtttatgttaatgaggtgacaatgggaaagtccctaaggagtggggggcactggttggttgccaggagaaccaaccaagtgataataaagttaaaactttcagcccaactgccagagaggagaaaggggataaaggttaagatgatctccaatggtcaaagatataataaatcatgtcttcctaatgaaatatccaattaaaaagaaaaaaaaaggaaaaacaggccgggcacggtggctcacacctgtaatcccaggactttgggaggcctaggagggcagatcacctgagatcgggagttcgagaccagcctgaccaacatggagaaaccccgtctctactaaaaatacaaaattagccaggcatggtggcacatgcctgtaatcccagctattcaggaggctgaggcaggagaatcacgtgaacctgggaggcggaggttgccatgagccaagattgcaccactgcactccagcctgagcaacaacagcgaaactccatctcaaaaaaaacaaacaacgacaacaaaaataaatggggttctgagagctttcagggtggtaaacaaatggaggtgctgagagggtactgcagctggtggggagcatagatgcttactgtccccctcccccataccttgtcctgtgcatctcttctaactggctcttcctgagttgtatccttttctaatacacttgtaatctagtaaagaaactgttttcctgagttctgtgagctattttagcaaataatcaaacctgaagaggtgagtcaaggaagtctctgattgatagccttttggtcagaggcatatatgataacctagacttgagattggtgtctagagagggggtgtgcaggggaggaatgatgagatactcttgtgggactgaatctttaacctgtggggtctgtactaaacccagatagacagtctcagagttgaactgaattgcagggtaccaaactgacgtcagagaattgatagatataggtaaaaagtcacacatctggtgttagaagtgaagtgttctgcaaatgtagagaaaaaggaactgtttttttcttctttactagtccaggatacttctgtgtattgcagacatgattcacagcaggcgctggtcaagtcagcataggtaaaacttagaaataaggttacactctgatataacattaaaggaaataatctctgggtgtggtggctcatgtctgtaatcccagcactttgggaggccaaggcgggcagatcacccgaggtcaggaattcaagaccagcctggccaacatggtgaaaccccatccacactaaaagtacaaaaactaggccaggctcacgcctgtaatcccagcactttgggaggccgaggcaggcagatcacttgaggccaggagttcaagactggcctggacagcatggtgaaaaccccaaaaaatacaaaagttaggccaggcgcagtggcttacacctataatcccagcaatctgggaggtcgaggtaggcagatcacgaggtcaggagttcaagatcagcctggccaacatagtgaaatcccatctctactaaaaatacaaaaattagccaggtgtggtggcacgcacctgtagtcccagctacttggggggctgaggtgggagaatcgcttaacctgggaggcagaggttacagtgagccaagaccatgccactgcactccagcctaggtgacagagtgagactccgtctcaaaaaaaaaacaaaacaaaacacaacacaaaaattagtggagtgtgatggcgggagaatcacttgaaccgggaggcagaggctgcaatgagccaagattgtgccactgcactccagactgggcgacaaagtcagaccctgtctcagaaaaaaaaaaaaaagaattagccaggtgtagtgatgtgcatctgtagtcccagctactcaggaggctaaggcatgagaatcacttgaacccaggagaaagaggttgcagtaaggtgagatcgtgccactgcactccagcctgggcaacagagtgagactgcttcaaaaagaaaaaaaaaaaagaaaataatcaacacataacgtgtaattctaactttctgaaactgtctccaaagctatagctgaggggatttgggagcacaagtttaatcaaggtgaagagaaagcaaggaaaaaactggataattttttatgagacagaactttgatacctaactgacatatcagaatagagaaagccaggaacgttctcagagtcccgatctttacttggctgtatattttctagttccattaaaccaggtccatttttttctcaaccccttttagaaaagctcagaccaacagtgttttcccccaagtcttcatttcctatttcctcattaaaggaccagactagatatcatacttccaagaaagccaaagtgtatttattgcattgatgaagactaataaataaaacactggatataagaaatgttctgttggccgggcacagtggctcacgcctgtaatcccaacactttgggaggtcgaggcgggcagatcacgaggtcaagagattgagaccatcctggccaacatggtgaaaccccgtctctactaaaaatacaaaaattagctgggcgtggtggtgtgcgcgcctgtagtcccagctactcaggaggctgaggcaggagaatcagttgaacccaggagggaggcagaggttgcagtgagcagaggtcatgccactgcactctagcctggtgatagagtgggactccatctcacaaaaaaaaaagaagagaagaaagaaatgtcctattggtacacagaatattaatcatttttacagtgaaagttttaaaaatcttttcaatttaaaaacccctgacactcagttttgctgtctcttttgattattcctcaaaactatattttactatctctttaaaagtcacattaaaatccagctctaacacagctcttagtatactaattcagatagatttatagaatttggaagggatactatagctcttctaatccactccttcagctgctctaacaagcaaggaatctttcccattagaggtggatgctgtaagagcctcagttaaacctcatttactccgctgtatatgcatgtcttgccacatgatacaatccttgagagcactggggacatatcctggccatctttccaggtctgttctgatggccaagatttaagagaaacctagtaaatgctcactgaactgagctggataaatggattctgctgtgactctttttataaaacaatactatttatctctctcctttctgtatttccgttttaccttctcagctcagactcccttacatcccaggagacagcaggttctatcacctcaaggagaaatgcgaataataaaattgctactcacgggaggacatcaggatggttaccaatgagtttgctcatcgacacacatagccgttcatgcagatcatggttgatttggcctccagctttaatggcttcggcattcctttccagcaaatccaaaaggagagggcgaagctggcgaccaaccagcacagtacagtccttatccaaaagcaactgtgctaaggtactcaggacacactggcgatcttgaggtgtccacacctgagaaaggcaaaacaaaacatctttcactttttttttttttttgagacacagtctcgctctgtcgcccaggagcaagtgcagtggtgcaatctcagctcactgcaagctccacctcccgggttcatgccattctcctgcccgagccgcccaagtagctgggactacaggcgcccgccaccatacccggctaattttttatatttttagtagagacggggtttcaccatgttagccaggatggtctcgatctcctgacctcgtgatccgcccgcctcagcctcccaaagtgctgagattacaggcgtgagccaccgcgcccggccttttcttttcttttctttttttttttttttttttttttggagacagagtcctgctccatctcccaggctggagtgcagtggcacgattttggctcactgcaacatcccaggttcaagcgattctcatgcctcagcctcccatgagtagctgggattacaggcacccaccaccacaccaggctaatttttgttttgatttgttttgttttagtagagacagggtttcaccatgttggctaggctggtctcgaactcctggccagaggtgatccaacagcctcagcctcacaaagtgctgggattacaggcgtgagccaccatgcctggcccaaaatatttatgtaaataatattcatttgcactgctgtagaaaagcagagacgagtcctgggttggaactaaaatgtccaatttccagacttcataagtgagattctattataaaatatcgtggaaattttttgcaatggaggatcagagttaatttaatataaaggctgttacaaataagtttcagtacactggagtttgaggtacagggactaatacctggattccatttaaaagctacacgacttatctgaaaaataatctatgtgctggggtttcaacaatctccagggaattcaaaaccccaaaattcccccagctcctttaactcttgaagaaaaaaatgaattctgcagttagtagacaaaacttccaactcttcaggaaaggacagaggtaaaaaattaattcctgggagtgaatgaggatatccctatcaagctgatcaaggcatcagcctctaataaataaacaaaaaacagatccaaagtagacagcaacactttgatacggaagatgaaataaaatacaaaattctaggccgggcgcagtggctcacgcctgtaatcccagcactttgggaggccgaggcaggcggatcacgaggtcaggagatcgagaccatcctggcttgtaacatggtgaaaccctgtctctactaaaaatacaaaaaaaattagctgggcgaggtggcaggcgcctgtagtcccagctactcgggaggctgaggcagtagaatggtgtgaaccccgggaggcggagcctgtagtgagccgagatcgtgccactgcactctagcctgggcgacagcgagactccgtctcaaaaaaaaaaaaaaaaaaaaaaaaattctagtgcccgggttcagaatgcaggtaagcatacaaaggaaaactgaaaactgtataaaaggcattatattgctagtgtgtatacaggtctgcacaaccgtttctgcccagcaatgtaacatcaggtttaaaatggggacatgccctttgaccttgcaagtcccatgctatcagtttatcctaagaagtttcaccccaggccaggtgtggtggctcatgcttgtaatcccaccactttggaaggccgaagcagacagatcccttaagccgacgagttcaagaccagcctggacaacatggtgaaaccccatcgctacaaaaaatagaaaaattagccaggcttggtggcatgcgcctgtagtctcagctcctcaggtggctgaagtgggaggatagcttcagcctgggaggtcgaggttgcagtgagctgagatcatgccactgcactccagcctgggtgacaaacagttaaagccctgtctccccccacaacaaaaaaaggatgaggaggaggctcaccctagtcacctatataagtgtaccttgaacacagcataaatgtcatacgcaaaatttaacgagttttgccaaaattatcacccagaaagtcaccttacacctgagctcttacaaagtcttccaattacagagcattctctcatgaaaacatttgattctgatcaaagcactgattagggaaaaatgttaccttgaaacaatttctatcagtcttagttctgtcctttataggaggttaactgaaggattccataaaaatggaggcaaagaaatttaacagatttggtcatgatacataggagcaaaatctcacattttcaactgctgcatgtccgcataaacaagccctctaaagataccttttttttttcttttgagacaaggtcttggtctgtcgcccagactgaagtacagtggtaaaatcacagctcactgcaggcgcaccctcccaagctcaagcaatcctcccaactgagtcccctaagtagctaggattacaggtgtgtgccaccacgcccagctgattattttatttttgtagacatgggggtctcactatgttgcccaggctgatctcaaactcctgagctcaagcaatcctcctgccttggcctctcaaagtgctgggattacaggtgtgagccactgtgcccggccccattttttaaataataaagtaagttacattgcagaggaaagaaacatatccaaagaaaactggtcagacatggtggtactttgggaggccaaggtgagatgatcacttgaggccaggagttcgagaccaacctgggcaatgtggtaagatgccatctcttcaaaaaaataaaaataaattaaaaattagctggtgtggccaggagtggtggctcacgcctataaacccagcactttgggaggcagagggtggtggatcacttgaggtcaggagtttgagaccagcctgaccaacatggtgaaactttgtctctactagaaatacaaaaaattagccaggtgtgctggtgtgtgtctgtaatcccagctacttgggaggctggggcaggaaaacggcttgaacccaggaggcggaggttgcagtgaactgagaatgcaccactgcactccagcccgggcaacagatagagtgagactccacctcaataaaaaaatttttaaaaaaagcttaattaaaaaatttttttttttttaattagctggtgacggtgtgcatctacagtcccagctactctggagagtgaggagaggatcacctcacagcctaggagttcgaggctgcactaagccatgatcgtgcccactgcactccagcctgggtaacagaatgagactctcttaaaaataaaatacataaaatataaatttcattccccaataatcttaaatataaaaatataactcatttttatacattgacctggtatcctgtgatcttatgaaattctttattttgaagatttcttaagactttttacatacaaaatcctgtcttaagcaaacattgttttgttttttattttatttttttggagacagggtttccctctgtcacccaggctggagttctttgatatcagctcactgcagcctcgacttcccagactcaagggatcctcctgcctcatcctgccaagtagctgggactacaggcacacactaccatgcctggctaatttctgtatttttactacagtcagggtttcagcacattgcccaggctggtctcgaactcctgggctcaagagatccacctacctaagcccccaaagtgctgggattacaggcatgcgccaccacgcaagggggtttatggtttttctcagcattttgaaagatgtttcattgtgttgtttctgttaagaagtcagcagtcatttttatctttgctcctctacaagtaaagtgtctttttttctggcaatttttaagatgttatttattacttgtttctagcaacttgatcatgatgtggcttggtgtggttttgtgtttatcagatttaagattatgagtttttgggatctgtgaattatttttcaccaactttagaaattttgagattatctttttatatttctactgtttctcttctctccctcctcctgtaattccaattacacatacagtagactagttgataatgcctcacagatcactgaagcatttttattctggctttttcccaccctgtctgtttaagcctagataatttctattgccgtatcttgtaattcaatgttcgtttcttgtgaactgtctaatcttcaatgaggcctatccagtaaaatattcattgctaagatggtattttttggtttcacttgttttttttcatagcttaaatttctctcattatgtttatgtttccgaaacttcaagtccctgcacatataattactatttttttatgtttttgagagtgacaggatctcactttgttgcccaggctcagactgatcacaaactcctggcctcaagtggttcctcttggcccagcctataatcacttttttctttttttttttcccgaacattcatatcattatataatcactttttaaagtccttgtttattaatttaaatatctttattattttggggtctgttgcagtgactgacttttctcctggcaatgagccaccattttccttttcctatatctagtacttttttaatcggatgctgaacgttgtagatgtgtctagattttgctctcttcctttgttctagcaggcagttaatcagcttgtaggtcagcttgatcctttcaagacttgtttttaagttttgttagtattggtctagaaaggcctttgagggctgatttagccctagagtgtggcccttctgggttccacactaattatgccagtattcaacttggtcgttccactccaactagtaggagttgaacatctcctacacagaaaaactccagtagttattctttgcatagctcacgaaatttccctaagaagacacagctttacattcagccagtactcaccagaccccatatccctagagctgttccctccattccaacacccttcccagcatattccaactaccgccccaactctgagctctgtcttctcagctcagtaggaccaccactgctgaacttcgttcttcctctgagtcagtcctataagtgattccaggtagacagctggaatcattctagggctcaccttgtttcccatttttaggaattccaatcctatgctacctacctttcatccaatgtttgaacgtttttcatatggattttttcctctttttctagttgttttggcaacagagctaatccagtaccagttattctatcatgaacaaaagtatatgtatttggctgggcacggtggctcatgcctgtaatcccagcactttgggaggccgaggcaggaggatcacctaagctcaggagtttgagaccagcctgagaaacatgctgaaaccccatctctactaaaaatacaaaaattagccggacatggtggtgggagcctgtaatcccagctaccagggaggctgaggcggcagaagcacttgagcccggaaggttgagggtgcagtgagctgagatcgtgcccctgcactccagcctgggtgacaggtgagacactgtctcaaaaaaaaaaaaaaaaaaaaaaaagaagtatgtatatttgactcttttacagcactgtttgcatagcttcatatatatttaaaactttttattttatcttcccagatttatagagaaaagactatatatacaagactgaacatagtggttcacacctgtaatctcagcactttgggaggccaaggcaggcagatcacttgagcccaggagtttgagaccagcctgggcaacatggcagaaccccatctctacaaataatacaaaagttagccaggcttggctgggtgcagtggctcactcttgtaatcccagaactttgggaggccaaggcgggtggattacttgaggtcaggaattcaagatcagcctgaccaacatagcgaaaccccatctctactaaaggcacaaaaattagccgggcattatggcatatacctgtagtcccagctactcgggaggctgaggcaggagaatcgcttgaacccaggaagcagaggttgcagtaagccacgattctgccactgcactcaagcctgggtgccagagcaagactccctctcaaaataaataaataaaataaaataaaataaaataaaataaaataaaataaaataaaataaaaaattagccaggcttggtggtgtatgcctgtagtccctactactcatgaggctagagttgggggaaatcacctgagcctggaaggtagaggctgcagtgagccatgattgtaccactataccccagcctaggcaacagagtgagactccgtttcactaaaaaaaaaaaaaaaaaaaaaaaaaaaaaaaaattaagtttggaagattatatatcaaaatattaatatgggcagtccctgactgaatgtttttcttacatgtattaatttcctggagctgtcataacaaaataccacaaactgacttaaaaaaaaacaaggccgggtatagtggctcacgcctgtaatcccagcattttgggaggctgaggtgggtggatcacctgaggtcaggagttcgagaccagcctgagcaatacggtgaaaccccgtctctactaaaaatacaaaaattagccgggtatggtggcgggtgcctgtagtcccagctaccaggaaggctgaggcaggagaatcgcttgaacccgggaagcagagggtgcagtgaaccgagatcgtgccactgtactctagcctgggcaacagagtgagactctgtctcaaaaacacaaaacaaaacaaaaaacaaattaaaaaaacagaaatgtgttgtctcacaattctaaagtttggaagtccaagatcagggtgtcagcaaggccatattcctttgaaacctataggggagaatccttccttgcctcttcctagcttctggttgtcatcatcaatccctgctgttccttgtctcacagatttatcactccaatatgtatttctgtcatcgccacatggccatcttccctttatgtctttctctcctcataagaacagtcatattgtgctgggtgtggtggctcacggctgtaattccagcactctcggaggctgaggtggacagatcacttgaggtcgggagttagagaccagcctggccaatatagtgaaaccacatctctactaaaaatacaaaaattagctgggcatggtggcacacacctgtaatcccagctgctgaggcaggagaattgcttgaaccaaagaggcggaggttgcaatgagctgagattgcaccactgcactcaagcctgggcgaaagagaaacagtcatattgattaaggccctatctaattatctcatcctgactttattacatctgcaaagacctcatttccaaatagggtcacattcaggtattatagactaggacttctaagtatatttttgacagacacaatttaacccacaatatgggtggtgctttcctgaattctcctagtattctgcatgaatactactagttaatgaagttttaaaaaattataaatgttttactaaaacccatgaaagggtaaatgccaggcctgcaagaaaagggatcagctaggctaggatacctgtaagtatctagcgggtgggtgggggttataggaaaactacataatcagttttctccttctgtaagcccaggggtcttgctaatcaaagcatctttgaccatgtcagctggcttgctattgtaggaaataaaaacaggacaatgaatgttaaaggatttacttctttttattttttttttttaagatagggtctcactctgtcgccaggctggagtgcagtggtacgatgtcggctcactgtgacctccgcgtccctctcgggttcagttcaaccaattctcctgccacagcctcccaagtagctgggactacaggagtgtgccaccacgcccagctaatttttgtatttttagtagagatggggtttcaccatattggccaggatggtctcaatatcttgacctcgtgatctgcccacctcagcctcccaaagtgctgggattataggtgtgagccaccgcaaccagccaggatttacttcttaaacctgtgattactcccataacattcttaggaaatcctgcctttcttcttgggagactgggacccactggaaaagggaaaggactgcattcctcctggctacacctttgtattttctcacttctcttaacattctgtgaagcttaaatgggttttatttaggtagctgggatacaagcaagtatgaggaaagctgaagaatactgattacttaacaaatacaagaaaaaactttttttttttttctgagatggagtctcgctctattgccctggctggagtgcagtgccctgatctcggttcatgcaacctccgccttccgggttcaagcaattctcctgcctcagcctcccgagtagctgggattacaggcatgcgccaccacacccggctaatttttgtatttttagtagagacggggtttcactatgttggccaggctggtctcaaactcctgacctcgtgattcgcccaccttggccccctaaagtgctgggattacaggcgtgagccaccgcgcccagccaagaaaaaacatttttattggccgggtgtggttactcacacctataatcccagcactttgggaggccgaggcaggtagattgtctgagctcagccactgcacccggccaggaaaaaatatttttaaggtggctcagctcttctcttcccaccaaaaatactaaccaattccgttcctttgctataacaaaattcatcaatttcccaataattagccaacaaaaatagaaaaggaaaaaaagtcttcatatttgtatgtctgtatgcttaacatattgagtttttactgttttgagtaatgaaattactacactgtcatattcaactgctaactgatcagttagcccttctcaaagcagagttaattaaaaggataaggcaactgctaactgatcagttagcccttctcaaagcagagttaattaaaaggataacctcagtgttattatttataattacatgtatcggctgaaatgtgtattttcagctaaagagaaacaattcctaaactactctataaaacctaagcaattaggctgggtgcggtggctcctacctgcaatcccaacactttggtaggccaaggtgggaggatagcttgagcccaagagttcaagaccagcctgggcaacaaagtgagactccccatctctacaaaaatttttttttttttttgagacggagtttcattgttgttgcccaggctggagtgcaatggcgcgatctcggctcaccacaacctctgcctcccaggttcaagagattctcctgcctcagcctccccagtagctgggattataggcatgcgccaccacgcccggctaatttcgtatctttagtagagaaggggtttctccatgttggtcaggctggtctcgaactcccaaccacaggtgatctgcccacctcggcctcccaaagtgctggtacaggcctgagccatcgtgcccggccacaaaattttttttagaaattagccaggcaaggctgggcgccgtggctcatgcctgtaatcccagcacttcgggagaccgaggcaggaggatcacctgagttcaggagttcaaaagcagcctggccaacatggcaaaaccccatctctactaaaaatacaaaaaattagctgggcatggtgccaggtgcctgtaatcccagctacttgggaggctgaaacaggagaattgcttgaacccaggaggcggaggttgaagtgagccaagatcatgccattgcactccagcctgggtgacagagcagactctgtctcaaaaaaaaaaaaaaaaacaaaaaagaaagaaattagccaggcatggtattgtgcacctgttgtcccagctactcagaaggatgaggtgggaggaccatttgagcccaggaggtcaaggctgaagtgagctatgatcactgtacgctagcccaggcaataaaaggagacactgtttcgggcaggggaagcattaaagcatcatcactctcatcatttgcttaaaacactgaaagttaaagctatgttctgccaaaactaagtaagtatgcctgtaattccagcattttgggtggccaaggtgggaggactgcttgagcccaggagtttgagaccagcctaggcaacacagcaagaccttgtttctacctaagatttaaaaaaaaaaaaaaaaaaattagccagacgcggtggcatgcctatagttccagctactggaggggatggggagggtcctaaagtaagatgatcagttgaacctaggatgtcaaggctactgctctccagatcctgtcttaaaaaataaaaaagaaagcataaaccaaaaataaaattctaagcccccccaaccaactgaatgaaggtgaatccttctccattcagtcaagtgcattctaaagtaaacctgaaacactagttcaggccatgctgggaatgggtggtcagacacgcctcattatactctcttcccttcagaattctggcacagctaaccagcattaacattaaaacagagaccttaggactgacaaaacagattactagtagcaataagatacaaatatgacagacagcaaaccctgaaagaagtatttcaggtgttctttaatccccctccttttttttttttttttggtagagacagagtctctctgctatgttgcccaagctggtctcaaactcctgggtccaaacaatcctcctccctcagcctccaacagtgctgtgatgacaggcatgaaccaccacatctggcccaaaatatatagctttgacaaattttgaaatggccctgcaaagttgtctctttaagtcttataagaaacatttaacatttacagtgctcggcttcaggcacatgttgggggtgttgaggtctagtgggcagagtagactcttggccagacagatggtttctcagtggcaggatgcgagggcctccatgcaccggagatctctccagcaccaggagcagccgctggacagcaaggagcggcagcctatggttagccattgggagatctccgccagggccctgggttctctgtgcagacagttccaaagaaggctgcccctaagagccgtcaacctcaacctccggacaggtacctcctagaaacccctagaaaccagggtcagggcagtaagagactccaggctgcagctcgctcagctaagagcaccctgggtgccatgtcacagagaatccaggagtcctgccaaagtagcaccaagtgtctggtggagacccaggtgaaggccaggaggaggaagaaaggggtacaaaagggagagcagtgtctccccaactcacagcctgagccagaagaggattcagctgtatggagctgcccctgaccactcagctacagacccctgtgcatcaccacctctctacctggacaggctcacgtgcctaccctctacggcagtggaggcgggagactgccttccagagcccctactccttgacagagctcctctgctctcccagcgcatctgatagtgacctagcacctatggggagcaggaattcggcatctccagaagctgtcccaagagctggatgaagccattatggcggaagagagtggtgaaatgacactctcattcatgactgaggaagtgccctgcaggaaacaagccctgtctgaccaccaaggcttcgtaccccagaatgtctgtgcttccccatgagcttcctggcggaagctcccaggagtcatcagtacccctgggccactgctaacaaagacctgactagcaaggagcccagagcccccctgctccagccacatctggacccatcagtgactgcctgccacagcctgagagtgtcttggggagatcttgcagaggtggggagaattgttccttctactccccaaggggactcttgggtttagtaatgcatcgtatacttgaccttgagcctggtatttgcttcatctacaatgtgaagagctggcatcagatgtttgagagctctgaactcaaaccaggtgcttggtttttggggagtcatccacagagtcactcgcccactgtgtttccagtgccaaggcccttgggggcaccactctcatccctgctttccctaccagggacctggaggaaggcataggagatagttccaggcttaaaccctgggctcacaggtacctatttatatgttcaaggcagagcactgtgggtgtgccaggaggggtagccctgttcaagagcaatttctgccctttgtaaattatttaagaaaactgcttttattttattagaaagaaaccagatagcattgctttcttataataaagactagataacactgctttctcataataaagactgttttgtggctgggcgcagcggctcacacctgtaatcccaggactttgggaggccgacgcgggtggatcacctgaggtcaggagttcgagaccagcctggctaacatggtgaaaccccgtctctactaaaaatacaaaaattagccaggcgcagtggcaggtgcctgtaatcccggctactcgagaggctgaggcaggagaactgcttgaacccagggggcagaggttgcagtgagttgagatcgcgccgctgcagtccagcctgggtgacagagcaagactccatctccgtctaggggcgggggtgaggagactgcatttgggggaaaaaaaaaaatcatttacaggctaggcttataatcccagcactttgggaggctgaggtaggtggatcacttgagcctaggagttctagaccagcctggacaacaaagcaagatcctatctctttaaaaaataataaaaattttaaaaaaagaaacatttgcaatctgttctctctgaaacctgttacctggaggcttcatttgcataatatgaaccttggtctccacacccctatctttttttttttttttttttgagacagagtctcgctctgtcacccacgctggagtgcagtggtgcgatctcagctcactgcaagttccacctcccgggttcacgccattctcctgcctcagccacctgagtagctgggactacaggtgcccgccaccatgcccagctaatttttcatatttttagtaaagacagggtttcaccatgttagccagaatgatgtcgatctcctgagcttgtgatccacccgcctcagcctcccaaagtgctgggattacaggcgcgtgccactgtgcccagcctccacacccctatcttaacctagacactccattctactgattccagggatttaaatgaactctcacccaattgccagtcagcaaatctttgaatccacctgtgacttggaagaccgcccccctcacccttcgagttgtcccagctttccagaccaaatcaatgtacatcttacatgtactgagtgatggcttaggtctccctaaaatgtataaaaccaagctgtagcccgaccaccttgggcacattttctcaggatctcctggggctgtgtcatgagccatggtcactcacatttagctcagaataaatctcttagaatattttagagtttgacacttttcattgacaaaagtatcacaatttgggagtaccttaatctgttaatacagtcaataaacatttactgcctactgcatatcagacactgtattggacactacagctacacaatccccttctctggacatactctcaatcaactactgagaatcagttagttgaaacaaagattaagaggaagaggaaagggtaaagtcagaaaagtcttcctggggaagaccatttcaaaagcagtcttccagaacaaacaagttaactgagcagggcatagaagagagatgtagccttctaaggaaaggaaatgcaaagtcaatgaggcaagtaacagcaaggaatggcccagacaataacaacagacattaacaacgggaggtgactccagtcaacaatagtagagggtaacaacctgtggtcattgcaggcagtttagtgttgctgaaatagcaagccctgagcagaaagtaaacaaccagtctggggcagggtttctttcttaattttgcaccactgccatttacgacggataactgttgtaaggggttgtcccatacataacagaatgcttagcagcgtccctggccttgatgcactagatgctagtagcacccccataatgaatagttgtgataaccataaaggtctccagatttgtccctgggagcaaaattggccccactccccagaacaattgggcttgagatacatcaaaaaaaatacttcagggcagggcgctgtggctcatgcctgtaatcccagcactttaggaggccaaggcgggtggatcacctgagatcaggggtttgagaccagcctgacccacacagtgaaaccctgtctctactaaaaatacaaaatattagccaggcatggtggcgcacgcctgtaatcccagttactcgggaggttgagacagaagaatcgcttgaactcgagaggcggaggttgcagtgagctgagagggtgggccattgcactccagtctggacgacagagcgtgcctccgtctcaaaaaaaaaaaaaaaaaaaaaaaaaaatttaggccggacacggtggctcactcctacaatccctgcactttgggaggccaaggcgggatgatcacttgagcccaggggttccagaccagtcggggcaacaaagggggaccttacaactacaaaaaaaaaattttttttttaattagccacacctgggacccaagtacctgggaccacactcacctgtcccgtggctcacgcctgtaatcccagcactttgggaggctgaggcgggtggatcacgaggtcaagagatcgagaccatcctggccaacatggtgaaaccccgtctctactaaaaatacaaaaagtagctaggcatggtggcgctcgcctgtaatcccagctactgagagggtgaggcaggagaatcgcctgaacccgggaggcggagggtgcagtaagccgagatcgcgccactgcactccagcctggcgacacagcgagactccgtctcaaaaaaaaaaaaaaagtgtcttcaactcagatagaaggagtcaatgagaaggttcttaaaagcccgaagacctatttcccagaaaactctaattaaccttataatttgtatagttagttacagtgagtatgagctgtcttgctctgtacttcagctgttgtaagtgtttacgaactgtctccaaaaacagatgcaaatttccctcatggcagagatcgtaacgaatttatctatccactttctcacagcgccacaccgttccttacgcacagcaggaatgcaatcagtatttgtcgatggttccccaaactaacaggagtggctgcactacgcacacttaggtgatacgtacacttgtcaaaacggcagaaacgcaacctcaatttcagaaaaacaaaccacattcctttgggaaggccacctctgccacaagcagccaaagcgcttgcataggggtgagaggcgatgggaagggtactggaaggctcccccagataaaaacaaaagactccttccaatcgcctcaaacacgctcggaaacctccacgacctgcgccagcccacaggagggggccagcttgacctgaggctgcaccactccccacttaaagcggcgagtatcggcgggggagcgcaggaagcttactagtggggcgacccagtcgttccggcgctttccctctcccttcacgtcttacctgcttggccaagaacctgcccaactcactgcggctcttctcgttcttggctgcgattaaccgcagcggcgcggctgccacctccagcaagaagtgctccatgacccagggccctcaccccgagcggccacctgcgctccctacttcgcggccagcgtccccaagccgccgaggtcccagtgcccgagcagccagcaactacgcccgcaggaaaggcgtcctcagctccagcgcctacaccgggagaggggcaccacacgtgggtgagcacacggcgtttgacgtcatcagctcgggacggctacgctgcgccctcccggcctcagcccctcagcggcggaaacgccagtcttcgctgtcccgccttttccgggagggaaatggaaacaaaaatctagtcggtttggatgcaggagtgatggggactcgcgaacacagcacgtggtgggacagaaagaagagtgcgttaggccggggaggaaagagggggcgtgtgagtctcagcccaccgtgccttgcttctgccttaacacacggaaagatcagatgtgagagaaaagctgattctcggccgggcgcggtggcgcatgtctttatcccagcattttgggaggccgaggagggcagatcacttgaggttagcagttcgagaccagcctgggcaacatggtgaaacccccttctctactaaaaatacaaaaattagccgggcgtggtggcgcgcgcctgtagtcccagctactcgggaggctgaggcaggagaatcgcttgaacccgggagacggaggttacagtaagccgagatcgtgcagctgcactccagccgcgcgacacagcagacttttactgtctcaaaaaaagaaagaaaagctgattctccccttcttgttagcggtggcagttaccccctgtataggtaggggtcagcagtaaccttagttcttgcctcctcagaagaaataattccacgaagggcataaggcaggatagacctagacaagtttcagaatagaagtaaaagtttatcaaaaagctttagaacgggacggaaagaaaaggaggaaagtacaacttggaagactgccaagcaggcgacttgagaaaccaagtgcgcagcttgacctgttgacttgaagttttatatgttggcatactttggggaacttgcattgcttctccccactcctgagatcttactgggaagctactgatcagtttcaggtgttttctattaggagactgcctttcgctggccccggtgaacgttagagaaacagttaagaaccgcctgaccatcgtttgattgtcacccaatagtcctggtatgtgtggggtggggagcgctctcctgttctgctcatacctaactagttaacattctgccccagcaattccccttgtaggactctagcctgcggaaatcctcactaagtgtgacaaagacaccccttgcagttttcttaatacagatattggaagaaaatgttcaattgggaatattaaactatggggtgtaagttatagcatattctggaagtcataaaaaatagtagagtccataacattaaaagtgcacttgtgggctgggcgcagtggctcaaggcaaggcaggcagatcacgagataaggagttggagaccagtctggccaacatggtgaaaccctgtctctactaaaaatacaaaaattagggctgggtgccttggctcacgcctgtaatcccagcactttgggaggccgaggcgggcagatcacctgaggtcagcagtttgagaccagcctgaccaacatggtaaaaccctgtctctactaaaaatacaaaaattagccaggtgtggtggtgcatgcctgtaatcccagctactcaggaggctgaagcaggagaatcgcttgaactcaggagacggaggttgtggtgagccgagatcgtgggattgcactccagcctaggcaacaagagcgaaactccgtcttttttttttttttttaagtggggccaggcgtggtggctcacgcctgtaatcccagcactttgggaggccaaggcgggcagatcacccgaggtcgggagtttgagaccagtctggccaacatggtgaaaccttgtctctactaaaaatacaaaaagctgggcatagtggtgggcgcctgtaatcccacctactcaggaggctgaggcaggagaatagctcgagcccgggaggcggaggttgcagtgagcggacatcgtgccagtgcactccagcctgggcgacaagagcgaaactctgtctcaaaaaaaagaaaaagacaaaaaaaaaaatgtagttatgtagtgataatgcaccctggcaactattctcaggaatctgttgaaagagatgcgccctgaaaaaggaggataaaaccaagaaagaagacgacacgggatccaggaaataagagatttagcacagaaagaaaaagtaaaataaccctgtcgatcgtaatcctaatccacgggattattttacttttaagtgtttaaagttaagggaaatcccggaactttcatctgggcagcagcaggaagatgaacagctctagggtgattaaattaatagaacaggttagtggttgcctgagtttgggattagaagagaagacaatgtaaacagccaggaggcaaaatttgggggtaataaaaatctaagactgggcagggcacagtggctcaagcctgtaatctcagcactttgggaggctgagtcgggtggatcacaaggtcaggagttcaagaccagcctggccaagatggtgaaaccccatctctactaaaaatacaaaaattggccgggcacggtggctcacacctgtaatcccagcactttggcaggccaaggcgggcagatcacctgaggtcaggagttcgagaccagcctggccaacatggtgaaaccccatctctactaaaaatacaaaaattagccgggcgtggtggcacgtgcctgtagtcccagctatttgggaggctgaggcaggagaatcacttgaacccaggaggcagaggttgcggtgagccaagatcgtgccactgcactcccacctgggcaacagagtgagactccgtctcaaaaacaacaacaacaacaaaaatatatatatatatataaattagccaggtgcagtggcaagcgcctgtaatcctagctactcgggaggctgaggcagaagaatcgcctgaacctgggaggtggaggttgcagtgagtcgagatcccaccatcgcactccagcctgggtgacagaacgagattctgtctcaaaataataattaaaaaaaatgatgataaggaaggaatagagcatatatagtatagatgaaataaggttgacagtgtattagtaattattgaaaccagatattgggtaataggagtttattgtattcttcttttctcttctttcttttttttttgggacggagtctcgctttgtcacccagactagagtgcagtgacacaatctcagctcactgcaacctccacctcctgggttcaagcgattctcctgcctcaacctcccgagtagctgggagtacaggcacgctccaccacacacccggctaattttttcttttgtattttaagtagagacagggtttcaccacgttggccaggcttgtctcgaactcctgacctcaggtaatccacccgcctcgacctcccaaagtgctgggattacagaggtaagccaccgcgcctagcctattgtactcttcttttacttttgtgtatgtttgaaattttgcactaaaaaaatagtatctttgatccttttatagttcataagcatgatgattgggtttttgcacacgtgtaatatgtgcctccctcaaaccatgttatgacctcagcatattacctgtctgatataaaaatatgtatatattttagaaacagggtcttattctctcacccaggctagagtgcactggtgcaatcatagctcaatgtaaccttgaacccctgggcccaagcaatcttcctgagcagctaggactacaggaacctgctaccacacccaaatttttttttttttttttttttttttttgagttagagtctcactctgtcacccaggctggagtgaagtggtatgatcttggcttactgcaacctctccctcctggattcaagcaattctcctgcctcatcctctgtagtctctggagtagctgggattacaggcgtgcaccaccacacctggctaattttttgtattttttagtagagacagggtttcaccatgttggccaggctggtctcaaactcctgacttcaagtaatcctcccacctcggactcccaaagtgcacggattacaggcatgcaccaccacacccagctcttcttctttttttttttttttagtagacaaggtctcagtatgttgcccaggctggtctcccgctcctgggctcaaacaatcctccagccttggcctcccaaagtgctgggattataggcatgagccactatgcctggtcttaaatgtgttaagttgtcttaagtcttacgctactttctctgctggtggtgcccacccaacggccattggtgacctctgaaaattaatatttttgaaaaaaattatgagtgtcatgtaaagagaacttgggtatcaacttgtagatgctaccattgaccaaagatgatacaatctgagctttaataaagatagcagttataatgaatcaaaacctattagtttaacccattaatataatactaataattttaaaaatttgttgcctttggagagtaagaagtcaatcttgaaagctgataaagggagaaatataaaaatgtatcctgcctctcatatgtgaattgtaccactgggtaactaaatagaagatgatgacaagtgtctcttcctgagaatagtccacctaatttgaaaaagaattgccagtgtggtggctcacgcctgtaatcccagcactttgggaggccgaggagggcagatcacgaggtcaggagatctagaccatcctggctaacacagtgaaaccccgtctctactaaaaatacaaaaaattagccgggcgtggtggtgggcgcctgtagtccctgctacttgggaggctgaggcaggagaatagcatgaatctgggaggcggagcttgcactgagcagagatcgtgccactgcactccagcctggggaacaaagcgagactgtctcaaaaaaaaaaaaaaaaaaaaaagaattgacaaaattagaataccactattttgcaactcccagttaatccattaatcttggcattaagtatcaatggctgctaacatagcaaaaggggcaaaaaaaaccagactttagatagctcttgctgaaagaacataatgctacctatagtcttaccaaaaggatcaaacctctgatccagctgtcaatttttttttttggggggggtgatggagccttgctctgtcacctagcctggaagtacagtggcgcaatctcagctcactgtgacctccaactcctgggttcaagcgattctcctgcttcggcctcccaagtagctgggattacaggcttctaccaccacacctggctaatttttgtatttttagtagagacagggttccaccatgttggaccaggctggtctcaaactccttgcctcaagtgatccgccagcctcagcctcccaaagtgctgggattacaggtgtgagccactgtgcctggccccagctgtcgattttttaaaatgaagatgatagaatatgttaagctgcaccatgaatttataatcagaaaaactcagactgtgaaagattctacagatcaaaaactcaggtttttcaagacataaatttaagaaaaaagtatgggaggggaaactgtgaattataagaaatggcaaaatgatttaaatgtttgtgaacctccaaaattcgtatgttgaagtcttaataccccagtgtgatggtatttggaagtgagaccttttggaggtaattagatttagatgaggttttgaggatagagtcctcataataggattattgcccttataatgggagggaaagactagagtcccttctctctctgccaagggaggatacactaagaaggtggccatctacaagccaggaagggagccctcaccagacaataaatctgctggctccttgatcttggatctcccagcctctagaactgtaagaaatttttgcttgttgattaagttaaagaggttcagaacgtgcaaccccgaaacagaccattttgacatactgattattttgaagtaaagaaaaatcagaaccagccaactcagtgaaacgtctttacctccccaattgcctaaaataaagtataaacttacccttttgcaaaggaaatttatactcacaaaggaaatttctgttagtaaagctatctgtaccaggaagagagctactccaagacaacttttttcacttaacagactgttatctgtgtcaataaatccactgagaaagtttatgttttaagcctcagcctcccgagtacctgggattacaggcatgcgtcaccacacccggcaaattttgtatttttagtagagacagagtttcaccatgttgtattttagtctccactaaaaatacaaaaattagctgggcatagtggtgcacgcctgtaatcctagctactgaagaggctgaggcataagaattgcttgaacctgggaggcagacattgcagtgagctgagatcatgcactccagcctggggacagagccagactccagctcaaaaaaaatgttagttttattcagtctatagtcgtaccgaggactatagactgaggtctacagcccaggagctgtccttcagagttctgtcagactgctgcagcacagtatttcagcccactgtttatatacctgtggtggaggttcagtatgtgcaaaatcacattaaagttttggtgcaggagtacatctagttatagatttcagaggcataatcactaaccctatcagacgttatctcatgtgtaggaaaaggcactatattcctcctttcctttctttttttttttttttttgagacggagtctcgatttgttccccaggctggagtgcagtggtgcgatctcggctcactgcaagctccccttcccgggttcacgccattctcctgcctcagcctccctagtagctgggactacaggcacccgccaccatgcccagctaattttttgtattttttagtagagacggggtttcaccgtgttagccaggatggtctcgatctcctgacctcgtgatccgccctcctcggcctcccaaagtgctgggattacaggcgtgagccactgcgcacgtccatattcctcctttaagcaatatagtgactcaggcaagagatgttgggggctgtgtgcactatcctggtttgccttcaaagcatcttttcagagagctgcacttcctcacagagtgaggggctttgtgaaattagatggcaagcagaaatgagcaaaatggcttcttaccctttttactttgtctcacaataattagagcactatgtttaaatgtcacttcaaggaattattttctctatggttacatttctctctttttacagtttaactttttcaaataattttccattttaggatttttttctttctgatttaactcagtctttgaatatgtgaaacagttacatggttcaaaagtgaaaggttataaaaatacaaactcaaaaagtaattaattaatttagtttttatttttctcaccctgtcttatggtgctgaaaactcaacagtttaattggggccaggcacagtggctcacatctgtaattccagtaccttgggaggcccaggcatgaggatttcttgagcccaggggttcaaggttacagtgaactacgattgtgctactgcactccagcctgggtgacagaggcagactgtgtatctaacaccctcccacacccaacttatttgggtgaattatatagtatgtaaattatatcccagtaaagctcttattaaaaaaattaaagccggccagacacagtggctcacgcctgtaatcccagcactttgggaggccgaggcgggcggaatacctgaggtcaggagtttgagaccagcctggccaacacggtgaaaccccatctctactaaaaatacaaaaaacatagccaggcctggtggcaggtgcctgtaatcccagctacttgggaggctgaggcaggagaatcacttgaacctgggaggtggaggttgcagtgagccgagaccgccccattgcactccagcctgggcaacaagaacaaaactccaactcaaaaaaaaaaaaaagttaattaattaattaattaaaaaaaagccatgcatatgtgcaaataaaaatacataacttaggtggagtggctcatacctgtaataccagcactttggaaggcagaggtcggaggattgcttgaggtcaagagttggagacgagcctgggcaacaacatggcgagaccctgtctatattaaaaaaaaaaaaaaaaaatgaaagaaagaaaggcgagtgtggtgttgtgtgcctgtggtcccagctacctgggaggctgaggtaggagcattgcttgagcctaggagtttgaggatgcagtaagctatgatcacaccattgcactccagctaggacaacagactgagaccttgtctctaaaaaaataataaaaataaagccaggcgcggtggctcacgcctgtaatcccagcactttggaaagccgaggcgggcagatcacctgaggtcaggagtttgagaccagcctgcccgacatggcgaaaccccatctctactaaaaatgcaaaaaactagccaggcaggcccctgtaatcccagctatttgggaggctgaggcaggaaaatcgcatgaaccccggaggcggaggttgcagtgagctgagatcacaccactgcactccagcctgggtgacaagagtgaaactccgtctcaaaaaaaaaaaaaaaagaataaaaataaaaataaattggttgatatggcagttaagactaaatggggtcaggtgcagtgactcacacctgtaatcccagcactttgggagactgaggtgggaggattgtttgagcccagaagttcgtgaccagcctgggcaacatagcaagaccccatctctacaaaaattttaaaaaattagccaggggtggccgggcgtgggtggctcacgcctttaatcccagcactttgggaggccaagctgggcagatcacctgaggacaggagttcaagaccagcctggtcaacatggcgaaaccctgtctctactaaaaatacaaaaattaggttggcgtggtaacacatgcctgcaatcccagctactcgggagactgaggcaggagaatcacttgaaccccggaggcggaggttgtagtgggtcgagatcgcgccattgcactccagcctgggcaacaagagtgaaactccatctcagaaacaaaacgaaacaaaacagccaggggtggtggtcgctcgcgtctatggtcccagctactctggaggcagaggtgggaggatctctcgagccttggaggtggaggttgcagggagccgaaatcgctccactgcgctccagcctgagcgacaaagcgataccctgtctgaaagcaaaaagaaaaaaaaaagctaagtggacaaacgaggaaatgggtagggatgaatataggcagactataagtagccgaggaaggtggccttattttcgcacctatcaatgctcaggctgagctcctgaggctagacctaccggcaccccccattcctacaggttctataaggcaagtcaggtattccaccctgtaaaaagctcttctctctcctgccccgctagactagtatcccctccttaaggctcccaacatccgaagctaagttgtttgtctgcctatcatccaggaacgcgtctgagggcagggaacaaatttattcatcgtaatcgagcccagcactttgtctcgcacgcagctgacagcagaattttaagataaagtattaaataaatgacagacctctcaaggcttcctgtctttcactaaaaagcttctctcaggccacgcccctacctccactcaggtcagccccttcctattgaagccccgccccatcgccttccccgccaccttacaccccgcccctctctcttaaagccctaggaagatt

SEQ ID NO: 447 - DNA, 62349 bp, Homo sapiens
ctgcagcctgcccacctggttgagtctgtgaggcttctcatagggacatcctgggctttgctggagggggatgggcaggatggcaggggccaggggccatttgggatggagctggagcgctccagcatcctctcagccacagtggggctgcgattcctgctgctcagaagcaaggcgagccggccagagtggctgataactgagcgtgcggttggcaaaggtggttaccagggtttgttttacagatgaagaaactgaggcttagacaaggtggtgacttacccacagtgacccagctgggcggtgccagagccagcatctgaataagccctggtctgatgcaggtcctgcgatctccccacgccctgacagtgacctatctttgtgcacacacgtgtgtttgtgtactgggcacacctcccctaaggtttgcagggcccagggctagaacagagatgtaaacacgagaagaggcaggaaggtgtgtgccattatcaaaagaaaagagaggctggccaggtgtggtggctcatgcctataatcccagcactttaggaggccgtggtgggtggatcacctgaggtcaggagttcaacaccagcctggccaacatggtgaaaccccgtctctactaaaaatacaaaaattagccaggtgtggtggtgcgcgcttgtagtcctacttgggaggctgaggcaggagaatcgcttgaacccgggaggtggaggttgcagtgagctgatactgtgccactgcactccagcctaggcgacagagcaagaatccgtctcaaaaaaaaaaaaaaaaaaaaaaagaaagaaaagaaaagaaaacagaggcaacagaagcagaacctcagatgtgagtgtcagtagacaggtattttaaaataactcattcatgtgttactaaaaacaggaaatgccgtctaacgggatctctggatggagaattccacagctgattggaacctaaacgagagaaccaaatggacatcccagggctgcaggtcagtgtcatgagacgggtgatggcagactggaccccgtggcaggtggaccatggaggggagacagagacagggcaacagaaacggtgcaaacagccactgaaatacccgtgggaaagaaaagcacaacagagaacaggagacttatgtgactccgactcaacaagacgcattagttaaaagatctaatatatgcgtatggggcttcccagaataagaggaaggaaggaaggaaagaatgagacatcataagatagtgttaaaaaaaaaagaattcccagccgggcacgctggctcacgcctgtaatctcagcactttggaaggccatggcgggtggatcacctgaagtcaggagttcaagaccagcctgaccaacatggtgaaaccttgtctctactaaaatacaaaagttagctgggcatgggtggtgggcacccgtaatctcagctactccagaggctgaggcaggagaatcgcttgaacccaagaggcagaggttgcagcgagctgagatcgagccgttgcactccagcctgggcaacaagagcaaaactgcatctcaaaacaaacaaacaaacaaataaaataaaagaattcccaaactgattaaagataccaacccacagactcaagaagcctagtaggacttctgctgctggccacgatgctgcaacttgtcaatgtaaaataaacaacagagagactggctctcccaaataaagtttactgggggatggcaggggattgcaatctgggatatgcatgctgagggggaccgtaggtgtatctttcttttaggggtgggaagaggaagtctacacagattgttttggaataaacctccctgggtacaggagcttattgcagggttggtgattactcatgggtaacatgattgttgcgggggagatgtcttcataggagcagctgatctggaatgttgtgtgctgtcggagtccctgtaacagttctcatcataggcacccgagcatgagggaccttccgttgaggcctcccagctccgttttgcttgggtcctgacataagtgactctgccttagtattgacaattttcacacagtggagccagtttcccccatttgtgccccctcccccagttcatatgctgaaaccgaatccctaatgtgatgacattatgaggtggggcttcggcatgtgcttaggtgggtagtgagggtggagccctcgggaatgggttagtgcttttatttatgtattttattttattttgagacgaagtctcactctgtcgcctaggctgggaggcagtggcatgatcttggctcattgcaacctctgcctcccaagttcaagtgattctcctgcctcagcctcccgggtagctgggattacaggcatgctccaccacgtccagctaatttttgtatctttagtagagataaggtttcaccatgttagccaggctggtctcgaactcctgactacaggtgatccgcccacctcggcctcccaaagtgctgggattacagacgtgagccaaaacacccggccaaagttagtgcctttaaaaaggaggccccccagagccccctcatgccttccaccctgtgaggacacagcatgaagaagtgatctaggaaccaggaaggggtcctcgccagaccttgaatatgccggcgctttgatcttggacctccagcctccagaaatgtgagaaatcaatttctgttctttagaagccaccccatctatgactaagacaccctcccaccttcatgctactgagtggacaagcttacatgaaatgactgttttcacatatgtggcaccaggcagcccagggatgccggtgaaatctctgggtaagtctctttggcctctggtactggcagcttctcctgttaagagggcagtcctccacgagtgtctcgtgccccccacctctcacagggtgtgccaggaatgcaggccctgagtaccctcccccatttctcagggtggtttgccctgagagtcctctagggacaaagagcagcttgctcactgcttgctgcagaaacagctgactcccccagtgcagggctcctcagtggccacgcaaacctactgactgtgcagtgcccacccaggcctacccacatggcacccgtggaatttgggggcaaggggataagaccaaacacacaggtgagcacctgcctgccacgccatgaatgaaaaagtcctttgtctctgaccccggagtttcacgtcttctgtcagcatccctgctgcggtaacgggccagctcttcctttgtaaggaaagctaaaacccagtcccagagctggcaccacctggaggaggaagtgctcttccctgcccctccttggccatgtgacttgctctggccagtgacatgggagtgcaagcgacacatcccagctgtgcatggccgctgggagagtgtggcatggtttctccatctctcctccatgtcctcccttgtcaggagaacggcatgttccagagagccacagcttgctcagcctggaccccagaacgaaggaggcatcagaagctgagccacccgtggccgacaagaaacctgagtgggaggggaaacttggttgctgtgatcgacccaggcttgcgagttgttttggcaacacagcctagcaagagccgaccaatatgtcattgatgaaagaaagtcaacaggcgtgtagaaggagctgtctactgagcatgtctgcacttttctgaattatgttgcacttgagtaaaaagtaagcaagcctgtctatttactttaaatgatgtgtgccagatatgtacagtatgcagagttaagaaggtgccaccccaaaataggctgctctggcatagtcactattaggaattaaaggcagttaaaacaataacaggtgcaaaaagatcattctgatctctcttgtgtttcttaaaagcagaagatgaaattcccaggtgaaagatgctctccctacactagaaagctctgatcctcaaggatgagaagctgagacccagcaaatgctgtacagtccctgataaaatgcctctcaccttttcagccccccacatcatctagctgcttcctcaaacctcactgttctctgtccaactcagcacacgactgagtctgcttcactgggtcttcacttccttaggagggctcctgagccacatccaactttaatcaaatacactggcatgatgatctgtcttatcttgatttaactcttgggcccagccaggacctcaaaaggatggaggtggagtttttcagcccctacatatgcaaacacacacatagcatgtatctgagcggccacatgggctggccctgctattttcttatggcttctcagcctcccagccaccttctgctctgcatcactggagctgggaggctgcaagctcctttcccactctcctctgcccgttggcttccagtgaggctcctgcagcgatggcgttggtgggagatgccaggcgaggaattgatctcgcattctcgtttctgggaacgtctctgaaaatggctgaatcccgtctgggatcccagctcccaaggaggcggcagcttgctcactgcttgcacagccccagacggcagaggggccctctcctgcacagcctgagacagtggaggggccccctcctgcacagccccagaagatagaggggccccctcctgcacagcccgagacagtagaggggccccctcctgcacagcctgagacggtgggggggggcccttcctgcccagccccagatggtagaggggccccctcctgcacaactccagagggtagagggcccctcctgcacagcccgagacggtagaggggtagccctggtctctgggggctgcactcctgggctctggagctgccacagctcctccctcctagtgcttccccttccttgttttgctttttgccctttctgacatagtgacgacttccgtttcgcagtctggaccttcaccaccccagggcgagggcacaggcgaagcagcagcacccccccggggcctctctttatttggaatacagtgtgggggctcccccttccttctccagcccgcccaggcccctggagctgtcctggggcctggggagtgaggacccgtgccagcagcacagactctgccaggccgggcccgctcaggtgggagcccaggccgggtgaagctgtgacccggccctcaccccaactcggtgacaaaagctatcacagggctgcagtgggggaggaacaggacgcatctgccaggcacctgacccgcagtgcacttctgggagctgtgcttatctccccggggtctatttcgccccaaggtttggcgggttaaaagctgatatgcaaccggcacgacatgaacagtatttcatgattaaagacatcgcgtccatgtataattgagatgctgccgcatttgcggggattttcaagcgaaaaccaggccacgtggaaaggctaagccctcgcacccccccgccccccactgctgggacccccgccccgcgggagaccccggcccgcggtcccctatgcccgcgacccctgcgctcaccctctcccctcaaccctgagtccagcccagtctcgcgcgaggccgcagggagacccccgccgctccctggaccacccctgggcccaccgtacccagccgctccccggcgccccccgggacgaccccgagccggctgcccgcctcccgccgcattccgcacaggcgcaccgcgcaccgagggccgcaccgcccagctccgcctgctgcgccaatggccgacggggtccaagtcggcggcccaacggagaggcggggctaggggcgggaccaggacgcgggacagcaactgtcccgcaaggcccggattgaggaggcgggagggaccgaagcaggcggacccaggatttggcgccgcgatctcgaggcttggcctggagtaggaggggaaacaaggcgggactaggggcgaatccgagggggcggagcagggctcggggtgcggtcgggggcgtggccggggcgcgctgcggccatcttgggggcgggcccggggcggagacgagcccgaaggggcggggcctcggcggcagcaagaaaggcgggaccggggcatctcggggcggggcttggggctggatctatgagccgggagcggggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggtgaggccgggtggacgcagggcggtgggcgcgtccctggctccttgcccgggcgtcctggcagcgatggggtggtgggggccgcggggcctgggcggggctgggggcaacggggcgcgcccatgacccagccgcccggcaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggaggtgcgtcctgttccccgccgcggcggcgcacatacccttccctaagctcagggcgttcggggccctttcctgcccaaccccggcccttctgtctgctggagcggccttgatatgcccacgggtcagcgtccctcatctctccctgcctccccgccccgcagctggtggctgggtggtgccctgcacagacctgggcccagcagcagagtctggacgagctctgccccgccggctccacctgttgcctctgggactcagcccctcttctgaggggaggggggacactcagccccgttttacccctccctgccctgcgggggtgggctgagcacggagggtgggcagaggaacagagggtcggaaggaggagggcgattctttgtggtgagtgggttgggggctggttctgcgcctggggcacacacatgtggcttccgctttccagagctctacctggatgagagcaagcagctttacaaggagctaggcttcaagcggtgagtgggggcgggaacccttgggtagcgtggggtggggggcccaggggttcccaccgctccctgccacctcctctccctgctgccctctgtggtgctgtccactcgggccttcctgggcaaggcggctctggtggcactgttgaccagcccttctgccaggccttctcttgggtgctgggtgactgtaatgagccacctcgtccggggcttactctcggtgtccagaccacctcgtggggtggagcctcgtggcccatcaggggccatcctagctttctggtgtctgtgccacaggctgcttcctttgcttggcagttgccagctgagccagatccctgggcacacccagcctggggccccatccatgctccctgcaccctctgtggaccctcggctagcagccactgggctcggtgtccaacctgccggtgggctgggctggctactgatctggtcgcctgtgccatctctgagccctggtgaggcgggtgggtggggtggggcctgacctaggaactggtctcatggacactggagcaggctctggacccaggcttctccggagtttggccaagcgacctggtgtcttcgcaggtacaacagcctgagcatcctcccagcagctctggggaagcccgtgcgtgatgtggctgccaaggtgtgtgcgggtcaagggtgtacaggccggggggtggtgggagctcccaggagcctttcttctaggattgactcaggctgtacccactcctgacaggccaaggctgttggcatccaggggaacttgtctggggacctgctgcagagcggagggctgctggtggtcagcaaaggtgggtcgagggaggggcctcggccactgcctcaaggagggccttgctgaacttggtggcccagcccaggccctctctctggcttgtcagtctcatcacagcccctccgccgcaatgtggcctggttctgcgtgtctgctgggctgagtggggctgtggcagaacagctcactcatctgggtagccgggtgggggatatggctggccagggctgccctaccctccctcctcctggtatgtggctgtgaggtgcaggcggcctccggggtgccgtgactgcctgcccgctgctacaggtggtgataaagtgctcctgcatttcgtccagaagtccccaggcgactacgtccccaaggagcacatcctgcaggtcctgggcatctctgcggaggtctgtgccagcgacccgcctcaggtgagctgggccttgggggcgctgcctgccagcccacgccctgcccctaggtcccctgggaggagcactcggcttggctgggagctgagccacagcgctgtgggcatcatgccaattgtgccctgggatatggatgccactgtgaccccacttgcagagtggggcaggctgagaggggccgaagggcagcatggctggatggacaggcaccttgggactgtcctcagaggtgggggcgacacatggggtggcgggcagagaggcgtgtcctctcagccttgggagggctggggattgtccaagggggccctccaggcatttgtctgatccagtgtccagcggccccatgggaccctgctgtccccacagtgtgacagagaggtgtgagggaggcgaaggccctggcctccgaggatctgggtggcgtctgctgccctaggtgtgctggaagtccacttggaagaactgttccggaggcgctgggtcgggatgccgaacctctcctgatccgccggcagcaacgagccattaaaactgcagttcctgaccacgcactgcttcgcaggctccgagccctgcatcctccacagcccccgccttgctcactgttgggccctcagggcgggcagggtggctgtgagtcccaggtgtcatcttcctgctctgcgactttctctggagaccttgggcctttggcctgtggggcactggggatggtaacctcactgccccgtcactcccttcaaaggcgacagacccaagcccacgtcaggagaggagcgtggggtcagctccagcagggtcggggtcagtgcctgtgtctggtgggggccactcaggagagttgggttttcagggcagagatgggcttgattccacctggtggggtgggtggaccctggagactctcaggtgatgggccagcctgccccaaggctctttactgatgtcagaatcattgtttgcacctgctgggtatggcctttggggcggccggcccgggagggtcttagtctaattaggtgtgtccagcttcttggccacctttccctggggaccctaacaggcccagagcagagccccttacctcccaggtcagactacctgctcaggccctcccctcccatgcaggccgatgacaactgcagccctctctgcactccctagtccagacctggggaccactgtgggttcctgtgggtctcccggctcccttcctgcccccaatgccacccttgcagtggccatttaaaaatgcatagcaggtgacccactgcgtccctttgcgttcagcccctcctctggctttcagttacaccaagctaaaatttcaggttcccagctgcagctctctgggtcccccggtgccccagtggggctccccgcatctgaatgtgtggtccctgggggtgggcacttgggggcatcctggtcactgctggccctagcattggaccctaggagacctgactggaactggctccctccccatcagctcccagctgtcactctctcccacccccgggcagctgttttgcccaagaccactgctacctgtttacccaccctggtccctcccagacaagcaaggcctctgatttctttgaagcatttacttagctcaagtctgaagctgtagatactggaagacaatgcaccttggagggtgggcaggacacagttgattgtctctacagagctgtgacgggggcactgagccccgcgggtgtctgtggagggggctccggtccaggtactgcactggacactgctcatccctgggtgtcaggcaggtggctgcaccctaggccaggcgcagaggcctggcaggcaggcttggcatggttggccggggcgggacgtacactgggtcgccgctagctgcaccttcgcacagatgcctccgagcagcgggtgggcgtgggccgcacagcgcggcagggccttggctaccacacgcggcatcgctccttggggtgcatgggggtgccccgggcacagtggaacgtgtctgcgaaggcggccaggttctgcagcgaccccagtaccctgtgggtgggtgggtgtgacagcaggagcattgccatcttggacaaacatggccattttaagttctccgtgattaaaaaccagcccaaaacatcagcctaatggctcatgtcagtatgagcagaaacatttcaaccatgagataaacccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgagccactttttgtgctttcttcttttacaggccactggggtgggggtgagggggttgtgggtggcaagggggttgtgagcatgggagacttgcctgtacttcaggggactgtggacgtctgtcttgatggattggatggcgaactcgggccggtaggacccgcaccacacctgtgggcatgttgggggcgtggctacaggtggcgtggtggggtggccaggaggggtgggggagggtctccactatccccaggctgccccttctagggtggggtgaggggagtcagcaggtgctcccctcctcccatcagcattgaaatcctgtccagctcccgccccctgcccctcatgcttttcccccaaggggccttccatgctgggctctggtccctggaggtgccccagagtgggccctccagagatgagtggggaagcatggggatggtgggaccaggactgcggctgccacctgggcatagttgatgaagaagagctgctcatgggtgagatccaggccgggcagctgctggtccttgccaccctctgccatccacttgaggtaggcctgcaggcaccagacaggagctgagctcaggcctgccagcctggactccagaaccctcagatctcagggcagagcagaggtctggctccaggacctacccctgtgggggtcctgctgctgcaagggcccttcacacaccccacggatgagcgctcaccacctcagtcactcagggacccctgagctgggccctcggggggggatccctggccagacagcccactgcacaccacctgtcccgaatgagcccctgacgccccctcccctgaggcactggtgcccccctcccctgcagcgctgatgccccccctcccctgccatgctgacgccccctcccctgctgtgctggcaccccctcccctgccgcgctgatgccccctcccctgatgcactggcgccccctcccctgccatgctgacgccccctcccctgccgtgctggcgccccctcccctgccgcgctgacgccccctcccctgccgcgctgacgccccctcccctgccgcgctgatgccccctcccctgccgtgctggcgccccctcccctgatgcactggcaccccctcccctgccgcgctgacgccccctcccctgccgcgctgacgccccctcccctgccaggccccaccttataggcttgccgcacccctccgttgtcagcaatgttttccccaagggtgttgaatccgttcacctgcgcacaggagacaggattggggcagccccggccctgacttccctctccctcagggccagggctggggctccggtacccccgcagcctgggtgctggtggcagcgctcacgttctgttcgtctgccaggtcccaggagtagttgccgtactggtagatcatgcactctgactgctcccggaagtgctgggtggagaagttactccaccaatccatcatgttgccattcttgtcgaagttccggcctgggcaggggcagaggagggctgcccacatgcccctggctgcactgtgcctggccccacggcagccactgtgcctggccgctcctgcccctcctgcagccagccccagtacggagagcccacagtctgagtaggctgagcctggaagagcatcgcgggctccaaggggcagcagctgtctggggctacacagcccccagagaaggagggcttcagtggtctcccatgccaccccctgaggctagggcctagcacctgggtcctgtggtcttggaggcatcatggtttaagggctcctcctgggatgcccaaactctaagttccaggcgagaggagtacgtggtccctggggacaaggactgcccacggaaggtccggatggccgagccacaggggaaaaccagctggggcccctgtcccaggcagggcagtccccaccgaggggcggaggtcagcatggccatggcgggggtagcacaccccccggtggaggatgctggccgtctggagagtctcccaggctgggatctgggcttcgctgctgtattgggcagtgttgtcgtccccatgtcacaggccgtgggagggaagtgcccagtgccaggtggagtcagggtcatgggctggagtccctgggtcccctcctccatgctgggagtcagtgcccccagacagggccccagcctggcattcaaagcctgctctgcccccacagctccctgaggacctggcctcggtgtccccactgaaaccgtgaaggggttgaatggagcgcccccaggccccttcctggctgcttctccgcggagaggggagggcgtgtgtgattggaggggcggccgctcaccattgtcgtcaaagccgtgcgtgatctcgtgcccgatcaccatcccaatgcctccaaagttcaaggcctgtggctgctccttgctgaagaaggggggctggaggatcccggcagggaatactgtccccaagggcgggacaaagaataagctgtgagtggacacatctcctgtgtgccaggctcagggatggcgctgccaggggttctgacacttgatcccacagaccgggaggcagaggtcaggattccctcaatttacagatgaagacacggaggttcagaggctgggcgggctcgtgcctggcagacccaggacctcagtccggcctcctcccaccatcctgttctgcctgcaggaaaggctctgggccgcctgccaagtccctcccgaagccgctcatgggcacgggagtgagtgttccccacgggggcagcaaggggtgacataggagaatgttccaagaacaggctggggtgcccccaggaggaagggatgggcagggggctgcaagccaccccttcaactctggcaccaaagggcctgggcaggcagggagggggaggaacttaccaatctggtttcggtttggggagtagaacgcattgaccaccgccgccccgatgatccagctgtgatagacaagccggtctctgggagccgcctctccggggaccctccctctgggctctctctgccttgatggaccagggcctaccctggccacaccagagcaagggcccaggcctatcccaagatctggttccttcctggggtccctgaggaggaggcgacttgggccccagaaagcagagggtgatgggggactctgtccaagataggcccagtgactgcacccctcagctggcactggaccccagccacgcatccagtcccccgcctggcaggcagccctgcacgccttactggccactccctggccccccccgcccatgccgcaccagcgatgccactcacagatttgggtccaccttttcccgaagcttcctgaggctccgctgggcgcccaccttgaggttctgcagactgttctcaaagtacaggtcctctgagaagttcagctacgggagaggggcagtcactgccagatgctggggccgggccctcagaggagcaaggggagaggtcctgggtggttggggaaggacctcaagccttgccaggcgtccgcacgtggacagtcggctgtgggtgcaggtgaacggggcagccctggctgtgggcatttacatgactctgagcaagtccctcgtccctccaggcctcagtttccccatctgtacactgagggtagtgctggagccaccaccctagggcacggtgaggacagctgtgttagcgcctgggaggagggcacagagcttggcacagaggagcccccaggcaatcagggcccatgtccacggtgtggggggcagtttagggctggggttgggggcgcacattggagtactcctcgtccaggcgcctgttcatctcctccaggatgtagtcagggtgcccgatctgctcccggatgctcatggcctgagtggggaggagggactggtcagtgggtgccccactgcggatggagtcagcccgggggccggtcagtgagtgccacactgtgggaggggtcagcccggggcatcctggctgtgctctccctgtcctgtggtgaggggctggggggctccgggatctggcccccaccttgcaggctctggggaggtttaatggggacagaatatggaaggctccgcccacctgacctagagcccaacagcccgccaggggtccgggtgggggcaggggccctggaggggtcactcggctgccgtctgtcacttgggtccagaggagcttctggtgggtctgacccttgctcccgaggccaccgctacccccgctggctcatggggggtgctggggatgtcccaggcctggttcctgcccctgcctgcttttcctcagctccacagtgggcgagtggtcctgtctgcgcctcccggggctgccttctccccgtggggtcctgtctgcgcctcccggggctgccttctccccgtggggtcctgtctgcgcctcccggggctgccttctccccgtggggaccgtcaggaggctttgtcggggcggtgctgcccgtgcccagatccagtcggggctgccctgacctctgcgagccacataccttctcctgcgccttcttcttggactcctcgtccatccagcccagctcgtccagcgtctccacaaacactgtccgcaccttgtcaatgagttctctgacctgggaatcgggcatggccctcgtgtcccagactcatctggagggcgaatgaccagcctcaagggctttggggaggtctggtctgagccccgccggggcaaggcccagggctgcccagctgtgggcctctcaggtgaggtgtggggccggtggggggatgagatgacaacccaacttcagggtcctccctgctgggctgtgggtcctcgtgggccaggggcaacttgtaccacctgtgcctttcccagctggacctgcagggctcaggctggggcccagtggccggctggggtcaggggcatggggtgggcacggcttcccttagcctccctctgtctggtgagctggggcaggtgcccctgagcctgggcggggtgggagtctcagggcagggaggctcggtgtccctgtggaaggctggccccgcgtgggccatggatgaggggcgcccaccatgctcttgctgtctccagggaacgcctccctgacgtagagggagcccacggcgttctccatgttgctgttgacgtagcccacacattcacgccagcgcacctcctccaccattgtgccaaacagcgcctggtggggccacccgatcatcccacgggcccccacgtcagccttcccaggcctggcgtggggccctgggcttacggggtgagcagacccacctatcctcagcctcagggtgccccggggctagcgggggcacgggatgatctcagcctcacctctgggtgctgctgcggcggggggaaggatgggcatggtattgtgattggggaacttccgcagactgagagctgggcctttaccctgaggagttgggggggttcctccccggcccctgtcctggttgtctggctggactctgctctccaggactccagccccagtctcaaggcacagggctggcgctgaccccagagcaaggcctgggaccacgtccctctcagccaccagctcccagggccctggtctctccattgttgaagcagctgtgagaacacctgctcatctgtccccagggacacaggagcacgagactctgggccccagactcaggcaaagcccagggagcactctgcccagcgtcctgccacaccttctgggctgcaggacttcctgccctttaggaaagggaggcagccctttcttcctccccaaagctcctagactcagtgcccccctgacgcttgactcacagatgtctctgacctacccccccatggcaacaggaggcttgacttgcccccagcttgcctctgcctcagtctccccattgcagtggggacctctgtccctcccattactctaacaaaggtcttgagagtcccgactcccctctgcccttagcccctatacccaatccctcagctgctgcggtcaacacctcccctgcgtctgtgtgtctgccagcaccatggccaagcctgtcacctcacctgggtgaccacatcggcctccatgctgaccccgccccctactcaactcactctccccagaacagccagaatccccctagggcctccctgcggttccttgtctccaccctcaccccagccctggagcagccacagtgactacaggagcagcatatctgaccgcgtctctgctcttagcacccctgcggctttcagacagggagtacaatccaaaccggctgctgtggcccgtggtcacctcgcctccctccctgccatcttctccttcctgtccgctgctgaccacgggtccggcccctgcctgctcctgcctctggcctctgcactggcactggctgtttctgctcccgggaaatcaccccgccgcctcttcaggcctttaaggtctcaaatgtcgcctccccggagcagtgctccctgtcctcgtccctccctgcctccccgccacatcatactctgcggttttggcagagctacgttctgccttgttgactgtcatggtccactccccactggggtgggcgcctcgccctgcctcgtccatggctgtgaccctggtgtggacctcggtgtttgcctacagcttatgctcagcatcgtggcctgaatgaatgagtgcccggccaggctctgggcagggaaggggctcaccttgcggtagttcactcgtgtgtccttgaatctctggcttaggctaccaatgcggtccagcaccaggcgccagaccaggtagttctgtatggtcctgggggcagaaggtagagggtgaggggagaacaggtgagaggtctttgcaagggaggagatatggcttagggcccttggccagcacgttccaccccagagagttatgggtgctggagaaaacctccaggacaaccacctccaagatccagcccatctgccccgggtgcttgggatgtgacacatttttaatgtaagactccactggccactaaagcttaacccctcatgtcccacacccctcagggcagatgcttcatagggtcccctcctgggagcagaagctgtgttggggaggatgggagagcaggggcaaagatgctgaggcctttggagaccctccctgggcctcacctggctgagtaggtgtcgatgatgttttcaaggttctgcaggtaggggatgccatagaccaccacttcctcatctggcagcagcttgattttgacagaggatagcacagtttgtatgaacagagtccagttaaatccctgcagatagaggaagtggggagaaagagggagagagagagagggagaaacagttcctgggaatctaagaaacccagcccctgttgaagaatgttcaaggaataagagagaagtgcaggtaatcagaatcaggaaagggtgggtgacattattacagagcctacagctgtaaaaacccaagcgatcatgcagatatatgcgaaagcctaagtataacaggcaagttcctagaaaaacacaacttagcaaaaatgacaaaaaaagaaatagaaaatatgaatagtcttctaggttaaataaatggaatatttaatttgaaactttccaataaagaaatttccagacccatttggcttcaccagtggattctatctgacatttaaggaaaactgccaatcttattaaaactttccagagatgagaaaatgcttttcaacttgatttatgaggccaagaataaccttgataccaaaataaggatattataagcagagtaaataataagccagtctcgtttatgtcatagatacaaaagttctaagcaaaatattagcaaatagaacctagccatacttgtataaaatgctaatatatcacagctgaattagatttattcaaggaatacaagtttggtgtaacatttgaaaataaaataattttaattcactacaataactgaataaaggaggaaagtcacatgattatttcaacagatgcagaaaaagcatttgataaaatctgccatctattcataataaaaactcttggcaaataaaaatagaaggggtcagccacagtggctcacgcctgtaatcccaacactttgggaggtcgaggcgggcagatcacctgaggccaggagttcaaggccatgctggccaacatggtgaaaccctgtgtctactaaaaatgcaaaaattagctgggtgtggtggcgcatgctgtagtcccagctacttgggaggctgaggcatgagaatcgcttgaacctgggaggcagaggttatggtgagctgagatcactccactgcgctccagcctgggcaacagagcaagactttgtctcaaaaaaaaaaaaaagataaaaagaaaaatagaaggaaaattctataacctgataaaggaaatgtatgaagcagcagaagcaacaaaaacaactccatagcaaacataacttttttttaaatttatttttgagacagagtctcgctttgttgcccaggttcaagtgcagcagtgcaatcttgggtcactgcaacctctgacccctgggttcaagcaattctgctgcctcagcctccctagtagctgagattacaggcatgtgctaacacacctagctagtttttgtatttttagtagagacagggtttcaccatgttggccaggctggtctcaagctcctgacctcaggtgatccacctgcctcggcctcccaaagtgctgggattacaggcatgagccaccatgcctggccaaacataaaatttagtggtaagaatatacgtgcttttcttttaatgtctactattatgacatcagcattatgctcaaaatcctgtccagttcagtaaaagcaaacatgaaataaagccagtaagaactgaaagagaataaataaaactggaccaggtgcggtggctcatgcctgtaatcccagcactttgggaggccagggcgggaggactgcttgagcacaggagttcaagaccagcctggccaacatagagaaaccctgtttctgggaaaaaaaaaaaaatcaggcaaggcttggtcatggtgtattcctgtggtcgcagctactcaggaggcttgagcccaagaggtcaaggctgcagtgagccatgactgtgccactccactccagtctgcatgacagagtgagaccctgtctcaaacaaacaaacaaacaaacaaaacccaacccccctgtttttttacaaatgatatgattttgtttattctacaaataaataaccagaactaataagtgcattgagtaagactgcatatttacaaagtcagtatttccatatatcagcaacaaataagataatttcaaaatgattctatttatagtagaaaaccaaacacctgtaatttatctaataaaatatgtataagaacttgacactgaaagctttaaaagttattaagaaaaattgaagcataaatggaagcatatatcatgttcatggattggaagactcagcattgcaaagtctccccaaattgatagagagattcaaagtgatccctatcaaatttctagcagagttttctttttgtgtgtgtgcgtgtatgcaaatggaaggcagattttaagttttatgtgaaaatgcaaaggactgagaattatcaagacactcttgaagaacaaagttgaaatatatactctattgactatcaagacattataaagctgaaggagtgatggtggtaggggttatcacttggatagataaagagaccagtggggcaaaagagagtccagaaatatacatatgggcccacgcatagacacacaggaacacctgatttataacacagaaggcaccaagaccaggggctcacagggggctctttttaataaatggtgctgaatgactggaaatccataagaaagaaacaattcctacatctcactgtccattaaaaaaatcaactcacagtagattgtagacctaagcaaacctgagggtaggcaaagagttctttagcagaacacaaagaatactaaccacgaagaagagatctgcacacatttgctaagccaataaattggaccatttaatagcctccattgaaacaaagaaacccttatgagagtaaaaaagcaagctgcccagtggggagaacatttgtacacataagctgaccaaggagtcacatctaaaataggtaactccaagaatcaatcagagaaagatcgcccgatagaacaaatgggcaagactcaaacagacgttccacaaaagggaatggcattggccaattgacaggagatggcgtttaacctcctccgcccttggggaaagtcacattgaacccagatgaaaccccactacacaggtgcagaaacggctgagaacggacaccacccagcacgggcgagggtgtggcaccagccgctgttggggagcgcacatccctggataattctggggaaagacagtgcctgttactgttgaacagatgcgtgtgcttccacccagcaattccactcctacccacttgcctgccacaggcacacacaggcatgggcatgacaacatcactcagaaaaggcccagagacagcacagtgggacccgagttgtcgcatgttcttagagtcagaggccactcagcaatctagaggccacgtcagggaccggcctccctccagggagaagtcagggtctcttctccagggaaggaggcaggcacaggggctaggcaggggcatgtgggggcttctgggatgtcggtggtcacgtaagtcttgatctgaggggtgattgtgtggatgtgttcactctggggcgattctgaacatcataaatgcattgtaaaccaaatgtccccaaaccctgggctcctggacgctcccctgaacctgccgctgtgatgtctccacggcaacctcaggccatctgagctctctcacttccatatttagtccttttgcaaaccctgttggctccacttccaaaatcaaccccaaagccacctccaccacgggcaccccccttggcagagctgccatctcttgcccgggctacgtggcagcctctgattggcttctctgccacctgccccgtccccttcactcactcttacttgtgaaccaggtcacgtcctgtcatacccccactcctctcgggcagagtctgagactttcaagtggcccccgaggtcggacacggcatcccccgctttacttcctactccatctctctctagccccggtgctcattagctgggagtccctgccccagactcttggggaactgctgtgtgagccacactggccccagatggccatggcccttggttctctgcaaggctttacctcctgtctgctgtcctggctgagctcatcctgccccctttctggctttctgacacgttttagaggtcactccgcttttctgtccctctcccgcaccggaacctcgatcgagataggcctttgtttgggaaggggataaagcccagtgccagagcagagcctggccccactgcgtgtgttctgggcagcggggtgttggggaaggtgtgtccccgcaggccagccctggggaccagaaccgatctagggaccaccagccttccaaggcactaggtgccctggggcgaggctctccccagagtctctctgtcttgcccttggcaagagctgtggctccagacactcagggacatactctggttgagggggcaggggctttggacccccttctgcccttgccctccccccactgacttgggcaccctttgccgaagctgcacgcctgcgcctcctgggggaggaggccctcgagaaggccagctgctccagcagggtgagagtcggctgagggagtgggggacttgccccttcccaggctgggctgctcctctccagcccccacctcaaagcacagggcggtgcctggcctgggcactgggcaggggagcgcctgagggtgtggccagggggaactgctaccctcagggcaggcaggactgggaggaagcaccctgctaaggttctgagcgggacttggggtctgagagccctgggtgggaccctgtacacccccacacatcagcagccccctgaggcctccgtttcctgctcagaagaccggggccatcacagcaccgcacagatgggtgactctgttccaggatggcacagttggcactgctgtcccagtgacattagtaatcgtgctggtgctgctctgcagcaagtttgggtgatcaggtacagggtctccctgctcggggatggggaatgtttctgagcttaaatgccaggcaacgtgccctctcagagggccgcttccatgtcccccacgagtctccacccggccagtgccggcctcctgtgtggtgtggcctcaccttcaggccaaactggctttgcagctcctccagtcccatccggtggtacaaggcgatgacgtcgtgtctctcctcctggggtaccgtggcctgtgccggggatagcagtcacacgggcgggtggccaggatgccccctggggctcctggcccagtccctgcctgctaccggcccacccagcaccccctcaccttggccagccacaccgcctggggctcccagcccactcgctgcccgctccccacccgccccggcccccttaccttggccagctgtgtctccagctccagcacctgcaccatgtcctcctgcaccaggcagctgtccctgggcaggtttgcatcctcccgcagcaacgtggccactgacaccatgaactgcaggtaggcttcccgcacctgggccaaaggacgccgggcagagctgggtggcctcagccaccatggcccccagggagttttctgtgggggtggggtgggcgtaggacatggggaagcccctaatgcgtgtccacccaccttgaccagcaggctctcgggcacacagagtgccgagtgggagcgtctcagacgcgtgacctgtgcccgagccactggacggggtacctagtctgcagggctgctcagggcttaaactgtgtggctgcctataagggtttgcacaggtgggtgctggggctctcagtgctggggttggggtgctgggcttggggtgccagggctaacttgggcctgccggggctgtgggtgccagggtggtgggtgccggggtggtgggtgccagggctaatttgggcttccctacccaggtgcttcccggcctgagtgtctggagtgggatcctgaggaagtttgctcctcagggagctgccttcctcgcgctgggcagggcttccccagtgcaggccaatgctctggccaggcttggcccatagctgcctggtctgaacacatggccagacatggcgcttttgagacactccagtccctcctgctctggcgtggttctctcagccccactgctccacctttggccacacggcccttcctctgggcttggtcatccttcaaagtctagttcatagcccacctccaccaggaggccccctggattgtgtctggccctctggggcattcatgcctcatgcctgttcacctctgccctggtgctggatgccttgccctcctcacctgctccctgtccttccccacccttccctgcaccctgggctagccctgggcctgccagcctcaaggtccccttgtccacagtgggggtcctcatccctcccctctcttgacagccccttgagatggagcaggctcggggcccagctgcctgcactcagatctccaggggccctcctgggaatccggtgctgcagagcctgggtctgtactgacgggagggggatgacagttctgccccatggggctgctgctgagctgagcttgtccccaggcctggcccgggtgttgagggaacgtcccccaggatggtggcaagcaataggtcacgtctgcacccgccaccctcagtgccgggctcaacctccacaggtgctcactaacaccagcttcggggagggaaggccaggtgggcaacgggaaggccagaccacggggtagggggtgatgggggggtcatctggcattgcggtgaggacccacccaccttccggttgctgccgccgttgaagtagtactctcgggagggcatgcccaaggtgggctggtctatctggaaatacagaaggtgtgaccctgggcaaggggcccggggtccccgcagcctggctgaggcaggctgcagccgcctccccacaggactgtgccccgtgcacacgtgctctgcccaggagctggtggtggagcttgtgccggacccgggaggccagaccctgccccgagtgatggtgggggcgctgggctggactggagagggtggcgggggtggggtggggaggggttcaggctgtcccgggcctcgcagcacccgcggctcccccagagtggggcgcgtatttgtttcgtgtgtttctctttggcctccagcccgtggccagcagtggatccctgaggtcaggcctcctgccccggttccagccccgctgttcaggagcccccgcccctctgaccagaaccgggttctactgtggcccccagcttggccaggaggcccaacagaaactccagcagcagcagctcgttcccgggcccacggacgtggacaggagccaggagcccaggtcccaggagaccccggagctccctgtcggcctggcccatccttctgctgtgctgcaagagcccccagccaggcttggggaccctgcctacccctgcccaccggcgcggctcgtacgtagatgatgtgccggctggagttctggtcgtcgttccagatgaagaggtcgatgaggacgcgcctgttgaactgtgagttcatcagcgccagctgccgctccagctcccactcgagtcctggggagacagtgccccgcactggagactggcgggccctggggccccagcccggccccttgtcggtgaatctggcctccggagccaggaactagggggccatagggtggggagctcacctgtgcgccttaggggctgggggatgtgggagacactttccctaacagcccaggagccacaggcgggcccccaggtgaccggagggggttgggagcagcatggggttgtcagggctgccagccacgtgaggtgccactcctgcccccgggggaatggagcacatgctcagagtggggagccctggggccagggcctggccggagcctggctggggcctgagtgtcgagcgctcctaggggccgaggaggggcacccctctgcagggctggatgggactggccacggggcaccaactccccagcatggaacctaaaccacctcccaggaccctgaggttgccccggctgggttgggcctcttggggctcctgagagcagccagctgggggtgggggtggggtcccctcctggaaggcctcagaccgaaggagccctggtcctggtcctcctttgtctgtctgtgaggctgctgccaggcccggccttacctacggtctcgttccacctgtccatcgccaccggccagcctcccaccacctccaagatgtccagcaggggctgagagcctcgcttctctatcacacctgagaagggacgcagtggtcactctcccagcctccctgtggctcacgtgccacgacacagaactgtgggggcgccgttggccggcgtcacaggtccccacagcccctgcagtgctccgcgagaggcggcctcccagcctctgggcctttacacctgcaccctcccgtcacaggtcagcatcttggcagctctgcagcgcaggaggcggaggctgagactggacacgggcgtgaaaggagacctgggggctgagaaaagcacatgagccccgggggacaaagaggatgatgggaggcagcccctggggcctgggagccggccagcaggcgaggagcctgggagaggagaggaggctctgggatcaggccaagcctcggcgaggactcaggcagcggtgggtgggctgggagggggcgcggggtaggcaggggagccctggggcctgtgtgtgtcctgtgtctcggctcagcacggtggggccccgacaagcagggcttttgcagtcgaagattaggtaaaggtggggacgcggagatagtcactgtgggaataagtgaagaccacccacagggcaaagtgaaggcttcagtgctggcacagcatggcaggtgccccgtcaggtcaaaggcctgcagggagcagcagggcttcctagtggaagaggggaggcccgagtgggctgagtgggggctgctggcctggggaggctgtggcgggctcactagaggccggcctcctctgggcttggctagggtcctatgctggaggaagggacagacattccaggggaggctgcctgtgatgaggcaggccccggctgttaggggccggatgccgtggggagtgccgtctgacctcctgggctgcccactggggataaagggctgggttcccggctgggctgccggtcctgagttgcgttccagttttccacatggtctggcccctgccgtttgtatattcagcctctcaggccaaaaattaagtaaaggcgaggacacaggaagtcatctccagctgggagtattgcccagaatgggggcccagccttctgtttccatggggaggagacaagcccagcgcacccaagcaggggtctcacggagacgccccctaaagccagggtcccagcgagttccacagtcaggcggaggctccacgagaccccctgggcaaaacaaccagccctgaaccctggtgctcagcggagaagctgtctctacagcagccacaaccacaggttgggcctgcagacccccaagtggaggagttaaacggtgctgggccgggggtgctccaagcacgtgaattcctttaataggaactgaaacatggataatctgccccccacaccacacacacacatccacatacatccacatgcacacacaagcacatatgacacacatacagcacacacataacatgtatacacacataacacatatacacacatacacatacacacatacacatacacacatatacacatgtacacaagtacacacagcacatatatatacagtacacacatatacacataacacacacatacatgcacacacaacatacacatatgcacacacaacacacccatagaatacacacatatacacatacatgcatgtgcacataatacacatatacactatacacaatacacatgtgacatgcacgtaacacacatgtgcacacaatgcacacacatatgtacacaccgcatgcatatacatatacacatatacataacaacacacatacatgcatacacaacacatgtacccacatgtacacatgcacaaaccacatgtaacatatatagatacatgcatgaacacatatatacacatacacgtatacacatatacatacacaatatacatacatatacacacaacacacacatatgcatataaatgtataatatgcatgcacatatatacacatactcatatccatataatacacacacacacacacacacacacacacacacacacacacacacacagtcttcctgcagcctggaacgtgtggcctgtgctggggttggggtgtgagtgaggccgcagggcagctggcattactgcgagcctggaccctgtggctgggagcgggacacagcacatagaccctctggcatgagtcctaaaggcacccactcctaccctaggggcagccatggggtcctggggctgcgctaggccctggcaggggcagcccgcccccgtcccctgcctcggccccttcctggcggcccccactcactctggttcatgcaggagcggtacagcgtcctggccttctccacagccggccggtccttggcagtcgaattctccagcaccgctgtgggcacaggaaaaggttggacagaggcctgacgaggctgcaggggccaggtcacaggtccctacaccccctgaagtgctcggcgagaggcggccccccagctgctgggtctttattccctctcctctgcgcccactggaccaaggaggaagcacaaacaggggcgagacacagccaggaccaactcctggcccggtgctgtcctgttcggcgtcaccccactgcacccccggccgtgctctgccacctttgaggatgacctccagctcgtcgcggaggacgtcaaagatgctgtatcttgagttggtctcagggatcacgtggcgccgcagccagcctccgcatgcaaactggtagaagtcgtcacacggttccgtggtcgggtccatgttctggaggatcctggcagctgctcgtccccatggcgtggagcagggagaggggagacagagagagttgtggacagcccagaagcctgtctcccggtccaagacacagcctggtcccttgggaaggggctgctgtccatccagtcgcagctgtgtgcccagggagagttaaccaccctctctgagctgcagagagggaatcccccaacctggattcagtgctagggttttcacttatttatttttagagacagggtctcactctgttgcccaggctggagtgcagtggcgtgatcacagctcactgcagccttgaactcctgggcttaagcaatcctcccacttcagcctcctgagtagctgggataacagatgtgtgtctcctctcccgaatgcctttttaaaaaatttattttagaacagggtctcgctgtgttgcccaggctggtctggaactcctgggctcaagtggtccacctcggcctccagagttgctgggaattcaggcatgagtcggctgggttttcacttattaaccacttgatcttgaaccccaaaccctccgagactcatttccttgtctgtgaatccgggaacaccagcggtctgacttgcaggctgaggcgatggctgagatggtgccagctcacaggaggtgctcagctggtgaccatgccctgtaagccgggcccagctcctggctgtccgccagggcctttctgttctgactctgccccctgccccctcactcatcagtgtgcttggtccccagagggagggacgactcttaccaccatgggggtttgtattctgctagaggggttggctttgccccaggaaccccgaatgtgcacaggacaggggagacccaggcttcccactgaacgctttcaactggggtagctgggctgcaccccccgaccaagaaccgtccctcaaattctgtccaacttggtcttggccactccacctctggggctggggacctcacggaaggcgtgtccacaggccccccagcccccagcacgggcagaaaagccacagtccagagcttctccactattggcgctttcacagcatgttaacagtttttgtcatctgcaaatagcggtacctgacccccaattttaagacaaatgcctgggagaaaatctgaaataagaaagtggctattcattgaacctttctttctataaatgtggacaaaagccgctggggttcttggcacgggatgctgttgctgcagggcctggctgctggaggctggggactgggggcccagcggacgccagatgccagaaacaccagctccgcccgctccacagcgagtccgagtccggcccacccggctccaccgcccgccgtgtcttggagttgcttccctgggccttgggcggggcctacgtcagtgtcagccgggagcccccagcccttgggcaggctgtggacggcaagggggcggggcttacctgctatcacgcagccaggggtggtgcagacctcgctcacctcttgggcctctgggatccctgcgggcaaggagcagcctgagcaccgggagccacggagagggtggggcaggactggagtgggtgtgggcggggcaaggtctggtgggtgtggcatggggatgggcatagactggggtgggcggggcaaggtcagggtgggtggagcatgggctgaagccagtagggcaaggccagggtaaccaaagcatagtctggtgggggtggggtgtggccctccaccccatcttccatccccatgggtggtccagcctggcagcccaagtcctccccaggtggcccaggcctgaggccttcagtgatagtgagcttcgttctttgtccttgaccgctgcagggacctgggagcccctttacaccctctgcctccatgtacccccacagctgccccaggccccaagggctgaagccggccattctgccctcctgccttctgcccagcccactctcacctgctgccagggccagctcctccaggcagcctgccttgctgcccctctctgcatgccctgccccggcctgccccacccctgtgccagctggtggaattgaatgtgctgaggccacgcaggagcaggtgcggagtgtccacagtgcccagtaagcctcctgcgtccagcaggtgcacccagctgaggtccctgccactgtcctctccccatggccctcctccggcacatgagggttgggcagaacccagcccctgcccctccacggagtccccccaccttgggaggccagcgcccacctgcctggggctgttttggaagggaaggcaaaggctacctcggggttttcgttttacaaaggtcctctcctcctgtaagaagcacagccggctagcaaggcgtggcagctgcttccctggggagaaacacagcgctcagctgcggcctcctgcctgcagctccctgggggtgctgggggcctccctgggtcagcacgccatcttcccacagtgctgggtgctgcagccctacccctgtagtgagggctggtccccagggcagcgagacaggagatccacagagttcactgcaggggccagcttcaatctgtgtcctgctgggcttgaatggggggcggtttgccctgccttgccagccccaccctttaattctccctccacccaccccaaggtccccgatgtgccagggcctagaggggtcctgaggtgagaccttcctcttcccgacagcctcctctacctcaggatcttcctgaccctgacaaggcccacacaaggtggcacgctcctggagtcccacagggcaggctcatttagagggacagggccttttcagagagggtggcttcccactaatgacccttgtccctagcccctccaccctcactgctgctgaaggtgccaagccaccctccctccatctctctactgcctgctgggaggggcctgcctggtcagcatcgggggctcctgggatggctgtcaactgcctggagagatgtatgggagaggagggtgggatggagagaagaggggaccccaggtccagagaggtgacaagccaggcctggctaccttcagacctggcttgtggccgaatttccccagcagtgaggtacacagaggactgaatggaaggagggaacagggctcgttcaggtcagggctgttggcaggcctggaacctggcctagccctgggcagagactgcagagagggtgctagaagccacaaaaatatcagctccttgggggcctggccattcaaaaagccattagtgaaacactggatgatgactgtgagccaggccagatgctgcagttcagatgtgagcctgacagggcccagccctcaaggagccccccgcccggtggaaacagggagaaagtgccgcatgctgcatacaccgaggtaaagtgctgaagggcaaggctgagcttcagagcaaaggaatcccccaggccagcaacggaaaggaggtggtgagtgcgagcggaaggcatggctgccctgtggtgtttgccaattgcagtaacccagagcctatggaccagagactggactgtggactccagagggcctcacctcagcaaaagagtggattcgagggacatcacctctgaccaaagtggtgacaaggagggcaagggctttctgcttctgattaggatgcagaaagttgaaattgactgtggcccccaccctagccaggagagcaagctggagaacctacagcatgggcacttttagaaacccacgagagctgaggacatagagaaaccagcatgagtcaaattccagggaggaatgaagccttcccaggagaggagaggcctgtggctgcattgcctttggagtcaaagcatgaggaggggcacatgcgcctggcaaggacgttcaagcatggcggcatacgtctgtagttccagctacttgggaggctgaggtgggaggactgcttgagcccgggaggttgaggctgcagtgagctgagattgcaccactgcactccagcctgggagacagagtgagaccctgtctcaaaataaaaacaaaaacaaaaaacaaaaaacaaaaaactatgagctacatactgtctgattccaattatgtgacattctggaaaaacaaaactttagagaggagagatgttaaatagtagttgccaggagtttgggaaaatggatgttgaagaggttgaataggtgaagaacaagggagttttgggggcaaaaaatgacaaatagtgaatgcatttggcagggcaactattctgtacgatactgtggtggtgaatggtgaacccatttgtcaaaacccacagaatgttatagcacaaagagtaaaccttattgtatgcaaagttaaaaaattatttagactgtcaggggaatcccaggatgaaacgcagaatgagactcaagacaaatgtataaaacaatctcactgaaatggataggggaataaagtgttgacctaagtaactttagaaatgagtagagtctatgagactaaagcaaaggaagctgtacataagcgctgtactctagttgataaagttgtcctacatgggatcccagctgaactctgaaaccactgcacatgtacattggaatggaaaaagtaagtggatagcaggtggctgggcttattgctgctgcagtgagaagttacagacaaggaaaggaggaagtcagaatggtccatgtggtggtggagtagagttggagacaacagtgtgaactcatttttagcttaatatagatgcagatggttgcatatataaatatttatagatatgagtatctagatgggttcatgtatacatacatattcctttgctctgccaggtgagctagactagaagcaacaccaaccaaggagtagcaataagcaaagaataggacccagctcttggtttctgtttgtttttcagacaccacattatcctagaagctgttggtttttgataccattatccgataaaagaagccagggctccttagaaaaatggttgattatacaactggggtaggaaacatacgagatgagcttggagcatgttgaaatgtcaaaaagtaagaaagtgctcccccccaaaaaactcaccccaaattcacgataatggggatacatcagagggtcatagaagcaactgacaactcccaatggccagagttagaacaatttgagcaatgcaatatagcagtggattataatgcaaagtgtaaaataaatatctacaaatcattgagtaaataaataaatgagggagaatagatgaatctctcatacagaagaatgccaaatactttaggtagatactctgcctctaaggatgtggagcataactccccactcctcaggtgtgagctgcacacagtggcttcctttcaaagactgcactatgaaaaagaagggaaaaaagtaacttgcagcgcagaaaccagacactacctccagccaggcaattaaggttaacatcaacagtgataagtccagtcattgaaagtgtgcacctgtgacctgcggccttcctcttcaacacatgttaccccagtctaatcatgagaaaaccattaggctaattccaactgagggtcattccacctgatcagtaatcctcaagactgtcaagatcacaaaaaacaaaaacacaaacaagaaaacaatgaaagtctgagaaactgtcacagccaagaggagcctgagaagatgtggcattctggatatgaccctgggacggtaagaggacatgagggaaaacggggaaatgtgaattgagtgtgaactttagttaatagtaatattatcactattggttcactacttgtggcaaatgtatcaggctaatgcaagatgttcataataggggagactgggggtggggtatatagggatttctgtactattttgcaatgcttctgtaaatctaaaattgttctaaatttttgaaatattacggaaggaaacctgaacagaagatctcagacctgtaggacaatgttaaatggcttaacatatatgtaactagagactcagagagcaatatttgaagagatactgaccaataaatatttaaagttggtaaaagatataaatctaccccaagaagggcagtgtatcccaagctgggcaaatacaaagaaaaccatccagcagcatcatagtcaaactgtggaggactaaagataaagagaaattcaggattaagaatttcaagacatacttaaaagcagtcagtggggctgggcatggtggctcatgcctgaatcccagcactttgcgaggctgaggtaggtggattgcttgagtccaggagttgagaccagcccgggcaacatggagaaaccttacctctataaaaaaattataaaacaaaaattagctgggcatgatggtggacacctgtggttccagctatttgggaggctgaggtgggaagatcgcttgagtctgggaggggggatgttccagtaagctgtgattatgccactgccctccagcctgggcaacagagtgagaccctagctcaaaaaaaaaaaaaaaaaagcagacaaaaaaagacacattatattgaggggaacaacagtaagaatgacggtgacctctcaccagaaagaatgaaggccagaagatgatggaatgagctctttaagtccttgaaaaaaacaataatacattatcagcttataattctatacccagcaaaaacatatttcaaaagtgaaagtgaaataaagacattttagaccaaagctgagaacatgtgtctctaccagatgtgccccacaacaaatgctaaaaggtcttcactcagaagggacacgaaaccagtgggaagaccagattggtgggcaggaatgatgagcctgagaaagggtaaagagggagcaaagtgtgacgggagacctggacccaaacagtgcctctgattcatttgtttcccatctagtcagatgtatccagaacaaattaggacaactgaagaggcgagttcatgcctccttcatgcctgcatcctgcctctacagctcccacggcattcccaacataggatttcccgtagccttgttgatgggggaaacccccaaggaaattcaccagatgctgcagatcaagggctgcctgaggatgtagtgagctcctgagcagcactttcaaaactgaattagatgagctaggcatgttttttccgtgtcgtcccttaacttacagtgcctcacttaatcatcacaaggaagctggatcacttgaggccaggatcacttcaagaccagcctggccaacatggcaaaaccccgtctctactaaaaattcaaaaattagtcaggcgtggccaggcgcggtggctcacgcctgtaatcccagcactttgggaggccgaggcgggcggatcacgaggtcaggagatcgagaccatcccggctaacacggtgaaaccccgtctctactaaaaatacaaaaaattagccgggcgtggtggcgggcgcctgtagtcccagctactcgggaggctgaggcaggagaatggcgtgaacccgggaggcagagcttgcagtgagccgagatcgcgccactgcactccagcctgggcgacagagagagactccgtctcaaaaaaaaaaaaaaaaaaaaaaaattagtcaggcgtggtggtgcatgcctgtaatcccatctactcaagaggctgaggtgggagaattacttgaacaccgtgggtggaggttgcagtgagctgagattgcgccactgcactccagcctgggcgacagagcgagattctatctcaaaaaaaagaagcttgtgaggttcctcatctctacttttcttgggaaaactgttggggaggcaagatcacacacccaaggtcactttccttgggggagtggcagggcatgaacctccagaccccatactggcattcgacagctctgttcttctaagagaaaaagcaaaaacagtgagacccttttgacacaatggctgaaaagaaacaaaatcttaccctaatgctaaaatatgatcacaggaaacacagtcaatgatctctccaaaaggagatttttctttttcataattccaaaaagggcagctttcctgaatactcagttgacacaggatcttctctttgttcttttatatttgcttgaataacttctgtaatatgccaatcattttgacataggctttctacattttaaaaactatttttgacatttcctctgaaggttttgttttcctaaagttttccaaatgccttgatttgaataagacctctgccacggtttggatgtggtttatttttccctaccaagtctcatgttgaaatgtgatacccaatgttgggggtggggcctggtgggaggtgtttggattgtggacctgattcttcatgaatggcttggtgcccctgagtggcttgaaaagagcctggcacctcttctctctctctctctctctttctcttgccatatgacctgcatgcacaggctcccctttaccttccaccatgaatggaacagtctgaagtagatggggagccatgcttcctgtgcagcctgcagaaccatgagccaaatccacctcttttctctataaattactcagtctcaggtattcctttagagcaacacaaatggactaaaacaatcttgatgtaaataatttacatttttttcttttccctctcttctccatccctctttcagaagaaacaaaggcacaaagaacttcacagagtggagaaagaaacaccctccctggaggatgtgtaatcacagacggcttgtcatgccattgccgagtttacagaaatgtgtggccaaggaaacctctcgcggagaagccaatttaaagaaactccaggctggtagtgtcctaaggtgcctgatgaaaacaaatacatattctccagagggaacatttctcagcccaataacacaggatccccatagataaaagccaatttgaatatgtatttacatttttaaaaaagaaaatcttacattagtgagagaaaacaaacagcaaaaccagaaccccaaagattgccaattaggaatgatctgatccagaacgtatggaagctggcaccactggccctggatctgagtcttctctgcatccgtgccttggccatgtgactccgtagttgctcccacaaaagggacaaattattttttttcttctatctcttgactgtgcgtggcccaagtgacttgctttggccaacagaatgaggtgggaatgacagggttccagttctgagcctgggccctaagagggctttcatgttttcacctgtccttttggatttctttcactgccaggagagggatctgcgcaggaatgcttgctgggctctggtaggaggatgaaagttacatggacagagcaccccagctgagcccaacctaggtcagatgaccccaggcaaacagtggaggtgcctcacaataaatcattgttttatgccagtgagtgttgggctgggttttaagaccccaactgctaaaataaaataacgtaagtacgtttgaaatgcttcaaaaagaatcaaaactaggccaggtgtggtggctcatgcctgtaatcctagcactttgggaggccaaggtgggcagatcacttgaggtcaggagtttgagaccagcctggccaacatggtgaaaccccgtctctactaaaattacaaaaattagccaggcatggtggcggacacctgtaatcccagcttctcaggaggctgaggcatgagaatcacttgaatccaggaggcagaggttgcatggatccaagatcgtgccactgcattccagcctgggcgacagagtgagactctatcaaaaaaaaaaaaaaaaaaaatcaaaagcaagaacaaggaacaataaaaaatcaatttgaaaaaggatccattgtaaattctagaaataaaaccacgtagttgttgagatttataaaacaaaaacaactacaaacccaaaaggctgagttaagcaacagacataacagaacagaagatttagtgaaatgaagtgtagttctaaagaactgacccagaatgcaggagaaagtcaacaagatggaaaatatgaaagaaaagctgaaagacatggaggacagtgggaaaaatggagcagatatgcagtggaaaatggaaaaggagagaaaagggatattgtgggagatacaccatccaggaagataacgggtacaattttccaacattaatatatgttatcagtgctcagcttcaggaatcacaacaaatccacagcagaataaatacaaataatttcacagctaaacaactcatgataacaattcagaatacccaagacaaagagaacatagctcaaggagaaaagattgttcacccaacagaggagcggcagttaggctgactgtacttttctctgaagccacgtctgaacagcagcaaggggagtcagaaggcatgagagctaaatcttcaagatattgagagaaaataacagctcagactcatttaaccaattaaatgatcactgaaggacgagcgctaaataaagtaattttcacatagacaagagataagagtttaatgctgatagattattttcaagcagggctccccaaacttgtctgatcacaagcaaggtctcaaatgcgtgtgggattcagaggtcttaccctacaagattcccgggtttcactgtttggggcttgttatggactgactttgtggtttgaagccctaacccctaatgtgactatttggggatagggcctgtgaggaggtttaaaatcagctcaatgggcagggctggtggggggcataatctggtaagtctggtgccctcataagagggggaagaaatgacagagctcactgtctctttccaccacatgaggacacagcaagaaggtggccatttggtagaccagcttattgaagtgggaaaacatttttaaacaataaaataatgaaaaaaaaaaagcatgggccttgtgggaagaaagcatgaaccaaaaataaactaaattttccaggtgactgatggaccctcccttcaggcaagggcattccaaagttaacctgaaaaacgagttcaggccatgatgggaagtgggggttggacatgccccattataccctcttcccattggaattcaggcacagctgaccagcattcaccttaaaacagagacatgccaggcgtgatggctcacacctataatcccagcactttgggaggctgaggcaggaggactgcttgagcccaggagtttgagaccagcctgggcaacacagagagacccatctttacaaaaaatagaaaaacctagccaggtgtggtggcatgtgcctgaggtcccagctacttgggaggctgaggtgggaggatcacttgagcccaggaggttgaggctgcagtgagctgtgattgcaccactgccctccagcctgagtgacagagtgagaccctgtctcaaaaacaaacaaacaaaaccagagaccttaagactgagagaacagactaagtctaataagaactacaatctattttctccaaagcctgctacctggaggcttcacctatataataaggaccttggtctccacaaccccttattttaacccagacattcccttctattggttccaagtctttagataaactcttccagccaactgctatcagaaaacctttgaatctacctgtgatgtggaagcccctacttggagttgtcccacctttctggactgaaccaatgcacatttttttttttttgttttggagatgcagtttcatccatcatcatgcaatggcacgatctcggctcactgcagcctccgcctctcaggttcaagtgattctcctgcctcagcctcccgagtagctgggattacaggcatccgccatcacgcctggctaattttgtattttaagtagagatggggtttctcacattggtcaggctgatctcgagctcccgacttcaggtgatccacctaccttggcctcccgaagtgctgggattacaggtgtgagccactgtgcccagccatatcttacatgtattgattgatgtcttatgtttcccgaaaatgtgtaaatccagactgcagcctaaccacctagggcacacgtcctcaggacctcctggggctgtgtcacgggccattggtcactcgtatttggctccgaataaatctctgcaaatgttttacagagtttgactcttgtcattgacaagagggtctgattcagttggcatctagatcttggacttcacagcctccagaactaggaggagaaaatatgtttctgtttttaagccacctgagcattttgtgactgtagcccaggcaaactgagggagggcccaatgtctggatttgtaacaatttccccaggtgattccaattatcaagcaaatttggtcaacactgttttaaaccagtgcttccctaacatgaatgtgcagatgaatcacctgggggtcttgctgaaataccaacaccggtcctgcggccttggttggaccttgagtttctgaatttctaacaggctcccaggcaatggctgacaccactggtctgtgggccacactttgagtaggagactctgaagtatgtatttcagaaaaaagaaaaattatttaataagaactgcccaagatgtaagaagaaagatgcataatggaattcatgaggataggggaagatctgagttaacattgaccatattaaatagtaatgttgctgatctgtggtaggtaaaaagtaagatagaaaccaaattcttggccgggcgcggtggctcacatctgcaatctcagcactttgggaagccaaggctggtggatcacctgaggtcaggagtttgagagcagcctggccaacatgtcaaaatcccatctctactaaaaatacaaaaattatttgggcgtggtggtgggcaccagtaatcccagctacttgggaggctgaggcaggagaatcgcttgaatctgggggcgaaggttgcagtgagccaaaatagtgtcacttcgctccagcctgggtgaaagagtgaaactctgtctcaaaaaaaaaaaaaaaaaaaagtccaggagcggtggcttacccctgtaatcccagcactttgggaggccaaggtcaagagatcaacaccatcctggccaacatggtgaaaccccatctctaccaaaaatacaaaaaattagctgggtgtgatggcacgcacctgtagtcccagctactcaggaggctgaggcaggagactcgcttgaacccaggaggcagaggttgcagtgagccgagatcacgccactgcactccagcctggcaacagagtgactccgtctaaaaaaaaaaaaaaaccaagttcttaacggcaataacatgtgaacagggtgggtagtggtgcgaagagttaaactgttctaaatgcttgtattgtttggaagaaataatagagatattgattactttaatatttaagttaaataagcataaaaatttaaggtagagaagttctgctttttgccgaggacatcaaaagctgcaattgaatatcatttccttccgtacaagaaaaagccaaagaaactacaaaaagcacaactttttggagcccatccaagacctgaggtcaaagacaatcaggtaaacaatttccgagtgataaggccctccaaggaaaggccggatatgtaaattatttcactttggtcaagacctgagagtaagagatgttccaagtgggtcagaagaaatcagctaaaatttttcacacattcttacaggcccagtgtgggctgctacatgagtttggagtagccgggagcccccatcacgaagaggttttcaatcactccatgttctgtccacggcctttcccagatgccgatgagaaaggctggggcaggtctcagaaggctggagagagcctcccttggtggcccagggatggaggcagggacctgctttggctgagacatgaaactatactcgtctggcaggcagcaaaagctttaaaccactgaggcaggtgtaacccctctcacgcccaggaaccaggcaaatcccctgttctgtaggagggtcaggagtaaaaatccccggcccatggaagggcaggagatccttgtgggcccagaatcctagactgacatcaagcagtctcctgcctctagaggaggggtgggcaactcaggcacagggcgaagcttggttgacatggggatgtggtagggatgccaagaggtgcatccccagccccaggtatactaggcctgcctaagcctgagactgggccacgacaccagagagcccccacctccagcccgagcctagtactgaccagcaacagcaactcaccactcacagaaggaccagggcttggggaggatgccctctgtgtcataggcatccagactgctgaaggccaaggctggagcaggcaagaggagagaaccgtctggtccccgggctgacttctctaagtgcagggaacaggagctcattgctggagaaacgtgagtctgaggtgcactgtgggtaacaacagcagtagaacccccagccagctaactcctaaccagaggaattcaatccctcacactcacgcactgatggaagaggaggtgtacctgattctgtatattaggaaaccgtcctgcatataccatttcaaaaagactcatataccaaatggtgcaatgtattattatgtaaaaatttaaacactattcatgaggctcctgattttatgttttgacaaatattggagtctgcaaagaagtatctcagaccctcccacagcagtgtattgtgatgatgttgccaataatacagaatattactaatgacagcaatagctcttacgttcttaacagtgtgttccaggcccagtgcaaatgctattgatctcagtctctacttgtatcgtccattatcacactgctagaaagaactacctgaaactgggtaatttatgaagagaagaggtttcattgactcccagttcctcaggctgtacaggaagcgtggctaggacgcctgaggaagcttacaatcatggcagaaggcaaaggggacgcaagcacgtctcaccatggtggagcaggggagagagagagcgcgaagggggaggagctgcacactttcaaacaaccagatctcgtgagaactcactcactatcacgagaactgcaagagggaaatccactcccatgatccaatcacatcccaccaggcctctcccctgacacatgaggattacaatttgacatgagattgggtggggacgcagagccaaactatatcattctgcccccagcccctcccaaatctcatgtccttctcacattttgaaaccaatcatgccttcccaacagtcccccaaagtctgaactcattccggcattaactcaaaattccgagtccaaagtttcatctgagacaaggtgtctcgggcctagtgggcctgtttggattctggaggcagcacactcctcatctgggcgagttacttcagcccatttatcaagtgatccaaaaggctgccagtgtcgagcggggtccagaacaggagcaggctctgcaacaggtccaggctgctgggcaagctgctctgccacttgggctgtatgacccagcagatccaacggtgcctggagtgtcagtggcagatagatagggatgctgtttggagcctttggcaggcccctgtgggtgaatcacagcggagccctctaggattttggagcggggccctgctatcttctgcagttaactgctctccttttgagacagctcttggcccgttactgggctttggtggaaagtgaacgtttgactacggatcaccaagtcaccatgcgacctgaacttcctatcatgaactgggtgctttctgacccatctagccataaagtgggtcatgcacagcggcattccatcatcaaatggaagtggtatatacaagatcgggctcaagcaagtcctgaaggcacaagtaagttacatgaggaagtggctcaaatgcccatggtcttcactcctcccaccctgccttctctcctccagcctgcaccgatagcctcatggggagttccctatgaccagtggacagaggaagagaagactagggcctgattcacagatggttctgcatgatatgaaggcaccacccacaagtggacagctgcagcactatagcccctttccaggacatccatgaaggacagcggtgaagggaaatcttcccagtgggcagaacttcaagcagcgtaccttgttgtgcactttgcttggaaggagaagaggccagatgtgcgatgcgattatgtaccgattcatgggctgtagccaatggtttggctggatggtcagggacttggaagaagtatgattggaaaattggtgacaaagaaatttggggaagaggtatgtggattgagctttctgagtggtcaaaaactgtgagcctgggtgctagccacaatctgataatgcctcctcatgatctaaactgtacgataaagagagaagggttcacagaccaggtttatacacgaggggcactccagtcttggggttggacttctgtaaaaagccagatgtaaatatttgaggctttgtgggccacatacatgcttcatctcacctgttcaactttgctgtcctagcaggaaagtagccatagatgatacataaatgaatgggtctggctgtgttccaataaaactttatatacaaaaagaagcaaggggccagatttggcctatgggccatagtttgccaacccctgtactagaaaatgaatacagttgttttggaggagtagaattctaggatggacatgagactgtatttctcactgtcatttttgtaaaaacatttgattttataaaagaaagtttataactttaaaaataattaaaacaaaaaaatctaagataactgtcgaaaagatagaaatacaaaacttccaagttagttgagggaaaatagaggaaataatgataggttgatccaaaacaaggcaagaaaagagaaaaaaacgaatgagacacacaaaacaacacaataggaaacacatacattttagttgtcctggtaattataaaccaacaaaatcctccaattaaaagatagacaaacccccaatccagccatacacgattgaaagagacacatctaaagctaaggagatgaaaagtttcaaagaaaaagaatggaaaaaatagacacagcaaatgctgagtagctagtactcatgtcaggctcaacaggatttaaggcaaaaagccttgttaagtcagaaacggtgactacacagtttcacgaagtgaaagatatattaacttcatatgtgtatcttactacaatattaaatttatgaaactaattttataattcatacctaaatttgcgttcacatagtaatatcgccttaaataggtaaattaggtaagatttgatgtaactacaagaacgggtgattctttagtgcaagattttagcatacacacttcagtacatgattttaagaaatcattttcttgatctttccaaatctttcattcttttgagatcaagagaatggaaaaagagccaatatgtagaagacttgattgatctagtggatgtagatagacaccatcactcagcatttggtgattgagcctattccgcagcacacagggcttatttataaaatcgatcaagtgttagccccaaagcaagcccagcaaatatcaaagaaagaaccacataaataatggcataaaccatggtttctgacaacacagttaagttagaaatcaataattttaaaaaagtaactaaaaactcatgtctggaaattaaaaaaatttctaaatgacttataagtcaatgaaaaagtcataatggaaatgagaaaatacacagaaataaatgataataactgcttagaaaaccttccacaaacaatcctggactgaggccaaggtcagctgtggggtcattcctggtggggggtcttgacggggaacagagggctctgccgccctggagggagggggtccagggcccgtttccacactggagtgggtggaggcaggctttgctgagatccatggcaccgtggggcactcccgaggcacctggctgggcagggagggtctctctgggatgggtgggctcaggccctttggcacgacccagaagaagagaggcctcctcctaccccacagctgggggtgtgtgtggggtcagccttgttttatgaaagcctggaaagcaggtgttttgagcccagcaggctctgaacagagcttcccttgggctctgggttcctcagtgtgagtgagcctttccctcccccactgcccaccgcccatggaggtcgcaggacccctctgtcccaggggagaccctagagggccaggggctgcggtctgggcagcagccacactgtacagtggccagccatgcagccccgggccgggacgccctgcacatccacaggcagcacccacttctgcttcacagacacagcctcccgcaggggtggagggatggtcccaggcagtgcgcagggctccagacatgagggggcattctagtaacacaggctgaggcgccccattgttggacctggggtgcgaggtccgccatgagctctgagtccggtgcctgccacggtgggagcgccctacgcacctgccccgggggtgagcattgctccccgatgtgtgcgcgctgcccggtctcagagggaccagggctgtgcctgcggaggggctggcaggggcggctggaaggtgaccaggtctacgggtgcctgggagcccctgaaccaagaggggagatcaagggaggggccggcgtgggggcggggggagtgttcccgggacagccgggggcggggggagtgttcccgggacagcccgaggttccagcgagcagccctggccacgcctttgtctccgtgggaccccagactggccccttcccgccgtggtcccgtgacctgacccggccttgagcggggcgggggcggcaggaccctcaggtctctccgcaggatggcagcgggggagtgaggcagccaggtgagcccgggcggcgggagggacacggacgccggtggtccccagccggggctgcgcggccaggcagggagggggtgggcggaggggcgggcgacgggtctgcgccccccaccctccgggagtccggcggaggcggaggcggaggcggaggcgggcgggtgcggagctgcagaagcagcgcgcgggagtcggggccggggcagagctttctggaagggaccgcgggctccctgcaggtcagtgcccctcccgccgcctctgagtccgcagctcggccccgggagcccctgggtgcccagtgcagacccacctgccccatctgacgggcgggctcgggctgggggcaggcggaccctgcagcaggtgcagcggggcgagcgcggagagcgggcacggggacaggcgggggcggggcacccgcactcacctctgcggtcggcgtagaggacacccaaggccaccagggcagcggtcaccagcagcagcagcagcagcagccccccctccaggaaccccgggcgcttctgccctgcacggccggcgctctccaccatccccactgggccttcggacttccccatcagcagggctctggacgggagagcaccgcggaggaacctgcaggcccagggcaggggagaggggagaggggcgtggagctccccgagcccggcccgaggctggaagggccggatgctggctgggagcgggcgctgggtgcctttggaacactcttcccgtctccctctccaagctcacaaccctgggtgactgggtcccgggactttccacactacccctgggccggaatctctgagtgcatggaggttctaggactgggatgctcccagcttggggtcgcaagctggacccaggaggctcagctcctgtgctgtcaagggactcctgtagtggagccccccccctgggctgctcatgctggttgtcttggagctgtgggcctgagcgctaggtcagggacgctgtcggggaggccacttgggcttctgggctcccagcccacctttcctgttgaagcccagaagccagtgatgggcgacaccagaacagtaggtacccacacaggcggtgactacgtgggccaggaagggatctgcagggccaggcaggcttgagtctcaaccctggcagccacctggctggtgtgcagctctggtcgtcccctgaccctgttactatggaggggacaccttctggagccagcagggcagtgggcagcacttgaagacacacacggctgggcacaggctgctgctgtaggcaggacagggagctgggcaggaagggttggggcacaggacactggactcaggaggctcccaagtctgcgtgctccagtgtgcgtgtatgtgtgggagtgtgaacctgagtgtacacatgtgtgcaaatgagtgtgtgcatgtagttgggcgtgtgcatgtgtatgactgtgcgtgtgtgcatatgttctgatgtatgatcgtgtacacacacgtgtgcacatgttctggtgtgtgcatgtgcatgactgcatgagcgtgaacgtgtgtgtgcgctctggtgtgtgcatgtgtgtgtgtgcacgtgtgtgcgtgtgctctcgtgtgtgcgtgtgcatgattgcgtggatatgcactgtctacgctcatgtgtgcatgtgtgtgactgtgagtgagtgtgcacgtgtgtgtcctcgtgtgtgcatgtgtgtgactgcacgtgtgtgcctgtgctcgcgtgtgtgcgtgtgcatgattatgtgtgcggatatgcacgtgtgtgcgtgtacactcgtgtgtgcacgtgtgtgactgtgtgattgtgcacgtgtgcgtgtgctctcatgtgtgcatgtgcattatgtggatatgcacgtgtgtgcctgagtgtgcacgtgtgtcctctcgtgtgtgcgtgtgcatgattatgtgcgtggatatgcacctgtgtgcgtgtactctcgtgtgtgcatgtgtgtgactgtgcattgtgtgcgtgtgctcttgtgtgtgcatgtgcatgattgtgtgcgtggatatgcacgtgtgtgcgtgtacgctcgtgtgtgcacgtgtgtgactgtgattgtgcacctgtgcgtgtgcgctcatgtgcatgtgcatgattgtgtgtgtgggtgtgcacgtgtgtgcgtgtgctctggtgtgtggctgtgcatgtctgtgtgtgtgtgcacatatgtgagcacatgcatggatgtgcacatccctcgctggcactcggagccctgctgggaagttgcccggtcctagggaagcggctgggtgctttggccttccagcactttcagtcgtcacacgcaatcacacacctgctgtgctgagccccagcttagccctgtaccaggcagggcggataatgtgggagcagcgaaaggaagccaggcccagtcctgcctgtgggtgggtcagggactggctgctgagactgccagcacctgggctaaatgtgcttccgcccccctgtaccccaccgcccccctgctgtggactttgcctgagttctgtccctgactccctgggagatcctagatgtcccttagcctgtctgggcaacaccctgcaaaggtggctgggccagctcatttcagcgactcctccagagatccctgacctctggctgtgtgaggagcggggacggggacctggacctcactcctctcctccaggtccctcgctcctcccttcctgtcccctcagccacctctctcagtccctggctctgtgaaccgcagcgttcatgcatccacacaccctcagatgcttcctttgacgccctctgctgtgcccctagacacccctatcccgccactggctgaagctggactttggagccatctgcctcccttgcctgcgtccacaccccgcgccagtcctcagcctccaagcccatctcagtcggaccctttctcattcctgccactcgctgcctgttccaggccccaccaatcacctccccctgaggggtctgtctcacccactgatccccaccacaggggcccaggggcctgtaactagaatcagaggccgtcactccctggcccctggtagccaaacccttggaggaagagccgggccttgccctgatgtcaggaccctctttggccctcctcccctctcactatgccctccccttaccctcaggcaggcccaccaggtttctccccccaccctccccacccacccaggcaggcctcccagattcctgccaagctccccttcccagtggggccttccttggctcggcctcgggttcaactcggggagccccagcccctcccctgctctgtgtctctccagggactcccagctccacctccacatctcctcgatacttctgcagccccctgggaacgtcagctccacgggcaggggcaccctctgtgggggccgcttcacctagactggcacccccaccccagagacctcggtcattatctgttgggtgaatgaatgaatgaatgatgaatgaatggatcaatcatttggacaagtctgagctcagcttccacgaacttctttctttggtcagaattaatgaatctgctcctgcgtcctgaattcattctgtcctgcaggtatccacagacggctccatgtgccccacggcacacacaaaataaacaccttcaaattgagccaagtacccggggcaggtgtggagtgtctgctgaggcgaaggcactgcggctccctggggacactcgtggcctctccaggttactacagatgggggacagcgggtcctttgggtaagataaaccgtatgccagagggggctgcctgccctggcacaggcgagactgcacacaggacgccctgcccagcctcctgagaaaggggctgagcgcctggagagggtttcaaggcccaggagagggcctggagagggtttcaaggcccaggaaagcaggccgggtaccttccttcagcacaactcacctttgctcactcaggagtggctgccgcccacagtcaggcccctggagactgggtcccagtgggttggagttggggtgagctgggccaagtgggtggatttccagggactgggatgggagagcagtggcttggggctgagttgaggctgcctgaaggcttctgggcctcctttgtgatgcaggcatgggctccctggaggcggtgactcctgctcacagtcaggaggttccactgggggtgtggcatggggggaggggctgagggcagcttcttggcacccgggctgccctgcctcatgggtgcccttctcagggcctctggccccgcctcccaagccgccctccttccttgcttctgtctcctgacctttcagtccaaaggggccccaggggctgctgggaggaaggtcaggcccttgtcctactccacaccctctgctctgcccctaaccacccggtggggggttacaaaggccccaccctgggtgttctttctcttcaatctccaaggaggatggtgggttctggggatcttgccaaggtgcaaggggaaggggtggtcctgaagggggtgggcgctggctgccaggagggtcccacccagagatactagcctgggtttggctgcttccctctgcccacagaaaactcatgaggttcagacctcaagctacagagggtgggcagccctggccggggagctggcagaagggctctgtggcttctgaagggttcgcagtgatcagagtgtgagccctgcacccagccctgcttgcggacgggggttctgggcagagcagtctctgtctgattctccaggcctgatgaggtttctagcttctgtttcagaatccccagaacgagtcctcctgcccaggccttgggcatgtgtcagggcatctgggcagggctgggccacagagctaggggtcccacggcaaactgctcctcacggccgccccggccaggtctcccacgctgagtgctgttggaagctttgtctatggccctttaggttggccaggccctgggaggagaaaggcttcgagctgcagccaggctgggatcagatcccagacaccaccctgagcccgggaagtctctccctggggcccgctggctgtcctagcagccccctgccatcacgcccagcaaccagcccaggagctgcagtctggcctcaggctgcctgggttgctggcccaaatggaaacaatgtcaaggccagccaagcaggaagctgggaccgccctttctggggagctgggagtgggccagggtccagcctggctggaggctcctgctatggggagaggccagagcctttccgagcccacctgcccgacagccctggtgccagcaggccctttctggatgtcacagtgttcttgtctctaaggtacaaatccacagagggagaaacagatgcaggggcctggcctactctcagcaggggctccctggactctgaaccgactccccaaggctggccctgtgcatgctcctccttcccgaaccccaggcctgtccagcccagcagcccccagcctggcccaaggccacctggtgacctgggctgccaaacttgggaccccttattcccaggttctccctacttctaggtgacagcaggaggcttgggtcctagcctggcacctgccagacaagagaaactgggaaaggaggctaaaggccaaggaggctgcagaccccgagacctaccccggtcactggacactcacagatttgcaggtgcccagggcagtgcaacccagccgccccaaacacctgcacagatgactctctccccagacacccgcacagaccgtccccccagacacccacacagaccatccccccagacacccacacagaccatccccccagacacccacacagaccatccccccagacacccgcacagaccatccccccagacaacctacacagaataaactgtccccccagatacctacacagaccatccccccaacacccacacagaccatgcccccaaacacccacacagactgtccccccaaacacccacacagaccatcccaacacccacatagaccatgcccccaaacactcacacagactggccccccaaacacccacacagaccatccccccaacacccacatagaccatgcccccaaacacccacacagactgtccccccagacacccgcacagaccatcccaacacccacatagaccatgcccccaaacacccacacagactgtccccccagacaacctacacagaataaactgtccccccagacacccacacagaccatccccccagacacccgcacagaccatcccccgcaaatacctgcatggattgtccccccagacacccgcatagccagagcccagcaccccggaggtggacattaatcccatctcctagggagattgggggaaaatgggtgttccctgcccctcctactctctgggttgctgtgggatgtggagatccaaggagcagccccagctcaggggtccaaggaggcaggtgggacgggggtcagggaagtgcttcctgcagcagccctggggccagggtgggccttgagggcactagcctttgtccacactgctgtggggctgccctcacccaggttgccgtgtccaccctgccttgggggctgccctcaggccctggagacgcctgcctgtgactgccccacactctcaggccaggctactggtggcaggtcctgtgctttggtgcaccccagacgtgcccaacgggcatttcctctgcccattgggagcagggcctctccctcaggtctgcccagctacgctctgggcaggaatgaggtgccccacttagagaagatgcacaggtcagaagaggctcaccagcatttctgggtgagcctctttccggctgctgggacgacagccgggcctctggggtccccaccttccttgtcagctgcctcctgaagtcaggccctgggtatccagggcaggagggaaggggcccagtggtcccgctgccccaaaatctgtgtcattgagccaccagcccatccccagtagctggagcctctgcctcctcacttgtgaattccaaaaatctgagacaggtctcagccaatttgggaagtttattttgccaaaattaaggatgcacacctgtgacacagcctcaggaggtcctgacatgtgcccaaggtggtcagaggacagcttggttttatacattttagggagatatgagacatcaatcaacacatgtaagatagagttacattcttttgagtttctgatgagcctttccaaagaaggcaatcagatatgcatctatctcagcgagcgggggaatgactttgaatggaattggaggcaggcttgccctaagcagttcccagcttgacttttccctttggcttagtgattttggggccccaagatttattttccttttactctcctaaaaaggttttttttttttcttttttttccagattgatcgcagagttgaacaacagagaatgtgtgcacagtgccaggcacaggtgtggtcaagattcacctgggagaggaagtgggcaggggcagaggagtgtgcccacctgagctgaaaggctgcatggcaggtgaccattatcaccagtgtcgccagccaggtcacctctctgaattttgtggttgcaacctccatgattccctagagctgtttttacccagaactaatgaaaaattctgcacattaaattcatgctattagaatcactgttgtggtttccatctcccaagtagaccccaactgatacataaattcatactaggagggggtccccagagacaggccctcaaagtgacacagtcaggtacctctttggtcactttgccagccaggtacctctggctgctgacaccccccctccccaggcctctcttggccatgctacctgccgcaggaggtggcccacccactcagcctgcctgggccacacctggctgttcaccagctcagcctgtggctgggctgggcatgttccagcctgcttgtgttatagcttgtacccatgtatggcagttcccaagttcttgtcccgtgtccaagaagaatgaggagatgctgccaatcgaagtgtgagaagggcagagaagaattttattgagagacggaacagctctcagcagagaggggatgcacgggtggttcccgacctgaagtcaggtggtttctctcctagtgtggctgggtccggggcatttatgggctcagaatgggggagtgcatgctgattggcttctgattatgcaaaaaaggcttaaacaaaggtaccactcaaaggtgggcatgccagtgtagaaaatgaattaggaaaagataggtacatgtaaaataggtgaagggtggggatcaatcagaggaaagcagccaaatgggaagatgggttctcaatccaggctgaggatttaatttgtagcttggctttcaggctttaaactgtctttggctcggaggtggggtttcactgggaacctgtccctgtctgcctaggatttgtctgcctcctgtcactatcaaaaggtggggtccggggattaggttagtgtggttgttgcttgggctgggctgcaggccgatctcctggccagtgggaaggggaggctgttggcccacagtgttgttgggggagcttcacagttaaccaagccatcccccatgctggctgtgaggcaccagcagaattgagggcctcgggaacccacgtgctgctgtgtgaggctgtcacggccacgaggatgaccacaaccacgagggctgtggggggtcccctgagtgtccagcagcactaacaggaaggaaccacacgttcaggtctctaaactcagtttaagtcatagacagagaatcaggactgccatggccatggaagagtcccttgttcctgagagcctcggggctgctgctgctacaactcggatgcacagtttaactctgagttgtgtgactgctgtgtggctcacactcacagcctcactactgaaacgtgggcactgagtgggaaggaactggatgctgaagcttggcatggggatgtctggttgggctcagatgaagctgagaattgtgaaccccctggttctctgagcctctccttccaggggaagcagcttgtcctccaagatctgagagtagcctttatttattttttttgttctgcttgaaaatgctgtgataagcttacctggccaggtgcctagaaatgatgctcattttatttaaccaccatagccaccctgttgcctctagaacctcagtgtactcccagggaggggaagggtcaagtacaaagcctgactcaggaaggaaccactttcacaccaaaatgctcgtaagatgttacaaattcacacacggagacctgggaaccgtgtgggaatggagggtagggtattaatgcagctggaccggcttggctttattgatgcaggtacacttactagagattctgaatttaatgcgctagctcacattagctgctggaaatgactctaccagtttacttggttgaatgaaatctggatttgctggcggtctacagttaatgaaggggagatgctggaatgtccctggtgtaacgtcgaggcaggaatcgtgcaaagcaagggccaccctccgtcccagcctgatttctctccacctccagctgagcactgaggaagacgcaggccggggactgcccagggaagtggtggatctgcagacagcgtgagctcctggagcgtcaggacccagagcagctgtggacatgcccctccaggcgggacacccaggcctcagggacgagtgcgtccatgccttaagggctgctggttgtgggtgtctgcttggtcctggagaaactacctcaggaaaagccagggctggaccccagcagggatgggataaggggaaccgagactcacccactgtgctcagggcagaggtggtgggccgcgggaacgggcatgtctttgtctatctggactgccccaacagaatagcagagacaggtggttcatcaacagatacttatttctcacagttctggaggctggaagcccaagatgaaggtgccagctcgctctctagtgaggatcccttcctggttcacagacagcttctcactgggtctccacatggtggaggggcttgggagaactctggggtctcttttataaggacactaatcccactcatgaggttccacccctggtcatctcccaaaagccccacttctgataccataaccttgggggttaggatcgcaacacataaagtttgggggaatgcagacattcagagcccagcaaggagccaggccaaaggctgatgagagatacctgctgggtgagctggtggtagagggggcagccccctggtgggggagaaacacagcgatcctgaggtccaggaggagcctcagcggggctggcatctacactcagccttgcacggatggatggggcaggacatcccaggcgaggaggacggtaggagcagggaacgtggtggggaagggcacccctaggggacgcctccccactgcctccacctggccccgacattggagcaggcccttctgctgtgaccaggctctctggaccagcccttgcctcctctgcctcagtgccgactggcccacctgacccgaggaacttgcgtgtccctgaacttagctcttgggctgctgacaggtgtttgttgagtccttgagcacacgggtgaagacagggagggaagggtggatggggagctggcaggcggaagatggatcaaattggtgcctgcgctggggaaccccggaagagggggactgcgtgaagattccgagcggggaaggcgaggagcggggctgaaggtccctgtcagggccctctcccactgtgggctgcccatccccgaggtactcaaggtgggaggcactgaccctttacccagacccctgtggccagagacacataggcggtgccagctgatgaaggtgcatgggggttgaggagtgggtgaggcctgaggaggaggggggctacccagccctgcacctgccgcctgggggccccacttccatgcagggcgaggaatagggcccctccctgcctgaccccctggactggggttcgtcagatgatcccagaagcgaagtgggtggagaggcagggggtctatctgtgggttcaagaccatggaaggaagcggcagagaaggggacagaaatgggacaaatgcaagtgcccaggaggagagagaagccaggagggggggtcgtggccctgtctccccagggtgaagtcaggcagggcttgggggcacgttttgcaccgagtcagctcacccagcatgtctctcgcccatggccatgagagaaagccccgggctgaggcctcagtctgtgacactcacagtgatgggcaaaggctggctgcctctgccccacccagaagtccccaagctcactggcagctgcaaggcctggggacatttaacgcacgtataagaacaagctgttctctcgctctgtggaagcactgatacctcccagcagcttcgggagacaggtctggtgggagcctggggactgtgctcatcagggcccctcggtggtccctctgcttggaagggaggggcctgtggaggagggaggaagtttacccccagcacactggattctcgatgaagggcccccatgaaagcaccctgaaaggtcagcttggggtatgggctggctgggcccatttgggagctctgtctctggagagggctcaggctctactggaggctggcccaaggctcagggtccaagcaaaacgcagcttcacacccagggaggggcttctggggctggtaccatctccccaagggccccaggagtctggcctcaaacctgtccaacctgtaggatcccaggccagggacgagacctggggctgcttcttcaaggtctgagccccaggtgtgggccaagagggccccaactgcagggaccaggttgctggtggtagaagggactgtgaagcttctaggatggtcccttcatgcaagtaggaagctgtcccctgtccttcccaaggcagaggtgtgaggctggctgtccaacactgactcatgctggggcagggaagcggggtgtggggagggcagggaaggggggtgtggggagggctgggaagggaggtatggggagggctgggaagggaggtatggggagggctgggaaggtggtgtggggagggctgggaagggggagggctgggaaggggtgtgtggggagggtgggaaggggggctgtggggagggttgggaaggggggttgtggggagggttgggaaggggtgtgtggggagggctgggaagggggtgtggagagggcagggcaggtacctccccgatttagggagctgggtacacccctgggcctggacatcaggtgcagatgctagggtggccccgtgattagggctgggagagggtcaggcccagtcactgtagccagcagcctgaggatgcctccctccggattctggccttcagtctcttcaggccacggtggtcggggtccaccaggaggccgctctctaccgccgtccaggcctctgcgtgacgctgctcctccaggcagcactgcccgcggagaaggaacatgcgtgcagtgggggcccggcctggctgcctgcacaggctgttctgggccaaggagggcgccagcttcagggcctgggcaaaggcccctgcggccgccgcctcatcccccaggctcagcagcaggcgaccctgacggcagaagtcctctgcccgccttgggaggtcaccatcccccagcgcctcctggagcacatggtccaggtccctaagggcccggccaaactcctgcaactcggccaggcaggtggcccgcagacgcaggtgacaggcactgctgccactggccaggacagacagcgaacagtagcccagcgcctgcctgggttgccctgcgtccaggagggtgccggcttcctgggccgccgcctgcacagaggacacagagagaggcagggagagtggggtcagccccaaaagcccggccgcccctgccctgcagaggtcctctgcacagccagcttctgctggctccctggggatggcggggccctgggctgcacaggagctgcccgctgcttctggaggggctggctgaccatgggcaagggcaggaagggggacccagggtagaggacccctccctgcaattcccactgccctggaacctgccaaagtgctgttccgacccttggcccaaggcctggcatccttgcccactgctcttctccctgggcctcggatcagggacctggatttacctcctcatggtcccctcctggcagccctaccgccccaccggctgggcccaggttcccttgactgggtgaccacaccggcctcctccctcggtccctctgggccaagtcacctctccatcgggccctctgagggggctgctgcccagcccttccactctgcccaccttctgaaggctgctccaggcctctgagcacgtgcaccctagcccctctccctggggctgctggacggagggcacagcctgtgctgtgggctgctgctggccaggcctgcctgccccccccactcctcccgggcactttcctgagcccacccaggcccaatcgcctcatctctgacccagttttttcacagagtcaaccacgaccagaaatccgctcgcctcgctgggctcctcctccgctcaagaatctgcaggggttccccgctgcctgaggaacacgccaaggtgcaggccccgcctttctcgctggcgctgcctctcttccagcagcccggcggtcctcgacgctacctcccccggggggcgcagcgcacccaggaccccgccaggcttggccgcacggggcgaagccgaggcccacgcccggggtccgtgcagggagcgagggggtcccacggccccggctttgctgctgggctcccgcagggcacagtgtggcctcttctgccagctgtgagcggcgctgagcagggcaggggctcgaaaccccgtccctcgcctgcggtgcggcccgcgggaccgcccctctccgggcggag

SEQ ID NO: 448 - DNA, 40329 bp, Homo sapiens
gcagcctgtaggcctgggagggtgcaggaggggtcccagagtgggcaggccccagctgagccacatccctatgtcccattatgagctgctgtgggtgacagacttggttctgctcctcccactgcaggctttctcagtgctggtatcctagatcctgcccagaagggatgtgggccctgctcttgggaagctcctggtgtgatgggggacacacagccctaatccccaccccaaaacttaactgggggcccggtgtagtggctcacgcctgtaatcccacactttgggaggccgaggagagtggatcacctgaggtcaggagttccagaccagcctggccaacgtggtgaaaccctgtgtctactaaaaatacaaaacttagccgggtgtggtggcgcatgcctgtaattccagctactcgggaggctgaggcacaaggatcgcttgaacccaggaggctgaggttgcagtgagctgagatcgtgccattgcattccagcctgggcgacaagggcaaaattctgtctcaaagaaacaaaaaacaaaaaacaaaaaaacacttaactggggaagatgggatctttgaggtgacctggaggggagggcttggaagcggtgggacgggacaagaggggagagctcccaagaggggcctgaggcagcagctatcaatggctgtgggcagagtgaggtcagtggggaggcagctgactggactcttgacggtttctcaggacgtgaggctgtctacaccgcaggccctggagcctgtggcctgggtgcagtgggccaggcccaggggcagcaggagcaaggccggggctccctgcaggatgcctgctggacactggccctctgctgggcgctgctgctgtggaagatgcggcttttccagcgccagtgggccaagtaggtgtcctcgagcttgtgacctggggttgggcctgggggctgtggggtgggcacgtgagcagtgctcagcaccaggaggaatgcgggaggaatatcccatagggcagtaactgcatcccactcctccccgtggccctgcacagggcctggcacactgcggtgcccagccaatgtcaggccctgggaggtggcctagggacactggaacagtgattgagcagagggccactgggggccagggggctgccagagacacagacatggagctctacaggggtggccggaaccctagtgaatgcccgtctccctgccaagtgtaagtccctggtggcaggaaccatgtctgtctcgccgtcaccgctggctcccagctccctgcaggtgcctggcatgttgcaggcacagaataaatactgtaaaggaacaagggcaggagccagggatcaagcttttatctcctctcccattggcctcattacacaactagagaaactgaggctcagagggctggagcagcttgctgtaaatcccagtgggagtcaggagcaagaaggtcctgtgttgagacctgggtgctgcccccacacaagatggtcactgatggaattcggagcccagaagaaggctgtaggtgaggggagggtggcgatcaggagaagccagcttcccggaggggatgtcaggaggaatggaagcgagcagttgcagggttaagaattctgtccttggctgggcgtggtggctcacacctgtaatcccagcactttaagaggccgaggccagtggatcacctgaggtcaggagtttgagaccagcctggtcaacatggcgaaaccccatctctattaaaaatacaaaagttagccaggcgtggtggtgctcgcctgtaatcccagctacttgagaggctgaggcagaagaatggcttgaacctaggaggcagaggttgcagtgagccaagatcatgccactgcaccctggacaacagagcgagaatccatctcaaaaaaaaaaaaaaggaattctgtccttgaaagccacacacccacatggtccacatggaccctcagcctctttcagtgtacccctgcaacttcaggggaattcaattcaccgtgacctttcagaatgtgggggcactgctcacatgcctgccccacaacccccaggccctccctctccagcccatcctctggcctttggacttcagggcacagttcatatctcctggcagctctcccggggcaccctcctgggcctagatgagtcccaggtctgctgctatttggagtttggggaaatgatcttcccctgggctcagctttcttatctttataagtgagtgcaggcagaagtactggtgtggttgtaggggtggcctctggagtctgggatccctgagcctggggaccagctccacctctgatcagctgcttgggctcccagccaccccgggagcatgatgaggccagccagtgaagcaggtggagcactagctcggttagccagacgtggtggcacgcacctgtaatcccagctgctcgggaggctgaggcgggagaatcacttgaacccaggaggcagaggttgcagtgagctaagattgtcccactgcactccagcctgggtcacagagccagaccctgtctcaaaaaaaaaaaaaaaaaaaaaaaagcatcagcccagtcagcccagtctcagctgctcactgaggtcactcagagaaccccagaaaaagtctggaagcccagactgtaccctgaccattaagtcagaatctagcagaatctagggtgggaccctggtgggcatcggtacctcttgaagcccccagtgattccagcatgcagccgctgtggggggcagcagcgtggaacgctagcccagcgtctggcctgtggcgagcaccctttcagcccatctctttcacagcggccagggtagggtagcccctgcttggccaccctgcacagcctgagggtgaggctgggtgggtcactcacctgccccttctctagctccttcttccagggcctgcagcagcggatgctgcagcgcagcctgagatggtggcacttgagggcactgggcccagatgccacatcaagctgcaccaagaccccctcggctctggagccactgagcagcagcacactccaagactctctggagaaggtgagaggtaggagggtggggaggggctggggcaggtaggggtggatgggtggagattgtgggaaggggacagggtaggggaccaaggactccacatctccttccccaggttcccagggcccccaccctcccggacactctccaggggagccttctgtgggcagctgggcagcggcagcaggggcagtgccttctgctctggcaggcacgggcccagcagttccagggcacagccaggtggtaccagcatacccgccagaggcggtagggatccctccccatccgcccgccactctatggacttactgtttcccggccccttctcccttccacccttggccttcacagcagcagccccttggggtctgcacctcagggggcttcagttcctcctgtcttcctgccccgtcctactgagagggtgtcggggagtggtgaggcactctacagagtcactgttcctcttggagattttgcagctgaggttccttcatttattcatttatagcacaatgcataagagttggtctccctgggttctaatcccagctttgcccctcattggctgtgtgatcttgggcaagttgcataacttctctgtgccctatttgcctatctgtaaaatggggttaatagtactggctccagtggggcaatggcgaggcacggcacatacattccccaatgccgtgtgtggcacgttgtgagtgctcagtccatagcaatgtttatggctagtggttgagcacaggacttggcagtgggggtctagaatcccaccctatccccaccactcatcatcgtgaccctgggagaggtgcttggcccctccagtccccagcaacccaccctcccataatggaaacagaagagtcacccagagcctcctgctgctggggagaggaagagaaaggagggtggggcagggctggcctgggatttgggggacagtggccatcctcagggtggaccctccctttcccagcatcttcctcagctggagccgctgggcaacagcccaatgggcctggagagagctggcttcccaccgggcctgggatcggacctgcagggctgtgctgggcctgtggcgtcagcggctgctgcagtcacggctggtggagtggtgggcccaggagcggggctggcggctggcacgagatgccctatgccactggcactcctgttggcagggtgagtggagacttggtcgggggcactgcgggtgagggcagggccagggtctgtctgagacccagactgcagccctggccaacaacttgactgtaaccgcatgggagaacttgaggcagaggctaagctacatctggactcctgacccatagaaactgtgagataacaaacatctgtggtttaaaactaataagtacttgggtaatttgttacacagccatagctaacaaatgcagttgatcagagaggtccgctgagctgtgacactgacctagctgggttcaaagaaaacaggctgaccaactcttacacattgtgctatgaatgagcaaatgaatagacctcagctgtgaaatttccaagagggacagtgactctgcagagtgcctcaccaccccccataccctcccatcccgtagcaaattctggtgatgagacccccacagggcacacccaggagtcaggtggcagagcagaacctgggggcttggactctgtagtcttgagtttgaatccctgctcttccataccctgactgtgtgaaacttaaacaacctagttaacctccctgagtctcagcttacacatctgtaaaatggggataatgtagtccctatgtcatcacctttatcttcatccttatcctcacctggcctctaggagtcactggtcggagccctgagttgggagagaagtgggcagagtcatggtgcccttaggggccagcagagttagtcagggagggtcccaggaggaggtgaggagggctcagcgggcagagcagtggcgagagaggttgaggcgtgggaaggggtcagcaaaatagggcagtgggaaggactggatttgcagaggctggctgagggtgcagtgtgttagaagccctgaggaatgtggccagtgaagggaggagggatggtcccaaggcaggcttgctctctgggtcttggcctctgggcaaaaagagctgttgcatggcccaaccagtcttttttttttttttttttttttgagacgatctcgctgtgttgcccaggcatgcagtggtgcgatcttggctcactgcaacctccaccccctgggttcaagcaattctcctgcctcagctcccctcgtagctgggattacaggcgcctgccaccacacctggctaatttttgtatttttagtggagatggggtttcaccatgttggccaggctggtctcgaactcctgacctcaagtgatcaacccgcctcggccttccaaagtgctgggattacaagcgtgagccaccgcacccggccccaaccagtctctttataacctgatatcagaagtgacatcccattgcttctgccaaattctgtctgttaaaagcaaattagtaaacccagcctgtattcaaggcggggcattgcccaggacacgaacacaggatgctgtcttggaggctgcccactacaccgacatatcgcattaatgagctggcaggcagggctgtggtggttctagaaagtcatgtcctgtccgctggagacagctgcttatgcagcccaatcattccccggcaggaacactgagccagtgtttccagaacttctagtttttacagaaaaattgaaaattagatttttgggccgggcgcagtggctcacgcctgtaatcccagcaatttgggaggcccggactggcggatcacgaggtcaggagatcgagaccatcttggctaacatggtgaaaccccgtctctactaaaaatacacaaaattagccaggcgtggtagtgtgcgcctgtagtcccagctactcgggaggctgaggcaggagaatggcatgaatccaggaggcagaggttgcagtgagctgagattgggccactgcactccagcctgggtgacggagtaagactccgtctcaaaaaaaaaaaaaaatagaaaattagatttttacctgaattctccagatttgaaaatactgtggcaaaattaacaaacaaaaacaaacccaacaactctatgagctgggctggcctggtcaccagcaggacacccataatagaggctttttaacccagacagtcagggtggcctcctctgttcccacctggtagggggcgaagggctggctgcgtagaggcccatggggagaggctggggtgagcacccagtggctcttcagcatctctctggccccagggcagcagttcctgcatgaaaagtgccagacatgggtgcaggtccacctccagggcctgcagaaggtggtgttccggagctggcagcaggcagcagctcatcagagatgcacagtgacccggccagagcagctgctactgcagaggtgggtgggcctgggggtgggagggtgttggtcctccccacgcaaggaatagcaaggagagcacccagggggtgggaagctcagacggtggcccagataggaggcctgtggcctgggaaaaaaggggcatgaagggagatcctagcctggaaacacagggccatgaccactgacaccttattacctattttgggagtggtggcaaaccccacccctaacctgtggccccaacaagccccgggagtccagctcctggccaggtcagttctttggttttagaggatatgattaagatgggagaaatcagctgggaacagtggatcatacctataatcccagcactttgggaggccgaggaaggtggatcacttgagatcaggagttcgagaccagcctggccaacatggtgaaaccccatctctactaaaaatatgaaaaattagacgggcatggtggcaggtgcctgtagtcccagctacttgggctcaggcaggagaatcacttgaatccgggaggcggaggttgcagtgagccgagattgcaccactgcactccagcctgggcgacagtgcgagactccatctcaaaaaaaaaaaaaaaaaaggaggagaaatccactcctcggaaatctaccataacgcccattgtgaggagttacagcaaggagaattctgctgtacactgtcgctaagagaagagagtgaaatcttcatttaagtaaagatgttctggtggaacatgtatacagttcatgaatgcatattgtaaaaccaagcagaggacacagaatggctcctcccacagttcagtacaaatttgcgaatgttcagtgtccccgtggggcagtgaactgttggctacagaatggctgacgtctgtgcttttgcatctgagggtgtagatggttattttgtttgtttgtttgttttttgagacagagtttcgctcttgttgcccaggttggagtgcaatggcgcgatctcggcttaccacaacctccgcctcccgggttcaagtgattctcctgcctcagcctcccgagtagctgggattacaggcatgtggcaccacacctggctaattttgtatttttagtagagacggggtttctccatgttggtcaggctggtctcgaactcccgacctcaggtgatccgcccgcctctgcctcccaaaatgctgggattacaggtgtgagccactgtgcctggccgtagatggttttttttcttggcttctcactgagtgagagatggtgttcctctccctcaccaaccacctgggcatgtgatgggaggcagggcatggctgatgtgggacttgaacccatactgctggttcccatccccctcgcagggcagcccctgccctctgaggctgaggttgcaagatggaaagccagtgctttcacctgttactggtcgtttactgttttgtgggagatttgcaggtgtaactttgaataaatgtgacttttgactctgagaacgagacaagccctcccatgcatctgtttttgttttgtttcattttgtttttttgagatggagtttcactcttgtcacccaggctggagtgcacttgcgcgatctcggcttactgcaacctctgcctcctgggttcaggcaattcttctgcctcagactcccaagtagctgggattacaggtgcccactaccaggcctggctaatttttgtatttttaatagagacggggtttcaccacgttggtcaggctggtctcaaactgacttcaggtgatccactcaccttggcttcccaaagtgctgggattacaagcatgagccaccacacctggcccaatgtgtctgttttgcagctacttccaggcctggtgtgaggttgtaagagacacgggggtgctccgggcccagcatcaagcctttcaggatggcctgaggagaagagcactgggggccgtgtttgccacatggcgggaagcccaggaagtggcagccggggcacaggagcagcgtgtggcccaggcctcccttgcccgctggagaagctgcgggcagcaaggccaggaagatgggcagcagaagaaggcccgggccccacaggccttcccagcatggccagtggccccgggcatgcaccatgaggcccagcagcaggcaggagagagcgctggggcccaggcagcccagtgctggacttggtgctgggctctgtgggtgcatgagtcctgtcggggccaggtcagccgagcccatgcttcctggaagccgcgagcctggtgagtgctgtggtctaagtgcagccccactctgtgcttccagctcaggcctcaagcctgtttttggcaggggtagagcgtaattcatggctgggtggcagggcaaaggctcaagagggtggttgggggtgacagggagaggccgccctggccatctagtcctgggccacatcctgacaccgcctcttgctgtgtgtcccctccttggggaagtctctaatggtcatgccttgcagtcaccagcacagccagccactcagcaagcgccataaacgcgctcttgccagggaaggggaggcaaagtggcactggcaggactgtcccctctctgcccctaaacaggatgcttgtccccgtctgtgattttctccttccaggtcgctctccatcctgtttacccagattctccctccagaaaagggagtgtgggaggtgggtgggccccagcctggggctgggcccggaaggccccctcccgcagggcactgggggggctccctgcagagagtcctggcctttatggccctggctgcagactccttcctctcccgcagggtcctagaggcctcggtgcagtcggcggtgcgcggcggtgtccagcgagccatcctcacccagctccggccggctgagctcaggcgcttcctgcggacagtgcagctcagggtgcggctgggactgccaggggccggcaaggtacgccccaagccccagactgacctcacgctctggccccggatggccagcagggggagcctgctgctggacgccccagccccttggaaacaggtgaagggagcctaggcagggcgggaggtccaaaaatgaccctcggaccaccggccttagaatcagcttgattcagccggtggtggcagcatggctggatgcctccccaggggcccagcaacctcgtatgcaccacctctccccagttctcagtcagcctctgacaagcaactctgaatccatcagcaaagatgaacctggcacctctcgagtgccaggccactgcaggtccggccgcaaagaccagcatgttgggtcacagcctgttagggagacattgaaatgcatgctttctcacggtgcagttgaggatcagaataggtacacgaggacagtagcatttttttgtcaagtttttttgtttatttttgagacagagtctggctcaattgcccaggctgaagcagaggagtgatctcagctcactgcaacctctgcctcccgggttcaagtgattctcccgcctcagcttcctgagtagctgggactacaagtgcacgccaccacgcctggctaatttttgtatttttagtagagacggggtttcaccatattgcccaagctggtctcgaactcctgaactcaagtgatcctcccacctcgacttcccaaagtgctgggattacaggtgtgagccaccgcgccaggccaagtttttttttttcttattggaaaagtgaaatatgcttattacagaaacctcagaaaatataaagtagaaaaataccaaaatttctttcataattctctctacccaaaggcatcggtcagtccctctccagaccagaagcagttagttctgacaccaacaagtggtgataagaggttgatagcctagcaagggggaagaagccaccaccaaaccaaacacaaaaaatgacactgcacagcagtctggggacatgtccttgaaggacacagccccaaagatactggcaggtgaggtagtgtccctaagatcaacaggcatcatcatgaatcctatttcagaatgccacaaagaatacgttttagagaagattctaagagaaaaagctaaggtgattttttttttcagtcgttttttgttctcagacagtgtctcactctgtcgcccaggccagagtgcagtggtgcgatcacagctcactgcagcctcaacctccagggctcaaacgatcctcccacctcagccacctgagtagctgagactacaggcgtgtgccaccacacccggctaatttttttttttttttttttgtagaaatgggatctcactatgttgccagggcttgtctcaaactcctgggctcaagcgatctacctgccttggcctcccaaagcattgggcaggcccattacgccatgagccaccacacctgctggtttttgttttttaaatggaattgaaaggaactagccttggctagttgcagaattcacacatatggggctatggcaacagcagattctggagtctcagggtcttttctttctagataagttacagggcaattgcttttcagagtacttttacatttctattccattcttgtcagtaaagacaaggatcccataagctgatggagaaactgaggcctctagaaactaaacgctgggaatggcacccagggtgctgaattccagggtctcctcttttctgccacaggcacacatgccccagcagcccctttggagagccccctctctatagggtactagccgggggctcagactctggagtcagacggcttccgagggatgaggcctcagacaagtaactcagctttgaaatgttttcagtggggagagaaatagccccctcccagggctgtgctccgggaactgactgagggctaactattatgggcccaccccattgttggaatgtcttcagccacatgggggaatgggtggaagaggccgggatgtgtcctgccagctagagcagcgaagaaatcccagcggggccccaggaagtccaagcccatggggttcaggtgctcctctctggctattccttcagacccgcagctgctggacacaggccacagagctggtgcctcccgcgccatcactgcagtgcagcctgggtggacggaggaagccaaggggaacggcctgggctcagagtaaggagaccttgccccgggggacaaacggtgtctgaagtgcaggggtgaagcggtctccagtcctcaggggcctggaaatcagctccttgggacacggtcttatgtgtattgaccattctccccatccattccctcttcggaatgtttcagctgttctgagaaaacactttgcattcctgccccgcccctgtgatttctctttgggcggcaggcagccgggagaggctggaggcctggggagatgggggcagggcacaaggctaagctcagcaccttcctccaccctcctcactgtactcaactcctaggcgggcactaagagcagctgccttcctggacccaccttaacctcttgtgactcaactcccctttccagggtgcagggaacattccctctgccctgccttccagctctggccacagtggcctggacagagtagctgggtcccaggcctgcccctgtggacgagggaccagggaccaagagcgcactccagccctgagcccagagcctgcaaagcccaaagcaaggcccataaacggaggctacggtaagaggagctgtgtgtgcagtttggtgggtccgagggatgggggcaagggctgaggggcttgcctgagccatggctacagctgggccctctctggccagtgctcgttcctgcaggatcctggaaaagcaggcccaggcccatggctctgccctccttctggccctgaagggtcacgatgctcttggccatcaggaggaagtacctgcagcgccggtgcctcgaggcactgcttcacgggctgcggggttcccagcaggccaggtgcctggcagtggcatggcagcactgggtggatgcccaaggggcagagcagctggtgcggaccctggtgagtgggtgcacccctctccacactgaccatctcccatttcacctcatacttaacccaaacccctctcaaaagtatggcccttggacctactgactccaaaaccttgggggacaggcccaggaatctgcattcttaatactcctcagatgacacccccttgccatagccctttcactctggtgcagcagtgtcgggggagaaaggcagaagggctggggactgcgggggagcgtgagcacaagaggccttctctgccaactgtccccaaagctcagggagtggcacctgagatgggcctggcagacgtggtggcagcggatcctgcgactgcgagtggctcagcagttacagcagcaggaagatgggtgggtcctttcccaggtactgccctcttccctgcattccactcagccagccttccagaagtctgtgccacagccacgcaccgtggagctttccctgcttgccagccccggggccccttcgttttcaggggagggggtcagttccattacagaacacacaggctggatgctggagcccttgctttgatttgtggccccagctcaggccaggcccacccggtccatcagtttgcgaagaaggtgtggcatgaggcatggctgccactcacactagcccatggagggcctgggtcctgagcgccccctccctcatttgctctgctctgagtacagcttcccagctcaccatcagatctattctgagcttgtgcatttggcctaggcaagactggctggctgcttggggcagagggaggggccctggggacaaaaggagctgggtacaggggttgctctagcaggcacagcacagaccccggagaaagcccacaacaatagcatttcctctcctccctggttccaggcctttaagaagtggcaccaacgcctggcagccaggagcccaaggagaggagctgccagtagcccaagaccctggagcaagccaggccccaagggccccgagagtggacaggaagccgccagagcaccgcggggttgggggcttggggcagagcatggggcccagctgcagctgtgacttgttctcatagaataaaaaacagaactgaacttagccttcccagggaaggaaccatgccccacacatccagggagtgatgacagaggggacagcttgaagagctctgaaggacaataaaacccactcctcagtcctagctgctgctttcagtctctcctagcggctgcccctctgccccagccagtgaggccaggaagggagtaaagaggacatcccacaattgcgtccacccccttggccatcaggctgctcttccactacacgaaacagcccatctgcacctgccagtcactgcccccaggccctggggcttgcaggtgactcgtggggagccaggccaggcagataacctctgggacaggacgaggggatgaggaaggcagctggcaggacaagggcctacctgaaaaatacaccaggaagctgggctgctgcacaggcccaggcagatctggggcccctgtgctggcaaatctcatcttagcctctgacagggaacggggcagcatcaggcctccacagccaggcaaaaggggaaggccacgagccccaccaagcacaagggttcagactgccttcaacccttaaggggcactttttctctcaaggctcagaatagacaactgtgccaaaaagcagcatggtaggtgtcagcccaatgcccatccagggggctggtgccatggacggctaagtgggcaggcagggcagtggtgtgccccttcagtcacaagtaggtggggcccagctgcccacctctaggaggtggaagggtacagcactttgccacatctcttctacgatgccaccagtgcctgatgcccttgcgtgttttgcctgtactgcacgggctccaagtgtaagttcactgggagtcccaggctggctctggaggctgccttggttcgagggcttagttggcaacaaccactctcctcgccttctcaggaggtgccacccactgtggtcctctgcaggacgcaagtgctccccaccaaaagagcacagactcctggctagagcagagagtactaggttcccatgtggggccgactcaggtccaggaagagcctggaagcctcactccagtctagctgccattgtcaggtgggggagtggaggccggggtgggagagacacgaaggagagtggagttcccaagagaagcagcactgtggaggaggaaggcgggacaggagtggctccaacgcagggcgtcaggacgcagggtcatggagcctccgtttctctcgcattctgggtgggcctgttgagaagctccaatgtgtcttccaccacctgccagaggcagttgtccagtgggaagtcattgtccaccaggttgaccaggaagtagttgtcgtggatgtactggatgatggtgcgggacggggactcctcctcatacagctttccccaccgctcaatccacagggcaaaggcctcgtcctacacacacatacccccgcacacacgcacacatgcacacacacacagaggcaagattaacagggctctccaagggctctgctcaacaggacatttcccggaatagaacaaggcccactgccagtatcacttcccacccctgcccagaaataaacaccctgcatcagcagtgacatgggtgagtcagagctgggtgtgccctgaaggctgggtccagtgtggccttcagcacacgcttgggacttggtcccaatccctccccacggttttccaggtgggcggggcaagcttgcccccggctcctttaccttccagaacatgaagctgacgggatccactacggtgggctggatgatctctcgcccagggaagatgccccaagtgacagcattcggctgcagttcaggggcattggtgatgttttcaccctgaggggatgtggggtgggggtaagacctgggccaagaacaactggagtcccactgcctggacagccttgactcaatgaggctgtctgggctcaataccctctgcctgcgcctccactcccggcctccactctccctgcgcctccactcccctctccctgtgcctccgctcctggcctcctctgcctgcatctgtgaatgatatctctccccacacaagcctgaacctagaggcgtcctggccacttcccctctcctccttgagcaccccctgctcactctctgatccattccctcttgtctagcccacctccaggagtgtgtttggcttgggtcactccaggggtctcttcactggcctccccggctctagccgtccccaatctctctcatccgtatgactatccactgtgatttgcctaaaataaagcaggaaccaagccaccccactgctggagaaaggcttcccttgcattgagggaaaactcaaattccagcaggacaaccatgatctctgcgggcctggcccctgcttaacactcccgcctcctcctgctcatgttccccgtttccccagatggtgcagctcactgcctctgcctgtcctctgccctgtcccaggaatacccttctctcctgttggccaactcctctttgtcctcagtgattcccacagatgaccctctgagaagccttccctggcctcccaggtgagatatccctcctctggacccgacagcatcctctcctgaacttgattttcccacttacactggctggtggtcacacattgatctgcctccctcactctaggctgggagctccttaagagcagggccccagttctgcctgtatctctctgtcttgcacaatgcctagcccaggctaggtgctgggtgtttgctcaacgaagggcctggtactctgtgggaaccctggggcctggcctaccttcacattgacaaggtggtaattaacccggagctcgtacttcttcagcacttgcagaagtgcttccgctgtctcgcgggaagtgaaaaactctaagtaggcctgtgggagagacaggtgcctgtcaccaaccccagccctgccagacgccctttcgcagacacctaaggtatcaggactactggcagccatgtgggcggaataatgaactgtggcgttggcacgtccataagcaaagggtgaggggagtggggacgtgagtttctcagtctggacaggtctgagggctatcagccacccctctcccaatcagtcagggaagactccacgaagaagccatttctgaacagcagcaactggtttgacaggccgagtcatgggagagaggccccacacattccatcctccccagtgcaagctgacaatgacattgacatctcctctagaaccagtgcctatcagggattaagctgggtttactcaaactcatttgctagaatgctgataatacgggaggctgggcacagtgagccccacgtgaggaaagtgggttcagggaagttgagcacgttggctactctgacagtaaacagtagagctggtccttaaactcaggtctttctgctccagggcctgtgggccttagatcagaacataatgttaactccagcagccctgggagaaaggtgtcaactcaggatagtaacagcagctgcctttcagggagtgcttcctgctcttaccatgtgccaagcacgttacatgctttgttaggtttcatgcccagaacacaagctacatcccattttacagacgagaaaaccaggctcagagaggtcgagtgacctgcctccataggtctgatttctatctttttttttttttttttgagatggagtcttgctctgttgcccaggctggagtgcagtggcatgatctcagctcactgcaacctccgtctcccgggttcaagcgattctcctgcctcagcctcccaagtagctgcaactacaggtgcccgccaccacacccggctaattgttgtatttttagtagagatggggtttcatcatgtttgtcaggctggtctcgaactcctgaccttgtgatctgcccaccttggcctcctaaagtgctgggattacaggcatgagccaccaagcccagccaatcttttttttttttttttttttttttttttgagacagggtctcactttgtgggccaggctggagtgcagaggcacaaatatggcttactggaggctcaacctctcggactcaagcgatcctctcaccccagccccctaagtacctgggactacaggtgtacaccaccatgcctcggtcatttttgtattttttgtagagaatgggtttcaccatgttgcccaggctggtctcgaactcctgggctcaagtgatccacccgccttggcctcccaaagtgctggccgggttccgtgcccagccaggtctatctgacttaaagcatgagctcccatccgctccaatccatgctcattcaaaatttaagagcccaggagaggcaggctgctctgccctaagctctggggaacccacgggtgccggtcaagagaggggggcaccccgtgcctccctaccacaccttctggaagacatagcccccgctggggccccagcccacgatggggtcggaggacggcttcccgttgatgttgggctgtgagttgatggtgaggatgccctggcggttcacccgcagcagctcctccttcagcaggctggtctcagccgccaggggctcatcgttccagggcaggcaagtcacctgggagagacggtgagctggctggggcgaccatcaggtttggcaccctgagtccctctcacggcccccaacaaagacccagcctgtctttgcctccctaagcccttccaggtggaggtctcccaacttacccttctccctttgccatgtccacagcatggaggggagggcacaggatggggaagtcacagccccgcagcctggcctgcagctggggtcaggccaggggcaggggatgaaccagggtccccactccagcatcactcactttgtgaccattccggtttggttctcccgagaggtaaagaacgaagacttcaaagacactttcttcactggtcagctcctccccccacatcttcagcagctcctccttgggggacttgctcttcaggtagaagaggtagtagtccttcagctccccaaaggcaggggaagaggaattgcccctggcagaggggtgcccagaggtcagggcacactcctgacagagggcagtgccaccacatgcccaggaggccattcctgtaaattctgcccctgactcctcccaggtcaaccacaagcatgcaaacttcttctgccctcccgctcccaagaacaaagatgtatttgcaaggaaggtctgcaggccctcaccagcggccgttagggaactcgtcccactcctgggtacggtagatgtaactctttggtctggaggcccagaagatgggacgtacatcttcctctcggcgcttggggtgggcgctgagagcccagggtaggggacgcctgggtgaggatggggacagagaattgagacaagggattggctagagggagccggaagcaggggagcacccctgaggctgagttcttccatctgatgccctctgagactggagccttcgatgtgcccagctagccatggcacagacatccatctgtaccaccgtggggagccagcactgcagccggggctgctcttggaccctcctctggggatctctgggccactgccctcacctggggtcctcagtccacatccccaggcgcttcagcacctctgtggtagccatctcgcggttgagggtgtagaagtggaggcctggcaccaagccactggccagaagctcctggcacaggctcacggccagctcgatgccatagttgcggatggcagcatcgttgtctttgattggctcaatcacgtccttgatctcctgtggcacctccagcttggacagcttcacaagctgccgaagggagtggtagccctgtccaagacatgaggggctgtggcggctgctggccagcccgtctcccaccctaaatacttctcccccttccatcatccatgccaaccacagtgtcaggcagagggacccacgaaagtccgatcatattctaggagcacacctgggcttggcctgccgttttctcctcttttttctgtttttagagactgagtctcactgctctcaaacgccagggctcaagccatcctcctgcctcagcttctcaagtagccgggactacaggcacgtgccactatgcccagctttcccactttttacagagtagagcagctgccctaagcattccagccttgggttgagccagccttttagccctagatgtgtctgttggtaacatggtgtcatctaacccagctgttcccatgctgcactgatcatccgaatcacctgccaagctcaagaagtaaaacacacattccgaggacctccctcagatttactgagtgagaacctccaggggtgggacctggagatccactttttgaaaaagcttatcaagtggttctgatgacagccacctttgggaaacactgatttaagcaggatttgtaatgagaattagaatcccttttggtgatgcttgttggccaaagtacaacaaacccctcaacagacactgttgctgggttttggggggaaaattagaggtaaccaaaatggggtggccaagcaacgctgtgcaagttctggacctgagaggagatctgggaagaactcagcgaactcagcactccacccagagcccccagcctgtgcgaggacggtgcggtgagagtggggtggagggagcttatgggctctcctgggcccctcacctggatgggaaagatcccggggacgatggggcaagtgatgcccatgtcggtgcatgccttcacaaagcggaagaatgtgtcagcctcaaagaaaagctgcgtgatgatgaaatcggctcccgcagacaccttctccttcaagtgcttcaggtcagcctcaaagctccctgcttcggggtggcctttggggtaacctgccaatagggatgacagtcaggagaggctggcctccacctgttcaaggcgagggatgaagagaccacagggactgggcagagagagtcctctgctttgggggctctgatcttgcaccttccaacagcacagcacagcctgaactaaaacagtgagtggctgggctcatgactgatatgcttctgaccccagagatgactctcaggggaggtggctcagagcccagttccaagagtgggggtggattgctccaaactcccacactgtcctgccttgagcagccaagcaaatcaggcctgcacttggtggccatagaaaagagaaaatgctacagttagcactggctgggcagcatctggggtagtaagcttgacttttctctaggcaccggattaaacattgtttttaatgtaacactgaaattactcaggggtccaagatagtgaaaagctaaaaaccaagttacacaaggaagaactgaagaaagtgatgttttcttcaaagaaaataatggatggcagggtgcggtggctcatgtctgtaatcccagcactttgggaggccaaggcaggaggatgacctgaggtcaggagttcgagaccagcctggccaacatggtaaaaccccgtctctaccaaaaatacaaaaattagccaggtgtggtggtgtatgcctgtaatagctactcaggaggctgagtcaggaaaattgcttgaacccacgagacagaggttgcagtgagccgagatcgtaccattgcactctagcctgggcaacgagagcgaaactccgtctcaaaaaaaaaaaaaaaaaaaagaatgaaaagaatacagaaactcctttcaaatgtccaaaggtctgtcctggggaaaaaggatccaccataggtgagtttgttttgttttgtttcagagacagggtcttgctctgtcacccaggctagagtgcagtgatacaatcatggctcactgtagccttgaactcccgggcacaagtgatctcccacttcagtctcctgagtagcttggactacagatgcaagccaccacatctggctaattaaaaaaaatttttttaattaattatttattttttagagatggggtcttgctatcttgtccaggtttgtctggaacttctgggctcaagcaatcctcccaccttggcctcccaaagtgctgagattacaggcatgagccactgtacccagccccctagtgaagttctttattagtcatattctgtgttgtttctaatggcagaaccagcatccggttcagagagctggctagagtactataagccactcacaaaacaatgagctcctggagtctgaaaacacaggggcagtggatgctgaagacaagattccagaattgcttaggaggtgggatcagatgtcccataggctccttactggctctgtgaactctctgacccctttcctcaatgactaaacttactagccgccttgctcggtcaggcaagcaggatgaccataggccttcatgaaactacatggagtgctggtttcatcagcccaagcccagggcaggactctgagccaggcggaaggccaagctgctttgctctgataaggcagttccgttcttaagaaacccagagtcatcaaaaaatgaatataaaaactattgtttcaaggggtaagggagtgggggataaagcaatggggcttcacacttgcaataacaaagctattttcccagtaggaatttcagaaacaacaaggctttttaatagctgaaaagtatagctacaatacctaaatatcaccgaacaaatctagcatttgattacgtatagattttgctatttactctatttttctatcatgaacagctgagggctttcttttttaaaatgtttttattttttgtagagacacggtctcactgtgttgcccaggctggtcttgatctcctgcctcagtctcccaaagctctgggattacaggcatgagctaccatgcccaacaggttggtgttttctaatccactcatcttcattacccacttgataagcaaagtaagaaaccattcagcaactgtgagctcacagcttcactagtttccaatcattatcacctaacgcccatcacgggtgcatattcccccagtaactgactatataatggctgatacaagcgatgacaatttaacagttggaaatgtctgttctctgactcctaatcagtgcttcccagacttagcacctaaacacccctgttgacagaatggacatgtccatcgggggttagggacaaggccaaagttactcacaacatgtaattttcttgaagccacgtggtttgttttttgggttttttgttttgttttttttgagacggagtctggctctgttgcccaggctacagtgcattggtgcgatctcggctcactgcaagctccgcctcctgggttcaagcgattctcctgcctcagcctaccaagtagctgggactacaggcacgcgccaccatgcccggctaatttttgtatttttagtagagacggggtttcactatgttggacaggatggtctcaaactcctgatctcatgatccacccgccttggcctcccaaagtgctgggattataggcttcagccaccgcacctggccttttttttttagttcatatcactttagatgctactccataacatagccatgtttaatataaaaatggtaggatttctcccagaatattggcaaaaaaactgtcatcccagaaaatgtgccaatcccgggacttcctgtccctggtgcacactgtcttgccatacctgagcgctgtctgagacgctgagggctcaatgccagccttcagcttcaagggtgggagagaagtccaacccacccatttctgttgggggaacctggtcttgtggctgtggccaatggtgattctctttcctgggaatttggaacggaggcctgtccattagcctggggaactggctggaactgacactctgcacactcaggagcaggccaggtgtgtggaaaagcatgggtatcaggtctcccagatgaagcacagatgtgcagtgggaagcggagatgggggaccctgtggccccagagggaatgagggagggccttgctttttgacctcttccagtgccttgtgaggtctgaggccatctcctgatcttgggttccctgccctctggaatcctgttagtaaatatccctcttttgtggggtgttgttttttttttttttttgagatggagtcttgctctgccactgaggctggactgcagcggcaccatctcggctcactgcaacctccgcctcttgggtccaagagattctcctggctcagcctcctgagtagctgggactacagccgtgcaccaccacacctggctaatttttgtatttttagtagagacggggtttcgctatgttggccaggcaggtctcaaactcctgacctcaggtgatctgcctgcctcggcctcccaaagtgttggggttacaggtgtgagccaccgcgcccagacccctctttcgttttaaagaaaagaataaggccaagcaggctaagggcacagccaggcagaggaacaaaaagctaggggtcgatggtggcaggcccaggaggggagtgggtgatacaaaaggagcaaggacatggtgcagttcacctctgcatgtccttcatccagcatggacccatgagtgcccctgatcactgtgtcctgaaccgaacaccgacaggctctctgggcatctcagcctccctagctccatccccgccaccaggatgatccagccactcacctgccacacagatgtcaaagtagtcaccaaactcacttcggatgtgcttcaccaggtccactgcgtagttgaagcctccctcctcctcttcccactggtcacctattgggtctgcagggttggtggaggtcatagtcactgggtctcacccaacctccagagaccctttctgttccctctacctagccccgacacccaggactgcgagtccctggaaggcagaaacttcatattatttaggtttggttcgtctctttctagcacttggtaagacagcaggagggaaaaaagcagcccaccagttcaatattcactgcatgctgaccctgtgctggcggtggagaataggagaccaccgctgcttctcaccgtgcctggaggattggagagcccttccctacttctacctgggcatgcctgccaccctctcccatcccacggccttggggctcctgcctcctgggagaattttctactcatctcaagtgaaggggtcttgtggtagggagcacgaggccataggatcccacccatcaggctccctcttcccactcttaggtggcctgacaacagcgggcaccagaggcctgaccggctattctcactcctggatactctgttactctgtgattgggccaagtgctgggtgcagccagcaatcgatgcagtggtgtaggcaaggcagagggttatcaggccgcgactgcattcctgacggaactcctatgtcgaggtcaagaggtggaagaggtggctgcctgtgtgtggtgcccaggatgactcactacccacaatgcctactgacactactggcggggatgggatcctgcggatcctcagcgtggggcccaggaagaagtaaaggaccatttcaggaaccaagttcaggctaccaagtggcctccgggaaagccagaacccagagtgtaggggagtgctggctccacacctccccgcagcgccatgatgttcttcaggcccagctgcttagctttgtgcagatggcccgtgatctcctccaggcgctgacggcagcaggtcatgtgcaggatggtctccaggccacagtagttcacggcggtgctggcgatcatcatggaggaggtctccttgtctgagccagggtcacctgctgggtgccaggtcacgtctatgtagagggggccacctgctgccatccggtcaaacctgtagggggtttgtttctgaagagaggttccaggagaaataccatccgtcactgccttcccatggggcccgggagttagagaagcatcaatgaaggttggagacagaccaatcagcgttcatatcctggctttgctacttatagctgtgtgatcttgggtacattacttaatctctgtgagttctgtttccttatttataagacacggcagatagtagtacccacttcataataacactaggatgctgggcgtggtggctcacgcctgtaatcccagcacttcaggaggctgaagtgagtggatcacttgaggtcaggagttccagaccgcctggccaacatagtgaaacctcatctctactaaaaatacaaaaattagctgggtgtggtggtgggcacctgtaatcccagctacttgagaggctgaggcaggagaattgcttgagccaggaggcagaggttgcaatgagccaagatcacaccactgcactccagcctgggccacagaatgagactctgtctcaaaaaaaaaaaaaaaaaaaaaaaagcaacaacaacaacaaaaaaccataacactaggagaatatgacggcagctggttccacagaacttagaacagtgcctggtgtacaaaccgaatactcagtatatgtgaggtgccgttataatcactattacagaggtaagacacaacaacagcgctatcattttgtgtgagagcagcacttcagacttttcacagcgcttgcctgtttattatctcaggtgagttaagacatcatgattgagagttaggggaatcctaactgtggcaagcacagcctcgctgtaggaacagttagaaagagggtcagcagactcactttctttcatgccaccccccaagccctgtgcagcagcttacagttatgcagaccaaggccaagttccgaaacgagactcaaaaaaaagcctggatgtgcacgagtacttgtgttacaagctatcaacggtgtatttaaacatccttgtgcatttaaacttcaaaaacttgggagtgacacgtgagacgtgcatacagtaaaaggcataaacttaaaaaaaaaactgcaattcatgaagtgctaatgtaattcagttggcatttctagagttcaagaagcataatccaaatttctaacttgctgaaaacaatctcactgctttgtgacttcctaaactgcactcgtgatccagcccccaagttccctcaaagaatacagtgtgagaatcaacatttttaacccattgaagagtgtgtctaaaataccttgacactgtggagggacttttacaggcaacagagaagttgcagatcagatgacccactctgccttctccttcctgccccctccggctgcttttttctgccgggttaaagggcagcccagcctcagggctgacagtttgctccccaggcaccaccactcccgcctcccaccttaaccttgcatgagtttaccttgagatgagattgacagctccctcagcagttcgaggagggaagaattccagggagaaccacttgtcaccagattccaatcgccgcctcatcttctcccggagtctctcatgccgctcggggtccaggcccggggtggaacatctcgaactatctttggagctctcactgccactgctggcactgccctccaagcaggggttgaggctgctgtttcctctggcttcgttcaccatggctgggttcctactgcacagggtggggcagggagcatcagggggcaggcagccacacccccgacacatcaagacacctgagtggcaggttcaagccggaggcgctgtatttccacacaggaagaaggccaaaaaaggtgacactgccccctcccagtggctccatgctcctcagctatggctgtccgggccgcctcactcaaagccttgccctccgctgctgccaggctccttgcatgcaaggcagcccccacccggcactgcaacatgctcctcggtgacagctacctgatggaaggtggcacagaggacctcacgctgccgacctgcgaggcccatattcctagcgaggggcagtagtgcccagctgggaggaccctggcttttcgatggtccatctctgtcagctcaggcccagagtgcgtggggagggaacagaggcaccttccccagcgggtgtgttcaactgggcggagctgcgacaaaggaagaggcttgagctccagccagcacaagggggcgggggcaaggcttccaggcgaggagggagggctgaggctctagtaaggggaggcggatggaaggagggggactcaggggcagagactgcaggggttggtggagatgaggccaacaggcgttcagggataccagatcaccctccagagaaggaacagctcactctggctggctctgcctggaacatctgttacttgaaacagttcgtgcacaggatggaaggggtgagggcttgactatgcagccagatttctcctgaattcatgctactccaaaaagaccgtgttgtgggttagaacttgatgctggccatgttccaaaaatagccagacccaagttcagtaagggcacgaatttctcagaacaaaagctgccccatctgtgcttgccttgcaggctgctcttcttacacatcacagaattcaattcaaatcatcacagtgacccagctactgggaaggctgaggcagaaggattgcctgagcccaggagttcaaggccagcctgggcaacatagcgagactccatctcttaaaaaaacaaaaaacacacctgtaatcccagcactttgggaggccgaggtgggtggatcacctgaggccaggagtttgagaccagcctggccaacatggtgaaatcccgactctactaaaaatataaaaattagccaggtttggtggcgggcgcctgtaatcccagctactctggaggctgaggcaggagaatcgcttgaacccggaaggcagaggttgcagtgaaccaagattgtgccatagcactccagcctgggcgacaaaagcaaaactccatctcaaaaaaaaaaacaaaaacaaaaaacagaaacaagtaatcagagccaccagggcacagacaggccaacagagggcatagggtcatctggcagtctggttaagaaaataagacaaacacttaaaaacaaacaaaacacttgcacagcaatgggcaaacacacagtagtgaatgggtgtgtggtgacatggcacaacagaggaaagcccaggtgaggttcatttctttcagactgtccaccactaaccctgtgtacctaaccatttggggtcttagactcttttgacaatctgattaaatgcactgctcccttcccctgaaatacacacacaggtgcacagactacacggggatacatccaaagacaaggagttgattccagactaagaaccctgggccaaagctttctccctctagggctgctctctttcattctgacctcaaactccagattctcagtggggatggctgtggggagtgaggaacgggggcgggggggaggagtaacagcaagagcagccagttggctttcctccagcgtttaagggcgcacctcgttaattgcttgctggaacagaacctagagtaggaggaagctgaaccacctgtaaaccctctgattttcaaagacttattgcattcctagtatatgccacgcatgtgccatatttgtaagccaactcccacgatttatccgttatcagctggactcccatagcaccctgggttgtaactgtgggtgaaaaggcctgtctcctttctctttccccagttccctgagacaggaccggtgtcctgcctggggtatccccagagtttggcacacggtgatagccaacattcactgagcgccaaagggccaggtgctgccactctctcaaaataagcctctgccacttactgaacaactagtctgcgccaagcactgggatactaagcctacgactcccagaaaggtcccggcggacccccgtgcgcagcgggacgcagtgggcgccagggaccgcagtgccccgggcccagcgctcttctccaggtgatcgccggggaggcaggtttaaaaggcaggagccggaagccgtctcggcgcccaggtggccgagaatccagtcaccaggtcactgagtcaccgatgggggcgaggacacgggcctgggccggtcagaggggcgggatcgtcacccctggctcaggggcccctccgtccaggcagggagccaaagtcagtcttcgcttgagggttggcggtcgctggaagtggtagccattgggagttacactaatcccgcgaagggtgcgcaagggaggcggcagccccccccaagaagagaggcaggccggcctccagcgctccccgcccacaagcacgtccttgcccccgggaggttgtttgccggctccaggatctccctcccggcgaccccggcctcgccgtcactcaccctccagtcccgggtgactcagaacgctcggccgccggccgcaccactgtggccgctgcaggggcggggaacgcagtgaaggggcgcggcgcaggtgtcaggttgctggagaggcgggcctacagggcggaaaccaccggcgcgggtgaccggaagccccgcccccaacatggccgtgcccacaggtctcgttggaggccgtgcctttatcgtcatgtgacgcgagtcctcgccccacccgtctgcagccactcctggtctcagtcccagagctcgagagggccacgtgaccgtcccggggccagtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctggtaagaagccggcggagtcggcctggggagggggcggttgctaagggactgagagaggcgttgccgggggtggggccgggccaatctgggcccgcaggtggcagcgggtggggcctggggaccgcagccagggctctcgaagcgtctaccctgcttcacgtgcctaagtctggggtcttttctcataacccctcctggaatctgagggagaatccaggccagctccagtaaatcccacccatgtttccttttatttccatctgaaaagagtttggaatgaaacaagcgttttcagaatgagcttcctcacaggactttgtgcttatcatgctgctgttttagcttctccagtcctttctcactctatccctcaccctttctgggtcactgacagtccagcttccccctgcaaagcatcctgggaaaacttgagttgtgttcccagagttgacaagtcctttctgatttcagatacgtcacactgtcaaatggaacctgcatttttaccccccttttcagctggcgttggacatctttgaggtgtcctgaagaggagggtggttatttggagactatcagtggaaatgaagagctcagctgatggctgtagatcctcacccacatggtccctcacccctgaaaggttttttttgagggctggttcctatttgataatggctccagatgatttagaagctagccactgatttcagtaaatacttctgcctccttccactcctaaccactaaaaaaggctccctctgcggatctgtttttctagaccatccttggagaaacacaggaggaggaggatgagattcttccaaggaaagactatgaggtgagctcctttgatactgcttgggcaactaaagtagtgagtggcctggtcacttcaggccgaagcattatgattccaaccagagatgctctttgaccttctgtcccagggagtgagtgggtaagagaacttccttctaggaaagagactgtttagcaagcccttttctcaccttaaccccaaaacaaggtctggtgtttttacacgtttataaatctgtggcaccttaacctggatagagtatgtatttgccattaaactgtttgcttttacagcttacagagagacttagagtgaaaggcactggcaggcagtatgtgcccctaacaggtgtgtgcttataaactgttaaggaggccttgcttctcttctaggagagcttgcttttcagatattttcttgctcaagcagcttctctctgacatgttcttgattaagttccacctttcatgtatgggattcttagagtatgtgtttttagtaaagccaacactgctggggtgaaacaacatgcgtgactttttatcattaaattcttaaacgtaataaagaaggtagagaaaagcctataactccattcattaaaagatgactgttaacaccttactaagtatctttctacatccttacccatgcttttatatacatgatacatgctttttttaagtaacaaaaatgagattccactaaatcatctattttaacctgtcccactcaccccctttattatactttttgtatcattaggtaattttccacaaccttttcttttttttgacagagtctcactcttccataaattcttcatgctgtagaatttagtgtcagcgttaggatttgtagcacttttttgtttaacttttattatgaaggatttcaactatatgcaaaaacagaataatctgttgaaaccccttgtcctcatcacacagcttccacagtgatttagctcaagcccagtcttcttttgtctgtgctttcgttatccacttctcctttctcatattattattttttattgtatgtgtgtgtgtgtttgtgtgtgtgtgtgtgtgtgtgtgtgtgtgtgtgtgtgtgtgttttaaagtaaagacagtctccctatgttgcccaggctgttctcgaactccttgacaccagcgatcctcccatgtcagcctcccaaagttctgggattacagtcatgatctaccatacctggccgcccttcccatgttattttgaaagaaattctgtacatcatattatttcacccataattctatatgcatctctaatggataaggacttttaaaaagcataacccaatactattaccacatctaaaaaattaggaatttcttgatatcaaatatctactgtccagattttccagttttcttgtaaatgtcatatgtattttaactttatttgaattaggttccaaaagtccttttttatttgtttgataaatctgttaaatctcttttaatctgtagcttcttccttcatcttttttttttttttgtaagttatttgacaacataattaggacctgggattttctactgtctagattttgccatttggagccgtttgtatagtttaatatgctactctgatgggactgctttgaatgaaccaaaaagcactgtatccactgctgtgttttgttctatttctttttttttcttttttttaaatttgagatggagtctcactcttagtgcccaggttggagtgcaatggctcgatctcagctcactgcaacctccaccccaccctaggttcaagcggttcttctgccccagcctcccgagtagatgggattacaggcgcccaccaccatgcccggctaatttttgtatttttagtagagatagggtttcaccatgttggccaggctggtctcgaactcctgacctcaggtgatactgcttcggtctcccagagtgctgggattacaggtatgagccactatacctggccattttcttctgtttcgtaagtatttgttttcttgtacatagttgagaagtttgcaggaattagtataagatactccatattgttctgtcaccttgcactccctcactgaaccctgttacatcatcctgactgtatcaccaggactgagactgtctcacagccttcatcctacttctaggagctcaccaaggcttccccattgacacccaggctccctcaccccttctactaaattgtacttacatttgtaatgtgcttgccttcagctgatatgcatattcatgtaaatttttgttgttcttgtcattgtttgagacagagtctcactctgtcgcccaggctggaatgcagtggtacggtcttggatcactgcgacctccacccccgcctctgagttcaagctgttctcctacctcagcctcccaagtagctgggactacatgcatacaccaccatgcctggctaagttttgtatttttagtagagatggggtttcaccatgttggtcaggctggtcttgaactcctgacctcaggtgatccacccacctcagcctcccaaagtactgggattacaagcgtgagccaccacgcgtggccatattcatgtacatttcatgggttaatgttcttttgatattggtcattgatatttctcaaccatcttcaagaatgagcttcttgagagcacttgctttgtgtaagaacaaattcaggcacttaaacagaaaagtctggattttatttattcaataaataaatcaacttgacacaaaaagtataataaagaggggagtgagtgggacaggttaaaatagttgatttagtggaatctcatttttgttatttaaaacacgtgttaaaagcatgtgtataaaaacgtgggtaaggatgtagaaggatatttagtaaggtattaatagtcatattttaatgaatggagttatagggttttctctaccttgatagtcagtcaactagaaaacccttctgttgaatatctttctaaaaagtgccccttcttcctgtctcaggaagagttcattgcacatatttgactctttatttgataaatttagggtcttacaaaatgttagaatcccattttgacatccattctcattataggtggtttgaaaaatggtaactttctgtgagatgtgccattgcaaacaggaatgttttcatgcaggtcacacagtctatttatattgtacctttgaattagaaagaggcacactcagaacgtaagacttagaattaaaggcctcccccactggccatagcagcacccctagctcacaaccagttgaaggtggttttggtgtgaacactaagatgccccttcctggttgaattggggctggttcagcccccacctccctcccggccaggtgccattttgctcgtaaccccctgtaacagccctgcaagacacagataacattttatttttttaaaaagttgttagtcccctaaaccaaagagcaacatatactgcagaaataaaaagttagtcatagcaaaggagaagtaacagtatctggttttaataatagctcatatattccattggtacatatttacaaagggccaaactcaactaatttatttaaaaaaaaaagaagcgtggcacagtggctcacgcctatatgctcagcactttgggaggccaaggcaggaggatcgcttaaagccaggagttcaagaccatcctgggcaataaagtgagactttgttcctacaaaaaaatttgttcaaaattagcagggggccgggtgcagtggcccacacctgttacccccacactttaggaggctgaggcaggtggatcacttgagcccaggacttcataccagcctgggcaacatggcgagactccatctcaacaacaaatacgaaaaaattaacgaggtgtggtggctaacctgtggtcccccctactcaggagatcgaagcaggtgaattgcttgagcccaggagacggaggttgcagagagctgtgatcacgccactgcactccagcctgggtgacagagcgagaccctgacaaaaaaaaaagggattctggtgttctagcgttgcggttgtttctaaatgcccttcttagcagttttattgcactataattggcatactattcagttcacccatgtagagtgtacaattcaatggggttttaaaaattagtatattcacagagttgtacaaccattcctacagtcaatttttttttttttttgagacggagtttcgctcttgttgcccaggcaagagtgcaatgttgtgatctcagctcactgcaacctctgcctcccgggttcaagtgattctcctgcctcagcctcccaagtagctgggattacaggcgtctgccaccacacccggctaattttgtatttttagtagagacgaggcttctccatgttggtcaggctggtcttgaactcctggcctcgggtgatccgcccgccttggcctcccaaagtgctgggattacagacgtgagccactgcgcccagctaattcctacagtcaattttagaatattttcatcacctgagaggaaaccctgcactcattagcagccactgcctgttctccttgcccctgactccaggcaaccagtgatctcctttctgtctatttgcctattctagatatctaaaaaccttctaaatgtttacggaaccatatcattattagatggaaccatcaatgaagtacttgaccagtaatttccatacatattttggatgaaggcaagggtattgtttctcctctgctctcaggcaccactcgcggaacactgctaacaccgatatgtggaggttgtttccccactactcaggaggctgaggtgggaggatggcttaagcccaggagttggaggttgcagtgaaccgagattatgccactgcactccatgctgggtgacagagaaagaccccatctcaaaaaaaaaaagtagtaggttgtcacctgcatttctcagcagctggcagtgaattgaaggttcacaggactccctccttgagtttggttaacttgctagagcgggtcagaaaacacagaaatgctacttacatttgctagtttattaataaaggatatcataaaggatacagaagaacagccagatggagagattcaaggaacgtgggagggggcacggagctttcatgccctctccaggcacgctaccctccaggaacctccaaacggttcagctgtctggaagctctctgaaccttgtcattttggagttttatggaagcttttttatgcagtcatgattgattacatcaccagcccttggtgatcagcttaaccttcagcttcggtctcctccctggagggatgggtgtcccaccccgctaatcctgccttggtctttctggtgaccagccccttttctgaagccatctaagggcccccagccgccactcatctcattagcaaacaaaagataccacggctcaaaaaaaaaaaaagacaaagtatgtttgtgtgtgtgtgtgtgtgtgtgtgtgtgtgtgtgtgtgtgtgtgtgtattgttggggctcagaaaatgatacctggaaatatggtgctttgatatgctgaactctccaccctcacactttgtctctcccaaagcacaggatgaggctcttctctgccgttcccttatctacctagaaactggacctaccagagaggaacacagttgtctttgatccctttcctgaaatgtcattaaccagggaacattaaaactcatcttacagaggagactgaagaccaaacaacatacctagagcctggacaaactgtcccaaccgttgtttgttcactgtcccatacaatttccaaagagaatcattcacaagatgatatctgcttcccagatccattcattccccactaagaattatttcctcccacatccctatctccccttcccctgtgaagaagagtatagaagcgtctgtacctcgctggcattattgggtaatcattctgcagttcccctgtgcaatgcatgttaaataagtggatgcctttgctcccattaatctgccttttgtcggttcactttcagcagacctttagagagtgaaaggggaagcttttcctcttggccgctacaatacatatgtaggtgcatatatgtttaatcacttatggatgagtctagtttctaaaagtacttttttcatcactgtgtttcttttctgatcagtaaaaaagattttttttttttttttgagaccgagtctcactctgtcgcctaggctggagtgcagtagcacaatctcggctcactgcagcctctgcctcctgggttcaagcgattctcctgcctcagccaccctagtagctgggattacaagtgtgtgccaccacacccacctaatttgtgtatttttggtagagacggggtttcgccatgttggccgggctggtctcaaactcttggcctcaagtgatccacctatctcggcctcccaaactgctggaattacagacgtgagccatcacgcccagccgatcattttttaaaatataaaaaagcacaccatttgtgctatgagaatttcagacaacacccagaaacaaatatctccttaagcactacctcacggatgttttcccattatgaatgctgacgtacaaataatcctaattttgtttaatcaaaaagggatattatacttttaattctccatcctgctttatttttattttttaattgcatcttgctcttttgctgaataatttttggagattttccatatctttctatatagacttaactataatcattttattggtgtatagtttactatatttggatgtataattgatttactcagtcacttgttggtactccaggactcataaaaaaagaatttggactaactctaggtagtcatatagatagaataaattgtcactcatcacatgtgtttggctgacttgaaactattgtctgggagtgtggctgccacccagccaatgtccagctgatgtgggtaggaacaggttgtgggaaggagagctgatggccgaccattatttttctttgttgccaaactgctgcgtcttttttttttttttttttgagagtgtctcactttgttgcccaggctggagtgcagtggcatgatcttggctggctcactgcaacctccgcctcctaggttcaagcagctctcctgccctagcctcccgagtagctgggattacaggcgtgctccaccactcccagctaacttgtatttttagtagagatggggtttcaccatcttgcctaggctggtctcgaacttctggcctcaagtgatcctcctgcctcagcctcccaaagtgctgggattacaggtgtgagccactgcacccagcccagactgctgcttctctaacaagacaactaaaatgatttcctttgaattgtttctctaaatgtctgtggcatacctgcaagttgcttgcaggatttctgtgttttgtgatgcatgttgtaaaggatgctgcttcagatgtagaagttttaggagccgagagccaagctgaatctgtgcctcttcctaacataaagtggaagttggccaggcgcagtggctcatgcctgtaatcccagcactttgggaggctgaggagggcggatcacgaggtcaggagatcgagaccatcctggctaacacggtgaaatcccgtctctactaaaaatacaaaaaaattagccgggcgtgttggcaggcgcctgtagtcccagctactcaggaggctgaggcaggagaatggtgtgaacccgggaggcggagcttgcagtgagctgagattgcgccactgcactccagcctgggcgacagagcgagactccgtctcaaaaaaaaaaaaaaaaaagtggaagttgcttttaaaaatactttccatgttagtttgtcttgtgactaacctcatttccatagacactaactacaaaagataattataactaattgacattctaaattaatttggttctggctaactgaaacttttgttcatatctaatggagtaagtttcataaggctgatgatagctgaaggtctttaaatattttgccaaaacaggaagtttaaaaataggtaatttaaaacttctcctaaagcatgaagtatgaacctaaagcaacaccactcaaattttaatgtgcatctgagtcatctggggctgcagggctgcaggagtctaagattctgcattttgtttttgtgtttgtttttgaaacggagtctcgctgtgtcacccaggctggagtgcagtggtgcgatctcggctcaccacaacctccacctcccaggttccagtgattctcctgcctcagcctccaaagtagctgggactacaggtgcgcgccaccatgcctggctaattttgtatttttagtagagacagggtttcaccatgttggctagactggtcttgaactcctgacctcaggtgatccacctgccttgacctcccaaagtgctgggattataggcatgagccaccgcacccagccagattctgcattttgaaccagctcctcctgggtgctgcaggtaccactgctctgcccatccacacgttgagtagcaggaacccagaggtttgtccctttgcaggtcttctcacctgacatgaccttttgactcaactttgcctcttttcagagtttggattatgatcgctgtatcaatgacccttacctggaagttttggagaccatggataataaggtgggtcttacaattcttcatctctggggatcaaatcagtcttaacatggcattttttttctcttctaaaggccccagtaaacatctttacaccttgttttttgaaccttttcatgcgatacaggcagacctcactttatgcgcttt

SEQ ID NO: 449 - DNA, 663542 bp, Homo sapiens
cttatcctaagtgtctcaagaggcaatctaagatattgccagaactcagccagccatcaagtaaagctatggccaaaaaaaaaaaaaaaatgcctattgcataccttctatttcagcaattaggcctctaagtattcatctaaggaaataatctaaatgtttatttaaaatgtgcacaaatagaagggtgctcgctgttgcaccagacatgtgatgaacctaagaccggatggaccatttgatggatctgctagacttgtggctaagggcatccagtgtctccttcctgagtttatatcatggggaaggaagtctgaatggtgaacagtggcatactgtgcagagctgtatcagatgagaagacgagaggccgtcctgtgtgctgcatggcctgacctggtgtgattcctacagagaaaggagcaggaggctaaaggggatgaggctgtttccaaacatgatttgggaactgctgctctagtcaccaaaatcccactttggggcccaggagggaaaggcatgttcccatcattttcttggacaggaagcaaggtgattgcaaaccaacaggggctacatcctgggaacaaggcactgcagaactctcaggataagtagttctggaacactgtaaacacagaatacagcccactggttggggcatcagaattcctgtgggggtgccccgagtagcagtcacagagaggggccttcgctaagctgctttcaatccaggtttgtgtgtgaggatgtgtcagtcacaaatggaagaagatgtttttatgactgtacatacgaatgtcctgggaacttctgaaataactagggggaagtttcttgtggggaagagtgagcagagcctctgtgtctgttgggagtggggaaagatggaaaagagccagccacactcagtttcttaatgtgacctaatctgaccccagaggcagatggcttagggagacttggggataatatttataatacggtaaatttggaaacagataaaatacccaacactagagcattggttaagtgaattatcacacatccatacaatgtgaggtggggctatgactcaataaatgtgtatactttctctgtatttcacagcctcactacattcattctcactgttaccccaagggaactgctagacctcagtgagcagaggcaatgctcagagaaattgactgccaaagtaaagacagaaatattcatgtttgcagaggctgccctctttttttttaacagcaagcaaagatgagaaatactatggtgaaggcaaattgggataggcaggggacccactatattgtgccttgggttaagaacttccctaggcatagactgaccacagaatttatgatcgaatgtgacagagggcgttagctggatgagtaactgggactcagagaaccttactttgcatggggctggttgatcctaggccactgttacaaacggatcattatgtaaccattaaagtgacagcataaaaacacacatcataaagtggaaaggttccactgtgacattactaacaatcacgttacaaaaaggcttgtactgtaggatcccattaaaataggaagaggcatagagaagaatgactggcgtgtagatgccaaaaagaatgattatttctgtattaactgtataaaaggttatttgaattctgtggttttccatctttctattaatggacatttattgcttgtaaaattaaagtttatattaaaatgtgaaagaaagttagttgacttaggaccaaaagtacagcttatatgtggcactagctgcttaattttgaaattcaatttctagaccacctttggaatcatcactacaattttactgtggactcaaatgatgattttctcaagggcatgatctgtatcttatttcatctctttacttttttggaggggttagaataacccagtttgtagctgtgatgtaggttagcatgtggctgccttcctgggtaaatcaaattgaaatattctactttgagtcttgattctctaatgcaaaattgatggaagtgccagagtggagtagacccaataatgatgacaactaatgtttatggaatggtttccatgtacctgtgtgccaggcactgttgtaggctctttgtgtgctttatttaattctcacaataatcatatgacataggaactcttaacatcccttgtttacagataagaaagctaagcagaaagatatgcagtgacttgtccaaggtaactgaaaatatgtaatctactcttgatctgccatggctttgatgaaactagcaagccactcttgagtttggcagaaaaatgacttaaaataattttcagtgcttcattatggttttagaaaatgatttttaaaaaactttaatatatacttttgataactcatttataagatccatacgtttggctgctcatcataatttacactgtgttctgatgttatacagaagagggcattaaaatgatagttcatagcccttatttaaccgccaggattggtaattttcattttgtcctttaatctattgggttggttgactcatttgttataaaaacttgataacattttagtaaatacatttttctgctttaaaatttataatagttgattattatgattagtatttacagttgctaacttgaagaacaaacataaactaggcaaatacagggaaaatattatttcacattctttgactttattggctgcagagatgggaaaacagccctacaggtgcacctttgtccacctgtggggcttaaacatccagctcccatgagctctttattgaggccatcagaaacacaggcctgtgactatgattccttttaatgtgtctttgggctccaaaccataagacttctctccaatcactctgtcacttaactctaaatcccacttataccatttcataaatttagtttctctgaggatcctcctcctcctctgcaggaggaccaatttaaatcatccttaaatcatcacattaaacactagctatcattggctgcaagggaaccaagaagtatattataccaagtcttaaaatgctgtccatgcctttttaattttaccataaaatcagagatagctatttgatcaggaaggatttaatgagtttaccttttaaactaatggactataatgggctccttaaattttgcatgtaaaaacccatgggttgggaaactttcaatttctccttaataactcatcactataaatcagattcctttaatatactatgcatcaacattgcaatgagctcagaaggatctggtaccattttcttcctgatgtctcagccacaaggaaaggctggtttttttctgaaaggtagtactcaaagcaatttcattttatttccctctacagaagatatcagatatttaattaagcactcccataaaagatctacccttaggtatttcagaatgacctgttccttgaggatttccttggtttctctcttgctagaaaagaaattaaaagacatagatcgtagggtttgtcatggtacattcagcatatattttgtaatttttttttatagccagtagttaaatattaacagtagaatgcatttattggatcatttctcctccaactaaaatataacactaatgattataatgatgatgacattacaacatccataatgatgatgacaatgctattataaaataacgttaacttgatccttctccaaagctttgcatttctctagatttctaaaataagaacaaaaaagacaataaaacacaagtgattcaaaggacagtataatgtaaataacaatgctttctgaagattccaagtttagaaaaagccatgaaaagaaattccaagtttagaaatagccatgaaaagaaattgcttcctgaattacatagtaaatcacaatctgatgcctaaaggcttttgacagtgaaaggtctacacattgccaaatattgggatgaaagcttcatgttttcaaatacccagtatcaaacaaaacaaggatattcccaattcatctggagttggcaccatggtaagtcacaaatgatctggtttaacttcttaaacaaatgatgaatttattgtttcatttcatggacctacaagccatagtcaaagggagaaacagaaattgtccagcttcttttccatcaacctaactaacatggcaattcacatagcaaagtggatttgcagtgacaagagaggaagccaatttacatgtatgggtggaatgggagtggtgatacagccttcttggtctgggggatggagaagggaaagaaaaatgcactttcaggtagagcactcccaggatgtgttcacttcagctaaaaattcatcaattaccctgccacagagaataccaagattatagtacagcatataattaaagaaggtggaggcgcagaggccctggcagagactgtgtctgtctatcttgctttgaatgtgtgttctacacagcagcacatgtagcttgctggagtctgggcacctggagagaagggtgggtgggagccaccgctgacagagagtcattcactgaacacgcaaactagctaaaagaaattaatgttaacaccaatcacaagattaaatacacaacatttgatgcaagatcaacagcgggatgatggtatagcttctgaaaacaggtggagttgaccttaaagaaatcagatcagcaacgacagacaagaagaacagaagagacaaagggcagaagaaacagaaggaaagaaaaagataaagcaaaaaaagaaaaaaatgagaaggaataaagaaaatatgatctctagaagatgacatctatacttctacaagacgatgcatcaactctagggaaatttagggcttatatgaaatatagaaatttgactcaaagtgactggaagatgctgagtctatttttcacacagctccagaatgagcagtaagtatctgcaaagttatgaagagaggccaagtcttgcttgtgtctaccttagttatcaaagggcagaaaagggacctctgtggcctggatgctgttgctggttgaaatgtgcattgctggagccaattttaaaatccaagtagcaagttcatggttccttggctactgcctgcatacctacattgcccagctgactggaccaccaggacccaccgtattcccctctcccccttgccatctggccttttcatgattttttttcttttaaattaagttcctatgctatttcatggcaggaagttttgtgtgatgtatctatgccagctctgaagtcagactgttcacaactcagtttcaccatttcaatcagatagttatgtgaccaagggcaggttactggtcctctctgaggtcctaggtaggaataacaacacattccacagaggaggagctgtttgctcattttgctttcacatactagaaatgttcacaattattctccatcctacaccatgtgttgagtactatctgtgggttacagcatcatgtaaaaagttaggcagagaaaaaaggacccccttttgttgatggactctaccaaaaaaaaagtgggagacaaagggaaagctgatggccaagaattaagaaagttcctgtaagaaaattcaacacttgcctgggggtgctgtgtgttgactttccatagcatgaggcctggttcaagggacctgaatgtcatgttccattgagagcttatatatatatggaagaacttatatatatatatatatataagttagtttatatatatatatacgtatatgtatatatatgtatatatatatatgtatatatatgtgtatatatatatgtatatatatgtatgtatatatatatatatatatatatatatatatatatatatatatatatggaagaactaggttgtcctttgagggctgggtccttctgctcctcattagctcagaatgcacctccctattctccttatttaaaactgtattaaactgacaattctacttgattgagatcctgatctcccttgtggcatttaggccttaatgtatggcactacagttaagtatcatcaactcccagcccactagtgtgaaatccaagaatcaaagtccatcatcagcaggaaagacattgactgaactgtatatattcccagagaggatcttctcatccttaaacccttccttggtttttctcatcctctcacgaagctttatctgccattcctaggttgatgaatcctcaaagtaagccccacaggaacctcatgtaccaaactgaaccctttatctctctctccaatctcctctgttgtggaggatccagaaactagggtataatcctccttctctaagacatggagacctccttctcacccaacactcccacctgaagcaggccctcaatcctgtagattctccctttttaacattcctcaaacatgtgtcccactgcaactaattataacttttttctttattgtaagctggcttctcagattctaggatagctcaatataacatccccataacaaatatttatcgagttgtccactaggtaccagaaatatgcaggtggataagtaaagagccattgcaatgctgctaggacatgagtatatgatgctattgggcatgcacaggagggatatctaacctagtctttgatagctcagagaaggcctcctggaggtagtggcaatcatcccgcctttgaaggctgagtgcaggtgtgttagccaggtatagcatcagttgatgtttcctgggccaacatcaattacctatctttgggaaagagtatcttgacttacgaggaacctcttcccctaccctacaagtcactgttcctgtgatttggttggagctgactccaatacagcacctccactcctcctgctttccaggtgggaatgtaatgcaggtttggccattcggtgcattccaaccccatggcctcagtgactgtttcagagatgagcccatgactctatcagagtcaatatcaggacttttgctgggaggtgcttagtttccacggacatgactgcgagcccaagatgtaggtctagaaatgttggccattattttgctaccctgtactgagagtctgcctgagaacagagcagagagatggacagaaaaagacacctgattctgatgacaccacctgggttcatgaacgcagctatgcagggagctacttctgagtaaatacactgccagaaccagtgtgagttaggttttctgccatttgtaactaacaaagttcttactaatgcattaaggaggaaaagagtattctaggaggagggaatcatacatgtaaaagctcagagaccaagaaactttgacccattctatgtacaaagttctatgtgaccagagagtaggagagaagagtcacttggagaagaagctagaaaagttaagagccaggcttttccagtagaatgttgctctgccagagtcaatgtcataaaatgcaaatgtgatcatgcaattcctctcccctgcttaaaatactttaatgagaccccaaaggttttaggatgaagttcaaacccattagcttggcacccaaggcttttgatgacctggctgttccttctctctctggactcatctcccacatctctcccatgggcaacctgtgctccagctaaattaaactacttgtagttttccaaacagggcatgctgtttcatgcctttgtgccttcatattgcaatgcattatataatttaatcctcacaagggcccccatgaagtgcatattattatcctgatgttcccagaagtatagagaagttgaggagcctcaaaaatcatacagccagcaagacagagatctaggatttgaacacatatgtctgacaccaaagctctccttctttcttttctactaccactcattccagttcttttaacttctggtcatggacctttatgttgcacagcctggtcttttaatggaatcaataaaatttcagaatttcaggagtgggggctggagggatgcataatgttcaatttaaagctactttgctactaaaatcaacacaactgcatcttctttcagtccaccttttttttagcatctccttcatgccaggcactgtgtggagagatggtgctacagaggtaaactaatccagctacagtccttgccttcatgggctttcagcaaagtaatctactcctcacacttaattctcctgagaaggcttcctggatacacttgagaatgaactccactttggttatacagacacatggaactccatcactgctgttgctgagaaaatatcaatggctacattattttcaactgctgcctatgagttatatcagagattaattgatcagctaaatgagaaaatgcagagaatacacaaggaataaatcgatgaaggaaaaagtgtgctgtgtcttctatacctgggatcaattgtgttacagctcactcagagaggcaccagattgccaaacagcctgcttgcaaggggtcacaaatagggcaaatcaccagcttaacaacatgtgaaattttcattgtcttatttataaccaatttctcactaaagtgaacaacatttcttaatggtacagttctgcagaagaacaaactagaaatgttttctttccttctaattgggacaaaactgatcatcacctaatgggctctttacagagaataaaagaaactaaactaaaaaaaatgctcagcacgaattggacgctaaggattaaatgaaaataaaaggacagttttgtttcatttttacctcagatctttaaaggtactgttagaaaaatctaataattgttttataactcttatttggtagaaaaagctaattattattaaaaattttaataaaaatgagaaaggattgtcgagaagtgaaaaattaaaagggagatttccaatgttgaaaaagcaccttttatgaacataaaaatctatcagtctgtcctcccctaaccatatttggataggatctgacacattaaaagctggacgttagcccagttagcctgagtgagaagtgattcaggagacaccagacataaaccaaatggctggccccacaaccagtgggtaaaagatgcttgctgtccagcagggtctgcagagccaagtggtcacagtgcccagagaagcccccttgggcaggcgacccctacaaacctcagcttctactcctgggcagaggcttttacagtcctgaaaatgctatgctacagaagagacattctgcgagtgaaaaaagccattattccacccaggaaaaagatgatttttttttcccataaccgcagtggccatcaaaaaatggattcatttttcttgtgctgtactctgggcccataaaatagtttcaggatctcaaaaagacgatgtcgtagatggaagttttgttgcaatgagccagccagaagtgagaatgactttaaaagactgaatttttaaaatgctctaaacccaaagattaagaaaatataaaatattacagataggtcactccttttgtgttgtgtgagttaatcatgtttattcaatgggtcccactttaaatgcagtatgtcaaatcctaaaatattattcttagttcttttaaaattacatgacatattctcttatcaacataggccaataaaatacaaacaggcataattggtgcaagacaacccttaacagctagtccaggttaatccactggcatggattagattatgaaaggtttaaataactaatttcaaagtcttacatatacatcagggatttcatttgactaagcttagtgattatttgagtgttaaccagagtaagttgagaggctataaaacccatgccaaatcacattcaataacatgagacctagggaggtctaactggaactgcagaattgacgtgaaaaaaatactaaggaatattttcattatagatttatgaatgtgaagtggattgggatagattttttttttaagctaagggtgaaaaaatagagatttagtgaaaataagttagggcaaaatggcaccttgtgatttagaattgtatgttttgcatctcatacccctacagaggctggctgtgccttagacacagtagtgatttgcttcttttgggggcagtggtcttcaacatttttggcaccaaggaccagtttcgtggaagataatttttccatggactttgttggggggtggggaatggtttcaggatgaaactgttccacctcagatcatcaggcattagattcttataaggagtgcacaacctagatccctcacatgtgaaggtcacaataaagtttgcactcctataagaatctaatgctggccaggcacggtggctcacgcctgtaatcccagcattttgggaggccgaggcgggcagatcagaaggtcagcagatcaagaccatcctggttaacacggtgaaacatcatctctactaaaagtacaaaaaaaaaaaaaattagccgggcatggtggcaggcacctgtagtcccagctactctggaggctgaggcaggagaatggcgtgaacctgggaggcggagtttgcagtaatccaagattgtgccactgcactccagcctgggtgatagagcgagactccgtctcaaaaaaaaaaaaaaaaaaaaaaaatctaatgctgccacttatctgacaggaggcagaggagctcaggcagtaatgctctctcacccactggcccactgctcacctcctgctgtgcagcctggtttctaacagcccacagagagataacaggtctgtggcctgggggttggggacccctgttttgggggatagttaattctagtctaaaattcatcttcaatagttgaggaagtaactttgccaatgtgacaaagtaaggtaggggatacaaagttctaaaatcaagatttcctgaccaccaggtgttatgttttttactaatcttttctaaaaaattttacgaatttagggggtacaagtgcagttgtgttacatggataaattgtgtagtggaagtctgaactttcagtgtagccatcacctgaagagtgtacattgtatccattatgtaatttctcatccttcacccctctctcactctcccaccattttgggtcttcaatgattattatcacacactttaggtccatgtgtacacattatttagttcccacttacaagtgagaaattgtggtattcgacgttctgtttctgtttctgagttatttctcttaggataatggcctccagttccatccatgtttctgcaaaagatatgatttcattccttttaatagccactagtattccattgtgtgtatataccacgttttctttatccactcatccactgatggacacttagggttgtgaatagtgctgatataaacatataagtgcaggtatctttttatatgatgatttattttctttaaggtagatacccagtagtggaattgctgggtcaaatggtagttctacttttagttctttgagaactgtccataccattttccatagagtctgtagtgacctactttcccacaaatagtataaaaatgctctcttttctctgcatctcaccaacatttgtttttgtttttggtttttgtctttttaataatagtcatctgatgaatataagataatatctcattgtggttttaatttgcatttctccagtaattaatgtttagcatttttttcattgcttttggccatttgtatgtcttcttttgaaaaatatctattcctgtcctttgcccactttttaatggggttatttgtggatttttgttgctgttgttgagttccttgtaaattctggatattcattccatgtcgtagtcacaatttgcaaatattttctcccattctgcaggttgtctcttcactcgtttatttcctttgctgtggagaagctgtttagttttattaagtcccatctgtcaacttttgtttttgttgcttgtgattttgaggtcttaatcgagaattatttgagtagaccaatgttcaaaagaggtttccctaggttttattctagttattttaatagtttcagatattacatttaaggctttgattcatcattattaatttttatatgtggtgagagacaggggtccaatttcattcttctgcatatggcaatccaattttcccagcaccatttattgaaaatggtattcttagtgtatgtttctgtcaactttgtcaaaaatcagttggctgtaggtgtgtggcttcatttctgggttctctattctgtttctttgacctatgtgtctatttttatagaagtgccatgctgtattggttattattgcctcaaagtataatttgaggtcaggtaatgtgatgtctaactttgctctttttgcttagaattgctttggctattcaggctcttttggttccatattacttttaggatttttttttcccaattctgtgaaaaatgacattggtattttgatagggattacactgaatatacagattgctttaggcagtatagtcattttaacaatattaagtcttctgatccatgtgcatggaatatttttccatttgtttgtgtcatctacaatttccttaatcactgttttgtaattttcctcatagagatctttcatctctttggttaaacgtattcccagggttcttttgtttgttttgtttttttgcagttcatttaaatgggattgacttgtggatttggttctcagcttgttattggtgtataaaaatgccactgatttttgtattttgattttgtatcctgaaactttactaaatttatttattaaatctaagagtttttggagacatcgttagggttttctaggcataagatcatatcatcagtgaacagaggtaatgggctttaatattaagaagttgggcaaaggggttcaccaagataagttctccttctataccttctactctttcttatggagaagagacagagccatattttcatgaactttcttgcatgttgactcataattgttttcccctttcacatgtataaaatatatctgtttcttaagtaaaagcaaaatttcttgtccttcccatatgcttctctgaaccctttctatagtgctttgtgcatggcttttgaatatagtaggaaatagaacaggatagtgtttaagaggtcagactacttgggaatccaatgtcagctttaccacttattaactaactggacttgaataagttagttaactcctctgtgcctcagtatctccacctgtaaaatggttacaataatacaattatcttataaggttacagggagaattaaatgaattattcctgaagctcttaaaacaacatctggcatgtggtaagcactacgtatgataaattaagataaaatgcttgctgaatgaccaaatgtttctttgcacctacaataattaatattactcattaattgatgaggtttccttaacaaagacatggtttgtgtctttgctaaactgtgaaaaactctatctcttctttgagataagcagaaagataaataatagctatgacacatatacctatcttgtaagttgctttgtaattatttattacttgctgaaaaactcaagtgggcaaggggaagaacaaggcagtcatgttaacatctaaaccttattaaagtttcatcttcttttaaagtccaggaagacaaatgagctaccagaggaattttctttcctctgtaaggcttatacacgaatttgaacataactattaaagtaaattaaatgggatttagtaaatggccaaataacactgtggtgggagccaagggagcagacagaagcaaactatcaagtttgggtatgaatttcaatgtctaagatgaagttagacctagtctaacttcaagactcctacgtggtggctcatgcctgtaatcccaacactttgagagaccaaggcaggagaacagctggaggccaggagttcaagatcagcctgggaaatacagtgagacccccttctctaccaaaacaaaacaaaacaaaacaaaacaaaacaaaacaaaacaaaattagctgcacatagtggtgtgcacctgtaaacccaatttgatggtatctggaggcaaacagtggagcccctgtgcagagcactctccctttctaccatgtgaggacacagcaagcaagaaggcagaactctgcagaccagaagcaagctctcccacaacacagaatctgccagcacgttgattttggatttcgcagcctccacaactatgagaaaaaaatgtttattgtttacaccacatagtctatggtattttattatgtaagcccaaaataagacagaggcaatgaaaaaaaaaatcacacaaaacacttttcttgctctaacactatgactgtttgatgcagaatattctcaaaatttacaattaaactagataatttctggctctttatgcagatgtgattggctttgcttgatttgtgttacctgagttaacaaataaaaggttaaaaaaccctaaaaatatactgttaaaattgttcatatttcagaatctgaaaagtattttgggagtacaatttaagaaaattaaatataaaatattatgattctcaggagaagctatgtacagagttgaataaagccacagctgccttcttcatctaggtgagaacagttctttagggtctaggagcaagcatagcaaagctctgtggaactctgcctcatggtcatcaatagatgtgctctctataatacaggggtaaatcaaactcagtatgatttgcctcatttctttacttctctcagtgttgtcttctcttctgccccatgtccttttcctattattggtcactatgctgactttgtgacatgtcaacttggctacagtaaactacattttctctgaattccctttgttgtatatttcagattagggtgagccacaagaaaaattcttcagagatacgagtcgtgggcgtaaaacagcagctgttgtgtagctcacacaagttcttgctaatctgctggtttttaaactcgtgatctgacttgtctgagagcatgccttgtggacttcaagccccagcatgagatccagtgataacagccttgcagagactacttccaacctccacaattgtataagccaggtccccgtaacaaatctcatactggttctgcttccctggttgaaatttgaatacagtcactctattgaccaggacgaccctgttgcagtacatggttgtctgcagtcacctggctggtagattcctccaaatctagggggaaggactaaagggcccccaagaggctatagtgatgatgtgataattaattttatgtgtcaacttgagtgggctgaaggatgcccagaaaggtggtaaaacattatttgggagggtatctatgaaggtgtttcaagaagaaattagcatcaaaatctgtagacagagtaaagaagatctgccctccccagtgtgggtaggcatcattccatcacttgatggtgcagaaaaggtaaaaaggtggaagaagggcaaattctctctctttttcagctgagacatccaccttctgcagaaaggcataggagctcccggctctcaagccttcagactctggaacttttaccagtggcctcccagttctcaggactgtggacttgatctgaattacaccactggctttcctggttttccagctgcagatggcagatcatgggacttattcccatgtgagccaattcccatattaaacctcctctcctgcctctctatatatcctatagtttctgtttttctgaagaatcctgactataccaacaacttggaaacttagaagtaacaggtaataacaatgatgctgcggatacaaacatgacaggtacacagcatgtactaaatgtagggtcccagtactacagactcatttttttctcaccaaccaccctataaaataggtactgttattttatctccctctatactctgaggcacacatagctgaaataactcgccagtaagtagaaagccaaaattaaactcaggtactctggctccagaatctgtgctcttcaatactattgcaccattccaaatcaacctaaatgtaatgctttccatcctctggctaccctgacttttagaaatttttcacaacagaaaaatagtgtgctagcctgtgacagtgcagccaggaaacttctgttctggtcctgatttcaccactgactggctgttgttaaagcaaactaagtatggcctgagaaggaccgcatacttctgtatctgagtgattgtggatgaactgtaacctagcttaacaggcagactaataggcctaataacaggcgaatagactaataggccaagctctaaccaatccagccatctgttcctcacttccaatttctgtacgtcacttccctttttttttcccttctaccatgtggctgcgctggagtctctgtgaatctgctgtgatagtgggggctgcccgattcgtgaatcattcattgttcaattaaacacctttaaatttaacctgggtgaagcttttcttttatcactgtgtagcattgggcaggtcaggctaacttccttacttgtaaaatgatctcagtgccttcttccagctataaaagttcacaattctatggtgttaaagttctgattatgatgttaaaagatccttggaaaaaagctgctctgtacaataaaattaggtaataaaacctacaactgtatatttgacttccttgcatttatttttcagcctcttcctacctcaaaaattattctgtagctccctaggtaattataatagtgattttttaccctttccaattgtgaggaccctgttaatcacacacatgcaaaaagagttgtgaaattccatagaagaaaaatataaaattgtaagttgagaaaaaatacgatagaaagacatgttacacttgataatgcttttaagtaaagttaaatttcactaattataacaacatctagagacatttgaaaaagagtgcatattcaccgtacaggaaaaactttatggagttactgacctacaggattcttaacagttacctcttggttctcagttcccactcagggcgctcctcactggtaatcacctattacaattgtatgcaacttgttaaatgtaactatgctaaaaatcaatatatgctgaaagccaaaaggaggactgttttatatgccacagctttattttctttagactttactgcctatttttgtgttgttttgtttgtttctttcatggtttttaaattgacagatttttggtaagtattataaaagtttctgatctggagaagtatcactcctctttgtttttcttttcttttcttttttttgtgtgtgggtgtgtgtatcttcattgtcatttagcgaaagttcccctaattgttaaaaagccaagagtaagcatcaagttagagacagggaaaaagtacagagtgaaaagcaattttaaaaattgcataatcagtctaagaagagtagaactggccacttttaaaggccaaagtccaaacaaggtctttaagaatttggtaacaccaatggcactcaccagatgggttaaggcaacactgcaatgggaaaggtgacaactgctcagtagaaggcagacatcatgtaaacagtcgtactagctgttttcttgtgtctgagtctatgcctagaaggggtttactttttccacaaaaggggaaacatactatgatacccctgaatatacatcctagaactcactgcttaaagaacacatagaaaaaaacaaggtcatgcaaccatccctaggaagttaccaaaattcattcttagttcccatctgggggcaaccctgatgagatactgcaagggaagaaaagaagattaaaggtaaacaggcgtagttcaatatcaacactttaggcaaatctttcctgattatcctctactttttttttttttttttttttgagacagaatctcgctttgttgcccaggctggagtgcagtggaacgatctcggctcactgcaagctccgcctcccgggttcacgccattctcctgcctcagcctcccgagcagctgggactacaggcacctgccaccacgcgtggctaatatttttgtatttttagtagagacggggtttcaccgtgttagccaggatggtctcgatcttctgacctcatgatctgcccgctgcggcctcccaaagtgctgggattatcctctacttctaactctcaaccacgagctgaaacaccctcactttttctatattttgccacacttcagttatacacaaccatggtttgcactataaatatatggtacctctctgtctctcccattagaccatgagtgagggtagaggaactgggtctcattcattgatctgttcctagttcctagcacggtgtctaacatatgggaactgctcagtgaatgggaaatggaattaaatatatctattagtttgctctagagatccaaatttcaggtaggaatccaagggaaatttttccaagtatgcataacaattatcaaactttgtgtttctcacggattgttgataactgcctttaattgtatttaaagataggtagtattcttttgaaatgtcagaaaaggcaatggcaaaaagccttcaatttggctgtgatcccaattaaaattcttcaacccaaaagaaatagctttgatctgatcaaaatgtatgagtttctttttttgtcaccataatttaaagacagaaaaatggtatttaggatttacatatacatgtggaggccaacctcattatgatgattgtactgagaagccaggaagttctgaatcataaatgtattttcagaaaagaattgtattttcagagggggaaaaaaaagagctacaacaatagctctaatttaactggagatgttcactacacaatccccgaagagcaggataaattgtcgagagcatcagcagactgtctattcatttggcatattagcatgaaagggggctttttgcccagtggagcccaacctcttctctacaggatcttgcttttgagatctttgaaacaagtatttcaaatacagcatactgagatttgctctaatcttaactatggcattagaaaagtcattataactttatgcataagttgttggtgtatggccaagtcagaaatcttgccctgaggaccaacatctacataataagagaaaatagatacgtgtgcagccaattattagatacctctggtgatggcaactagaaactacgtgaagtcatggataattcaacataataacaatcactatatggaaaaatgttcctggctcatgcctgtaatcccagcaattttggagatccaggcaggtggatcacttgaggtcaggagtttgagaccagcctggccagcagggtgaaaccccatctctactaaaaatacaaaaactagcctgacttagtggcgggtacctgtaatcccagctactggggaggctgaggcacgagaattgcttgaacctggaggtggaggttgcagtgagtagagatcacgtcattgcactccagcttgggtgagagagtgagactctgtctcgaacaaagaaaattttgtaaaaaagtaaacgatgaccccacactaaaactatgaaaatcaaagttaaagaaaaaaaaccttttaaatcaatttattttaccttaatttattaaaacatgtacatttgttagacatttatgaaagacctatttggtgccagacaagggtgatcatctctaagactcataaacaagaagttgtaaatgttacctaatgtgatgtgccatctctaatgccctctggaacccatttgagtgtggagaactctgtggctgtctacacaacatccatttcacctcttgtatgtgaatatataaaagtcataggattggtcactactgattccctcttcacaggtagctgccctaatttgtcttatctaattaaggttatgttatcccctttgtcaaagtgattgggaaatatatcccagggataaaccaatcagtacatggcttttttcccagctacaagagattggttcagggaagagtatttaattgattttaggtccatgaaggtatctgggaagtgaaggctccctgggagcttttgtaaaggatagttctgcatttctcaggaactcatgtgagaaatttcttgggtgatatgttaagtagatttgtagattggattgatgacagccatttatccaccttgaaacaagccatcttaagaatgatgttaactcatggaaagagaaaagccaagaaaactacacagaaagatggagcctgagccttcaccaaattgcagcacaagctcaacctatgtctagacttctctgaacatacggcagcttgagccgagtttttgttaccggcagccagggcatcttaattattataactgtaacaggaactgtggcatcagagctgatttctgaaaggaaaataggatttagacaggtgaatggtaggtatgggaattgagagagccctttctgggacaggaaattatgggagcaaaagcaaaggggtaggaaaacacacggtatgttcaggggcgagtctatcacaccggatgagaggtggaaggtgaagctgacagtaggttgggggtggtgggggactttactgacccttctggaaaactaactagtggtggaatgggagttggagcagaggaggagaagcagatacaggtggttgttaccatcatctgggccagtgctcacaaggacccttgctcacaccttggcagtgaagatggagtagagaggatgagttcaaaggccatgccaatgacaagctacacatgatgtggtgtcgcacttcatgagaagcaaagagagtaagaaatggactatgaagtttaagtctggggacatctggtaaaggctggtgccgttaatcaggaatgataattcaggcaaaagagttaaactaccttaaataatattttttttctttttttttttttttccttgagacagagtcccgctctgtcgcccaggctggagtgcagtggtgcgatctcagctcactgtaacgtctgcctcccagatgcaaatggctctcctgcctcagcctcccaagtaactgggattacaggcgctcgccaccatgcccggctaatttttgtgtttttagcagagatggggtttcaccatgttggccaggctggtcaggaactcctgacctgaagtgatctgcccgccttggcttcccaaaatgctgagattacaggcatgagccactgcacccagactggaatattttctatataatttctttaaaaagtcatagaaacaacctaaatccaaactaacaaggagctgaatgactggataaattatggtacatttcctgaatgagtgaaatactctgtagtgagacattaacattttcccatgtgtgactcacttgtctgataatatttccatgccagacacacccccataataaaggttcctcactccatgtggctgcacaagggggtgggttacacgtttatttttcaacaccatctctttctttctccaccacaaataggtcccttggcactacacagttgaaaactattgtttgggaggatgtcaagaaaaattctttagacttggagaaaaatataaccaaaagaaactgttatctgagtattgaaaatttagaagactacatacacatggaaaaaaaagatacacacaaatgtgcttacagtaattacttctgagtggtaggatctagagtatttttttcttttacttttttatagtttctatttactttctaaaatgcatatgtatcaactttataattttacaaggacatcaattatattgggttcttcagaagcagataatgaaatgagggtttgtgtgaaaatgatttatgaggcagggaataatttttaccagcttcctcatttgtttaatagtgatgatgtgaaaaagaaaccagtgagtgagtagggaagtgagaatcatcaagggaagagccccagcaaaggtgtcctattaagcaaagtcccactgagggtaacttgagatcaacttctgctgacctatagaagctggggaatttactggccctcctctagtcagtcactattagagagctgcccccataaatacgtcaatgcccaggaacttctggttcttcttgcaggtaggaaaatgtggggacagagaggctgcccaaagagacacaggtgctggctgctaggagtaggcatgggcatggtaaagggatctgagggaatatgcacggaacaacgaccgcatttgctggagatgcttacaaaatcttactgctgtaattaataaatatggaaacctctgtttactaactgtgttcattcatattaaaaacatttacttaaaagaaagaggactaaatagtaatacattgttggccagcacttcttactgggaaaggagatttgaagagtcttacttttgtaaacgctttcctaagtgctacctgcaccttaaatgtcacaccttatattgctttatgttctcagagttcacattctaaaactcatacgttaggaattaggaccagtggatagaaaaacttgatgacccctggggacaccaaatgttgattgctgcttgttgttacagaggcaagacaactgaagtttggggagaaaaatctcccttcctgacagcaacatgccagaccattaagaacttttgcaaaaatcaatattggtctgaattattcaactggtgtgcaacaggatatagtggaatgtaaactattgggcttccaccaaagatttgtggctggcatccactataaatacacaaagtaactactctctagggaggaaaacagcgagaggagcaggaaatgccaggtttcagaaaattagccaaccaagttcacccagcataaatgctgatgcactgccatatttgctaatataaagggtggaccctctgatacattacatgttgagaagatcctcagcttcttgccatgtttcaacgtggactaaacaaagctattctatcctctgagcttttaagctcccttttcaataaataaatcacaaactaaacattttgaaagtcatctctttctcctgtccctgagagtccagtcataggtctacacagatggctgtcaaggtggtatgatttgaggtgtgctgggaaagtcctgtttgtccccaaatatctcccctctattggcctgtcagtcatgaggaatcaatcaagatagggcatttcaggaatcagaggatacagtagagaacaaaggttctgaccctggtggaatttatgaacagatttcaggagtcctggtttcccaaaaattatttgagaaataccatgtgtatacacatgagtgcatttccaggttagagaatccagggctttcatggtattttcagagtaatccatgacccatgaatggttaaggatctcaggactgagtcaggagatctggttctctatgcctgtctggctactggctggccatgtcatctcagaccgagactctccctgcacttgcttcagattcctgcatttttgaagactgcctggttaaagtcttggtgctccaccatgtctctgtgtgtaaagggccccctttccaagactgctgaggaaaatggccaaatgcttcttttgtacctgcttcctatggatccccctcagctcagggaatagtaatactttaagacagcattactggagaaaggtagaggaaaggggaataacagagaatgttagagaaagaagggggagagaggtgagaaagagggagagagaaatgcctctcactgatataggggtgtctgtgaggcaaagtcaaaacaccattgacaaaggtggtcttaggatcagtcccttgccccagcccccgcccattcattccctctcacttccaagtacagctgcaacattcaaatgtttgaaaattcattttttagaggttttcaattgaacaaggacaggaggagaggaattacttatgcgtgtatattcatgtttagtttttactttttaaattatgaaaccatcgtgtcttccaacaagtaataaagtacaagggaataattttttactggcttcctcatttgtttaatagtgatgatatgaaaaaaaatgaccttttaaaaacacttaaacggttaacttttgatctcaagtcttctccccacagcttaatttattaaaactaaacacatcttgacattataaattaggaaagttgagagggcagtacactataattagaagcctgggccaggcattctacagaacagataactacaactattacaagccagcttactgaaaattttattggatgtcattcatgcacaagtaatgaatgaagaaccaccactcatggaggggctgataatacgatgggtagggtgggtagaagagggaaaatctttctggcccctctctgcattctagcctccgggcttgagactcaccaccaacactgcttataaacatgaaagggattctgtttgttcaagtgctgtaagacctatttttttttacattagttaaatttttatttgtattttattttttctcagtttttttatttcaatagattttggggtacaagtggtttttggttacatggataagttctttagtggcgatttctgagagttcagtgtacccatcacccaagcagtgtacattgtactcaatattgtagtttttggctgagcatggtggctcacacctgtaatcccagcactttgggagattaaggtgggtggatcacttgaggccaggagttcaagaccagcctggtcaacatggtgaaatcctgtctctactaaaaatacaaaaattagctgggtgtggtggtgggtgcctgtaactctagctactcaggaggctgaggcaggagaatcacttgaacctgggaagcagaggtttcagtgagctgagattgcaccactgcactccagcctgggtggagtgagatgctgtctaaaaatatgtatatatacatagtagtcttttatccctcacccgcatcccaaccttaccttctgagttcccaaagtccattatatcattcttatgcctttgcatcctcatagcttagctcccacttacaagtgagaatatatgatatttggttttctattgttgagttacttcagttagaataatggcctccagttccatgcaagttgcagcaaaagacattattttgttcataagggcctatttttattcactatgcaactaatgtaccaggcataatcccacaggattacttaagagctcataatgggcttgagactagagatggtcctcaagacagagtccatttctggtcacccttcagggctcagggaacactgggccctagctgtgatcaaatttggtcatcactgctgcactctaagactttcatggggtatttacacttaaaacataccaaatagaaagacatggggttatgacctgtaaatccttgtagttggttaaatctattctaagagcaaaaagtaatatagaaactgaataacagtaaaaaaaataactagcaacaagctaaatgttcaataatagggtagtaaaatgacttatgattgacaggatattatgcagccattgaaatgacggtaggaatcattgtaggtatcattgtggtaggtacttatgatgaaatgttaaattttaaaaagtagtaaaaacttatttattctttttcaaagatctgggtctctaatcatgccacaagattataattaagaaaaaaagaaaaatatcccataaagaaaaaaaaaagttaacattttgccatggaagagaggtgttaagaagtgatacttttcttcttctttttcatttatttgataattatattatcaattatattacacttgtcttacttttatactgatacatatatttataattaaaagaaacattaatattacattcacatattaattaaaattttaaaatattttctcctacattaattcatttgctacataaaggaaaagtaagaaaactaaaagtcaagttgctagatttggaaactagagacagtgagtgaaagttggccaagtccccacaactgtcagaaacagagcaaatcctcaaagacagggttgttaatacccagtctagagctctttagcctccaaatcaaaaggctatttctggcagaaaaacaattacatctactagagaatgtattcagggaaagaaacatcttctgttattgtactggacctctgctgtttgtacctatccattccagcactatcagcatctccctgtgacttcctttggtggaccactcttcccacattcatggtccattcatacagttttaggcagtgcctaccctatgtcccaaggccatggttatgcaatggcccatgctggacaatcagtgtagtccaaccagtttcaagcttatccaatgagagtgagccctgggatgttggctggaatgacattctttccactggggcggcagaactggcaacacagaaatctggtgttcctaggtgaccctttttactatctggagagatcctgcctgagaataagataaaccagggagaagcacagctaagaataaggtaagatgattcctggtctcatggcctgaaacctgggtctagcaattcctgagacttgataacactggatgttacattttcatgagtcgacaaattccgttatctccttttaaggcaatttgaggtaatttttattacttgcaatcaaaatactcctgactcatatttctgccatttcccagcaaagtgtatacaaacattttctggttaaaaaaataattattgatgaaagaaaccattgtagttctatatcatgtagtcacaattgcctgtgttcattcatcactgttgtgatctatgtcatattcttccctcgggcaaaaatattttagcatcttacaagatgctaaataaaggggcaaatatgaaatgaagcaattacaactatttgttttgtctcaaatgggtgtgttatagttcctaattaattttggtaagtcaacaaataactttatatatgttcattcacatttgacaatctgaatatgtatgatgcttaaaaataagttttgataaacatatcttaattgacagagcagaaaaggaggtttcttaacttgccatctatatccaatctggatttagacttttcaataaacattaaacatgaaaacatttttattagcggtaattatacataatttagataagtgattctgaaactttagtatgcatcagaatcacctggaaaacttgttaaaaaaatttattgctggccactgctcactctctctccaggtctctgattctgtggggctgaggttgggcctgagactctgcatttctgacaagttcccaggtgatgtcgacactactggtctagcaaccacagttcaagaatcactgatttagactttgtttttaagttttgcattttgctgtaatttttatttggtgtaaactgtaatatatattttatgtctccgattaaaaacatgagcccacgttttctgagatgccgatataatttagacctgaaaattctggacacaaagataatgatgtgctttaaaggtggatgggaaacaacagagttaaagtaatttgggcaaaaccttgattaaaataattcattatggaatccaatcaaccttaatttccaacagatgacatgaccactcaggtattccgctacatcaagcaaaattcaggctcaaatgttctcctgctgcactgattagcaaagttcaccaggccaaagtaatcaagtataccacaaattcctaggtgcctttttatctctgcctaacacaatgcaactaagtggtctctgtctgccaacgggagtaactcttaggaagagcaacgaaacagtttgctaaaacctggttagtctgcaggaagtcattaaaatgatagaataattcaggaatctgatgatctccaagtacaatgccttgtcattttgtgattatttgataattccaatccacttcattcaagtaagaggttctgggactttaaaatcaagtagggtctgaacctaccagggtctgaactgagttttacaatgttaaagcacaacatcttactgtcttcctctggacatacccaaatgggttttctctgttggtaaacaatgacatttctccctatctttccattcaaggcttaaccactaatgaagtaagaatctctcatattttaacaactaagattagattatgacagaaacttcattaaaagtcacatgtaaaatatcctctttgattgcatatcaatttgaatatagtccattttaacataccttgtcaaaagaagaatatacattaaatgtaaaaatgtgccaatgttagctgcaaggctagtaaatcaccagttggcaataaggatatttatttctgtatagtgaggaagtgtgataacatagatgcaaagagctgagagaaagcttacaatctgcccaaacccctctttacacacaggaaggaaataagctcagaaaagaggaatattttatcaaaggagttcacttggctgtaaaaatgatgttgccggtcataaagtttttcattttcccagtggagagagtcaccttttcaacacatctgcagcagactcagagcagggtggacagcacagatgttgccaacagcttcaggttccagaaaggccctgagagccagaagacaccgatgacaatggaatccacccaaccaggtaaaacttaactgaagtcaacatgctgccctgtgatcaaatcagaaacaactgtgtaagaacaaggcgggtgaaaagaccttaccaatgagagttcagaaactgcagacatgagtacgtagcctcctggggctgggtgaagtgtgaccgcacacttggtctgctttaagagttgtgcagcatgtgtagaggggacagaggaatgagagtttgctctgctcttcactgctcagatgggaacttgagttgtgtttggccagatgccacactcataaggcatatggagaaatgaggtcattcagggagatggatctgaatggtgcagggacttgaaccgtgtcttataacgcaagagcaggaaaaacagtggttatctagcccaaagaagaaatgttttgggggcagggggaatatgggagttatccctgggtgagacaagttgtcagggaaagagggattcaattgttctacatggccttaggaggcagatctagcactcatggatagaattagtgggagacaggctggagagaaacacagagaagtaattctaaaaatgagagatattcaaagtgaatgacagctaaatacaattttatctaacatttttattgagtccttattttgtgccaatttctgtgttaaggaccttaaaattgtcatctcatttcatccttccaacaaccgtgttaggtacattaccatactgatttaaatatagagcaatgacagctggaagagcttgagtaacttgtccaaggccacatagctggttagcgcagtagcctggattagaactcagctatctgctaagcttctcgacctcaccacgatgttgctatgggctactttgggaagtagggagtttcctgtcactagggtgtccaatgtgggcaaacatggtcttgtaatactttaatattctcttccagtaggaagaaactactgttctatgctttgtcctgaaagagcgacattttgagcacgtagagctatctttatataaataagagaaaatgactctaaggacattgtgaacatgtcataggattttctcttggcccaaccccagccaagaagtcactgctttcctggaaccaagaggataaatgagggactgtgggcaaagggaagaccttacccaggcagcagagatgggttcaggagttagagaggctctttggattccagaggcaaagccataggataatcacctatggatatgatggagaaggccttgtgctctgggtcccacaacagagaaaagacttctagggagctttgattaaaactggccccaagcgggttgagttggccaagacactccactggggaaaggctgtgctgctggtcctcaggggacaggagaagggaactcttggatgacacactccctacacccagataagttcctggggaattatggtcctagtaaaggagctacctgaaatttctttccatagtcccacttacatcaacaaatactgggggatcccacctgctaaggtgaggcgggggcaggggtggggtggggaaatgatcataagcacagtcaggggtttctccaactcctttgcttggaaggaagacaggacagatgaacaaggggatgtggccacagtggcagcaacgaaatcatctagttagctgaaaggaggatctctgtgcccttgggaatcgatggaagtcatatcccaacagctggatgcgtgataagacactaagagcccacagcacgaatcgatggaagtcatatcctatcagctggatgcgtgataagacactaagagcccacagcacccagtgtcaacatccttaatgggtcacttctcttacaaactgggggaaaaattacctcaattttacctagagataataacccttaagattttgctattcactctaagaagaaaaagaagtgcctcttattgtaccacaccccatgctagatgttcaaaagatgttactttttatttaatccatttgcatatgtattattgcttccatcttttagatgtgagattgaaacccagaagtacatccccaaacttagtgagaggaccaggagttgaacccagggctgaaggattcaaactctttactcatttctaccatgctgcctcagtattacgaaaatgtcaaaacactaaggtgatgtccagcatcaaaacagtaagctctctctacttcttctggctataattggtaaaggcaagtcccattttcctttgtcaggaaattcatattcgtgtgatatttatcacaagagatttgcattttaatacagaactcttggacagggaggtggatgtagctaaacatagaggaaataagtgaaatggaagaattatagatgatgtcagaatcagaaaggaggggaagggaggttggccatgtgatcccccctcaggttgcctggtaatcaatttccaagtctgctgcagcaaaagcgtcaggagatgaggttccataagatattctttgagaaagaggctgtcctctggtagagccaatatgagtgaccttctaaggcacccagaggaaaacaggcaattgatactgtatctagagccatctttagggtgaagatccagattcaattcagtggtaatgagtaatgacaatgttttgctggtctttggaatttataaacctataggtgacagcggccctcaaaaaactatttatctttctaatagcgttgactatactctcactgcccctacatgtcccaaaaacatcttaatttctctgttgaaaagctgacaaggaaatgaaaacttaacaaaaaaagtgaactccacttcatgaatgttttatcaccttcataagtttatatatgggttgggtgctgtggctcacaccggtaatcctagtactttgggaagccgaggggggtggatcacttgagctcagaagttcaaggccagcctaggcaacatgacgaaaccctgtctctataaaaaaatacaacaattcgctaggtgtggtggcttgtgcctgtagtcccagctactcaagaggctgaggtgagaggatcacttgagcctgggaggtggaagttgcagtgagccgagatggcgccaccgcactccagcctgagcaacagagctagaccttgtctcaaaataaaaaagtttgtatatgaagccaaattattacaggatgtatttttgaaaagtgagagttataaaacattagatcaaaatggatgaaaaaagttgtggtgtttcttaaacatacatataaaaaattcagtctcacagggatatgtcatttctatttagaggatcagggttgttttgaatagtttcttatttgtcatatgctcaatgtgcattcaaatacaggtggcaatccttgaagaaaattaaacatgctgtgacttataaatcaaataggaggactataagaacgataaactttcaggttgttaatatgaaaattttttgaaaagtttttattttgggtactaaaaaaagttaagaagacatcctgtagattagttaactcttcataaaggtcattaaatggctttgaatagtatagctgatttaaaaataagatatgctaatttatgtactgatagagtaaatggaaactagcaataaagtaaaataagtgagtctatcctgggctttgtcacttcttggtttatcagtattaataataaagtgtaattttaaaataaagtgattccttcagcagatagtacacaattccctgcagctaaagaatggaaaagagattaattccatgacaattatcttggcttatcatccctttagcagggcccctctgcttgttttaaacctttctatttgtatgtgaaatctactgcctgggaaattaaaacaaatgttacaattcaacccagcgagctctgtccaataggaattcaaggtgaaatgtggctcactgtctcagccctccaggagcccaccgtagagaggacacttgttttcttttaaagcttaattcccagatatgggaaatgaagaattcacaagatttcacttcgggagatttcacgatagagcattcctttgctggtttcattgtcacctgccccaggtaactcatgaagtcttatgagaattgcctcttattcttcgggaaggattactatataccttctgctatgaaattaaccccagtgctgagatacacaaacttactacccaaactcaactcaccctgacctgagatgaatgggggattgcgaagtctttctctgaaccaacttctcagcatcctcacagatgcctcttggatgctcaagggaatacagggaagagaggggaactgtgaaaagtttctgtgggcagacttagataacaataaacggtaatgatgacagttttttttatctagccaaaatagatcccacttcatttactattttctatcgatgtaccctttctctgtactcttcctggtgcagtggtacaagcggggcttcaagggaaaagtgggcccctttatgaatggctggttagggggggaagcttggctatatgtggatttgcagctcattgcaacgtgattcatctcagttggttatgtgcagagaacagctggcagcaggtacccaactagttgcagagagaagttaaaagggactgttgcctgctgagagtgcagaggaattgctttaaggactccctgaagcacagcctgcagcgagcgaaggggcacaggcagggaggcagagaaccagcagcggctgacaggcagttagagaaaacagaaatcggccattcagagcaaaggtttggggccctaatttgagtccaaaaggtggaatggcaaatggtaacaagctcttggagagccccaaaggagaggctgtatgaaagaaatagcaccaccctccaagccccttaattcaatgccagagatgaaatgcaccagtacagaaggaaatcttggccaatgggaacaaggcctcgtggaagccccggcttctgagatgactacagagccaggtacagcgctccaccccttctcttgccttttccccacacctccactttggcaggtaggtagcagcccatggacacaagtaaatcaggtctaaagcctaaaacaccaaaagattaatacatggtgtttggctgattcactatgactgatttgttctgtggaaggaaagaaaaattcaagtaaattcaaagaggcctgtgaacttttggtacagtaactcagaagcaacaaagatccagagaaatgaaaagaaaagaaaagaaaagaaaagaaaagaaaagaaaagaaaagaaacatggtgaggaagaaggacaagacccaccccccaccctgccccatccagggataagaagaagcaaagaagctggtgaactggtgaggcctgggggccagtgatgaaggaaatcatccagaagcctaggaataaaatgtcatttaggtctcacagtctgcaatgaacacgtccttatttccgtattctgaggctttgacatctgggaccttgctgactctggaggggcagtcccttcaaggttggccaattgctagagacagtgaacaactcactcgtgagcaaattttgcaaatgcaagccaacccagagcccacaccacctccaaccagctctctctcactctcacatgaagggcccctgtgccccagagcctgctgaaatcattcaaactgccaactctagacctgttctccctgccttgcttgctgctccttcccacagaaaccacagtaaggattcctgcctgcagtttcccctctgccccttcctctgtctccagacagaccctgagcttcaccttgaagccccctcagggcatggcatccccctccttctgaaacctgtgagaataagaactatcttttcagtagccctcatctcctaagctactggctttgccatacctacataaagtaaaagctatatttaaaaacatggctcccaaaccatgtgtcgctaaaaaaaaagtccattctgatacctcattgaaaactgtcattttgtaacaggtgaacatggaataaatacattaacgtttaggctgggcgcagtcactcatgcctgtaatcccagcactttgggaggccatggcggacagatcacttgaggtcaggagttcgacaccagcctggctaacatagtgaaactccatctctaccaaaaatacaaaaattagccaggcatagtggtgggcacctgtaatcccatctactcgagaggctgaggcaggagaatcgctggaaactgagagatggaggttgcagtgagccgagatcatgccactgcactccagcctgggtgacagggtgaaactccttttcaaaaacaataaaaaagaaaaagaaaaagaaattactttagtctgttcactacacctttactcctagattgtatcttactaaaaatatttttgaaaaagtctccgttttaaaattgtgaactgaactagttcaagatccacataagatgatcagataaatgtctttttatatttttctccaagaaaatattatcagtgaatttactgaatttatatctggctggcatcaagaggtttcaatattacataaatgttataatatcattattattcttcaatatatgattattaaatctattgtaataattacatggcgatgagcatggcttagattccatgtgatgatccatgaagctcttatacctttgcaatgaggcccctgggatcagttttcagacactgaggatggggtaaggtcataaatgggatgtgcattcaagaatttacattcatctcaggaaataccccgacaccacttttggggaaaaaggaaaaaggctgtttgttttcttatttgtctttctctcataaaactagactgcagggagattttttggtgatttggatttccaaggaacccattttatcatacgaacttagaaacacctgcacatcatatgctgtttgcctgcagttgcttctcattttaagctggaattacctacagagttacctcccccaagctactacactgtatgggaggcagtctcctctaaatgaattcctgatcatcttagtattttatgagattaccaaaaccaatttgacttggccccaggaacctaagaagcaaaaaacaaaacaaagcaaaacaaaacagaaacagaaaaaaaaatgatgtcacaggaaaaggtatttttcctgtttctaagaaaggtcttgtggatatgattacaaatgagacaaaggtaagggaaaagactctatcttgggaaaaatgatgcaaaatttccaactgctcatgttccttgctctgttcttaaaaatatgtcttctttactttgctgggttgagatgctgttctctcaaaacaaaccacggacacgtgttacaagctgtatcttctttagaaacacagtcgaacctgctttctagaggagcccctgtccaccgtgacagctgagcagcagcacttactgactctgaaagggaggctgagcctgccctgggtgtgctgtaactaaggcgttccaattccaaaggcaaaaatgctattaagcagccaaggatgtttaaatctagaaagttcaattcataaattaaagatgtatttcagatatttctgaaacaggagtaattaccaaaactaagactgtagagactcttacaccatgacagctggtgtttataatctctcctcccacatccacatcttaaatctctggtcctttatcggacttgggtcacactgctttggttataaagtaaaactgcatatttcccactccctttgtagtgaggctctagggttggagctcatttgaatgctaatgaattagatcaccctcaaaaggttgctatcagaaatcagactacgtggatattttacagcatttcatagtttcagggtgatcgtgttcctgactcagcaagtcaagccaatacctatataacaagggcatttttctggaccccattctagagccacaatttttcccccaaggctatgtaacattttctcctggcaaactattagagttaatagaatgctgtggttctgttctggggactgctcatcaatcatactgctttttgaatcacaacttgtgtaatttttattcatgacacttcagtaagttactttgaagcatcacatctaaaacaacccagggactcactaaacaaaaaaacaaacaaacaagatttggggttttgttttccacttctactcatgatatactaggctttaacttactttgtagagtaaggattaaaatgcttaattggctataactaagcaaactgaatcctttagatgaatcaagccagccagctttcagtttctgacatcaaaatttatgctctgtgaaaaaaaacaaggccatggctacataacattaaaccaacacacaattaacaacactttgttctaattatctctgggaacatttaatgttgcccctatagttcatttttcttctttgatagctcttagaatatttatggagattagtccttgatgcattggccttctctgagatctggggttttcttagaagctcccacacaaatctgagccatgcaaagtaacatatttatgcagattaattcttgacatattggctttttctatcatctaaggtatttctaataagcttctacctaaatctggccctggcaatgcagggcagtcacagaccccccccactccttggcttacctcacactaagaatgtttttttctttctctcagcagttggtcataactgataaaaggttatgtcttgattgaacaagcttccaggagttggaaggccaaaagggctgctgtaaaacagcaatggagatgctaataaaacccaaggtaagaggaatcttcggctgcctattactgagaaacctaaattgcagacaagttcagcttcctcacatcaatagtgagagacaggccacaagaaaacgagcactgatcaaaggcttttgatgatggtagaacttcaatttatggaatgcacgtatttttctacactccaaaggcgtttcttctgaagtcactgggggcattcactttaaagtcataaatattctctccatagctcaggatggtttgcagcgccacttggcgtgtttgtttgggcatgtgatttgatgctctacagatggattgaagcaccacgaggagcttcactgtggaaagtgaaggggctattagttaagaacacctctaaactgattagaggcttgctgaggcaactgcatgagttttaaacatagatgttgttagctcttcatactgatgtgttggatagataggtagttccatgtactacctatctatccaaagagtgtgaacaagctaagtaaccaacagtgaggattaaataaatggcacttgcacatataaacaggccgagccacttggcctcatctctggccataggtgccctggcccttgacaggcccatgttctgagggctccttgaggctgtttcaggcttttctgcttttgtctaggcaattccctctgctcttcattttaccatctttgcctggagaactggcataaagcctcaaagactcacagttcaagtgcaacttctttatctctttgcttcctccaaaactaattcagttagatacttctgtcttggtgctccactgagccttgtacacaccttacatttttctaaaattttaatgtgctttatttttattaccttaattaattagtatatttttaattattatatttttgtcttctttccaacaatgtgagtatctcaagggcagaaaagatgctctgtatctctttgtaattccagcatccagcaggaggccaggcctagaaatgccaaaggagggagaggaaggtgtgctagagagaagacagacaggcagacagagagagagagagagaagagaaaaagaaagataatatgccacagaaggggaaaaaaaaaataagcagtaacattctttctgggtggtattaaagtaattctgacatttaaataactaaaacacaagaattttgccaaatctttgatggaattgatggaactgctggttgaaatgctccaccctccagaggccaagaggtgggcctacaactgaagtcaagccaatgagatccctctctctggactgtaggagctttgatgggatgactaggaaagagacatggccttttcacggtgctgctgatttggtgccatcacatagaaaaggcctgcctgagagaggaactagctcaaatgaaagcagaactgagagttggagaaagctttctgacattgtctgaacccttgcattcatccatgtcttgttacagctgattgtccagttatatagccatccttccttttagttaagtcagtttgagtagtgtctctatgacttgcaactgaaagagtaatcacaaatagaataccttgaaggaatactaagatttcccacagtataaagttttcccaagattttaggtctttgaaattgtttcagcagcccacggaccctctcaatattgtatcctatactgagtgacaatggtggccccttggagcatgtgggttgggtgctctttgcctaactgtgctgcctccatcagcttcatttctgggattcttgattttggttcttaaataagaaatctaactgtctatggacatgactgctttaaaagataatggtatgctttaaatattctatcacaatatgtatgtataaagacttaggcaccaggatgctcataagaacattataatattgaaatactgtgaacaaggtaagcagccaacagtgaggattaaataaatggcactcagtatccattgaataaatttctacatagccactgcatcatatttttgaaaagtattgaataatgtggagaaacaggctacttaactgtatacagtgatatttcatatatcctaatttgattaggtacaataataacaaaaagactagaaatatatatgctgaaatgccaattccagccatttctgattagtgtaattacaattattttcttatgatttttccaattttctgtaatgtgactatttactacttttataatcagaaaactgctagtacaaagttacataatgacatagaatggaatttttctaaaaacttcaagcccctttaccaaagaatagtttttgtctcaaatcctagcttagtgatgttgctaggtgacccacagttggatgtaaaacaatcaagagaaagataaatgccagatactttaagacagggatgtctggtgttacctgtcagcaaactgtcatagaatctaaagattagaaggaaacaattatgaatttctattcagaataccactggcacgttgccttaatttcttttacattgtcttaagataggagaggataaaagtaagaagaacaaggtaagaacttaaagccaattagaaagggaaagaaaatagcccgttcctctcactggcaaggagacaaagccaaacttggacatatccgtggccatgtcaggggagccctcaaaggtggcatgaagccactgaagagcactttggatgatgacctttccccaggcttcaaagcttgtggcactgggcacatgtgggaagggcctctggatctaagtctgaagacccagggaaagttctacttaagaggaggcaggggcgcagaaaggttagattacaaggtggttaagatcagcttcatccatctctgaaaggacatgaattcattcttttttatggctgcatagtattctatggtgtatatgtgccacattttctttatccagtttatcattgatgggcatttgggttggttccaagtctttactattgtaaatagtgctgtagtaaacatacatgtgcatgtgtctttatagtagcatgatttataatcctttgggtatatatccagtaatgagattgctgggtcaaatggtatttctgcttctagatccttgaggaatcgccacactgtcttccacaatgattgaactaatttacactcccaaaaacagtgtaaaggtattcctatttctccacatccttgccagcatctgttgtttcctgactttttaatgatcaacattctaactggcttgaattgacatctcattgtggttttgatttgcgtttctctaatgatcagtgatggtgagctttttttcaaatgtttgttggccacataaataagatcaatgaaagcagagagtagaatgttggttacagaggctatgggggtgtgagaatgcagacagggtggtcaaagggtacaaaatctgttgataatagagtattacacatctcaaaattgctaagagtccatttcaaatgttctcaccacaaaaaatgttaagtatgaggtgatggatatgttaactagcttgatgtaattattacatgttgtattatcaatcataacatcactctgcatgccataaatgtatctaattataaattaccaatttacaatttttaaaatgaccagtgaaagcttgttgggtttagtacagaactggacctaagttgttttgatagctttaaatgtcactctaaaagtggtttctgtggttctcaatcctggctgtgcatctgaataatccacagagtttcagaaaaatacagatggtcagtttccattgtagacttaaaagagctgggatttcctgggttacattctagacatctgagtttttaaaaagctctatttcttctgtggtttcatctccctagcctgcttgcagatctcattcttgcattcatacttctctctcccgcatcatcgatttcgccctctccactagaacacggccattggcacacgaatgtgccataccatcagctgccttttgaagagtttctcttgtaccctatttctcttcagttttgactctctccatgtctgacccacttcaggcctgtctatacatgtctccacatgttttcctccacgcccactcccatcagaaactgttgttaccgaggtcatagctgaccatgccttgccagagccgaggatggattctgtgatccatcttgctggtgctcttagcagcactcaacaaggatacccttggagcactttcttctttaggctgctacaacacttcaccttccattttcctcctaccacaccagacactctccccaggctcagatgctggctcctcttcctctgccagacctcgaaaaatggggaaccttagaactctgtcctctgccctcttcttgtccatttacagttacttctgatgggaccttaattagtcccacaaggccgagtgtcatctgtatgctgatgactctcaaatccatatctctagccctgacctgaactttgtatttccacctgcccatagaacatcatcacttgaatgcttaataggcatctcaacttaacgcgggcaaaaaccaacagacaattgcatgctaattttgctaagtcacctttcctccaaggcttgcctctctcaggaatttggtacaacctcacactcagttgctaaaaccaaagaactagaagttatccttctcacttttttccttgtattccacatccaatggatccgtaattcctaatagaccttacttctgaaatatattatctggctatttcttactagcatagtatagtggagctatacattgggagttcaaattctgactctctcactgactacatgaccttgggcaaaatttccaaccttctggggctcactttcctcatctgtaaaatggggataatagtgctaactactgttggggctcagaaaaaatatccccaaatgaaagcctcagaagccaaagtttttctctgatcttgtcctcctgtctcccagcttcattttcccctagtctagtcatagaaactagaatccctcttccccaaggcaggtcaaagaaaccagaaagctagacataaaacctaaaaaatattactctaattttccttctgcttttctatgtaaaatctgaccataaggaaattatctgacctgtcttgtttgctataggtcataagacccctattctagaagaggttttgccccacacccagaaggaaggaatgctgcaagcagaggccaagaagaatctagacaggcaggcctcacagggtttccacactcagtctattaccattagatcatactctttttttgtacagtcatctttctacacggctctctatactccgctgaacctaagcataaaaatggacaatttctcctgtgtctttgagtccccgttctgaaggctcctatgtatacacattgaaaataaatgtgtatgccttttctcctaccaatcagttggccttatgtcaatgattttctgtgaacctctaggcagccaagggctcccgctagtccccatactaccataacccacagggttacgaacatgaaaatagcatatataaacataaatggtaatcagaacagtgtttgggatatactaagccttataggaaggcttgccaacatggttattattattcccattacatccctctagtccaataacattaatatggtatgattatcattccctattagtcctaggcacctaccctagactagtctactaatattgtttgtttgaatctaaaaacaacaacaaaaaataccttctacctggtctccctgcccctcctatgtcccactattagcccacaaagcagaaggatttgtctttataaatgagaagttacatcattgcttcttcccagtttaaaattctctaaatggcttccttttacatttatatcattttcagagtctttattgtgaccatggcctatatggcttaaccaggtctggcccttgtctacctctgtgaactcatcttcttccattttttaaatcttgtaccttgtgtcccaggacagacttcttatttctgttccttggacttgccaagctttccagcatcttcaggtggcctttcacctttgcagctgcctcctcttgcaatgttcttcctctgatcttcacactgctgtctcctttttattttttatattacacacaaatggctgatgtcagaggtcttctcaagtaaatacctctcctacccctagctcacattctctctgctactacctcaataaacttttcttatttacaggcatatagttgcctgtttgcttatttattatttcatttaagtatatgcttcctgtgtctgcccactggggtggggaccaaaaaaactgatctaatccctgtgcaaagaacacgtttggcccatagaagatatttaatatatttactattattaaatattatattatttatatataaatatattaataatatattaataaatatattattaatatatttaatattaatatatatctatcgactaccagttctacaggtaattgtgatgcacagccaggtttgtctattttgaactacctaattttaaataggaattaatgattaacaaaatgcttatgcacagcactgtaattgtcatcatttcatggaaaggtataattgagtagaaaaagctgttattcaccttaacacatttaattgccatatttttctgcacaaaataaatcattcctagaagcggccaagttctttcaaccttgaggctatctagctaagtcatcagcacatgcttttaggcttaggactctcaggtggtggcgggcctgttctccccctggctagaagctgagtatcagagatgccatgggagttgggagtgagccaagggaacatccagcttcacttttagtcaggtgtgcagttggtccctgagtggagagaagggccacgtgggagtgtcaggagtggggcctgcagacaaacaaatcatgtctttcaaggaacatgccatgagcaaatctggggcctgagtggggcaaatgcccaggagtagggaacagggaagactccagatgaagccagtggatcctggagggcaggtctgggaagatcccttgaatcagtggcttctggtggggtggcagaaaggagtgatcctttcgtagaagggacctgagacatggcagtgctgttgagaatggtgagctttgttctaagtcaaataaacagtctctgaaacagcagccttgaaaacccaaacttttaaaatacatagaaaatgctacagtcaggcactgagaagttacataaaatgtgcaagtggcatccagattgtccatgtgtgccctatgacaccaatatacaccaagtgatttctcctccaggcaccaggaccctaaacacaaattacaattgaagcccaggggaagcagtggctgggtagtgagggtaaacggtctactcttcaccatgaaaagctggcaacagctgaaaccaacgtactcagtagagaaaatcaggctaaaaagagaaagagagagagtgtgtataattataatttttataattttgactgttggccctggaggcgtttttaggaaggtaaaggtcttaattagcacaatattttgctgagcaggcggatgatatggaatgagcccatgacatggcatgcagagacctagacagctctgcaaattaaaagacagaacttggctgtgggagaaggtgtctgagggagaggagagtaagtgggacagagctggccacgttctaaggcgggatctgggaactgaggagaaaggctactgcgaaacgccctgcaaccaaaggactgggaggaaacagaactatcaaaagacagagttgaaggcccttagcctccagaatattctgccatgaccccatatccttcctagggttggattttggaaaaatcaagtaaagggggctctgtttcataagaggttggtgcgtggagaagaaagaggaattgattgacgaatgtgagtcggaacttaccccagaaatggtcacaagagggaataaataatacaggggtggcagctggagggtgatttgcttagacaatattaacttaattttcaaagtcaggggctcctcaagttgtttttgaatattactgtcacagtaatcaagaacgtaatatagaagtcatctctgcatttcattttccacaccttcttagaacctgttaggggagcaggaattaaagaagactgctgtccaccaccctgaaaatcattcctttctgtgatccacaacaccaggggccaagagattagggcatacaaatatggtcatttcaaaaatacgctgatggggtgctggtggtatattggtgagcctagctgccttccaaaaatatgctaatagaaaaattctttgtttttttaaaatcttgttgtatatcaaatttttccaaagtaatttttgacacattataattaattcccctgcaatcttccaggggagcatttcattaaagcataaaaatccacatggggtctgtgaccagctctgactgcagtctgtcaaaatcagttctctattttcctacaataatgtttaacccatgcaaagatcctagacactgagaatatggagcaaatattttaaaataaaaaaaattaagtagcatataaaattcatatgaaaattgaattacatgtatgacaaaatgacatctatatataagaagatatatttatatatatttacaaacatatatttgtatttcttattttacatactttattataaaatgaaataatcttcttattacctgttcaagtagaagatagtaagatgtgaaggcaaggagaaagttcatttaatattgaacaaagaattttaggaaacaagcagtgacactatgactataggaaaattaaaaaataaaatagttttatgaattaaaatagtgggtcttaatggcacttacagatatcatctattgcattcaactaatgctggaatcaagagttgttgcctgaagtgtaaagaactctgtggaaggaaaaaagatactgcttctcttttactcactacagtttaagaaacattcgctgccaaatacattttttaaagacctcttagcttaatgaaataaaatgtacttttcaatgttgtctctaacaacaacatgaactaagattaattttctctgtagtcataaacaaaaactaacaatttaagtacactgttctctgggagtaagaaatgataatatcagctctttcctattgtgaatctagttaattcaacctcaagataaagttatgagtttcttaaaactcaaataggaacctcagtttcccttgagaaagctttcctatcttttatagtgactatctttaaaaaatgacgaaagaatgagaacccttggggagacaagggtgattcctagctctttgcccagagggagttgctagcgattcctttagttgatatttgttctgctctgtgtttgaagctacttgcttacctgtctgccttcggtcacacctgtgtggagtagcccaactctttcattcacagtccttatattgttaatcactgtgcccaggtaagtaggaacaaaattaaggaaaaggagcaggtttggtgtggatgaatgaaagagactatgcaccaggcatcattttaaaaataattacacacgtaatcctcgttacttccctgtaaggctaattactattactatccccatgctttcagctgagggaacagaggcatggggagcctaagtaactttgatggtttcaaatctagaaagtagtcgaacagggattcaaatcaaaccccaagaattgagcttcaaagtgcataatctcaccattctgctttattatcaccgaggaaattagtgtaaaatggatatgctcattatagacaatgtggtagatctgaggtagaattgcagaaagcaagcatagaaaacaaggcccctccaggtctttttgtttttttgtttgtttgtttgtttgtttttttgagtctgtcacccaggctggagtgcagtggcgcaatcttggctcactgcaagctccgcctcccaggttcacgccattctcctgcctcagcctcctgagtaactgggactacaggcacgtgccaccacgcctggctaatttttttgtatttttagtagagacggggtttcaccttgttagccaggatggtctccatctcctgacctcgtgatccgcctgcctcggcctcctaaagttctgggattacaggcgtgagccaccgtgcccagcctccagctcttcttcctttatgctagtagagttttcaggattctgtagactctatggtagaactgcgtttttagatgttgggtgaaggccctttataagcttatcgaaaggacgtaagtgaactcatagaaaaaaaaaatctttgctgagtctttaagcatgtgacatttcaatcaagaactagtaactagaatggtctttgatgactgctataaaaattcatgaattaacacttgaaataatgtcgaatgccacgaagtaacagacgggtgttatcatatcccggtctggaggtctctggaggatgtcagtgctccaaaaatctccttaagtctccttagccagtttcagctcactgttagatgctttacacatttaattcctgcacgttttttttaaagatatgactatactgcttataaaatctctgtgtgtgtgtgtccaatcatctttacatactattaaatattttgcttagtcattcattcattcattcattttaccagttactggggaaaacaaagtaaaatatcacatagcctcttcccccaaggagcttgcaattttaggaactaatccagtttgagggctgaatttaagttaaaatcaattactgccctatgtactccttttaaaacaacattaggtcaagaccctttcagtgctaactttttgctcattgtagacaaatctcagcaggaaatcgtagatcatattagtctgggagaactcaaaagggaagatttatactcactcaaaaccagtgccaataaaagaagcagaatactgttatttttcttgaagagtgtaaaaattgcttcatttcttacctctagagctttcaatctctctaatagcaatttggtcttttcttttccctcatctgtactgctgctttcactcctcgaatcctcatcaaccaccatgtgaagatcttccaaagcttccttatgttttctctcttcctctgacagcttttcctgaagcaagaaagaattactgttttcaataatctccagtgaaaaataagcatgagtgtgaggctgaaaaggctggaatcattctcctgcgtgtgcattcttccggggctgggagtttgctaaacaaattctgagaggggtttattttaaaaaatgaagtagatatttttactgacccctggaaggacaaggccattgggttgccatctctcaatgcagttgtcctttgcacagttggagaagtgactaagccagcaaagccataggtggagtcatgtggttaatccaattttatctgcacaatgaaactcagctatactgcaaactgtggaaaaatacatcaattttgataccttcatttgtgaaaggcatagctcctcaagatagggtcattaaagtcactggacatgcagccatttaattaaaagaatataaaatatcacaaaatactgaaataagagtgatttcagaattcaaagctcacacctattagttctttcagctcaataatgacacaacttttaaggatccctcagtccctttctgtaacactgttcagcattcgtactatggccttgaggcagacataaaaagttattttgtcttgactcactgttggaagcccctcactcaaccttgtctctggaagctttttgaaagttgagaagtactaagttaagcctcatgaatagctcttgttttcaagggaaaaagaagtatcaagagattaccatattaaaaaaaaaaggatccattttgtgcatggagactcttgctccccacaatcaggtgacatccttccattacactatttaattctaaacacaatgctgcagaaatctttgctttaatgtagctggttgtcaaccatctgaacaaaactggattatcagtggtaaaagacttctctatattttaatactaaactaagatctatttgcaaatacagaagcacaaaacgtatcattcttaccctcaaggagctcatacaatctacttagaaaagaagaacataagaagaaaaaaaaaaccacggcgttttcaaactgtgctcatcaaggtactttgaaggttccaaaaatatttaagttactttttgaaaacaaattatgaattatgtaaaaatatgtcttaatgtatatgtatacatttatacatatatatgtatcagtgtatacgtgtgtgtatatataaatcactttagaccacaaagtcagtgaattcatccatgtgaacctgttatgtacagatttcaggatctaatttctcctgtcatctctgtatatataaatgcatagttgattagaaaggttgtagttctttatgaaatcaggcccaagcatgtgtaactgtataccatgtgcaggtgtgagttcagctcagataaatgccaggcaagtttaagatgtacatccacaggccaggaaacaagtccaggtcatggtagcatttttatagctttgattttttagggtttggtcacctgtcagacttacatttccaagataaggaatatgaagtttgtagatactgttcctaaacaaagaagtacctttacttctcttttgtggtttgggatgactgtaagtaaacactaacttaggttgatgaagcaagctgttttaaaattatcttcattttacttttctgtatatagtttttcattcatcactcagcatatgccacttatattttatacatatacatatgtatatatgcacacatacatatatccacacatacacatacacatatacacagtcacacattccttaggagatttcatcattgtgtaaacatcatagagtgtatttacacaaacctagatggtacagcctactacacacccaggctatatggtacctaggttagaatcctatataccatgttactgtactgaatactgtaggcaactgtaacacaatggcaagtatttgtgtatctaaacatatctaaacataaaaaaggtacagtaaaaacatggtataatcttacgagaccaccatcacacatctttataaggtacatgactctttgtgtgtgtgtgtgtgtgtgtgtgtgtgtgtgtgtgtgtatctgtagaagtatcctgtaataatcagagcccaatagctaattaaaacaaagaaaagccattggggtggtaaatgaaaagccaaaagactttggaatgtgacagccagatttcaggtctaacatttatttagcagtttggcaaatgatcttacacaaacttcctttatttttggaaatggagactcgctctgttacccaggctggagtgcagtggtgcgatctcagctcactgcaacctccacctcccaggttcaagcaattctcctgcctcagcctcctgagtagctgggattacaggcacctaccaccatggccagctaatttttgtatttttagtagaggcagggtttcaccaggttagccaggctggtctcgaactcctgacctcaggtgatccaccctcctcagcctccgaaagtgctgggattacaggcctaagccaccacacctagccttggacaaactttttaatttcaataagtcttgatgtctttgtctcctaaactcctaaatgaggctaatgtcaacatatatacactcacataccatatagtgaattcgtgtcattcacaatggttatgttctctaaaattttcatgaacagtacaccaacttaggaaatgtgaaattattgttcctaggggacatacagagttaggttcctgtgagcctctggtcacattttcattaaccagccattatataatcttgttttatgtgtatttctatttaaagacaccttacatttaacatatactgttgattcattcacactgacctaacagccaacagcactgtaactcatcctgaaggaagcttatccgacacacatgtattttatctgtagggcgcatcacagcctgcatgtggttaggaacaccagacagcacttaagcactacactcagggccatgtcaaacagtgaaatcaccaacaaaaagcacaaaatacaaaaagcatatcactaaatagaccacaaacaggatactagtttattgcatgaaagctaaaacaacaaggcacagtcagtgctgccttgctccatctcagctagtaacgtgaaccttgggtgactaatttttcaccattccatgtatgttcacgaatgaccacaaaagtgacacaagtatggatttttgggttgcaaatacatttttgtgagtagaaaatttgcaaatgcagaatctgcaaataatgaggagccactgccctatcgtacacacacacacacacacacacacacacacacacacacatacacacacacatacacacactcttaaagtacctagatacagtgcccaagtattatgatgtagaaataattaaagacaatatggattatgtatcagtatttagattacataaaacgtcagggtcactttacataatttgaagaaagggcaatcaatgaaagctgtgagacatgattctatggaaactgaatgtgactcatactctaacacagtgatacaacttaaatagttagagaggcatagggtcggtgtttggtgaaagagaaaattttaaaaggctcctagtcaagagtaagttttgtccttacaggtttataaggaaatcagtttgattataatagagaaaagctttttgagagaatagttgaataataggattggggagaaaaggagggggagaggatgcttggaaatgagacaaaaattcagatacaattcactcatttgttcatccaacaaatgttttgttaaacatggattactggccatttgctgatctagctaatggagtatggaaaacaagacaaagttcctatattccatgaaattatattctaatgttggtaaacatgacaaactccaaatcaaatctgtaagtaatataaggtattagtagctggtggtaaatgctatgaagaaaataatatcatctgatagagagtggtgtggttaggggcaatgttagatgtgctaacaacagagtgaggctgagtgaggaggtggccattacagcaaaggccaaatgatgaggaggaagtagctgtgcagtggtttggggaagagcattcccagcagaaggactagcaaggcaaatactcgtggcagggccaggcctgccttgctggccagctgagggagggtctgtggtggagcatagtgtctaaaagaggaaggctagcaggaaatgagatcagaaagagagctggaccatagagggtctttctaggcataggaagaagtttggattttattctaagtgcactaaagaggaactgaagtctagacgtaggggagtggtaggttctgatttacattttagaaacatcatcctgactgctgcaatggagaatgggctgtggaaggaaggagctaggagactagttggaaagtctttatacagaaggaaataaaaatcaggaatattttgaagggattgaatcaggacttaccaaaagcagtttttacggtggttcagaaactaccacagatgatgggtcagatgccctgaattcagtgcttagattttacaactttggaactttctgggaaaatcattccaactttttaggcctcagtttcccccagagataaggtgaggagttggactcaatgtctcttccagtgttaaagttctaagaattcaattaagatacagttttcagaaagaaaacgttgtcaaggcactcagtggtagcagaaatgacaagagaacagaaaaaagcacctctacattttgtaataagaaggttgttagtgggaacttgagagctgtttgactaaagtgtgacaatggtacccaaattgtcagtggttaagcaaaaagtaaaaagggagaaaatagaggcaattttctcagatgctcatttgaaagtttggcagggaaggaaatctaaagaactgtagctgaagggcattgtggaggcaagtggaaacctttttcaagatagaaaaaaatgaggttgtctgaagaactaaaaagaagagggagcaccagagagagtagcaaaggtgggaatgtacgaagagatttctaaagccaagaaggcaggggatgaagggcactgatagaggagccaaggtttggaaaatgcagctccctgtaaaatatcactgacttatttacttatttattttgagatggagtctccctctgttgcccaggctggggtgcagtggtgcaatctcggctcactgcaacctccgcctcctgggtacaggcgattctcctgtctcagcctcccgagtagctgggattacaggcaggtgccaccacaccaggctgatttttgtgtttttagtagagatggggtttcattatgttagccaggctggtctgtaactcctgacctcaggtaatccacccacctcagcctcccaaagtgctggattacaggcatgatccatactgcgcccatccccctgtaaaatatcacttacagtttaatttctcagttagcatttctaaatcattagtgtctagcctgaattcttagagaacaaggaattgagtacaagcagctcatttgggagatgcaggaaacaccagtagggaggtagggaagtgactcaaggaaaggaagaattatctgaccccagggtgagagagctgaggtgttggtgtcccaaccctggaggagtcattagttgaggccagctcttgaggcattcatttcctggctcttctagcctgctggaggcagtgaggctctgtgtagttctcaagtaaaagtgctctctgacacagatccttgcagctggaagtcgcagggccactttgaatggtcctggggtgcaggtactgctgatgtgctcgtgacaaagagagtttaaagctgctctgatgtaacgccacccaggaccaaaagccacatccgcatgctgctcacagactagtcactgacctaaaggcatacttgcctgtgctctacatgacaaaatgccctgatgcaaatccagaaggtggggttctctcttgtttcttaatcatttaagattaatcttttgtttcttaatcatttaccagtgagagcattagaatataaggtaacattgagaaagagagaaaatggaagggacgtatttagagtaagtgaatgagcaaaagaaacaaataggtggagacagaggtagaggaaagacctgagagagcggagagaaacgtggctataccctatccacagatcaccatagtccattttagatagactagcagttggatttatcctacactcataaaaacacgacagtattttttaaaaaatcaagtgtatgggttctatccaaaaataaataacttattttaatcagaaaaaatatcacaaattttaggtcctttgccaattaagaatctgagatatacacagcaaaaaggatatcagacagagaggtcaaaaatgtgtagtgctaaatactgtgtatttgtcttacgaacctccaaaaaggaaataagaaaaattagccaggcccactcatgaggatgtcaaagttgaagagaataagttgattctagaggtgacctgttttcatttttatggagtttaatcaagagtgaattctataaaagtgaagctaccatacaaacaactttcactccccacatatttcatatatgattgagaccataagcttgtttacctcaacaaataccagctagaactcagaaagctaaagatttaggagctcagtttgcatcgaagggtttatattaaatttcaccttgtcgctacataaagcaatccttagagctgtaagtttccctaagtggtatctagggtaatgattcacctttggcagagcactcaccttttgttctcaagcagtcaacatcatcaggcctatgtaaaataacatcaatcaacacaaagttctggaacgcatcaagtgaactcagatgacagcccaggaagcttggttagtcctaagagaggacagcatggctcttcatggatggccagctgctgctcagtctatacccttccccaaaatgtgtaaatgtgacttctccatcttctagtcactggctttccccattccaggacacaggaggactcaatcaatattccataaggttattttgtaattcattaatcaagctattcaattaatatttgctgagcagttcctacatgctaggcgctgaggaatatgccaggcatacaaaagtgaaaaatacacgtgtggcccctgttctcatggagcttacagtcttgcagaagaagatagctattaatcaaaatgtcaggagcaaacataaaatagcactgtagtgtgtcctgtgaggaagagtttcaaggtgctttgagaacagataatagagcgatataaatgagaggttgggagaggtttcccagaatgaggtgagatccgagggcacagtgagaccaggaaataaccacgatgtgagaagaggggagggcaactgagaagtccaaaagtaggccagggtctctggggagggagatgaggctggatgggcagatggggctaggccacttgtcaaggagttttgtctttaccctcagggaaatgagaagtcactgaatggaatgccactgactattttcaagtatggcagcagtgagggtaacacagtcagatttgagttctgaaatctctctctgatatggtgtggatgggttgggggaagttaacacagatgtcagaaaaacaagatgctgctgcaataggctatgcgggagttgaaggaaccattattaaaacaacagtctcacaaaatgagaacccacagtttgtaaggcgttccataattctgattcttcagtatgtacttcctctaacagtgacaagcaacatttccttatttcaatgtttctcagagagtgggccatcagccaccagcatcagagttgacaggggctgggggaggagaagaagtacggcttgtttaaaacgcagattcctcggtgcactctggccctagtgactcacaatacctgggagtggggacaggaatctttcattttagagaacactacaggtaattctaatccaagactaagtgcgtctggacaaacacacttgagcatagaacataaatcacttttactttagataagcttttgaggttgcacatttgatttaatttctattattaacaagtaaaatgaacagataattaatcatccaaagcaacattccctggagagtaagagtgggtgtggccattaatagtatactggaacagtaggtgtaaccaaacaagctgatacacatttacctatagcttgctaaccctacttcagtaatagatgtcctatgcaaactactctaccttcaagtgatgagagacccctcaaaatttatatttgagttctgagactctggggctcactatcttatgattgttccttttcatagaagcagatggtattaacagcctgtaactactttcagtggcttctagagcaaagggcattgaggctccaagagacaggttctatgtttgcaacaatgaagggaaacatgtctacaactctcttgcttagaaagccttagtaatttaggctgggcgcggtggctcacacctgtaatcccagcactttggaaggctgaggcaggtggatcatgaggttaagagattgagaccatcctggccaccatggtgaaacaccatctctactaaaaaaaatacaaaaattggccaggcatggtggctcacacctgtaatcccagcactttgggaggctgaggcgagtggatcatgaggtcaagagatcgagatcatcttggccaacatggtgaaaccccgtctctactaaaaaaaatacaaaaattagttgggtgtggtggcatgcacctgcagtcccagctactttggaggctgaggcaggagaatcacttggacccaggaagcagaggttgcagtgagccaatattacaccactacactccagcctagcaacacagtgagactccatctccaaaaaaaaaaaaaaagctttagtaatttaaaaacaatgcctgcttgccccttgttttaattaaataaagagagaaatctgcccatcagtgtcccaaatgaggtagaaaagtggcaacttgttgtcacaataggctcacaatttctctcctaagaaaaataagaagaaaagttggaacattttcatcccaactccaatactcagttccactgggtggatataattgcctagttttgtgtacaaaggcttaacctcaacacggtggcccttctgccttctacaccgtcactggggagtgactctaggtctgtctgagtctaggactgtgaagataactaaagaatcccaaattatggcagaggggataggcagtatatatcacactcggacacaccttggtatttcatttgacagtcaaccttcttgcggatcatcaagcaccgtctcactaggatctaaaagtctattcttctccagggtagagacatctagccccattttcagtaagccttagaacaagtagaagaaagaaatctgcattccctcctagctctgccactagccagctgtgtaattttagttatcacataaattctctgtccctcaatttcttcatccataaaataaaatgcacaaacatagactcactcaaaggtctcttctcactttaaatttatacaactttgatcatctgtaaaaactcaaccttgagaaataaatacttaaaacactgctgaagttcaggggtttttaatacataatttcattaagattagacctgcctagaagattccctgcataataaaactttcgtgcttcttttccagaagtgtatttctatcttcccatttcctcaccttcttggaaaaaaaaaaacacaaaaaaacaaaaaagaaaaccttctctttttgctgtgtacttttcttgggccctaaggttaaagctacctgtaagaaacaaaaggccagtgagagtttagtgaaagatactcctaacactttccaaaaatcatgcctaatataagccctttctaatggcatttgcttatgggaaaatagtcccaagtagctcttggttgcaaggccttaaaaaaataaagacaattcactcatctatttttattattactaactctggtggtggacacaaagcatccatgtagtaacactgcacctatcctgacggtaataacagctaccctctgtttccaactcactcattattttctgatggggactatccttaaatcttagcactgtagggggaaaaactctaaagtacttagttttttaacttgatggcaaaatgaaattacagggatatgaagaaacatccaactttaggaactagtcatttgtagaagttaaaacagaacttgttcattttgaaaatgtaaccatgtgtcaaatccacctactaattcatagcaacaatataaaaagctataatttaggactgttcacatgaggcagagatcagggtggtgttaaaatgaaatatgctctttccagaacacaaaagacataataaataacgattcatatttgtataacatctcagggttaaaccaagtgagttcagacatacaattttacatatggcaagggcgatatagggcaaatattctggactccctttacagacaaggaaacagcctctaatgggttgttaggtgacccgtttaatagtaagtggcagagccagaatttaaatacagttccgattttggacgtcatgctctttccacagactcggtgacctcttttggactttgacatgcatgtacagatctatccctaacggtagtaattctatctgagaatctgtgatctttagccaagcgtgaaccatgctactggcagcgtttctcccaaggctcccaggccattcctctacggagttggtgtttgtatcagaaatgtcagatctggcctcaggtgactactagcagaatagttttaacaaaccaccaccacttccatagttaatgatgacacaattagttcaaaacataaacacataccataataggagctaaatggaaatgcagagaggccagccgtctggctgacagctgctccagcgtgccctggttgtttcagcttctgtgatttatttactcatttgttttctggtggtgaggagggtgtgcaaaatatattgtcactttagatagcacttcagcaaataccataacaacattcccagggattgctagcagcttttgttcagcacaagcatactaaattttaaagagggaaaaatagcgtcagataaatcacaggattttaaaagaacatcccaatttgttcacagtttaacagtactactgtcaggcaaaacatataaaactcttctttttcatctctggatttgacttacaaagagaactaagcacatggtaaaatccccaagattaaatgtgtatgatggataagagaacaaagtgttttctttatgtctgtaatatgaacccacgaccactgacatatcaatccacatctcctccacattactcttcactcaaaaccctcctcaacattgccgattgtcttccatattgaacagatcctgtggagttacactaataaattttcagatgatgcttttattgcctgctccatctatcggcaacacttatttccctaaaaaaatagcctcaattctaaaaccactttacataaagggaaactctactgtggaatagaatggtgtgaaaagttcccctagaatttcattaaaggtatgctccaggtggctggacatctaagaaaactaataacagaaattatgtccttgtagcccacgggtagttgtttgagtataagctgggcagatagaaaccaaaaacagaaagtaagaatgccatgtagatagggaatttcagtgggtaatagttaaacttacatgcttaagagtcagagaaaaaaaaaaaaacctcataacttaaggttgaaatttgcaattcaaattcaatccccctttatcctgttttctaaaggaattcacagggtagggaagctgagctcatggacttagcaagggccatcccagaaggaactgacaaccccgtcactgagttgtaaatggtaggtgggtggctagagtattgctgtctattgtactcacttacagcagccatgtgtctgagattccctggcagaattttaatcaaaataaatttaagccaatataaaattttctacccattttgtcacaaatggatgaacctggaggacattatgttaagtgaaataagccaggtacagaaagacaaatatcacatgatctcaactacctatggaatctaaagaagatgaactcagaatcagagagtagactagcacttagtaagggtttgggtggaagcagcggttgaggagatactggtcaagggatacaaaatttcattcagataggagaccagatgcagtagctcacatctgtaatcccagcactttgggaggccaaggcgggtggatcatgaggtcaggagttcaagaccagcttggccaacatggtgaaaccccatctctactgaaaatacagaaaattagccgggcatggtggcacacacctgtaatcccagctactcgggaggctgaagcaggagaattgcttgaacctgggagtcggaggttgcagtgagctgagatggcgccactgcactccagcctgggtgacagagcgagactccatctcaaaaaaaaaaaaaaaaaaaagaagaagaaagagtaagtatacttaacaatgtatacttgaaaattgccaaaggcatagattttaagtgttctcaccacaagaaatgataagtatgtgaggtaatgcatatgttaattagcttgatctagccattcacaatgtgtgtataattaaagcatcatgttatatataatatatatacaattttattttttcaagtaaaaattctaaaacaaaataaaaaaaattctatctctgttctctagatgaccgaggtgctcaaatttttgtttcagaaaacacggtcaatatcatatcatttttgtgtgtgtgtggcaattgctggcaaataaatagttatatatcttctaagcttattaaaatgaactgattaaaaagcaactgcttctataaagaaagaattctttcagtgtttaaatgaaataacaatgataataataatacatagctcctatggagaagggaacttctcagtccaagttcagtaagtagatactgtatgcaattcaacaggtcacaattataatgtaagactctcaggggcaggaataatgttttctatatcacatccctatcaccacacactgcacaacacagaaggcattcagcaaatgtccaatgctggtgaatatgctgatgctttacctctgatgacactgggagtgagagtactgctgaactacttaactattcttaagtactttcaacagaaaacattttttaaacaagtattttggcaccatagacataaagcaaaaaaccaataggatatttgcacagaagataaaagcaccactaaattgattttctctcttagaaaatgagattttgcacgcttatcctttaactgacaccccctgccacatgcatcttctcacataggagcaaatcaacttttaagccataaatagttgtcttccctaagacaccctgggaatttctggtgactcaaagactaactcccaatcaaggtactctattcctcccaccttcttccaaccaggggttacctaaaagaagagctcgaataagatgcattaactatactacttttgaaagtcagacataaattacatagttaattctcttgggagctcatgtcagaaaagagagaagctccacctatttgcacctaaatggaacttaaggataaagcaagaagactacacttcttctagtacctgctgtctctagtcaggcaaaactcagtgcatagggtagggctgaattgcttgaggatttgtactgaagacatttttgctagtaatactgtcctggtatacttttcgacattaaaactattatttttatccctaacccctcaaagtggcaggaagctatcacttgaggtgcttctttgtcacatagtgggatgtacattctgacaaaccactcacagcctcagtgggagtagagaagcaaagagctacttggcgaagacagctgtaatcctgccagatgattcatcttggtgagagaggaaaggaaatttagacaaattaacaggaaataagtatgatcctcaaaggcaattagaaaagtcagaatatgtatgtgaaaaagcaacagaaaagtgcatccaaaacctgggtaaccagtttcttcatgcaaaatctctgtgtttaaagaataataaactggccaagctgtggttcccatgacaaatggctctcccggaaaagctcttccaaattaatccaaataaatagtcttctagatttcaccagtagccatcttagtgttaggcaaccaagtacatcttctgttgccacaatcatagggaggggaaagtagaaaactgagcatccactgagctggatgctggttccaggtctgccactcgtaggtggtatgactttggtaaagctactgggacatctgtgacatcatttcctcataggcaaaatgaggtggttggatgctggaggtaatatttagctctgagagtcagtgacttcaaattacctgtcttgtcttctattcctcctcctgagcacctaagacttgctgaccatcctgatcaccccacatggtgactgacccgcctgtgtcacactacagctctttccttagaaaccagacagaagctggccacatggtgcacatcaacatgacaatagtcgggaaacatggcctgtggtcttggctacacgaataaatgtgagattatccaacctctctgaagcggtcctcgtctctaagatcctggatgatcactttatagacttctgcccacaacaaccctgaagcattctggcaataactcccactaagctgtaaggatgctgcctggttctccgtgtctctttcaacccagcaaacttagcagtcctgtgtgtcaaagattatgccagacactgatgggagagtcagaagcaattatggtttgggccactctagaaactcagctctacacgtaaggctttgaacttgtggggctgagaagggttcactgtgagaatcagccctgcggcctcgctgcccacatcctctctgccaagcttccactgaatttccagggcctgtcatcatgtcaagaaaaaagtctcagtttcgtaactctctaacacttgctaattgttcaacttttaataaaggaaaataggcctcaagctcagttagcaggcaccactaactaaggcgaatttagagtcctgtcttttttttcatttaggccataatgtcctcccactaatgcagatgaaatgattttctatttctaggaaggtttttccagcagcagggttttcctccacactctgcttcttcagacacctctgctatttctcacccacccagtccagtctagggtgtctgaacagggcccaccccatgccctagtcacttttctgagtgacccactgaccttgctgccccatgcctacttcctccccagcaacgagcttcctaccaacccatgcttcaaacatttctgggaactcctcagagccccgagaggttaagtaattccccaaacatcaggccgcttgtgagtggctgctcagtgatgatctgaatctaggctgttggcctctgaaggctttaaacttatccaacattctctgcttcctctcaccagaatacccatagtcctctgctttcttgcatcacagtgcccataaccctctgctgtctctcatcagagaacccacagaccaaaggatactcccatttatctgaattttactccttcaaagaccaactcgactcccatcttctccagaagctttgcatgtctcctatgcagaatgcataggctggccactctacagtagaggctggtgttgggttagtgaaaatgagatcacagccatgagaccacagccacaggaagctttcacatagtgagcaagaaaaatcagccaagccttgcagtacaatgattttttttttctttttctttttctttttctttttttttttttttgagacagggtctctgtcgcccagactgtagtacagtggggccatcatggctcactccagcctggacctcccaggctcaggtgatactcccacctcagcctcccaggtagctgggactacaggcatgcaccactatacccagctaattttttatatttttttgtagagacggagtttcaccatgttgcccaggctggtctggaactcctggactcaactaatctgcctgcctcagcctcccaaattgctgggattacaggtgtgagccactgcacccagcccgcaatgattcttaacccaggcttcatattagaataggcctgcggaaatttaaaaaatcctcatgcccaggccacaccccagacccattaaatccttagggtggaaccagcacattagtgtttttttgttttgttttgtttttaactctccggatgattccaaggcacagccaaatttgagagtcactggtgtagaaagtaattaatgccatgcttgcaagatatgggacttggaatcaaaagatcaagtccactcccagcctgactcactgtatgacctgaaaaagtcaactgcctgtgtcaaacaggttcttcaccagagagatgaacttgcactttctgccctttctatttcaaaaggttaatgtgaggttcaaatgagatgatgctgcaagagtaccctgtaaactgtaaaacactttattattactgtgtcaattttcactaccagtcccccagtggtgatgttcaaaagctcagaagaaaaaaaaaggtaataaaaatgcacagaaaagaaaaatacaataacagtagggttagaataattaaatacagtgacccaagagaaatatagcctattttatatcttaagggtatgtttataaattatttttataagtacaataaaaaaggttgtagcaggaaaggaattgtattcaggtgaccacttatagcagaagcttattaatacagaacaagggataggcttggccttaatggggagaaatgagtttcctgtgctaatttattaatttaatgtggaacaaaatttattaggggctgaggtgggaaacctaccaaataaaacacagaaaaaagcacctgtacattttgtaataagaaggttgttagtgggaacttgagagctgtttgttacaaaacaatggaatcatcatgaatgagattcttggctcttcgtttaaacaaatgaagtgaaaatataagccatcataaaccccaattcaacaggcttgttcccaaagcccctttgaacctggtttgacacttggtgcatcccacagaaggcatgcagcaaatagccctgagacagcaggccaggccctcaacattgacttaagacataccagcctcaggtctggatcctgagaacatgagggaaggaggacagagaggatccacagtttctctctccttttgcatgcatgtggcatgtgacaagccctaaaatgagggttataatttgtaatttgcatttacttgcttttttcctcacttctgtatccctatgctaattcctaacagctctttcccccggttcacccagggaaccattaggaattagtctattgaataagtctaaggtttcacccagacttattcaatcactgtagaggattacaagctcctaaatcactttagggaaattattttcctgtctccttccccttcgaatactatgtcctaaattcccgttttctgagatgggttgatacagcaaaccctcagattaactggttcaaactaatatgtgaatgatgctctctgaagtatctgtcatcttaatttcttttgctttggaatgatgctttatggaggagatttcagaaaaacatatctaagtgaaaaatactggtagctggagtatggaaacaacagattgtgcagtggaagaagacagcaccaaaacagcgtctcctgcctaggaatctgaccctgggtttggcactcctgaggtgtctacatttctcacagcttcatgattttctccaatgctaaagctttaggcttacgaaaggcatccgtggcactggccatagaagtacagtaaggtgaggcaggaagaatttggctatgtgaaggggaagaacagttaagtagatgggggattagctgtataataatgataatatctactgtttattgaatacttaaaatgtgctatgcacgctatcatacattatctctgattgttaaatgaaattatgtctaaggaaccactgggaaaacagaaatctttccctttagcctcactatacccactacatagaagaggaaagtgcaattccagctaattaggttgccccaaatgacaaaaccaactgagggagaaagctaggattcatttccaggtctgcctctccctgaaactttttctcatttaaattcctcttcacaaattccccaaccagcacctcttatacatgtggtctttaagatgtgagggactgctgggacttcatagcagtcttttaaaaaaatataatttcagcttttattttagatccaggggatacatgtgcagatttattacctagatatattgcgtgatgctcaggttaggggtatgactgatcccatcacctaggtagcaagcatagtacactatagcttttcaacccttgccccctccctccctttcccctatgggagtccccagtatcttttgttgccacatctatgtccacaattagccattgtttagctccttcttataagtgacaacatgtggtattttgttttctgctcctgtgttacaggataatgtaggataatggcttccaactgcatccatgttgctgcaaggaacatgatttctttcttttttatggctgggtagtattctgtggtgtatatatacaacattttctttatccagaccaccactgatagggacctaggttgactccatgtcttttcatgagatgtctttccaattgtttgtgtcatctctgatttctttcggcagtgttttgtagttttctttgtggagatcttctacctccttggttaggtgtattcctaggtattttatggccattgtaaatggaattgcattcttgatttgcctctcagcttgactgttactgatgtatagaaatgctactgatttttgtacattgatttcatatcctgaaattttactgaagtcatttatgagttccaggagtcttttggcagagtgcttagtgtttcctaggtacagaagcatataatcagtgaagagagatagtttgatgacttcttttcctgtttggataccttttatttctttatcttgcctaattgctctggcaaggacttccagaactatgttgaatagaagtagtgagagagggcatctgtttcttgttccagttctcagagggatgcttccagtttttgccctttcagtgagatgttggctatgggtctgtcatagatggctcttattatgttgaggtatgttccttcaatgcctagtttattcagggtttttgttttaatcatgagggatattattgaaagcttttcctgcatctattgagatactcatttaaaaaatggtctacaatttccctttcatcagattatttcttccctatgttaatctagctattgcatggagaaaagaagaaatactgagtattgtttgcctctgtgtttgaatggatggctgacagactgacatgggagtcgggaggaggggggcaacttcaatagacttctctactatctccaccctttcagggcctaggagctgacaaagtcctgtgcagggggcacctctggatagtttcacagctggcacatgcctaaagtgatttaggattagatagcccttcccctcccaggccacagcaaataattattagtggaagaagaaacaccctttgaacttccattgagcatccacattctcccatgacctgtaagtcaaacttccttaagaatattctatggaaaactaagcatggtggctcacacctggaatcccagtgacgttggaggctgaggcagcaggactgcttcagcccaagagttcgagaccagccagagcaacatagtgagactctctctctctctaacaaaagaatcttctccctgtgcccttcctcatagagttgagctgtccagaaaagatcttcaagatcatggagttgactgatactcacaatcatagcaatggtatttgcatcacctggggaaaatgtttaaccatactaaggcccagtctcagctgccggagactctatggaactgttctgggttgaggcccaggtgggttgtgaaccccaatccatcacagcccaatcccttgtcttacaaccgaaagctgtaaaggggaagatggccacctttctagacccagaaactgctccagagggcccaggaacaagcttctaagccacaaaggttgtggttctgcctcctcagatatgcctgtcaggccaattaacacctgaatcttgcaatggcttaaatgccaacagcagacccctggccagaccattttcctttcaccccacacctggcaatttctcttcatcgccatgctgtgctcgccgtgcagacaaaatcaataaggacaatatagctaaaaggttaccatatagcagagatctcagtaatgaaagtgtatgtttttttccagcaggcctgttccacttctttcttaactatttcctcattccaaaactatatttcctgtcacagcctattttctctccatttcacaaagcattaataagccaagttctaaaaaaacaaaagacagttttttagccacaagtgaataaaagtaaggtcaaagttcaaggactgatatcatcgtgattttgctctgttcaaattcatttgtttcttagaccaggaaataactgatatacctggttaatgatctagaatgccccaagtatttgctcaagctgcacacttactaaagggcaacatcttttggatggtagccacagaacctcctgacctgaaacaatattgggtattcaaaataaaggctggctctctgctgagatgagctggggaaacagcgggtacatacattggcaataaccagctcacctgtagtaagagaaggtgcttttccagggcaccattttattcacaggttatatttgttttaacagagagaccatattctgcttttacttggttaagaactcggttcagggtcaaaacgtctaataggaaaagcattcgtgtctgagcacagaatttaggtagaaattgagaacaagaaagtagagtcagaacccattaaaccagggattttaaattccggagaagaatgtacatatctatttcaactcttagtgatgttatttaaaactcttctattcctttcaaagtatttaacatgactttggatgtacgagacaaatactttttagttagtgtgccagccagcaggtgctctcaaatgaaactgttttgaaaacttctggatatctgggaaatatttctgtaggatgtagaataaaaaaattcaccttatagaataatttcaaagagaaaaggaagattcatcttgtttgaaagacattatttttgactgacctgaatctaagcacacactttggttatgagaaattccgccttctgtatctgaacttgttatatgaacagtggatgccacttaaaacaaaagaggaagaaagaaatctgcttcctcaaggaagagtttcagccctttaaatcttaacacacaataaaaatactcccattaccaccatcacccacttcagcagctattcgaagttcataacaattcatagaaaagaacaattgcttaaagcagaatcaaaaacccttgagacttctcaagattataggccacagacataaataaaagctctcaataaaaatactttataaccttattgtgtattaaaatgttataaataactgtgcaaagacttagccactctatcaacaaacagaattttagatttcttttcccagcctgtgtgcactcagtcactcaatgtactcactgccgatctacatatttacagttgtttaccacattttgttaaggcttaaaaaaaaaataaggaaagagaaaggaagcactttctaaagaactgtaaattacaattgagctctcttaagagttcacttatcttcgctgattaacttccagggtacttactgaaacaggtgttgtgtgtataaaaatcagtatagatgaatatagcatgtgctggagtgagactttgggctgtgaacttcacttcaactctattttaaccttttcaaaatgagggaaaaggttatggtgaaatgaataggtgttgatgtacctcactggttcctagcacagatctacggacaagaggaatcaaaatgatctgtcaaacctggaaacaacaaaaccaagcagagtaccagcccgcatcacttgaactcagtagatttaaggagatgcccatacagcagattctgttgcaagtccctcaggtgattctgatactcagtcagggctgagatgaactagtcaggaactttccagttcttgaaaaccacaaacacttcaattttgccttgtgtgtacatatgttcatgaaaataaaatctattatgttagaaatttggcaaatatacattttatactaaagatattgctatttaaaggagatttcttttaaaaaagatatcttttataattgatagtttaacaatataatttttcaaccctaacttttctctccagtgtatttaaattttggagtttgcttaaagtatacttaaatcattacaaggaaagaaggaagttgtatggcagacaaacctgacagcaataacttaagcataccctgagaatgaccctagggtgtaagaggaatgtgtgtttggagttccaaacttatgaatccaggagtggacaatccagggattcattccttatcaatgaggaacatcagaacccaggacccatcctatggaacacaggctggacaggtgatcgaggccctctgttttgggttagatgaaagttgccaggtggaggttgctaggcggagggtgctaagtgaaaatgctatataaactgcatgctttttgccagcagttgtggttctcctgtccagcctgcagccactagaccaccctgtatgtaagttccctcaataaatcctgtgtgtcctccactggctctgggtgtcttctttgtcttctcgaacatggtgctgtccctactgaagttaataggggtctggcacaacaaaggtaaagttcaaagtcaaaaatttcctgccacctctgttaagaattatagtctgtggaataatatctctgccaggcaagtcttgggcttcagtcaggaaggtctcaggccatgtcatgtgctttccacataccataaaaggaactggatatatatttcatgattgataaacttagggataactggaaaagggtctctttccccatgcttaattacatctaagagtatgtttaaagaattatttaaggaaaaagtaattatgatgttcagttagatcactttaaatggaaataacttggaaacatactacattgctctagatgcagactaagggatcaatgactgaaaaaaaagaacatctttggaaagaatagagctgggcccagaaaacacaacagctcagggctctttaagaaggtgggataaagaggtagagagaaccaaaaacttggacatcactgaaattttgctgatcactatacttaacctctctatgctctccactggggcaatgactcaccaagcactccatttttatggcagtctacccagctaattaaaagggtgcaaaggatgtcgagtgacctaacattggtaatgtgtaactttgggccaactatttaatttctctgtgcctcagtttcctcttctgtaaaataggtgaaattacagtaactctttcaaagcgttttatgaaaattcagtgagttcatacctgtagaatgatcagcagcatagtgactggtacactgcaggtgctcagtaagtgttagatagtattaattaggtcagataagtggtctatgctatacctcatgtagtccaggccttatagcattgggaagagtagtgccaaaatcccagcattctaagagcaagaggaaacccttgaagttattgttctgttctaagggtttcacttggtttagcacatgtttcaatcattctacatacgtaatcccagcactttgggaggctgaggtgggcagatcacgaggtcaggagatcgagaccatcatggccaacacggtaaaacctgtctctacttaaatataaaaaattaaccaagcgtggtggcacacgactgtaggcccagctacttgggaggctgaggcaggggaattgtttgaacccaggaggcggaggttgcagtgagccaagatggtgccactgcactacagtgtggctacagagcaagactttgcctcaaaaaaaaaaaaaaaaaaaaaaagccatcacttacagactaagagatttcccataaaacttgaaattgtatcttcttgaaacatgtggcgatctttctgcactggtgtgtttctgggttgtctgaatctgctgccactgagctgtggctgcttcccttagggcagacagaggctctccagcctgccataggccccaccagtccctcctgtttctctggcattaaatcaggtgtgggttgttatggcatggctttcaaaagcaaggcttttgcctagtaataaaaaacaaatgacaaaagtgctctgtatttatttctttatcaaaagtgaaaaaaaggaatgtaatcccctagagggtacttgatttttctcatatctggcctactttagctatttacattaattggtgactctaaattcccttcttttaaaatatgaaaaacaaagaacccagagactttaagtgaccatctgaggccataagtcttggtagtcgcagaagctgtatccatagttgggtccttttccccccagttaccatttccacttgtccattcaccttctttctaaatgagttagctaatgtgattcaattcatattccatacagaaaagtaggaacaagaggaagcatggcggctacaatgaagaagtgcagaaggtagctatggacatacgagccctgtaaagggggtaaccctttgttagttctgtgattatttgcatcttactcaggctgtccgtgtttaaatattttggcagatgaatgtgatggaatgatgcccctctccaatgggttgctctattttctttatgcttaattgccccctttcatgtctaattgtaatttttttctaacataagttccctaatttacttaattaaatgaaatggtggtgtgagtgacacaaatatgaaacataacacatatgaaatcctaaaacacctagagagaatgagctggaaagacaaagcagtggggacccgggaggtgcttttccttccttgagctccctaaagttaatcttttcaggtcttcccttctccctaatgaaatgagtctatcctaggggcatatgtcaccttccctgcacatatgacaatatttctgtgactcatatgcttgtcacttcctcagggggaatgagaatcgaacattttatagcttgttaatatatctcagtttactttattattggatttttaaaatattgagacagtgactttgtgacctgagattttagactgtgcctactttccaccacaccatcaaaatattccacagataactgctcagtttaacttcatatggaaaatctgtgattaatttatagttctaccacttggcatttgcgagttcatcctcaaaagatacccacatcccagtccctgaagatttgagacctctacgagctttgccataaaatgagcctgaaaatatctcctttagtggctattggaagaaagaaataagatccacgttgtgtaagtgctttgcaaactgtaaagcaccaagcattgagttccatgttccataagtgctttgcaaactgtaaagcaccaagcatatgtgccctgacaatgagacatggtcccagaacactgggaacacaagatgctctgagaaaggcaggccgtggaactcatgaggaagctcatgactctcatgtccatttcaagagacaaaagagactaaaagagaagtggattattaaaaataagcctgagttaggaagcagagtctccaaggagaacagtgggtttcatgacacattcctttgtgccctcagaatgtgtggaagcttatattttggcttctattacgttgttgaatatatatgattatctacctgccttccccactcccgagcatcctataaactgagcatttcaggaaaagacctgtgtcaggcatctttgcatctctggtacttagaccaatatcttctgggtacttccagcctgttaagttaacatgtgctgcttagtgtgacagaataatacctatcctcaaaacatgttcacttcccagtccctcaaatctgagagcacatgttaccttattttgcaaaagggacttttgcagatttgatcaacttcaggatctcaagatgaggaaattatcctgaattatccagttgggctccatatcatcacagggtccttataagagggaccctagagaggacaatgagatgtgatgatgaaataagaggttggagagatagactggaaagatagaggcaagggccacaagctaaggaatgctagattctggaaaaagcaaagaagcaattttccctggaggcccccagaaagaatgcagcctgaccaatactgttattttggacttttgactttcagaattataagagaatgaattgtgttaagccaccaagtttgttacagcagcaacaggaaactaatacacttagataagaaagtacatgaaaaactggcatttgaatgaatgaatgagcaaatgaacagaggaattaatggaaagagctctagatagaaagcggaaaggcccaggttcagatctcagcatagataataagcagacctatcatttaacttggggcctatagtgtaatctctctggaagtcctcagcataagagctaatgctgtggaatcagactgaccagggttcaaaactcttctaggctacttcttgattgtacatcctcaggcaagcacttgcctctctgagcctatgtccacatctgtaagacagggatagtgccagcacctcctgcacaaaattgttgtggagactgaatgagctacagtctagtcacatttgatggggctctgaactaggtaaatttgaaactgtggtcacatgaaaatgttattaatgtcacttcatgcacaaaacttgaaatcatgcaaattccccaattaaaaaaaggtcaggaatggcaaagctggtaaattgtaaacctctgattaccacatagtgggaccgtctcagttgctgaacagaaaacacccattgtcctttgagagaatccatgttgaattatgcaagctataaattacacaagcaacaaattatgaaaggcctttgggaacacaccccctgaacaaaatatgactacctttaatgcatgcaaagcaattagcaggggcctggaacacagaaagctattactctgctattattatattagctcaatgataaaagactcagaacaaacactgctaccgcagtggaaaatgaaagtaactccagctttcccaggggcctaagctttacgtgggcctctggctcctttcagagaaatcttgcaagttggaaaatctgagacaggtgtgctaatgacaccccatattatgaagcaataaatttcccagctcttgcctgaaacgcagaatttggccgcagggaggtgttaactatgtgctccactagtatcaccacgcatacatcatgcataaactattttgccgctattagccttatttagaaaaatagaatttgtgagatgaaggggatctccctgggacttggcgccacccagcatcacctgcccttctctcttttctcgtttcttgaatgcccagggcacaaggctgtccctagtgcatatgagaagttcagtaagtgtttgttaaatgcacagtgacctttacagttcatgtaacccacctccctttcccattttacagataaggagcctgaggccaattaaaggaatgactgaaatatccctatcatgtgacattaattcaagttaatgactgtcttctccctacagggaagagttcatttcccaaaacgaatagactgggttatggagaggtaatagttttaaaacacgtttcttaaagcatatctgtttttctaagcagctttccgtttcgcaaaatgaatgctgctgatgatgttaagtgtctacaccacagatgtggctaataattgtttaagagctcagaagagaataagcaaaagaaaatatgaatctgaatgaaagagatccaccatgaagaaatcagatgtagcctaagaatgatgcctgattatttagttttaatgaagccaggtgttacatgtgatggggaacaaataatttacttcacagattcatatgaccctttcaggctgcatcgaaccattcaatgcagaatcgagtcgcattttttacttacacctcaactttgtaccaaagcagttataatatctatgaagaattcagagctaggaggactaaaattttttccctttctttaggtggccacatatcaggaaacgctgagcatgcattccctttgtcaagaccaccctctcaagaagaatctaagccctttccctagaaattgatcttagtgatttttccactgtctctatgaagctaactttaatttcttctgaggtagcttaagtcaactctttgcattatattcactgcacatgggaaagaattcttactaccttcttgaagtagccctgtgtagatttcaagggtcaacaatttaggatacagcctcgcctcttaaggttaactgtggccagatttcttaacttactttgatacttttacttgtattaacatattcctcccaatcccttttcacaaccagttgggttgcagagcccacaaattcaggtaagctaatgccacattatgctaatcagctgggttcctatgcttgctttctcaaacccactggctttttagccagcaaaaacctagggctgcccagtgatgacctcacatttccaccaatgtccttgctttttaaagcttttcatacatagttgtgcagtggatgctgggtctctatttgtgatttgaagtgattttcagtagaagtcctaaatttatctatatacagtgtctgtgctgtttctattgtatttcccttttccaccataccacagccttctcatctgtacaggcaatctggaccatactcagattagatgtcctgcttcctggcctggcagctttgctggtgttaaaggacagtgggataagggctatcagaagaagacaaagacctgttatttcactgactgcttactctctttggacctctttagactccttgttgcctgagatgcaaggccagacccaggaggactgcatacaccccagaccccatccagctcttccctgtactctcagtctcactgtaactttttatttccaggacattacttaattatctggagatgcttattctccacaagcctgctgtgaagattcacaccactgcactttacctaggtgtcccttctacctggaatgcccttcatggagttctctattccacaggcccaccttaaatgtcacacctctggcaagtatttattcctcacctcctcagccaagatgaggcattctctctcctgtgctcccagagaatgttgtacacacctctcttttagtcctggccacagagtactgcaatgcctatacaagtctctctcattcaccacaaacttattttttgcatcttctagaatcaaatctacactctgtttcacagtaggagtttatgaaatgaatgaattgaataaacgtgtatgattcctcaaaacagaggtgactaggtggcttttagcactggggtctggaacacaccttttatttatctctgggttagagaggacaaacctagagaaatacaagaaaaacaagcagaccagtacccagccaagaataataaacatggtgtacctgatagaccattatattaacagtttcttcttttttctgctctggagatccttgactctgcaatagatttcgtactgtttcttccatcctgagaaacaaaaatattaagaatttcttaaagaaggtttctaattaacacggatccactcgagttgtagaaatcactcttctatgcgtatttcccaagcttcaacctggaaatctcttttctctctacttcatcttctatcagttatctgtcatgaagtcctttgcaaccattctttgggatgcctctacattctctttctctaccattcaggtctgcctctttatacttggacatctaaactcatgcacctatctcccaatatccctcttcatttccaatcacttctttttaatttgatacagtatcactacatcaatcttcccaaaaaaccactttcatttttaaacaccaattttcaaagttaacacatattataggaatgcactcttcccattaatctactgtcaggtctttctgtgatggtctttctatgacagcacgtaaagatttacttcattcttctcaactacagtcatgcattgcttcataacaggaatacgttctgagaaatgttgaaatgcatcattaggtgattttgtcattttgcaaacagcatagagtgtacttatataaacccagatgggatagcctactacacaactaggctatattgtattacctattgctcctaggctacaaacctgtataacatgttaatgtcctgagcactgtagaaaaattataaaacaataatatttgtgtatctaaacatacctaaatgtagaaaaggtacaggaaaaataccatataaaagacttaaaatggtgcacctgtataggccacttgccacgaatggagctcacaggactggaagttgctctgggtgagtcagtgagtgaggagtgagtgaatgtgaaggccaggacactactgtacactgtgaacactgtacactctaaacactgcaaacttacactgcactaaatctataaaaaatatttttctttcttcaataataaaccttagcttactataatttttactttataaacttttaaatttttaaaaaactcgatgcttgtaatgacatttatcttaaaacataaacatgtataagttatataaaatattttctgtatgtccttagtatataagtttttaaaaattgttttaaaaaacattttttggctgggcacggtggctcatacctgtgatctcagcactttgggaggctgaggtgggtgggtcacctgaggtcaggagtttgaaactagcctgaccaatatggtgaaaccccatctccactaaaaatacaaaaattagctgggtgtggtggcaaactcttgtaatcccagctactcgggaggctgagacaggagaatcgcttgaacctggaaggcagaggttgcagtgagccaggatcacaccaccgcactccagcctgggcgacagagactctatctgaaaacaaacaaacaaacaaacaaacaaacaaacaaaaaacatttttgtctgggcacggtgggtcacccctataatcccaacattttgggaggctgacgtgagtggatcacctgaggtcatgagttcaagagcagcctggccaacataatgaaaacccatctttactaaaaatacaaaaattagccgggtgtggtggcaggtgcctgtaatccagctactccggaggctgaggcacaagaatcgtttgaacccgggaggcagaggttgcagtgagctgagatcgtgccactgcactccagcctgggcaacaagaacaaaactctgtctcaaaaaaaaaattttttttacattattttattaaaaactaaggcacaaacaaacacattagactaggcctacgcagggtcaggatcatcaggatgtcaccggccaacaggaatttttcagctccattatagttttaagacaccacagttttgcatccagtccacagttgaccaaatatcattatgtggcacatgaatgtgcttcctagtatgtcatgttgagaatgtaagttacttaagattcccctacttatgaaatttaaattacttcaaaatttttgttattccaaacaatcaacatctttacacatacctctttatacacatgtgtatttctacaaattatatactacatgttataatcttgttttgttttaaatgtatacctccagtgattccccattagctcaaagtaaagagtaaaggaaacacacccattcccatttccagacatttgcttatgctggtgatacttcttagaatgccccctccatttcatcttcctatatttcaaccctcttttcaaatttaccttaagtttcacttcctaagataactcctcattgatctcctgcttctttgaattcttatagccctatacttcaaaccatttactctatcacttaaaaatccttcactttaatgctcaaatattttgtatatgcaggtcttatcttctggaataaatgacaacatttggtataggactatgccatatatttctaatgtatctctctcaactgtagataaaatacatactcactagacattattgtatgaatcctttgctaattcattttttaaagtgtgaagtagttactctatgccagacactcatcctgtatgttcagactgtgtctggatgaccttgtcattggggcccaccatgaagattcatagacccaaactctgggagcaagaagcctgaactcaatgccctgaacacgatgctctctgtccagaacctgaactggttatcttttccaggcccatcttgaagcatgtatttgagtgactcagtatgacactggttgaagagaactgtgaagaaaagcaggctgatccagcttctccctcttactaagggcttctcgtatgacaaattaagggctctaggagaccagtgaatccgctgatgtaggaagcccattgcagtaggcaggataagacagttcaaaatgccacctttctaatatggcacgtaactactcagcagcagagtgaggaaactgcagacaactgggacaggccagacctagattattaattggagaaattctgcctttacagaggatggcacaaggactcatttgggttttcaggaagatggtgggcgctggttacgagtactctaaaaatgatttgtgaccacacatttatacaagccacctctgcatgtatccagctgagaaagcagaagctgttccctatattttcacaaatcttatgttattaataataactcaatctaatagtacttttaacttgacaaagaactgtctcatctgttcatcattataatttacttttaaaaaatcattctatctatttggtagatgagaaacctaaggtacagaaaggttagatggtttgcttaagagatcatggttagttggatagggagtttggatgaaatcatttttactgactctaaatacagcagcctctttctacttgaccttattggtattcaggaaaatggttttaaatgagtaagagtcttaactcctaactaggagttaccttggagaacaactttggtggatgaacccaagaaggcaacaataccatttctgacctggggagagcatgagaaaaactaagcttatgtgaaaaaaaaaaatcggtgcaaagaagtcacaaattctgaaataataagtgatcagaacccattgctaatacttgatttcattttatataaacaagctcttgagtggtatcagattttccatcatgtttgccgaactatcataaacaaggaagtaatgacaatggtcctaagacttgcccaagatcactcagcttgttcctggcaggtaaaggcctggtatcctggttttctaaatattagtctactttcttcccaccttagcacagaagctggatgtcttcttttaatccttattgcattcatttttaaacatctgacttaaaagtggccaaatagttagaactcggttaaaatgaaatcatattattttttactaagttaaaacacaatcttgtctcaatgcatatcttgctaaattatctcttctgtaaaattacaagctataaacacaagttgctggatcaaaaagaaaaatatctattcacctttcccccatttttcttggctttatacttaaaaaataggaaaaagtgggggtggacaggaaattgttaaaacaatcttgagcagttcagaacccttagtaatatggtaaacactcttctggcactactttatgattaatcaaaaccaattacatttcccacccaagtcttggaacagagtcacagggccccatcctaacccttggtaaaaaatcaagttgtcctatctttttataacctctatgaatcatgtcacagagaaaatgttataaacctgataagaatatgccattatttactccctgatgacatctttttttaaaaattcttatttaacaaacttctctattttcccaaaaatcaaaaatcaaagactaaagcatcttccattgttgtttgacgcccaattacattttgcttcattttattatttcgacggctaatgaatgaaagtttgcattactagccagcacatagtacagttccaccatctgtctccccaatatgattaagaaataagccaattcctccctctccctctggttcaggcttgggcagagttttgtgtgttttgtttgtttgtttattaaatagctggttgcaatttatccttaaacactcaccttaattcatgtcttctagctctccatctccttcccccacctgaaactaagaccattttttcccctaaatattggtcaagtagctgccataactaaaaatatagaaaccaaaattatacttaatgagttgtaataaattctaacgtacatcaagtgaactatttttaaaaagttaactcctaggacagccagaggaaacaaactaaatacatatatgcaaacagtatgtctcaggtaacattaggtataaatgcaggcattttattttattaaaatagattccattttttaaggtacacactatgtaatcaataaattcttattacactgtttcctctgggagaagcaaaaaccttgcttaagaagggcactaagttaaaattagggaaattgcatattaaaactaatgcatgagaagagtaacaattcaaaagcaccaaagagcaggatcagtgagccattttaactaaattctctcccagttcccaggggaccacctttgtcattgacctccttttaaaatacggaccactggggtacttgtcactggatctgtttccagtgtctcaagagctggtccgtctagacaccaaaggaagatctttctgaaagaaaatgttaaaacacagtggttttctgaactctttcatggtaagacaacacttgataatatcaaaggccttctttgtaatcagagactatggattggactttgaagacctggacttattcaataatgaaagcagtgttggaaaatatggctccaagctacattagaagctgattattccaacatgtaaatgactgtgggctttttcacatgctttccctccaaccccaacccaaaatctagccctctgttttgattaatgacactctagggactgatccaattattacaccaaattgttctttttcacccctatattcagttatttagttgagactaacttcatttttgacagaaataaaaaagaacagaaaacaagaagccactcaagaagttattctccccaactcacactgataactgatagggttcattcaattgaaggctgaaccaaattaaattttgtttttagaaaatattttaacatgtttacttgctgattaatcaaatacctacttaataatgaaattaaccatgaaattattcaatattccttaatattcttttagtcaggtgagagggtgcaagaagtgcccgccacattccctttgattcccccatgccatgaagtttgtcaagagctgctgctgaaacttgcaaattgcttttctttgtgtttcattgtatttgactcccaaacttctcactttgagaaattgtgtcgatttaagaaagggtcccaccatgactgaacttcatttaatgacaggaagaaagaggctgcagttaaattagaaagaggcagggggaatggggtccttgaagcatccctcccttaccctaggcttccctcctaggaaacctgacacaacacagccccatgtagagaacaatgctcatcttctagagccaatggcaacaaagaggaccagcatacttcccatattggctggaaaagaaggaatacttgcaataaaatactagctccctcatattggatgcctatgtagtagggttaaatatcaacacatacttcactttggatgttcaagacaaacaaaattcatttatttgtatataaccaaactagtcgttgcttgaacctccacaatatgactagcattaattactgtccaaaaccctagtttaaatcctaaccctagtctcttatgatggatttctaaaatttttaaattttttaattttaaaaattcaaaacaggtgtccatcaacatacaactatcctatgcatttcctgcagtggaatatataccagcaatcaaaaggagtaactgatgtatgcagcaacattgaagaatctcacaaactatgctaagttaaagaagccacacacaaaagacaaaatactgtatgatttcatttatacaaagttctagtataggcaaaattagtctatggtggaaaatttaagaatagcaattgccttgggtggtggcagggattgactggtaaggatataaaggaacttcctgggataagagtaatgttctgtaactctatagggatttggactgcacaggttatatgcatttgttggaattcagccaatgttacatttaagatttatgtatttcattgtatgtaaattttatcaaaaaaagagaactgtaaacacatatggaactccagttattgatatatatgtacaccttgggaatatgcctttgacttactttttttttttttttttttgagacagggtctcactctgtcacccaggctggaaggttgcagtggtgcaatctcgactcactgcaacctttgcttcccaggctcaagtgattgtccagcctcagcctccagatagctggaactaaagacacgagccctcaatgcctggctaaattttgtatttttcggagagacagggttttgccatgtttcccagactggcctcgaactcctgagcttcatgcctcagcctcccaaagtgctgggattacagtagacttactttgaaatgcatcaaaaatatttcatttcaattatttaaaaatgcatacattgaggttccatgagaataaggaactcattcaagatgatactcccagtaatagtagagctggtattggaactgtttgactccaaacttgtaatctttttctactgtgccacatcagcattcactcaaatatttaaaccaccctggcatttacttggctgggtatcaacattttctgctatactgttatcacgtggtaacatctggattgatgggttctcgttacttgcaaatgctgcacagttaagccctccgtatctgtgagttctgcatctgtggatttgaccagttgtacactgaaaatattcaggaaaaaaaaactgcacaaagttccaaaaagcaaaccttgaatttgccatgcactgagtactacattgaatccacatgaatgaagtgtaggcgtcgtattaggtattaaaagtaatcttgagatgattcaaagtatacaggatgatgtgtgtagattatatgaaaatatggtattataccattttatataagaaagctgagcatccccagattctggtatctgacgaggggtcctggaatcgatcccccatggaaactgagggatgactgtttttgcattagtcaatcttttctcccaatcagatcaaaattcttctagatccaggctttatgcacagtgatacagtagtcttcttagccatgggggatatgttccaagatccccccagtgaatgcctaaaaccctggatactacaaagctctatgtatactttccttttcctgtacatgcatgtctatgataaagtttaatgtacaaattaggcacactaagaaatcaacaataacaactaataatcaaatagaataattatgacaacacactgtaataaaagttatgtaaatgtggtctctccctctctctcaaaatatcttattgtacggtcctcaccaatttttaactggttgaacttcaggtaactaaaactgtagaaagtgaaacctcagaaaaggggaaactattgtgcattataacaactgttatttacctgttgaagcatttaagaccagctattcatggaaatatatgtcctgcccactgggtactctcaattccaccgaaatgccacagaaaacacagagccaagccttgacccgtcccttgcctaaggaaaccctcccttcatgttttcttaacactctgagctctcctcctgaggtcactgactcctccttgttgtttatgctatccataggaactatgcaaagcttagttattgggtagatatttgataaattctttgtggagtgaatgattgaacctaatggattttttacccttgttcattccctgcatctttacattttcacttcccatagacctatgtatgcatgcgactagtcagagaagtagatacagtgagaaatgccagcaagactgaaggggctatgtcttcacatgcagctaagatgcaagtccgctggtcagatgtaaaacaaaccaaatatctaactgttctttttgttacgttgaatgtctgtatgcttcaactcagctaattagctatggtgtttagaacattaccttaatgaggaaaggttctagattcaatccctaacttaccactgtcggctcctggcagactaatctctgccaagacagcccactgctctcctacttgggagagagaggataggacaattaccttaatgaagaacatattttgcattgcctcccatataatttgcttttaagtttctatttctcattctaattccattgccttcctcaacaaactatcctaccttcccattttaattgcaatgcaaagcttccctcaggtttgtgagtctaaaggaaagctgactaattttcaattccaagagcaaattgttcatgtggaaaatgttggtttagaactgggttctgcccaactgcgccacttgttttcttagaaatgagaatttcctcccttagaagctaggacatctaagcacgtaagcaggaacaatccccaggttggttgtcacttggatgctcttaacccaatctctgcttatcctcgctgcaatagttaggaacagtaaatctacagtgaacataactgaaaactgcactgaaacagaaacttactctggataaatgttggaggactggagtttcttacttctttcctagatgatatatatttttaattcagcacaaattttgcaagaataacagcactgcacagaaaccacagcactctaattcactcatgaggatgcaagagcattcataaacagatcgaaagatgctagtccaatttgaattactgcatcatattcactccagggccatctctatgtgaagagaaagtgacataaattttctcctaggcaggcttgcactgatcctgcttggggagctaactgcacggagagaggccgattgggagagggcagggaagcagagatgggcactcagagaagtcccgttttgcacatggagtagaaggaactcccctgaatgttagcaaacaaatctcaagtgtttttgctcaacagtggcagaatacaaaattgcatttatggattcatgtgtttgtagagttcacactcatccacaaagagagggggagggagaaagaatatctcacatgtgcaagtaaatgccacaaaggagaaatacacctcactggcttttacttgcctggttaacagtttgaaatcaggattgacactatatccagataatgcacaacaggtctacaaaatgggttatttccctaaatacagccaggttttaaattaatgtaataattataattatttatcaggggaaccagcctgcaatatttcaatgtaggttcttttctattttccctaagtgttggccgctctgagaaataaagagaaagagtacaaagagagaaattttacagctgggcctctgggggtgggcatcacatgtcgacaggttccatgatgcccacctgagctgcaaaaccagcaagtttttattagggatttcaaaaggggaggggtgtacgaatagggagtgggtcacagagatcacatgcttcatagggcaataaaagatcacaaggcaaacggcagagcaagatctcaaggcaagggtgaaattagaattaatgatgaggttccatgtcccactgggcacgtattgtcattgataaacctcttaacaggaaacagggtttgagagtagacaaccggtatggctagaattcgccaggctggaatttcctaaacctagcaagcctgagggcactgcaggagaccagggcatatttcaccccttatcttcaaccgcataagagagacactcccagagcagccattttagagacctccccctgggaatgcattcctttctcagggttattccttgctgggaaaataatttagcaatatttctcctattccctttctgcaagaagagaaatatgattctgttctgcccagccccgcaggcagtcagaccttatggttatctcccttgttccctgaaaatcactgttatcctgttcttttctaggatgcccagatttcatattgttcaaacacacgttttacaaacaatttttgcagttaacacaatcatcacagggtcctgaggcaacatacatcctcagcttacgaagatgatgggattaagagattaaagacaggcataggaaattataagagtattgattggggaagtgataaatgtccatgaaatcttcaaaatttatgttcagagattgccataaagacaggtgtaaaaaattattaaagtattaatttggggaactgataaatgttcatgaaatcttcacaatttatgttcttctgcctctgcttcagctggtccctccattcagggtccctgatcccgcaacaattattaatgtgattaattttattaatacatagtcaatagttaatatcatttcccatgttcagtctcatgagctcatctactcaacttcagaacctatccttgtcaaatgtgtccttaaaaaggtcttcaaaataataaaattccacaaatacatggagcattaggtctgctttttattttcttgagtaatctgaagcacaaacattctctgataccacgcaaaaaggactctgaattgccaagacagctactttaaaaataaatctattattttggggatagatctttacagcttagagttcaaatcttgggagaccttgaagacaacagatggctgaatttattattggcccccatatttatctttattggccactgtgtttaggaataatgaaaataatttatagtgaggatacaccttaaattctaattagaggccgttctcttctagaaaactaatgtaataacaacctggagcctcttttcccccatttgataaagattagtattttacaattttaccttggtgaaagaaaaataaaatatggcctggacaatcaaaatttcttctcttggctgggcatggtggctcacactagtaatcccagcactttgggaggctgaggcaggaggttcacttgagctcaggagttcaggaccagcctgagcaatatgatgaaattctgtctctacaaaaaataaaaaaaaattatctgggtgtggtggcaaaggcctgtagtcccagctacttgggaggctgaggtgggaggattgcttggactcaggaggtcgaggttgcagtgagccgagattacactactgcactccagcccgggtgacagagtgagactctgtctcaaagaaaaagaaaaacaaacagaaacaaacaaacaaacaaaaaaagatttcttctcttaatatgcaccatgcttttaaaagtttgaatctaatgttaggtatgccaaatgtagctcactttgcatttcacataagttaatatttctccacagttgtaactggctcttcatcagatggttacaatccctagaacacttactaaacaggccacatgctgtctgtcatgtttcaagatctgtatgggagtttgactcagagaaaattaagaattgaatgacttgactaaacttgattctcactggcaaactcactctaaatctgattcccattttctacatctcacacagtttttattttattttattttattttttttttgacacatgtttagtcattaaagcttggagaggtcaaactaacagtcacactggatctgaataatgtccaaagcagcacagtaagtagccggtgttaatctgttgctaatttttttgatggaggtgtaaaagaaaggcaagaaaatctaattggctgtatttgggataaaattatagtgttatattttctggacaagaagatggaacagtggcaaagagatgctttaagaatccacagtactggcccatctagccgtatggatgccaacagcacattcttcactgggcctgctatttaatttgcatgcttcttgtgacacttgttccatgatatttcagagtagcttctcttaaagaagcagatattgtaaaccacagcacatccagaaaagtcgctctaccaaatcctctttcagcctcaactcttggggccataatatggtcagtgtaacctcaggccctgtgctccctaaggggcgtaggtggagctcagcggaggccctctcaccactatgcaacttaggacagatcacatttcctgagcctcagttacctgtaaaatgaatacatcctcccagtcctacttacttcagagagatgttatgaggatgcaataagacaaaataaaaaatgctatatatgttgatacttgtttttattatggttttaaagatccaggctatctgaattgtaaaccttttggtgctgatgtgagaagggcagaaaattggcttcttggaagccccatccaatcaagttaacactttatgaaggcccctacctgctttgtctctttttgagaaagttcaaggggtaaagcacctctctccaagtttcagctagtaattggtttagagaataatctattatactagttgggataggctaggttatgctggagtaacaaccccaacctctcagtgactgacttactgaatttcttattgacataaagtctgggcaacttcgggtctgagcagcagggtagtcacttttcttccatgggtagggggtctatgtcctggtttcccaggacagttcagctcaagcttactgtcctggcaaattattaacaacacccctttcagtccaaaaatcgtcctggtttggatgataaagattataatcttcatatcaatggaatgactcaaatatttagcctgccccactctctcaatatgaagttttctctatggacaggaaaagataaactggagaatgtagtatggattttcactgcctcattcaacagctgtcacttcagtttaagggccactggccaggactagtcacatggcccaactcactgctagggtagctggtaaacttagtcttctgagtgcccagcaaagagaagagaaccagatattggtgctaatatgctgtcttctatgtgtgcattgtgaggactgaagatatatatgggactactactcagtgactggcagcccagcctcgctaacttttcaattgtgtccaggtgactcagggccgaaattcaagcagggcaagtaagtgttgctcttggtggccttttcccattgggtgttacttttttcctccgttggttgactgagctgtcactattgaggctcttctctcacctcccagctagatattgattgtcactctcctttccctcatgccaaattgatcgccagcctacacaattactttccctgagatctctgaattgtccacatatgcattccctctggtccggaaatcttcagacagacaccttcaaagtctgttttgctttgaaaaatacactatcaagccttcagtaagacagttaatagacatgtttttgatgcaggctattttatagcaaatatctataaacatggaaaagcagcctgtacttgcaaaaaactttataaccttccaagattcactggcaaggaaaatggaagaggtgatttctgtcctggtttcttgtagtgttggtaaaaggatacttctaatgtttcactacttttacccaatatttattgtttaaaatacgcaacttaagacacctcaacaagtagcatgcttgatctttaggaacactggagtatgaaagtctgtctagatatttaataggtcaaactaaaaactgggggaaaaaaagtcaatttaaaaggctgcctctatgttagattgaaaacaaaacaaaacaaaacaaaaatgaaccctgagagtaatataatttacactggggtctcatgaatgtggattttgccaatcatcaaaatcatctggtatttggatagaaatttttctgccagcagctatgagaaaaatgagattccttctcttctccccttgcctatccaaacatcatgcatcctccaggttccagcttaagtcccatctcctgtattcctgacaattgtggcccactggagtgtctccttagtcctgaaatatgttttccctggaacatttgcaggaagacactgaggactcttgctaaaagtctagattcctaggtctacttgagacctagtaaatccaaatatctgagagtagaggccaggaatctgtgttttaaataagaatattcttggacatgaactatgagaaactccattctaatgttctcctaacttattcatagactaccctggcatggttacatacgaacaaaatgatttcatgtatgggtttcttagttaacaactattctataagctcattagggactcttatgcatatctcaagttttttcctactacccacatcgcacagttggttaactgtttatcttgtgtagatggaaattccctaaattaaggagctatatattgatttacctcatttgaggcgtattagatgctgaaaaataaaaggaaaagatgaatctaattttacttccaatgctggaaagcttaaaaataacaccttatgtaatatgaataattgtttcctgatgtattcattcattcatgtatcccctcatccatttatctgttcctctatttgataatcatctgttgaatgcctatgataggctttgtgtggtaatgagtaacttgaatgaagaaaaactgccaactgtaggagacgggcagacccacaatgaccccacaatgtattaatgtattaagagccagaagaggatgccaggggcatgaagagagttgagcatcaacagaggctctctgggccgggcgcagtggctcaagcctgtaatcctagcactttgggaggccgaggtgggtggatcgtgaggtcaggagttcgagaccatcctggccaacatggtgaaaccctgtctctattaaaaatacaaaaaaaattagcagggcgtggtggcgggtgcctgtagtcccagctactcaggaggctgaggcaggagaatggcgtgaacccgggaggcagagcttgcagtgagccgagatggtgccactgcactccagcctgggggacagagccagattctgtctcaaaaaaaaaaaataaataaataaaaaaaacaaacagaggctctctggagatgctgatgtactgaagttttgaaaaataagttggacttagcttgatggaaagggaattttcaaacataactaatgatcttattcgcaaattttaaattgcttattatgattttcttcataagaaatatgctttaggtatgtgtaaaatagtctctctctactgaaagtaagagcgcttcattttagtttggtatacatgctggcattttaatcaaacacaaagcattatagatcattgtcagcccacctacttaaggttcttccaatggaattacatgcacttaaagttatgttcactgctacatacatcctacatctcaatatcaaccaggcctcaagataatgctcctccaatgtgtacatatgcatatttgcagcccctgtctcattataatccatgtatttgtgcatgtattcccaacatttttgggtgctcaggtttcctttagtgtttggaatatgttcttcttgaccttggatgtctataaggatataaagaataaccacatcagaatatctgttgctaagaaagaactgctatgataaaaccaataccaataaccacaacattccccaaccacaagattgacattaaacaatagtcaagtgtcttcaagtattttttatcatggaatacaagcttttatacagcacttttattgtacattcctgattaatgaaaaggattttggaaatacattaactttaggccaaaatagtgtccatttattcttaaattgtcaatggtacaaaaaagaaaaaagcaaggatacttgaggggaaagggcagagaatctatatactgaaactaatttttaaaaaaatgtctttgatatttaaaagcaatagaaaaagaagcacaattctcagataatagtataaaataaaaaataaggaaaattaagcattgataaacaccaaattcccaagtgataggatttttaagatgtaaagaatgagtgataatatactacattgattaagctgctacagaataccatgacactatgcacagatacacacaacattattttctatcttaaagctgtgctgcgggatttttagatccaggattgtaagtttttccccccatctcactacacaaacatgagaaactgtgcagacctttgctttctttccatccacagaattttactgtaatattgataaagacaatagtacctacgctatacagatgttaaaaatcaagtaataagcaagataacctgattccagttatcactgcctccctcaaaacaaaggactgcgctgaaagaagagcagatttaattgtaaagtgcaaagacttgccccagattggaaaagagagggaaagggcctgttttgcagcaaccagttagaacacggtcccctaggacttaattatctatatcttgttaggctataataggggcttaaaatgatattgcaggttttctgcaaccaagaaactgattagtgaagttgagtaaatcaattgtcaatcttcttatgagtgaacatggacagcaaccccagacttcaatagagagccttcattatcacacagcagttaataagcatggctatttgaagcacatcaatacagaagaaggagcttgtatccacatcaactggcagtgtgtttggtgttgctcatttcctgattttcagtttggacagaagggatgattatcattctgtgaaccacgttgctgatctccttgctttgacaccatactcttcaggggaattcaatatgttcctgattatctcaatttcaaagccaattagaatatttacagatgcggaggcccctgagccctcttttgcatggctattgctggaccccttgcttccattctctcttttctcttctggacctctgctttcatcctgccctcttcatagctgtttttatctctccaccggatcttctttatcagatggcaagcaagtaaatttatcctaatggatgcctcctttgtctcctttctcccgttgcaatctattcctcttttctcccttctccccactacctgttataaaaaggaatttatatgttctgctttcacgtttttcctcaacaaatgaacctcaacaactaacttcaatctgactttcccctgatcactatacttacagtggtttattattttatttgttgagacagagtcttgctctgtcacccaggctggagggcagtggtgctatctcggctcactgcaagctctgcctcccaggttcccgccattatcctgcctcagcctccctagcagctgggactacaggtgcacgccgccatgcctggctaagtttttgtatttttagtagggacgggggtttcaccgtgttagccaggatggtctcgatctcctgacctcatgatctgcccgcctcggcctcccaaagtgctgggattacaggcgtgtcagagtggtttcttatcatcaatgggcctgaagtcctccccttcaatggctttttctgcatctttctggttatgtatgtgcctgcactggccaccccttccctcctgaagttttgctctcccttgcctccatgactgccttctccagagtcttctccttcctatctcagttcctacttccctcttccatcaactacagatggccacacccctgtttaggatctcagtcttctgtttgccctatctgctcattctgtctctcaaatcatttactgccccctttccttcagatttccaaacctaaatctccaagcctacacctgtctttcccattacctactgggcatactcaacatgggccccaccagcaccttgctctcagcacatctacaggtgccagtcaccatatctcacacaggctctctgccttctctcgtctttcttatgaaatctggtactgtctgccagccctgggcagcattctcaccccttattatgctttccctggtggttcaggagtataaagcctgggaactgcattttctgactccactgtctacattcaggaactgttaataaggtgcaccagcagggttttgaaagctgaaaacaggtgacatttttcttcctctgccaacagtggtgggattagcgtgtgctttggcaacattaggttttggcacagctggctggactctgcaccctcctttttgtcagcaggctgcagggctgctgggctgttgtgacactcacagcagctccacacattttccacctttggtagtgtattagtccgttttcacactggtgataaagacatgagactgggcaatttacaaaagataaacatttattggacttacagttccacatggctggggagacctcacaatcatggtggaaggtgaaaggcacgtttcacatgaatggcagcaggcaaagggagagagcttgtgcagggaaattcccatttttaaaaccaccagatctcatgagactcattaaccatcatgagaacagcgcaggaaagacctgactccacaattcaatgacctcttactgggttcctcccatgacacatggaaattgtgagagttacaattcgagatgagatttgggtgggaatacagccaaaccatatcaggtagcatcagcaagctcctaattcagggaccacagctcagcctgaacttgacagccattagaggccctctggacttttgctccttgaaccctttttttgtgtgtgtgtaggcacctacatcctggtttacatccttctgtgttggaagtgtcttcacaggtctctattttcctgactgacaatgataccaccccagtcacaggatgaatggcctggagcatcttttcaactgctttctctttcccatcaaaatcccaactcttcccaagcactgccaattccttccaatcaacagcttcctctttccttgaccaatgcctctatttcctgtccttgaactgctcttaaagtcttctaacctgtttccctgactagtgagtcactccatcatcctcacccaatagcaggtccatctcttcaaacaacaatttttatcatttcaattatttgattgaaaaccttccatggacccatccttactgtccgcaagacaaagactgaaccacacagcaaggcatttgaaacacatacttattcctatgcccttatgtctccctgttcttcctcatgtactatatgtgcagatagccatggatacttgggattcattcttaaaatatatgcctttgctttcctgcctccagatctacttctcattttccctcgtagaatgtgactcccatccaccaccagtgaagctattcaaattctgcaagaattagtccaaaagccactagaaatctccatctccaaatggattcctgctgcattttaaaacctaatctatatgattcatcccattctcagttttgcacctcaacaggtgtgttgtcccttatggcacaatacaggtaccacttaacttttagttgaattatactgtctatgctgggcttgattttttggtttatcaaactttgaacaccaggaaaaacattagatcaagttcacttaccatgtttgtaatccaaactaaaacttaaccttactgagatctgggtgctgtggtcttatcacaatttcagccttacgttttcaatattaaatgatgtactccagtgaactgcccaagcctctttggcaaatggcggttttatagagactactgcttgaaatcagtggatcatgagatgataaacgttcccatgtataatgttttccattgaaagactttctaatttataagcaagatctaagattctaaatgggtaaatacataaagttgattcacatagaattgctgatatttgatcacaattgacctataaaaatgacagttttatatggttcaacctaataaacacattaaagtaaattttgatgcgtagtatttgttttcacagcagggctcactttatctaataaagcacaatgaacacatacactttataacagataagccagatggtaaaaggctttaataatgacagcagtaatcatgattaatattcattgagcacttgccatataccaaccatcatggtaagaatgctacataaattatctctttttttttcttatcacagctcaattttaatcaccatttgatacatgaagaaatgtgctgcttaaagtggccaagtaatttgtccaaagtcatataggtactaatcggtgaaagaatttgaaataaagaagacctcttcaagagttgtcatttttgaccagataaaagaaccgaactcttttttttttctcctggagacattctgacttttcattttttggtccctatactaggaggaaggatgaagaataaatataactcatggaagagctcaaatcccaactcctccacaaagccttccttgatcacacggctctgatccctctgttcattgtactactccatggtcatgaacatgtctgaattttccaaataatgataaagcttcatcagggtagtgagcatgttgaatgtgcatcatctcctggagcaaggagtggacattgtatttccatccaaacacaatccattcattcgcccactaattattgagtcttaacattgttgggtgcaaacaatcctgagatacaagacccagtctctactcaaaaggaacttactactgcttaatgaggagatgaacaagtgtgtcgacacaatagcatgcagtaagtaccatgaaagaggtagctagactgtgctgagaggagagatgtgggccacctggaagtgggagggcaggggatttacagagcttttccagaactgaaactgttgtggtgaagcctggaaaggtaagaagtcctcgccaatggaaggacttaagaaaaggctgtccaacaaaaacagcaggtacaaaggcacaaaaaagcctgcaatgtttgggtggctgtgagtactggcatggctctaggacatgaacaaaaaaaattagaaaggtgggagagagaaaagaaataggaaggagaaataaagaaagaaggaagagagcaaatttgctcttgaatttagcaaaattcagatgacagtaaaataagtagccccatgctccgcagtaaaaccaaataaaatccgagctactgtccggtggccagatcaatgccaatgaccctgaggcccaggcctacacacaaaagagcttggtgtgtgagagcacatgaagtctgacgatttataacagattttgcaaatggttggtaatacagtgacagtggcacaaaaaaaggtgatgaaaatagagaagtttctatttctacctgttttgataatagcggctctttagctgaacagatggtgcatttcaccaaaatctgatggaaacaaatctttacaggccttccgtgttaagaaataatttcatagccttcccaagagatttggaatgttctttgtctaaataaatataatacaaagaaaatggtcttttggaatccgtaattaaatagtgttaatgctatagaagaaagcgcggtctgacggctatctaaaatgaatcataataaaatgagagaaggttttccaagtctggacatgttcctagcaacattcagtgtaaggaaggatttcattatgtttcttttaaaaagtttgtgtctgaaaggttccagaaaggatagctgagtctggccaatagaacagagctaatggccacagccaaggtgatcaacctcaccaagaagatgtcagctttcctcactaaaaaaaaaatgtattttgatggggaattaatagatgtggcaatgcaatatttatggattgccactcaaatgaaaacaccttttaatatgtaactgagacacataacaaatttataatgccttctacatttcaaaatttgcattgaataatggtaaagggcaaggaaactagcccattgttaactgattgataggcagtgtgaaatgtgttcaatatttatatcctttccacaccaaccttctatttttatttatatgatcatttcctgacaaacataatatgaacgatgtctgcagaatttttattaacaaagtgcaaagacaatacctctgtgtctatacaaaaccatctgctaatgtctcatgtcaaaacctatttatgttattttctttgttcttcctatgttttctgaaggcaactatttgccattaaattaatcctgtccaccttcgaggcatttatgcattcttctggcatttcacattctttgggaaacccttgggtatgcagatttcattacaaaaattcttaaaacaaagcagggtcagggtttagaagtataatatacctttcctttcctaatgtagaaccagaaggctatgcacaaatacagtatttcattttgcaattaagttcaggtgaattattcaaaacttcaaaatgtgaaatatgccatgattatcattattcaaacccctgtaattctccaatatttttgaatggaaacatggctgaaggtgcccgattagtaatgaaaaaacaatggtatagcattcttgcctgtagattctgaaaaaaaaaaattgaacactttaaatcttcctctctttactagactgtacattcattcaattgacaaatcctcatgcatgccttgggacttttctgtaaggcaagttcttccccgcccccccactgtttccttctctccccagtctccccaaacacatgaaagcagtaacacaaaagagatttccctggactgaaatggaggccccagaacatactttataatcaagatcatactttgcaatgggcaacacttctcccctgctacttaatttcttggggttatacaagatggtaaaaaacgaaagagcagcaaatcacagctcttaatggagggcaagcaagggcaaggtgaagagtcttttccaatcttcctcagtctctatctcaagaccatactgccccaggaagctcttattgaccttgcaggtcttgatctttttcatcctagcaacccctcaagaagtgatttgtgctctgtaacactattttatcactcacattgttgtctcccatagctttcctcaaatgtcctggggtgcctattctgtctatatcccaacccaaacagaatggtggtcaacccaccatgcaacctgggcggtgcaggggttctatgcaatgagcgcctagcaatcgggttgtcttaggaagccacgtagaagaggcctgagttcttgagggcacactgccttgtttttcttttggtttaaagttatgacccaccagaatactgacatactgtctactaaggagttaccctccccaagagacaatgattatttgcataaggatttcaacagagaagtagaagtgcaaagtagttaggacaaatagctctggttcagacagtctgggtttaagtcttctacttaaactagatttaatatctactacttagatttcatagccctgtgcctcagtgttctgactcctagaacagggtaagagtacttaacacattcttaaggtggtatgaagatgacatgagttaaaaggacttagaacacctagaactgtgcacagcaagtgctcttattgcctaagtgctccagaaatgtatttatcatttgtttggggatccacaacaattagcaggagaccttgaaatacaggccactaaggcttttatgcagtttgcttttggcagatactcagaggcaggaggaacaccaatcttttgccacagtaattctagggaaattttatctcaaaaagaagccagttcacggtcagcatgatataaagtcacagaacatgcctagaaggtgtgccaagtggagggtgcctaaaagactttctaccctttagccttgttgctatttaaaagtcaaccattagaggttcatttctctagctttaagttcttgcttactaaaatgcaatgactcttggatggaaaccatattaatgaagaaacaggcccaactatgggaatgaagacaaccctgaagtagattcctaattcttctacttttctactgtgtcctatgataccgtggatttcacttccttaaacttctgttttagcaactgtaaactaggaataacttactaagttgctatacggagtggcaattacagaaaactacatagcacagtgcctgggagataggaggcactcaatacgttgcagctctttttttgttattatcattcaactcactggggagtttatcagatttttcttaagcgaaaattaatcaatagggtattttgataagggataaagagaagcaaagaggagggcactggtcagtggtggggagaattggggcaggggaaggaaggaaaagtggggaatgataaaatggaagcaaacttcacctgctttgaatgtcagggcctggcctgcagaggactctgtctctcctgtcatactgttttacaccttaattaaagttccttaattaagaacagggaaacagtccttcacatatttatctctgaactctgattattccttgaacttgtatcccaagaaaaggggatgaagccacataagatttggcagctggcattttcattttccccttattgccatttgaacactagacctaagagtgcattggatgtatctaatcatattagaaaagtggagaaaataacccaaaccaaacctaagagaaggaaccttaagatttgaaaatgcagctaactatagataaaaatcataatggaggattaaaatttaacttcctctgagacaggcaataattattgttaaaaacaagctcacttatatcctctggtttacccttccttagtgaaatctgacaaggcctgtgtgggtcggagcctgcacactgctatgggagagcactggggcagctgcctgccttctcctccaggcggtcactcaccagccatgtggcactggccagttgttacctccacacacttcagtttcctcatcagtaaaatgtgcttgtcagaaaatagttactaaataaatgtcaaatccaagctaattataactgaagtcatttatgaattcaatatttattatgcatctgccacatattaagtgctgctgtagacattggagccaccaaagacgacatcatgggaatccatctttgttcagctaaagacaggaaggttgctaaggaacacagcataaagaacattcaaatgataagctgtagaatttggacttggaccctactgctagatgagaaacaatgagggtttacctaacaaaagaggtgtttgaaaagctgagtcctatggtggtcagctgcaggcaaggcaccaccacttagtccagataagggatgagcaggacccagactagggcagaaaacagaagaggagaataaaagacatgcataaaagatatgttttcaggagtcaacaggacttagaggcaagtacatgaatgcatgaagacaaggaaagccagaagaaactttggggttcaggggaagtggtttcacagtagcatccacagaggaacttcaagaagagatgctggttggggcacaggataatgtgtcttttgtttttaaatttcatttcatcctattaaagcattctgtcctttaaggactaaaaatccgggagaatagaacttgttcaaaataaatacactgtggtgagctgcgtgcaataacgcacaagacacaggctaggaggaaggcggctgtggtaaataattctaccctaccacatcagggacatcctcacaacacaaggtaaaatctaagtgggattgtgaaaggtggagaagcaatcaccaaacggacaaggggagggagactagtccagggacagggaagaataagagcggagcccatggagtggaaggtgtcagggaaatgcctccaggcaccaggacggacaatgtcagcagttacctacttgtggtaatgacacaaatgccaaaataacctccctctctgcccgggaacacacactaaccctccattcagcacaccccctcaggaagacctggcgaaatgaaaactgtagactggcctttttttatttatgttaggggaaacagattatttagccatgacagaagcaaatagtttccatgcactatgcattttaacatttcagaaagcagtacccttagaggaaaagcaggttacggcatgcagagattatattggaaagaagcatagacatattcaatgcctagagagctgggtcccccaggaaggagcgaatctggggatcagtaggaggaaattggatacagtgggcctggagggaagggaggcccagaaatgaacaaaggggtccttagcagggggagtggaatgggaaaaaatagatattcttccacttcaaatttttcctggggctgaatatatgttagaatgcttatatctaaagccttgaagaaaaagtttctaatatatctctgtgaatgatgtgtgtgcatatacacatataagtgcatacacatctactcacatatgtgtcagtaagtgtgtatacacaggcacacatgcacatgatgcttaatccagggatatgtttgctattgtgtaaactctagtttttttattgttgtttgttgttttttcagagacagagtcttgctctgtcgcccaggcgggagtgcagtggctcagtctcagttcactacacctctgcctcctgggttcaagtaattcttgtgcctcagcctcccaagtagctgggattacaggtacatgccaccacgcctggctaattttttgtattttagtagagacgaggttttgccactttgcccaggctgttcttgaactcctgagctcaggaaatccaccctcctccacctcccaaagtgctgggattacaggagtgaggcaccatacccagcctaaactctagttcttaagcaagggaatggacaatggtatgtacacttctgagatgatcccaagggatcattatgatatattttctcctttggcagaggccggacctagcatctggcttcagccaacagaaaacagcacacttgatgggatgtcacttcggtagttacatgaggaaagagtgtgacttccatcttactagtgttggggctaagaacacgtcacctcaaaatatgactgtaggagactaggatatactagccccaaatatattcctctgacatattttgagctggttattctgagaaaatgcagacacaggagtagctctgaaaacctctccttttgtaaaagaaattgacatctacaaaggaaatcttcattagtagaagtatttgtatcaggaagaaggctgctcattatagaactttcattacttgagagcaggaaatgccattccaaaatatgctgctttgaaatgctgattacttcaaactgagggcacctaggaagggaaggtgcagggaggggctgtctctgggctcccctttatctgcctaaagatggatcctccaggggcggctcagctgtcatgaatctcctctctgggaatcttatcaagtagggaggtctgactcatcacagagaaaaccagagttggacacaatgtccaatcacctgttcttcggagtgtccattcctcttttccagaatcaattactcccctgtaagctgcctaaatgcccctcctctatcccctcggaagatggtaatatgcttctagatctcactgggtttggggatattcacttttccttcctttgatgccctatgcatgtaataaatgtgtccaccttttctcctactcatctgtcttacatcaatttaatttgtagctcagccaaagaaccaagaaggatgaagggaagccatcttcctcgcccctacactagcaaactctgtattaccttctctgctggctcactttgatgaggcaaactgccacgttggagaggcccatgtggcattgaactaagagctgcaactggccattagggagtgaatcccaccaacagcaaatgagcttggaagccagtccttctccagtggagcctcgaggtgactcccatcgcagcccacaccttcagctaagcctctgagaaatcctgaagcagaggacacagcttacccatgcctggatcccagatgcacagagattgagacaatcaatgtgtgttttgtttgagggtaaagatttgaggtaatttgtcacaggacaagagacaactagtacaagcaccaagtgttaaacagcttctctccattcaaacttttaagttttctccatattaatgttcaccagcactttttcatactgtctcttagacctgtgaatattttttcatattattttaacatatacatatatttgttctattataatgttcttacatttcttcatcctgcttctgtttctcctttaagtaaagcttggttgcaaattatctttattgattttttataattgtacatttattttagatttagggggtacatgtacagatttgttacatgggtatattgcataaagctgagatttggggtatgaatcccatcacccaggtactgagcgtattacccaatgggtagtttttcagcccatgcctctccctcccttccacgtctagtagtttccagggtctattattcctatctttgtgtccatgtatacgtagtgcttagctcctacttgtaagtgagaatatgcaatattcgattttctgttcctgccttaatttgcttaggataatgacctccagctgcatccacgctgctgcagaggacatgatttcattctttgttatgggtgtgtagtattccatggtatatatgtaccacatttttaaaattaaatccaccattgatgggtagctacgttgatttcatgtctttgctattgtgaatattgctgtgaaaatcatcttatttataatcagcaaggaacttattccctatcagtccttacacccaggactggctctcctgcatatattcaatatatagcctttgcatttgagatatgtatgtatgtcttaactccttctcactgacatgaatgtaaactatataaaaacattaaatagacctaaccataaagtataaacatctatgacccaaatagaattgtgtgtacttcacagttcttcaatgcatattgggattaagtttgcagatatagtacaagctcttccaaagaaaattcaaaggatactcaaaactatctcacaaaaaagaagttaatgtcatcacctactgtatatatttgaaataaataagttgcatgaaaacaaactgtacacagacacatattttagtagactataagctaagaatgacaactatcagacctttacaagatatcaaatgagaataattcaaagaaaagttttactcatatcttacatagcactaaaatgtaatactcattatgcaatcaaattatgaatctgaataagcaaacataaactatggcattttatttaattctgaaaatttagagttaacatatctttcattaaagataaaacatttttaaaagatgttcaaaacctcatttacttgtatttagtacactaaatgtaggagaaagttatacacttattttaaacaattataatttccccatattgaaaacaacagctgtggaagaaagtaattaacatgatttactatataatcattctatcattatatgctatttggaaatatagaagcaaaactgagtagctttctagcttgcgctcataaagaaacctgttttctcaatcttctcctcttatttatcaactttatatgaataacagttttgttaatttaggagagaacattttatgatatgtttccttggatttgggaactcagtcccagctgcctagcatgtgtggctagagccacacaccatgttgcaaagagacccaccacacatcttccaggagtgataatgcatttgactatatgccatatagaaaatatgatgatggatctgaaaagataaccaagtcgtatagttgtctactatttttgactatgcttttaggtgttttgaaaagaatgataataccagatgaattagtccaattaccaccctagagaaacggacaaagaaaatgtgcttcctctcttcactttaccatccttattaccatccaattttctccaacttattcctcctactatcttttgtggttgaagtatgatgttgcaagaagatttaaaactaggcaacaatccaaaactttttcctacattggggaaaatgatttccagtacctagatctctaaacatgactaaatgctagttgatacatacaatgtaaagctactaatcagtcagcatatgtttatttgctttattttggcttcggagaaagaaaaagcttctactttgcatgcttccaggaagagaaaactacgatcatgtcattcaatgaaagttagctcactgatggaaagtacaggtgtaggggctggtgaataaagtattaccgcttatttctgagtggattaagcatctgtgagaggtgtgaaaaattgtcaaaagttactgttgggtgctgtgggtagaagtgagttttagaggagagcctgacactttgttaattatggcatcaacactccactaaatgttagcaaggagcagacctagagaaagacaagaccaagaggagtgaattcagaactttccaaataactatagcctgggattagtgaacagattatttctagcacagattttagtgatatttctatctgagccacaaaagattcaagttcattcttaagctccagggattgtagtcatgatgagactgcccagaaagggtagaacatattattttaaaaaatttttaagatccacagtacatgtgcatcatgtgcagatttgttacataggtaaatttgtgccatggtggtttgctgcacttatcaacccatcacctaggtattaagcccagcatgcattacctatttttcctgatgttctccctccccctctcctccgacaggccccaagcctctgttgtttcttggctttttaatacctgctattctgactggtgtgagatggtatctcattgtgattttgatttgcatttctctaatgatcagtgatgttaagctttttttcatgtttgttggatgccataaatatttacttttgagaagtgtctgttcatgtattttgcccactttttaatggtttgtggtttttttcttctaaatttgtttaggttccttgtagactctggatattagacttttgttagatggatagattgcaaaaattttctcccattctgtaggttgtttgatgataggttcttttgctgagtagcacatattcttaacatggtcatctaaagtcacagtcaactaaatctgttctagtgtttttttttttttttaagaacacagtcaaggatcattgtggattcactctcaggaaacttccctggccttaagaataagaagaagcattccagaaggaaatcataatgaaaaatgttcaagaattcagaaaatcaggcacctttcaacataagcaacattttgctgctattctgaacaaaccataaagacttattgggaggaaaagatgtgaccttcatttaaactggctttattagatttcccttctaggcccaggcatatttagtcaaaggagagcttggatcagagactgaactgtttttgagaaagtctgtgcgctgaagccttgcagggaactatccttggtgctggcctcgaattccttctgccaacacctctcttacatgctaatttgatcctaatctttctatagacaaagttcctatcactgtggtccattgtgctcattgagatacacttctcgcttgatgaatatttttagctatggtccagccaggattcagcgagacctctagcatcacatgcaactcaatgctagcctgtctcttctgtcctgctctattcctgtctatgtcacccaggatacccaccagggcagttcattccaatgcgcccttacaaagtgctgtgagtcatgctgttgagaagggtgagagactcacttccaagggagtaaatgcatcagggagggcaagacattctgcaactggctactgtagctatcctttcaagtaataatggcgtctccctgtacctacttcccccatgacctggtaaccattaatatgactatgacaagaaaacatgacaagcgtcaaggtctgatggttctaacgcagacaggtcagttcatacacatcaccccagcatgtaacacccatgaaccatatgacaaataccctcgtctcttcttttcacttagtgtagctcctaatttaaaggattatagattatatgtcactaaacaatttattggtacctatattccaaaccccattttaagtgctttgcatgtattaactcatataattttcaagataataatttctatgtgtagttatcatacttctccccaataattagatgaagcacgtgagacaggcaggtcaagtgactagctcaaggtcacacagagtgtaagtggtagagctggaatacaaactcaggcaatttggctccagcatccattatccaaactgcttcatgacactaagggtatatagggagttgtaaaggggactcctgtctcagaggggaggctggactagaactgttaggttccttccagtttgaaacttctgtgattccaagaagaaacatatttttcttatacaaatgatcttttccaacaatgcatattatatgctaacatacaatttataaaattataattcatttagaaattatttttggctcaattgctcaggtattcaatttttgcagtgttgcatatgtttatataataatatttgcatagtatcactttgagtttctacttgcatgttaaatttttaaatctcataataaaattcctagagggaattatttaacatacctctgaacatgttttctcatggacccagaaaagttaatataaattcaaaatccaaaacgttttgagcatcgacaagatatgcaaaggaaatgctcattggagtattttgtatttcagatttttggatttggaatgctcaaccagtaagtacaatgcaaatattccaaaatctgagaaaatctgaaatttgaaatacttctgtttccaagcattctgaataagggatacttatcttgtattactgtccttaacatttttttattcttagaggaataaaaaataagatatttcaagtacatggattttccagataaattattagctgcccattcaatcaagcaaacttaaaaagtgtggaaattactttccagaaatgaagcatattcttttaagtcttcttggtatgacctgaagataattttacttttccatgatcatttagaataatcactataactatcaatgctgagcatatatcataaatttcctgtccctttccttaatgtcacttgtatgccactgttattgccataggtacctctaagagtaatttatatccatacaatactcctcttgctgcattgctatgaatttagaaaccttataaccaagttggttagcaatgtaaaacaaggtaggagtacactatttataagtgagaaccacagtcctcaaaaagtaaagcacttgcaatttagtacatggatcctaaggcaactgctttaacaacaaaacctttttaatttctttttagattttgatatagtttagatatgtgtccctacccaaatctcatggtgaattttaattccaaatgttggaggtagggcctggtgggaggtaactggatcacggtgatgaatttctcatggatggcttagcataatcttcttggtgctgcttagcacaatcctcttggtgctgttctcatgacagtaagcaagttctcatgagatctggtcctttaaaagtgtgtggcaccttcccctcgctctcttgttcctggtttcaccatgtgatgtgcctgctccccctttgccttccgccatgattggaagcttcctgaggcctccccagaagcagatgccactatgcttcctatacagcctgcagaactgtgggccaattaaactttttttatttataaattaccaagtctatagtatttcttcataggaatgcaagaatggcctaatacaggttctcggctatgtcctagggaattgaggtcatgacagatgagtgactctcccatacattttacagcaacataggcagttgtaatttttactacagcaatgaggcagataggtatcttatgtcagatgctgtggtaagtatatcactgtggtaagtaagtatattatgacattttcttttgccacaattttctgaggtaggcattactgtccccatttgtagacaatcagatcacagagttaaagtaacttgccccagaccaatcaaaccttgatagaggcaaaattcaaacccaggtccctctcacccagcgtaccactacatggggagcagggggaggttcatttaaggaagaaaaaggggttgctagataacaccattgtggatccaatctagcttgtataagtctttcaaaaatggttcatatttaaaagtagacatgacatctagggtgctatgatcggacacctgcaatcagtcaatatttcctgaaaatctattacatggatttttataagtatctattacaagggatttcccagtcccctgaaatgagcgctacttgccacatgtaatggtataggctaacaattatccccaggcatatcaggctgtgctaggggacacaaaaaagaaaaggaaattggggcagtgaacatcagtggtgccagaagatgctccctgactattcactctcatttattttcctgctccaaacaagctataatcgattttggaaacccattggacaaaaagaaatgtttacaaggatttttctggttatatagctaactcctttagaaaagaaaatatccctcaggccctggtaagattggctgcccaaatcaagaaaatcctctcagttactacgcagctgtcagtgcaaacaggcacttgtagaagctgttggtcaaaaccccctccgacacagaaacagtgtttcagaaatgcctctctagtttacacatgtagaaatgccgtcactggtatagattcggtttcagggaagaaaataagaagtttaatcactgagaaatttcccatcaaatcacagaatcagaaaattaactgtgagatgggaatgaccttgggggtcacaggggccatctcatgatgaagtattctggggaggcacctgttcttagggtgatggatgggcacctcacactcagtgcctgcaagggctgggcaaggaaagcaagttgagggacaggccaagggagcagcccagccgccgtgtttgtctctatctgaccacgcctgctgggcaccatggtgagcctgtgtcgaaaggtctctcagttctcagaagaaggtgtaaatccgaactttatagatatctccatatttttaaatggtggaaaggatctgggggctgcatgaggaccccaggatgaaagcttcacctctgattggaaaaacaagtgactcaaggtaagtacaaagcattctgactggtcatttggatgaagctaggttgacatgtggaaatcttaagacataaaaactaagttattgcaaatattattttttatcataaatagcggatacacaggcacaaagtgaggcttggggattatctcagttcaggctgctgtaggggaataccatagactgggtggctaaagcaacagaaatttattctctcacagttctagaggccagaagtccaaaatcaaggtgtcagtagggccatattccctccaatgcagcgggaacctatcccttgtctcctgcagcttctggtggctgctgccttccttggcttgtggctgcatctctctctctctctcacatcttcacattgcatcctcctctatgaattctgtgagaggatatatgcattaagggaccatctggataactcaagataaactcctcctttaagatcaataatcagagtaagatggtggaatacaaggctttgccgattgttccccctacaaggacaccaagttaacaacttcatatacagaaaaaaaaaacaccttcataagtaccaaaaatcaggggagtattcacagtacctgattgtaacttcatattgctgaaagaggcactgaagagatttttttaaaaatcctgaatcactgacaccatccctcccctacccccagcagcagcagaggcatggtgccaatagcatctcttggtgctgggggagggagaacacagtgattgtgaagcatcaaattcagtgctatcttgatagagcagaaaggaaaaccggaccaaactcagctgctgcccactctgagagggagcatttaaaccagcctcagccagaggggaatcacagatcccagctgttggaacttgagtgcctgcaaaccttgccactgagggccacattgctccatgtctccgagtaaacttgaaaggcagtctgggccataaggattgcaacttttaggtgagtcctggtgctgaactaggcccacagacagtggtctgctggcgggtgggtggggcatgtgactttctgagataccagctggggcagccaagggagtgctggcatcacccctcccctaccccagctgcacagctcacagctacaaaagacaccccttccttctacttgaggagaggagagggaagagtagggaggactttgtcttgcatattggataccggctgagccacagcaggatacggcactggtcagagtcatgaggccccacttcaggacctagttcccagaccacatatctagaaacactctgggccaggaaggatcccactgccttgaagaaaaggacccagtcttggcagcattcctcatttgttaactgaaaagtccctgggtcctgaataaccagcagtgatgcccaggtactatgtaggtaaggaccttggtgagcctctgagacttgctgacttcaggagaaactcagtaccttaccagctgtggtggcaaaggggcaaaactccttctgcttgagaaaagcagaaggaaaagtaaaaagggctttgtcttgtaccttaggcaccagcacagccacaggggagaaaagcaccaagcaggctcttgggtttcccagttttaggacttgactcttggatgacatgtttggaccttcccagagggaagggcaatgccctgaagggtaagtcccaggccaggcagcatttaccagaagttgacctaagaaaccttgggccttaagggaacatttgctagtttggcagtactcctcatggcttgggatggcagtgggtatgggtgaggctcctatggatttggaaagaagagggaggaatgagaaggactaggtcttgtggtctgagtgccagctcagccacagtacaatagaacaccaggtagacttctaaggtttctgattctagtccctgactcccagatggcacttatggacccacctaggggcctgggggacctcaccaccctgcagggaaaaacacaggcctggatggctttgccacctgcttattgtagagccccaagggctttgagaagatacaggaagtagccagggagtggttacagcaggtctcgggcgagacccagtgctgtactggcttcaggtctatatgagtctgttctcacagtgctataaaaaaacctgagactgggtaatttatgaagaaaggaggtttaattgactcacagttctgcaggttgtacagaaagcatggttggggaggcctcaggaaacttacaatcatggtagaaaggcaaaggggaagcaagcaccttcttcacatggtgtaccagtggggagagacagagcaagcgaagggggaagtgctacacgtttttaaacaaccagatctcatgagaactcactatcatgagaagagcaaggggaaaatctgcctccatgatccaatcacttcccaccagctcctcccacaacattggcaattacgattagatatgagatttggttgaagacacagagccaaacaatatcaaagtctaacctgcacagtcttagtggtggtggccactgaggtgtgctggtatcactccactcccagctttaggtggctcagaatagagagagatactttgtatgtttaggagaaagtaagggaagagaacaagagactctgcctggtaatacagagaattttcctgggtcttaattaagaccatcaaggtggtacctctatgagtctgcaagaaccacagtgtaactgggcttggggtgcccccaaaggaagatacagcttagatcacaacaccgaagtcctttcaaatatcaggcaagccttccctataaggatgactacaaataagcccagacagtaaagactagaatgaatacctaactcttcaatgctcagacatcaaagaacacctagtaggatcaacaccacccaggaaagcatgacctcaccaaatgaaataaataaggaaccagagaccaaacttggagaaacagagagatgcgatctttcagaccaagaattcaaaatagctgcgttgaggaaactcaaagaaattcaagataacacatataagcaattcagaattctatcagataaatttagcaaagagattgaaataattaaaaagaatcaagcactaattctggagttgaaaaatacaattagcatactgaagaacacatcagagtcctttaacagcagaattggtcaagcagaagaaagaactagtgagcctgaagacaagctatttgaaaatacagtcagtggagatgaaagaaaaaagaataaaaaaacaatgaaccagacctatgggatctagaaaatagcctcaaaagaacaaatctaagagttactggccttaaagaagaggtagaaaaagagataggagtagaaagtttattcaaagggataacagataacttcccaaacctaaagaaatgtatcagtatccaagtacaagaaggttatagaataccaagcagatttaacccaaagaagactaccttaaggcacttaataataaaactctctaaggccaaggataaagaaaggatcctaaaaacagcgagagaaaagaaacaattaacataagctgaagctctaatatgtctggcaacagactgttcagtggaaaccttacagaccaggagagagtgaaatatttaaagtgctgaaggaaaaacacttttaccctagaatagtatatccattgaaaatatccttcaaacacaaggaagaaataaagatgttcccagacaaacaaatgctgagggatctcatcaataccaggcctgtcctacaagaaatgctaaagagagtacttcagtcataaagaaaagaacactaatgagcaataaatagtcatctgaaggtacaaaactcaacatttatagtaagcacacagaaaaatacagaatattataaccctgtaactctggtgtataaactactcttattgtatgtagaaagactaaatgatgaactaataaaaataataactataacacattttcaggacatagtacaataagatgtaaatagaaacaaaaaaattaaaaatgggggaacaaagttaaggtgtagagtttttattaattttctttttccttgtttgtttatgccaatagtgttaagttgttatcaggttaaagtagttggttataaatagtatttgcaaaccctatggtaacctcaaactaaaaaacatacaatgaatacacaaaaactaaaaagcaagaaactaattcagatcaccagagaaaattattttcattacaggaagacagaaatgaaagaaaaaagagaagaccataaaacaaccagataacaaataacaaaatggcaggcaaagtccttacttgtcaataataacacaatgtaaatgtactatactctccaatcaaaagacatagactggctgaataaacgaaaaaagaagacccattgatctgttgcccacaagaaacatatttcatctataaagacacacatggactgaaaataagggatggaaaaagatattccatgccaaaggaaatcaaaaaagagcaggagttgctatacttctatcaaacaaatcatattttaagacaaaaactttacaaagagacaaaaaagtcactgtatatgataaaggcatcaattcagcaagaaaatataacaattttaaataaatatgcacacaaccctggagtacccagatgtataaaggaaatattattgcagctaaagagaggaataggcccaatacaataatagctggagattgcaggccccactttcagcaatggacaaatctttgagacaggaagtcaacaagagaacattagacttaatctgtactatcaaccagatagatctaacagatatttacagaatatttcatccaagagctacagaatacacattgttttccttggcacatgtatcactctcaaggacagcccatatgttacgtaacaaaacaagtctgaaaacactcaaaaattgaaataatatcaagcatcttctctgactacaatggaataaaacttgaaattaataatgagaggaattttggaaactatacaaacacatgggaattaaacaatatgacccatgggatcactgaaagaattcaaaagaaggaagaattcaaaagagggaagtttatagatataagtggctatgtctaaaaagaaaaaaaacttcaagtgaaaaatctaatgatgcatcttaaaaaactagaaaagcaagaacaaaccaaactaaaattagtagaagaaaagaaataatgaagatcggaacagaaataaatgaaattgaaagaaaaatgcaaagtatgaatgaaacaataagttggttttttggaaagttaaacaaaattgacaaacctttagccagactaagaacaaaagagagaatatccaaataaataaaatcagaaatgataaaagagacattataactcatattgcacgaatttaaaggattattaggggctactatgagcaactatatgtcaataaattggaaaaatctagaagaaatggaaaaattcctagatacatagaaccaagattgaatgaggaaaaaaatccgaaacctgaacagaccaataacaaataacaagatcgatgccacaataaaaatcttcccagtaaagaagaacttgggacccgatggcttcactgctaaaatctaccaaatatttagtgaagaactaatagcaatcctactcaaatgattctgaaagatagaagaggagggattacttccaaactcattctacaaggtctgtattaccctcatacaaaaaccagagaaacacacatcaaaaaagaccacaagccaatatctctgatgaatattgatgcaaaaatccttaacaaattagtagcaaactgaattaaacaatacattaggaaattcattcatcatgacaaagctgtttttatccctgggatgcaaggatggttcaacatatgcaaatcaattatgtgattcaccatatcaacagaacgaaggataaaaaccacatgatcatttcaattgatgctgaaaaagcatttgatataattcgacatcacttcatgataaacaccctaaaaaaactagggatagaaggaacatacctcaacataataaaagccatatatgacagacccacagttagtatcatacttaatggagtaaaactaaaagcctttcctttaatatctgaaacatgacaaggatactcactgccaccgctgttattcaccatagtattagaaatcctagctggagcaatcagacaagagaaaaacataatgggcatctaaactggaaaggaagaagtcaaattatccttgttggcagatgatatgatcttatatttggtaaaacctaaaggctccacaagaactctattagaactgataaattcagtaaagttgcaggatacaaaatcaacatgcaaaaatcagtagcatttctacatgctaacagtgaacaatgtgaaaaagaaaaaataatcacatttacaacagccacacataaaattaaataggaattaaccaaagaagtgcaagagctctataataaaaactataaaacacaataaaagtgattgaagaggacatcaataaatggaataacattccatgttcatggattgaaagaatcaatatcattaaaatgtccgtactatccaaaggcatctacagattcaatgcaatccctatcaaaataccaatgacattcttcaaagaaatagaaaaaatcctaaaatatatgtggaaccacaaaagatccagaatagccaaagctatcctaagcagaaagaacaaaactataggaatcacattacttgacttcaaattattctacagaggtatagtaaacaaaacaacatggtactggcataaaaacagacacatagaccaatggaagagaacagaaaatctagaaacaaatccacacacctacagtgaactcatttgtgacaaaggtgctaagaacatacactggggaaaaaaactgtgtcttcaataaatggtaccggtgaaactggacatccaaatgcggaagaatgaaactagattcctatctttcaccatatacagaagtcaaatcaaaatggattagagacaaaactcaaactatgaaactactacaagaaaataaatattggggaaaatctccaggacattgttctggtcaaacaattcttgagcaataccccataagcacaggttaccaaagcaaaaatggacaaatgggatcacatcaagttcaaaagcttctatacagcaaaggatacaatcaagaaagtgaagagacaatccatggaatgggagaaaatatctacaaactacccctctgacaagagattaataaccagaatatacttgtcccagttaaaatggcttacatccaaaagataagtaataacaaacgctggtgaggatgtcaacaaaagagaacccttgtaaactgttggtgggaatgtaaattagtacaaccactaaggagaatagtttagagatgcctcaaaaaaactaaaaattaagctaccatatgatccagcaatcttactggttggtatacatccaaaagaaaggaaatcagtatattgaagagatagctgcactgttgtgtttgttgtggcactgtttataatagctaagatttggaaggaactgaagtgttcatcaacagatgaatggatacagaaaacgtggtacatgtacacaatggaatactattcagccataaaaaagaatgagatccagtcatttgcaacaacgtgtatggaactggagatcattatattaggtgaaataagccaggaacagaaagacaaacatcgcatgttttcacttatttgtcggatctaaaaatcaaaacaattgaactcatggacatagagagtagaagaatgattatcagaggctgggaagggtatcagggcattgggagggtggggatggttaacatgggtacaaaagaaaatagaaagaataaataacatctactatttgatagctcaacagaaggactatagtcaataacttaattgcacatttaaaaataacctgaagagtgtaactggattgtttataactcaaagaataaatgcttcaggaaatagatacctcattctccatgacgtttttatttcacattgcatgcctgtatcaaaacactgcatgtaaccataaatattgatatatatatacctactatgtacccagaaaaattaaaaaaaataaataaaatcaaaggttaaaaaaagatcaataatcaggtcttttgccatgtaggtaatagtcacaggttctgagtattagggcatgacatgttttttctaagagccgccatacaacccactatagatggggaactggggaagatagcagagactgcaaaaatgtccaaaaacattgcacacatcacaggatcccagttctgggaaacctggggaggcttatacaatttcaacaaatgaattcaatgggcaagacaaggatgtggccaccaacaccagggcaccaatgtgactggctctggaggagaaggtttgagcggctccagcataggagtcctacccacatcctatttacgagggccagaggagccccacagaaataggaggacacagagtgatgggtttttaagtgtctcagcaatgggtgttagatcaccttgacttctaggtaataagccaaatgcaggtgaaaccgatattactgacaaatacatttgataatctattacaaacttcaatagttggccatgggaggtaatattttaggtgatgatatattgtagaacaaatcaagataacttctagtttagtttagctagtaaactggaagtaaagatttattttaagtcatttgcaaacaaccatcagcacatccatgcagcttaaatttccttttaggatcagagtctttgatcttgaatttggagcaatagcccagaggccttaagatctttcacaactaaatgccactacaattgctgcacactctatcatctggcaaggtttggcctaacctaggagatcaaagaccatgagattaggaacacattatcctacagcctgtacataaacacactaaacttttgagattataatgctatgacataaaccaacagcccctccaggaccaggtctggcccatgtagtgctaaagccccagaacttctggctctagccccagaacttctgattctgactcaacaagcactccctaagcaattctgctgtaggtggcccaggaaccacactccggaaaacactaccctaagagagatgggcattagaaaattaaaagaattattttaacatatctatgcataacagggcagtattacatattaatgaaccataaagtgaagctgttgatcatatacatgagctcaaagattttaaaaatattttaaacatatccttcatttggaagatcaatgttttgatattactttctccaaacactgattttatatcctgtatcacctttactcagaattaacatcctaaacatttacagagggaagtatttaaactcctttattcattcagaagcacatctagcatgccttattaacaggactggaaatggaggaaaatgtgctacaatattcctcaaccttcaacttctatctgataaaaatttatctgctaatctccagcctgtaacttctcctttctcctccaactagactgtctagttcttgcgcttttatattaggttggtgcaaaagtaatcatggtttttgctattaaaagtaatggcgaaaaccacgaatacttttgcagtgacctaatacttctctagtatttcttacatcccacaccatgacgcaattatctgtgaatgtcatctaccacattggactacattttctggaatcagagacatggcattatctgaccttgggcatgtcctcagcacactgctataaacaaggttggtataaaataaaagtttattgaattcaatggaaaatatgtatgctctttttaattccaggataattacataattcattatataggtatacagttatattttaaaaatctatttacatcaaccagtgtggttctgataaaaaactgttttcaaaaatgagaggaaaaataataatgtatccaacatattgcaaacttttgaaagaataatgaaggttaaggtagaagggcatcttatctcaggcatctaggcataactagacagcaataagaatgagttactttacaaaagggaattgatttagatatatttgaaacgggaggttgtgcagagttgggctggtctatatttcagacatgcaatacaggcagcattattgcttgcatgcaatttctcttctttctccaggtcatgcaaaattaattaaaagttattgaattttctcctggataatttctgggctgttcattcgaatttggagtagaaagaggttcggaatggcctgagcgcaaatgacaaatgttagcttatgcagaagcaacatcctaagaatagtgatgattttgtaaaatacccaaaaggagttttgcatacttcggaagttttgcacatttaatggactacaaatgtgtattccacatggggtgacagtgaatttttgaactggagatgctctttgcctctctctgatatgctttggaagtaaagctgggaaaagaaaaggaaaactctgttaaagtataaggagtgctgaggactcagtatagcatctctttcacatacttgacctggaagtgaaaaataagcatgtcttctctctacaggaaatcacaaagccagacactataatgaacaaggactgaatgactacttcagttagaattctgatgatgttaatgtcaataggaggaatttcacaagtagttttcatttgttgcacgaattttgagaatattcatatcagaaaattgatttcctattacctatacagattcaaaagacagatactttgaatgatatatttatacaagagaaatatgtaaaaatatttgcatatagcattgatgtggtcattagtccaaggtatatgaattggaattttctttcttatctgagatgaggtttaacagttcaatttcacaaaaggttgccttgcttcgtctgccaaatgaactcctaaaaaattatacgagatgaaatacacacctcaggaaagaatcatcttgattaaacatttgaccaatgtactcaacagtgaacatacacaaggtcctttgttctatattgattaaaagtgcaaacattgactttctaacacctttagccacacaagtaaaaaggaaagaaacaatgtacattttttgtaaaataaaggaggatgcttaaattttgttagaattatttttttctatcaaaaattctcaaatagcattatgcctagtataatttaaattctgtcaatgacaaacacaccaaagaataccatattgctgctatgtgagaatgctatcttgaatagcatatcattgatttgtcctatttttatgacatacttgatgatttgattaatcatctgaggattaaatatcatcaatttttattatgcatggatttgactgagtttttataatagaagacaagtttttattacagaagaaaatcatacaacttaactttatgctaagctgtttttccaccaatttccaagtttctatatatattcaacagcttaaacacagtgaaatggcaaggtatagaaagcacccagtccaaagtctggcaagtggagtgggcattcagtacttccttggtgcctcactgagtagcactgagtagatactggtaaataatgaaaattatgtagcctgggtgggaggatgtatgcagccagccaggatttcttttctagcctacatgttaattggtttgagatgtacttccaaaagaaaggtgagcagacagtaaaacaatttctacatgaagccaaagaatttgtttgtgaaaaatgaatagaattgttatttaaaatatctatgataggtaattgtatctgacaaacttaaacctcttttaaaattgctctatattaacatgccaaaatttgtattcataatagaaatagctactctataaactgatctagatgttgtttgtgtgtatgcacacacacgtgtgctttctaaatttctcataattaaggactaatattaattaagaattagatgaccttactgattcagccatgtttggacaacttgtcattggcattatttaatttaacccccactaaatagaggagtaaaaatcagccatttctttaaaggtggtcttttctctctatttcatcttgtgtcattgctcttttgtattggagaaaccctagattgtacacagatataaataattttatatgattatcaaatatgtcaaaaaattctgaagaatttcatctgatagttgcaaggttatttttttcaatgacctcaaattaaggtcctgagaggaccaagacctgggatttgcttccacattaaccacacagaaagacctgccttccagtgggtggggcttcccacttgaagtccacctggtttggacaaagaattctagagaaccctgacaatgctcctgttgggttcaacattttatgccacaaattattctgtgaaaaagagcagttttctatagaactaatgtaactctaggcagaaatatagatttagaagagtttaaaaatacccaagttaattcagtgccaagtacttatactcctgtttgcccatcccataatcacactctcccttctttataaattaataaattatgcatagggtcaaacatgttcttgaacttctctagtacttacagactaaaaagtacaattaaacagaaataaaatttgcctgaacgtattctttaattcaggggtttccaatctttggcttccttgggccacagtggaagaagaaaaattgtcttggaccacacataaaatacactaacactaatgatagctgatgagctaaaaaaaattgcaaaaaaaactcattatgttttaagaaagcttacaaatttgtactgggccatattcaaaaccatcctgggtcacatgcagcccaagggccacaggttagacaagcttgctctaattgtttcataagagttaacattgaatacctagaaagattaactcctttaagcttctcacaggatgcctagctcagactaagtacgtaataaatgcttgttccttgcttttccccatccgtcatgagggcagagactttgtttcatactttattctcttattgaactccctgcactgtttccagttcaatgctgatcacacagcttggaattctgtaatagtttttttttttttttgattgactaaaagatagactgattcagtgatactgatagtacagcagtatgcttaaaataataaaggtgtagttcctcacaaatggaatattaaatctcattaaggattcagatgctacagaaggaagagcccaaaaacagacccacatacatctgaaaacttgatatgtgatgtaattggcattgcagaccaataggaaaaagataggctgcccagtaaatggggctggtaaattgtttattcacaaatatataaaaagttcaatgcttacagtacaggatatttttatgaatctaaggttgtaaatattccttaagcagaatcgcagaagtacaaatagcaaaggaaaagtctgataaacacaactgcattaaaataaaatattctgttcatcgaaagacgcaaataaaaacatcaaaaatgcaagacacaaagtgaaagaagatagttgcaatgcatataaccaaaaaaggactggtatcccatacatcaataagaacccaacaaacaatccaaggaaaatataagaaaaacacatgaacgggcacctcaaagaagaggtactttaaataaagggcccataaacatgtaataagatggtcagctccatttaatgtgtaaattctaataaaaaccacaatgatatcatgtcacaaacaatagatggaccaaaaaaaattaagtctggcaaaatcaaaacttggcaggatgtggcactctgggaatgtttaagcaatcctagtaggagtataaatcggtgcaaccattctggagagaaatttaataagacctagtaaagttgaaaatgagccaacaacccagcaatttcactcctacttatttatatgtccctggagaagctcttacacatgcgcttaaggagacatgaccaagacagttcttcggaccaggcatgttggcacatgcctgtaatctaatcccagcactttgggaggccgaggtaggaagatcacttgagcacaggaacaaaatgtcaccccatctctacaaaaaatggaaaagttagctgagtgtgttggtgtacatctgtagtaccacctacttgagaggctgaggcaggaggattgcctgagcccatgagttccaggctgaagtgagctaagaaggcaccactacacccagcctgggaaacaaagcaaggctctgtagaaagaagaaaaaaaaaagaaagaaaagaaaaaaaaagaggagagataagaaaagagaaaatgagaaaagaaagatcttagcagcactgtttgtaagagccacaaagaaatgataaacaactgaagattattcacatgatggaacaatgcacagcacagaaaaaatgtgctatctccataaacttcacacacagggtccagccagaaagagaggaacagaggaatacatacagtatgttatcagtttatgatgttttataaatgaaaaacaatactatgtatagacttgagacccatgaaaatgttaaaaagtatatatatctatatctatctatatatatatacataattaagagagactgaatttaagattagattaactctgagactgaaaggaggaaaatcagatcaaagagaaacatgaaggtggccatatttctatttgtaatattccatttcttaatctagatgttgcgaagacaagggttctttccattagtcttcttttatttataggggatgcattccaaggtgcccaggggatgcctgaaatagtgaatagtatgagaccctctgtatgctaagttttttctacatacacttatttttgtgataaagtttaacttacaaataaggcacagtaagagattaacaataattaataataaactagaaccattataacattctgtaataaaagttatgtgactgtagtctctctctcaaaatatcttattgcactggactcacccttcttcttgtgatgatgtgagatgacaaaatgcatttgcgatgagatgaagagaggtgaatgacacagccgttgtgatgtagtgttaggccactatcaaccttgaacacaagcactgaaatactggatgccatgacagttgatttgataagcacgtggctatgcaatgactaacaggtgggtagcgtctacagtgtagatatgctggacaaagggatgattcacatctcaggctggacggagcaggttggtgagaaatctcatcaagctcctcagaagagtgccatttaaaactgatgagttgtttacttctaaatttttccatttaatatttttggaccatggttgtctgtgggtagttggaatcttggaaagtgaaactacagataaggaggcatggctgtatatttagtcttcatacaacatgcacagaaatatttaatttttcaaaatttctgcattccaaaaactcaaatatattttagttttgcttaactgaaaattctaaaatagttttaaattcttgaaacaaatagctcaaaaggagagtccctccaattcagatttttattgttatttattatttatttattttgagacagagtctccctctgtccccaggctggagtggagtggtgtgatcatggctcactacaccctcgacctctccagctcaagtgatcctccgaccttagccttccaagtagctgggactacaggcaagtgccaccatgcctggttaattttttaattttttatagagacagtacctctctatgttgcccaggttggtctcaaaatcctgggctcatgcaattctctcacctcggcatcccaaagtgctgggattacatgcatgagccactgcacttggcccagatgaagtttcatatttcactaaagagaaactacctagcttctaagaaatcattgaaaaaccatataaggcaataggcaaagcattgccaattacgtagatgattttagaaaaagaaaaaaggaatgtctagaaaggaaaagattagcataagggttcttcagaagggaagaaacataaggggtcgagagaacaggttgcaattttcgttggagttagtgtatccagacatccttgaacctgcctttcctgtcgttggttctatctccacaatccaagtaaattggcaggttggcttatcaaaacaatgcatacaaaaaatatttcagagtgatttgcccttgtttccttctttgatcacagaaacccacttaaagagcactattccacacataccttagtaaattcaatgacatttttttctggctgcttcagctgccatgatgattgcaaactgtacactgccctcaccacgcagactacttttcatgcctgctatgtgaacacaaagctttgttttttttccagtcccaagtcccttattcaggaccaaattacaaacaatgctgtgttagacacttttcagaaacctctggataaacgagtctcagcagccccctgggctcgaccccacagaatgtaatgcctgctcatgcccaaaccactgcttccttgtgagctttgaatagtcattaacgttgccaagactggcaatcatccttaaaagtcttcctatgaagggaatctaatttgtatatgtctgaaaaagacaatgaaagaaaacatgctggactatgaactctcaaggtatttgttcctctggctaactgaaatgagaaacttttgaaaatatatgctatcattttttgaaaataatgattgtgactttaaacctgaaaagcctcatctgtcccacctcctcctaattgcctggatgataatgatgtaaatgcagttataattacaaagaacttcaattcaatttaattttaattgtttaaaatttgtaaacactccagaaaaacctcattaagctggctgaactagcttgttttcaagagggaacagggagtcaacattcacagttattcatattacaacatccattcacttacactaaccattctgattaaccagtaatcacacacatttggagcaagcagcactggcaaagcttgttacagcttttaaaaaatgctttgcaaggttgcatatataaaatgaagccccacattcaaaagcagaactttggcatgcatgcacattgaagaagggagaggaaaatcctcacaaaatgcatgcatcaaaaagtttatacttctaaaactgaggtcttagaatcccgaaagattcaggttcatgtctccttttagtatgagatgatgtggtctgcataccttccacagtgtctcactgtggtgtgagtttcacagtcaaaggaggacggcctaagtcctttgcacaaagtacatctttataaccaattgccctgtaagcgtagcagtgaaaagagcactggattggactgggggaacctggcacataaaattcactacttgtgggaactggggtacatgttctagcctctctaaattggttttcttagtaagataagccaaacctgaagagctactgcacagagttttggggacaattaaatgtgcctggcatatagaaggtatgcagtatatgtagttcatagtatccaaaaggctgaaacaaaaagggttcacctttggttaccttctgcataattactaacattctagtgattgatgattgaatatattttagctgaaatcttaagttttcagaactcatcaccaatggtttataatggatacttgtttgtatcatgtgaaggccatatgtggataatttttagaattaacaaaatgttgtcttatgtcacaattctctgaactgtatgagggtttattggacaaattaaaattcaatctagtaatataccactcatattgtcacattttaccagacatgttttcctctgttattgaaattttagcacttcctgcagatatttggaatagaaatagaataacgacaattgttattactactcatttttacaaagggcttttcaatttctaagatgattttaatatacattgttttggcttgtccctatagcttgcagatttggtcccaacactcacagtgactaacaatgttcagagcagtgtaatcattggataaaagcagcagaggcctaagggcaggggtcagactttgaacccttgctttctggtctcaaatctcatgctcttttctggatgttgaattctcccataaacacactacgatcaaccagaactccacttccattcatttataagagttaaaaaagtgaagcctccattatcatctgaagtgtaaagagacatcagatttcaaaatgatggcaacagggaagagcccttgccaaactaactattattttaacaactaaatgactgtgtaatcactgtacttgctgcaaaaacactgaattgaggtttccatttgggtgtttgtatgttctcaagtccagcaaacagagctctgaagaatgtgagcacaggctgcctgggcacggtggctcacacctgtaatcccaacactttgggaagcctaggcgggtggatcccgaggtcaggagattgagagcatcctggctaacacagtgaaaccccgtctctactaaaatacaaaaaaattagccaggcgtggtggcaggcgcctgtagtcacagctacttaggaggctgaggcaggagaatggtgtgaacctggaaggcagagcttgcggtgagccgagatcacaccaatgcactcaagcctgggcgacagagtgagactctgtctcaaaaaaaaaaaaaaaaaaaaaaagaatgggcacacaggcaagtttttcacagtacacctaagcagtcagtgatcatggggtataagtggtagaaaatactaactggtttatttcatttcccttaggaacaaattcatacagtgtaacccagccaagagattcccagagattctcatcctgctcatctccgtcaccaagacgtgtgcttgtgactccagtgctccagcatgcgattgtcactcaacctaaatcccaggtcatctttcaaaatctgagccaaggaagccttaccatgaacactgaacatcaaccatgcctaattccctggcctagtgctagagccaaaaggtgtatgaacctggttccaagaagttccaaaggaatggggacaaaggagacattcataaatacataactgtcagtttggcccactgtgctaaggcacaataagaaaagtgagataatacatccttttgagtggaagggaggtggtcatcacctaccatgctggcctttcccttttctaaccacccattgttcttcctggtaatacaatttagcacctgctgggtttcttacaactcctcccatgttctttctatatctgtagtcaaagtgtaagccacttgaggatacagatgtgtgtcattcttctccaggattccccaaaacacttggcatagtcttagttacaaaaccagggctccatagagacatattaactgactgtgtatagaagattcagtgggtgggaaggggaaaagactaaaaacaaaaaaaaaatgggggagaaaacaaccctgttggaaaaggaatgactaggaatggtatcttggtgagggaaaaagagatggttttatgttaggggagtttatttaggtaggaaaaaaaatgagtaaactttgcacgatttgaaatctgcattccactggctaatataaagtaatctttcctgtttgtaaaatgaaaaccatgaaaagatgataacacactttgtactaaatctacttggggaaggaacaacaacattttctccctttgctcagttcagcctggaatataatagatgaaattgtaattcagagcacattatcaatgctgctatttattttctgaaacattagtctaggtatatttttctacatttttatatcaaaatatgccccttaagattcagacatacattctcaagggagctggtctacaccagttttgtaaaatgttgactaactatttgagtgatgaactgaataaaaggtcacttactttcttcatttatcacccaacagcctttgatggttgaaaatatttgttaacctttctttgtctcgattttatcaccaaaaagaaagagggataaaagtgcttgctttgaagtatatgcgcgactgaacgcatgtgtgaaattctttgagattctcagatggaagtgctgttggaatcattaaaatttagagaactttaggaatttgaatcctttaatactctgaaggtaaagtaatcagattaatggattttttttcttaatcttgtcaagagtatgggttgttcaagatcagatgtttttcacttctctactgaagaaaactgacttgaggcttggagtagagaaataaaagccaacttcctaattattccctctgtgtggtcctcagagactactgctgatctggggttaaacttattctttaactaattaaactctttttctttaattaagcagccctaacgaccttactttgtagacagctggcttcattacaagcagagtaactttcttatactgaacacaaagtaggtgaggaataaccaaaaaggtcttagaaaattacttttaccagaaattatttttcatctcattttgccagatgaaacatttagttaaagggttgctattgagcaacatgaaaggaacgtgggctggaacagtcccaagattcacttggtcaaaattaaagcaggtgctgggctccacaagtcctgggtaccacggaaggcaggcggtttgctagcattcacaggatgccgaacccaggcctgcaacgagttttcatgctgagcacctcaaagcaccaacagagacaggatatgtggattaaagcccatgaaaaaataaccaataatttattttccaatgcactgtgaatatttaaaagaataaaatcatctgctatgcctaaggtgatttatgttttaagatattcaaatatatctcccataagttactatcaaaaatgtttaagcatgggttctagaaaatggtaggctctcaatacatatatgtagaatgcttcatagatgaaaatggttaaaagataacttattgatctgattcaataccctccatttgtagatgagagaagtgaggtctagagagattaaatgaaatctccaagctgacacatgtatttttttcaataaacctttactgacagcctacagagtaccaagaatcatactaaaactgggactacaatgatgaacaaactgcactttctctgtgcctactagctacctctcctagaatatttgtaacaaaacatttgtcattggttgtcattggcagtacaagttaaatttcttggtttacaagttagagcttcagaaaaccttgcttttacttttcatcaatgacaaaataaacacaccattaatccaaatccacctctgtgccatctacagtagccaaattaggaaaccacggactatcatcacgtaacagaactcatactctgatctggagctagtccgcagctaccaagacattctgacaccaaagctgatagtgggcaatgaatgcagggataaagggttggttttctacctttctagagaagtatattaaggtggaggcaggagatgggcaaagagtatgaaaactggagagtttgggccgggcacggtggctcacgcctgtaattccagctctttgggaggccaaggcaggcagatcacctgaggtcaggagtttgagaccagcctggccaaaatggcgaaaactcatctctactaaaagtacaaaaattagttgggtgtggtggtgggcacctgtaatcccagatacccaagagactcaggcaggagaatcgcttgaacccgggaggcagaggttgcagtgagatgagattgtgccactgcactccagcctgggcgacaaaagagaaactctgtcacaaaaaaaaaaaaaaggaaagttcgatgtaaaaaacaagtatatttaatctcagtatgaaaaaggtctcttttcttccttgaattgataaacaattgtttatcaacaatagaatatttgttcaactaatgtagaacattcaacaaatagaataattacattaaagtagtctcttttgaagggtaaaagaaaattctaagaaagcagtaattaaacagaatggtagggagaaaacaaaataaaaaaatactcctaatgttttggcatcctccttgggatggcatgagagggggagataaaaaacatagaaaagtgggaggaaaaaaagcacagtctggaggtatattttagttcccaattgcctgagctataacattcagagtgataaaaccaagtacctgctgcccctcctgcccttcatttggttagctggtaaaccattcttcacagctttttgtctgctcagatccttgaagattctttattcgagagcagtcaggtctaacaaccattcctccaatagctttagttttcatgattagaataacactgtccagaaagaaagatgctgtctcctggaggagggatttgactcctggctggaagtttgccatctctggtcttgttttatccaagatcctcaagaaaatcaaagtctttggtctagtggtaaatggtaactagcattccagggacgtgcttgctatctacttgcgaactatcctaatcacaactctacttccagactctttattttacaattaaatgcttccttctgaaatatagcttggctaaagaaatgcaattttaattgtatgactttgtaaagcgaccttcaaaaattcaaaggttaactttctttactttctgaatcctactgtgccatgcatggccatgcaaatcagcactagtctaatctgtttcccttaccattgctactctctttcgctaatttccactttattttttcaagtccaagttgcttacagggtaagatttcaaagcaagctccggttcctggtgtctctgcataactttggttttagttactaaggaaacacttctttgctgtgctacactgtaaatcctttaattctcccttttcctaattcttaagtaatccatttaaactgcaaaagcaaatactatgagagcatttcataaaacacactgcatgcaatccaataaacaagaaatcatatataatttaacttcaaaatttcatattaattgccattagaaattcaaattcaagtactgtatgcagggtaaatagatgaatagatgcagtgtatgatggatgaagccagcccatgttccataattctatggtgtttatcagtatcaaggaagatggcaaaggcaagtcagaggctggtacaaaatttaaggctaaaagtatctaagcttgcaagaaaaagcaggcgatatctaattatacactaattctaaaatgctttgttccaaagtgtttacccagaaactcaattattccttccacaaacattgatggagatcacaccttgtttaataaagtattagcaatatgatggtatgttacctccccaccccagtagggagagaacctgtacagaaataaccatagaacaaagccaaatatgctaaggactaaagaaaggcacaacgttctatgagagatctatcagagaggggtttactgctggctgaggtgttagagaagctctaatgtagagacaaacattcctgctgggccctgttagcactgcaacatgccaagagggagcctgggagaagaacatgcattccaaggaaccgtgtgagcacttggtttgcctctgagtgtttttaaagaatgtcaagctggctaatgtcctaggggaggtagatggagtgaagtcacaactaggccaaggaatttgagttctgaaattaatctactggtgacgaagagaatttaaagagcttttagtggggttagaaatactaaaaagtgcaaagaggaaattcagaactagaaagtaaagtatcctcacatggtagaatgacatatgcccactcttatcaaatccagtttgaaattttcttggcaatcagatgtccagggggccaccgtggttcattgttcaggaaaatcacgagtcatatgctgacatttattagagttttgacctataagcaggtaggcactattgctccatcaaacaaaatgaaaaccctgatgaaaagtggctacaaaacagcctagcaaaaatctcaaatttacacatatctgtataaggcctcacagttgtctattgatataactcttgaaagtctattttgaacattctgcattttcttgactcaaccattataattcagaaaattaaatggggagaaaggagtgagtagtggtggtatcacaaaggaacaaactagagaaaggtgttgttctctaagagtcttgagttgatactaaaattagggcgtatactagtatactgatccaagagtcaagggagaactgtagtccaatcagccaaaaaggaaatctgagtgaatcatccaaaaaacaaaaaaagaatagaaaacaggtatcaaaagtgatacaccgagccaagaattagggttcctggaagagaagtaggaaggagctgagaacagagagtgagttctagttttaaataacaatctgaagcagttcatttttatcttaaagtatggaatcaaataggtcagccaccttgaaaacgccagaagatggtgtgctgcgagatatcagtttagataaactgtatatatatatatatatagtttatatatatatgaatagtttatatatatatgaaagaactaataccaggaaagaataaataagctattttatatagatttcaacaaaaattattaatgtcaaaataaagcaatataacaatatagacataatgggtatagccaatttaagctctgaaatgcacacacagaggatgaaatgagaatgttgggcatcatttgttgcattatttgatctatctactagttattttgtctccacatctcattataatagccagatgcagagctgtaggaaaacatgactcccagcaatggcacctgtccttttggtgagtaattcaaaaataaaactggtctttttggagagatctctgaattttccatctggccaggctgctcctgagctttgcctgccttgcttagagggtgtttattttatcatgagctttaattatgggaacaataaatgctttcttcttaaaattacttacaagagttattaaaagaatattacaagagagggagaggcacacacttatccctgtgccaatgtttccatctgtccctcctctccctactttcctcaacattaacttgtaggtcaggcaggaaagttatatgattgaatattccgtctgatgtggattattttgtctgtaccactttctcgatgacctgctcaactgaaatgcttgtttcttttatgcctatccagaacatctctgtcccctagtgtccaggtcaactctggattctgcctgaaaactttccccaaagctgtatcctcttcctaaattccaacattcatcatccctattttaacaatttacctttccttataatccaacatattattagtttcaaatgatcttattatatagttccatatttttctattgctctccactgcacccagaatggtatataatagttatttaataatatttactaataaattgtaaaatttcttctttaaaacattaagagtcaagtttttaaaatgctgatttgcttctcttactgcaaaatcttaaagtgtctgtcttcactaattttcattttcagaggagacctgtgccaattacacatgaaatgctaaataaagctagatgcaggactgtgctaaatacgaccaggatagttaaaggctacatgggcttcttttattctttaaaccaacaagtatttattaaacacatattatcaatgacaagcaggaaatcttttccttggatttttaagttacaagtactatatgggagtgcacatttgataccgtcataacttttttgaagacagatcattcaggcaattttgtttgaaaatttttgtcaattacacttagatctgtagctccaaagttgaagcacgcaaccatgccctgttttagtgtacatcattttattgtgctttgcagatttttttttaaacaaatcaatggtttgtggcaactgcattgataaagtgtagtagcactatttttccaacagcatgtactcacttcattgctctgtcacattttggtcattcgtgcaatatttcaaactttttcatttttagtacatctgctatggttaactgtgatcagtgatctttgatgtgactattgtcattattttggaacaccacaaatcgtgcccatataagacagctaatttaatcaataaacgtgtgttctgactgctccaccaattggtcatttccctgattcccctatctctctctcctcaggcctcccaattaattgagacataatattaaaataaggtcaattaataaccctacaatagcctctaggtcttcaagtgaaatgaagagtcacaggtctctcactttaaatcaaaagctagaaataattaatcttagtgaggaaggcctgttgaaagccaagacaggccgaaagctaggcctcttgcaccaaacaggtagccaagttgtgaatgcaaaggaaaaacacttgaaggaaattagaagtactacttcagtgaacacatgaatggtaaggaagcagaacagccttactgctgatatggagaaagtctgagtggtctgtatagaggacaaagcagctacaatatccccttaagccaaagcctagcctgcagcaagaccttaactctcttcaattctatgaagcctgagagaggtgaagaagttgcagaagaaaagtttgaagctggcatagagtagttcatgaggtttaaggaaagatgccaataccataacacgaaaatgcaaggtgaagcaccaagtgctttaggtgcttttatatgaaaaactacagcaagttattcagaagatgtagctcaaataacagataaagatgactacactaaacaatagatttttgatataaatgctgatagaagatgccagccaggactttcatagctagagaggtgaagtcaaagcctggctttaacggctcaaaggacaggctgactgccttgttagagactaacgcaatgtgactttaggttaaagccagtgctcatttaccattctgaaaatcacagggcctttaagaattaagctaaatctactctgcctctggctctatagatggaacaacaaagcctggataatggcacatctgtttccatcaaggcttagtaaatgttttaaacccagtgttgagacctactgcttagaaaaaaaaaaattcctttcaaaatatcactgctcactgacaatgtactaggtcacccaagagccctgatggagatgtacaaggtgatttaaattgttttcacacctgttaatacaacatccattctgtagcccatggatcagagttatctcaactctcaggccttattatttaagaaatattttttataaggctatagctgccacagatagtgattcctctgatccatctgagaaaagtaaattgaaaaccttctggaaaggattaccattcttcatgccatgaagaacatttgtgattcatggaatgaggtcaaaatattcaacattaacaggagtttggaagaagtttattccaaccctcatgaatgactttgaggggtacaaaccttcagtggtataagtaactacagatgcggtggaaatagcaagaaacctagaagtgaagcctgaagatgtgactgaattgctgcaatctcatgataaaacataaacagataagttacttcttatggatgaaaaaagaaagtagcttcttgggatggaatatactactgtgaagatactatgtagattgttgaaaagataacaagagattagaaatattacataaacttagttgataaagcagcagcagattttgagaggactgactccaattttgaaaaatgttctattgtcctgtggataaaatgctatcaaacagccttgcttgctatagagaaatattttataaaaggaagagtcaactgatatagcaaacttcattgatgaatttattgaattatactaaataatttaaccttgctcaagtttcagcaaccaccaacctgatcaatcagcagccatcaacactgagacaagactctccaccagtaaaaatattctgatatgcagccaggggtggtggctcaagcctgtaatcccagcactttgggaggctgaggcgggcagatcacgaggtcaggaaatcgagaccatcctggctaacacggtgaaaccctgtctctactaaaaatacaaaaaaattagctgggagtggtggtgggcacctgtagtcccagctactcaggaggctgaggcaggagaatggcatgaacccaggaaggggagcttgcagtgagccgagatcgcgccactgcactccagcctgggcgacagagcgagactccatctcaaaaaaaatatgtatatattctgatatgctaaaggcccagatgattgttagcattttttagcaataaaatattttgaaattaaagtatgtatggtgggccattacagtggctcattcctgtgatcccagcactttgggaggctgaggtgggcaaatcacttgagcccaggagcttgacaccagcctgagggtgggaccctatctctacaaaaaaattacaaaaattaacaaggcctggtggcacatgcctgtggtcccagctactcaggaggctttggtgagaggatcgcttaagcccaggaggttgaggatgcagtaagctgcaatcatgccattgccactcgagcctgagtgacagagtgagatgctatttcaaaaaaaaaaaagaaagaaaagaaaaagaaaaaaaaggtacgtacatttttaaaagacataatgctattgcacatttaatagactatagtatagtgtgaacctaacttttatatgcatggagaaatgaaaaaattcacattacttggtttactatgatatacactttattgaggtagtctggaacagaacctgcaatatctccaaggtatgtctgcatcagaaatgactgttttactttgaccaaattacaatttctccagaaaaaaaaaaatgagggaggaaagagaaagttccctcaccaacaaaatcagctgaattaacctggtgactaacatgatgacagatattgcagccagagagccctaagctcccaggacaaacaatgggatgccaagcttaagataaccccaagtaaatgcataagaatatacattcattctttctaagacatcagtgggactaggaaaatcatctcaagagctgaactttaaagctattttagacagacacatttaatagcatatttttttaaatcttgtgtatgtcatgacaagttcttttctttcataactctaaatatcacatacaaaagtagcaggtgtgaaatgtgttttgggtaagaaaaatatcaagcttctatgaaagacccttttgggaaaagtcccatactaaaagagtcctagagaatatacccatcatgacacatctcttcaaagctaaaaaacagcttacacaaaatcccagatatcaacaagtataaacactatgaaagaaaaaagtattcaatgtcaatatattttatagctgcatgtttatgtatatattttcatggactagattgatcaaaatataagaggctgtctctctcccgttttctagccgtccctgaaatccacttcactgccaactctaatccttgccccctttttatttaaatgccatcaagaatctgaagtagtaaaattgaatggagatttcaacggtgggccaattttcctttcttatgagctatgaagataaatgtacacacacgagtaaagaatataagctttgcccaagaggtacactgggcagaataaagaaacgtctttcttttcttagaagggaagtgaagatttatgaggaggcagcatattgggcagccttctgaatatcttataatttttttgtgacatgctcttcccctagtgggcttcatcattcaggctgctctcctcccctcactgatcagagcttataggccttctgatgaatccatcctctacaagctatggggacggcctgcattcttgcctacgaagctgcagctaaatagaaaaagcacatccagaatgaccactaaaaagagaaaaagcaaaagcagtttccagatccatgaatcccaaaatattaaaaaaaaaacaaaacaacaacaacaaaaaaacctatttatatattaaaaatttgcttcattactagactgtagagaaatttgattttacattggattcaattcaagttccaatgcatttggacaaagaatttagagtattacataaacttagttgataaagcagtggcagggtttgaggactgcaattttgaaagaagttctactgtaggcaaaatgctgtcaaacagtattgcttgctgcagagaaatatgccattgacagggcccccacgctaggcaccgtactataggcatttgtaaatattatctcatttaatcctcaaaactcgcattctagaagaagtttttttctgcatttcacctgggtgatgaaataacatgtacaataaacccctatgacatgtgtttacctatgtaacaaaccttatcatgtaccatcgaacctaaaagttacagaaaacaaaaagaaaactgagattcaaagaagggagtaatcctccacccaagtcacagaaccagatcaagagcacagctaggacttgaacttaggttttaaacattaactgaggcaagaaccagatgaacacattgtctgacggaactgccaaacctcctctttcgatttgttggggaaaataaaaatggaggggagaaaaagaaagatacaatttcagaagagagagacaggtcataatcaatcataagctttcttggagaactgagcctttgccattagtacctggtggctattgggccactatggcttccccaccttagatcaacacacttgagcccctcaccacctcctaaacacctttctccactccccaaccactaggtttcatttaaaactgacagtgcaacatgcccacattttttttggtaagttcaaatgaaaaaaaaatgtatcttaagtcatgcttgctatgcagaatatttttcaaatctcttactatgctttcattttctgaaatttctctgatgatgagtactaaagataaaatgtaaataattctagagatggaacaagccaagtgctatccatagccctagatgtaatgctcctgtaaggaattataatggacatggtaaaacctttaaaacaaattaaatgttcaacttcagcctccatggtaaagacaaaaaagccaaatatttacgcttggaattttgatctctggttaaaaaggaaatatagaacaaacaaacaaaaaccaaaaagttaacgtatcactatatgaggcttggccttgtgtctcctgttagataagagatgaagcaacactctttggcgacatatggtgagtcatttaagtgtattatgcagatttggagtagagatattaaacagcattttcaaaagaataatacaaggactatgactgaagaaccattgacaaaacacaaaagcacagcttgaaatgtgaagactcagcatcatcttaaagaaataaatacttctatattcttcaattgagctactcaatagttgtgagaacaaagaaaatcctggaggtaaaaatccatgcaataattctggctggtcctctttgcagaggtactcaggtgtgtgatctggtagatggcctgctataagtttaatagcagggttatagatttaaaaatatatttaaaagatagttcacatttaattttatttctggtgagattaatgtgttacaaagttagattaattaaaatgctctgggaaataattttcttggtgaatcgatctttataattcatttacttacaatgtttacatagaaatctttataaaaccaaagaagattcagtaaaaagcacccataaattgatttcatgggaaaaaaataacgagattaaattatcagtgtttttctgcctaaattacagcataaggatgtgaatgtattaggcacattgtaattggcccaatcctggctgctcttctcttcctacttcaaagtataaagaaagcactagaagaggcaggcaaaacccagctcccatggaaggcactagctgtacatattatttcagagaagcaaagcaaggttgatgcaatccacacaaaaagagagatctgagtaactccagattaattaatcacagcaggaggaagctgagttgccagaaatgttactaagttgccccctacagaatggatcaagagtgactcccttccttaggaatgaaatggagacatgattccaaacaccacactttggatttataatcaataattctattgtcatatcatttacaataagtgtgtttattaagctggcattgacagggcactcaatttattatctctgaactgtttgaagttacatatacactaccagcatgtatttatatatggcgaatccatctgcagcttctctttttctggtaggaagagttcacacagcttaccaaggagggcctgaccagatcataaatcaaggtgaagcaatttctgataactgaatatgagtttcctctaaagctttttatgtgacgaaaagctgagaagctctgtgactagcacaaagaaaaactcatcacatttttttttcccaataactgctggcctctttgttctagaataatctgtaggcttttcttggcattttaactcacatttgcccttatacccagggaggcctctgcagcttaactttctctctagtcattgctctcttcatatccaatattagctgagcaaagtgagttactaccaacttttgactcttcctggccaagatgttttcagtttgttcaaaagtagaaaaacttaagatatttaactgatatatttgtggggaaaacttgtaacatttgagagctaggaaaaaaccgttaacatctgccatactacagactaaaggaatggagactagaaagatctagtgaaccccttgctccttcaggaactgtccatggtgctgcaaccctccaaaacatcgtttcttagcagttgttgccacacaaatcagacccaacctcagcgactcactagtcaagattgctatttgacttctctcctcacagaggtgctgaggaaaaggagaaaggagaaaattctgacatgatcaaaaaatggtcgaactcacaccatctttgtcttggcatgggttgtcatcaccagctataaaactataaataaaatgtcatcagggaacaaaactgtatataaacaaatttgcaatgttctatcaagttagagtgcaaagcactgcctctcagaaacaacactgattataactggaaggtggatctttaagtatactgatagtttaagtgcagtgtttgtttcattatggtttgtgtaggagaagaaatcttcctaaaagggtctgctaacaatacaaaaatcacatacgtgccagaaagaatgctgaactgaaaacccagttttcctctaagcagataatgccatgttcacatgattatacaactgaaaaaaaaaacagattaagaaaaagtgttaaagagctttcttgtactgcagcaaaagcatttcaaagagaagataaacttacagagctattacaaatgttgtaaaaagcctaaggaagcctggtaaataagaaagttttaaattactgctcatataaaaataaatgttactgtccatcgttgctctgggtggggatacgcttggcataaggaatacttaagacaatggaaagaaaaaaggcagtgactgtgattctaatccaaacaccatattgttcgcaatagacagttaatttgccatctaatctctctctctgagcatagccccttagtaaccacattcatataatttgttttttcatttaaaattccactggaacttaaaagtttattaaagtgaatggactactccatctgagatgtaactgaggatatattagcagaagcaggctccttagcatctgattaaaatctcagtgttctaagcattggaagtaatactttttccaagcagcaacaaactggataaaaattatcagacccatgaacagagtcatttagcctcattctcttgttttaaagtgttgattgcctgtaagttagtagaataatctcctctcctctctagccaccagagtaagcaaaaaggaaacatctcataagtccacagcctgacaacagccatagttctaatggctctttgaataaggaatacttccacattagaaggaaaaacgacgacaactatgattctaaaaatggaaagcacacacacaaaaattaaaagctcaaatggtaaaaacagctgcgcaacagccatttctatagttttcctcttcaataaaaattgttggccaggcatggtggcttatgcctataatcaaaacactttgggaggctgaggcgggcagatcacaaggtcaacagatcaagaccatcctggccaacatggtgaaaccccgtctctactaaaaatacaaaaattatctgggcatggtggcgcgtgcctgtagtcccagctacttgggaggctgaggcaggagaattgcctgaacccgggaggcagaagttgcagtgagcccaaattgggccactgcactccagcctggcgacagagcgagactctatcttaaaaattttttttctctctcattaagttagtttacaccctcagggataaagaagtgtgattcagagaaagggtggcatggttcacactctaccagcaggcaagaggacccctatctcagtgcactatatggtcccaatgactatggccacgtcactgagagatcagcctcctcaaagcggtagtagagtcttgtctggcattttacttgtactctgacaacaatgtgagatcacatatgatataacgaatatttggtagaaaactgttgacaccagtgcaatatatagttcatgtagctattacagtttgattcattctccattcatcttaatgggaactgctaattctattcatcactaatgacacaggttcaagcaaaatctaaggaaggagtgtgtgagtgtatgtgtgaatgtgcatatacttgtgtatacatgctcatgtatgtatgtatttccctcatatgcctcattaagataattacaactgaaggaagcataattgatggctagaaaatttagcaggaataacacaagggaaatctggaggtttagtacatcaatatggtgaaagacaaattaaaggcttaattaccaaactgtagaagctatttaaaaattatgattcatgttagaactcacaattgagccagccttgtcatcatctttctctttgttttcaataagtgttccttgttcttatcatctaaaacccgtcttcttttttacccttcaaatgcttcttacaattctataattaaattcaaatccatcacaaattctctggataagtcagaatcttaagttggattttgccaattcaacttattaaagaataacagcccaagtagagaaattatatgtgtttcaaaatcattcatatctacatgcattctttctctcccttccttcttctattttttcctttccttctctctcacagaagaaaaacattgtaaacatgggatgctgagtgccatatgttccattacacagaataaaagcaaactcgtttcccatacaatgaataggaaatgtacaccccctagcataccaagtcctactttatatttattttggtctcagaaacgttagaatagccagtctgcaaaaatttttgcaatggttatgtgggaaaagtcagtagggaaagtcagtagggaaaaggaaatgttaaaatcaaagctaacttctaccacaagtgacctctccttggtatgatgtagtctagtggcatctatatttcctccagagcgattatctcaatttaggtgcaacagtggaagtttctgttttaaaccatttttgggttagcagttataacattcaagtggtttcttgagactctgagggaatagataacccaaatctgaacaggatggaggaaactcagtgccattttattttttatttttttatttttggtagagacggggtttcaccatgttagccaggatggtctcgatctcctgacttcatgatcctcccgcctcagcctctcaaagtgctgggattacaggcatgagccaccgtgcccggccctgagtgccatttttataggtactgttcaataaggtcttcaggatgcaacatcatcatattgttataagtgttattctgaaatgttgtggtgtctcacataagctccagttctatattttcaaaagcttataagattttccaactaagatattctaatgctacttaaatttatgttttaaaaaagaaaataccatttttcaatctgcctccaagaaaataggcaactaaaattaggaaagggtaaaaggaatccatgatcatgagaatgggaatggatacaattgcttaggttttagagctggcctatgcagtagtcactagaagcacaacacacagtgtggctggcaactctggcttggttcaggagaggctgatgtctgaggaaatccaatatggtggataggaggtccaagcaccaggggatactccaagtcaagtgggaaatgatctactcattcaaaatagactgtcttccagcctctgggaatgtagggaaaagttttagccacagcatagcatgatcagggttaggtaggttgcaaggacctgagaaggcaagctgcattagagaacatcattttggattttgttcattgaggagctgttgcagactgtttccctgggaaacaaactctgagacagagattaacatgcagggaatttattgcaagggatgaggggaatgctcttgaaattaacaatagaattgggtagcaggagctctggatccagaacagctctgcagaagtgtcctcaattgggataatacaaccagaactttattcccctcatgaattatcgattagatataggctgaccctaataagagtcatgaacttggacaagagtgtctcttcacctgatggcaaaacccagagagaggtagctatcttccacccatattcccagcagagaaaggcaaggagtcctgaaggggagaggtctgatggcacatccactctagtagtagatgcatctactacagatgctcataaaataacttagatagaagcttaatgctgatggtggggcttagggcatacctgaacctttgtgggcacacaagtgtccagggctcactcagatgtacaagatcccaaggctctaataccaacaggacagagctgcaaatgtcctcccagcttcccctcagagcaagtctcagaaatggccatgtgaaattacacatcctgtggcctttggatgatcagctgtttcatatggtctgtatttctctagtcaaaagaatagtagtaagatggacatggcctgaatatactggcagagacatgaacaaaggaagcagaaggcaatgggcaacacacttgtgctcaatttcaggacccaaaactacactgagcaaggggctccttctagacattgttccacagagaggctccctgacccctgttcaagctgttagagggactcgacctctgggtctgaaacataaaaaaccaaagtaggaaaagggaaaatcattcactgaggcatcactgaactcctttcaagtcactgctgtctgggtaaggctagaaacagtggccacactgaatctgcaccataacttacggttggctgactttttgctaatttgtctattaccccaagatgtttggaactaacttcttgcattgttaaatatttcagaatatatatagccaggaaagattcattctttagggttcaactaagagatttgtaactagcaaaatgatgaaccatgaatcaagctaaagagccagttagggacaaatataaatgtgaaacaaggcaatcttcaaacattaaaatttcaagtttaaaaccaggaatttatgattctggattatagcttttctttgcttactcaattggataatgaatgtaaactgtgacgttatggtgcaaaactgtaacccaaggagtgagcgatccagtactgacttgagaaaccaatattacactgtgagatattcacggttcaatggagagatggaaaattagatgccttaaggtctttcttccagcctaaatagaaaataacgtacaaatgtaaagcactggaaaataaaatcccttccagcccaaatagaaaataacatatacatgtaaaacactggaaaataaaaattttctgttgttgttattttattatctttctaagcccctttcctaactcttttccttctttgaagtatcttgaactccttttggacactaaatcttctttgtctgttccccagccagagatccctactaaaagagatagcatgctaaactgtaggcaatttacatgttccggactttcccctctcatttttcattccctcaaggacttcctctctgttaggcaattgaaattacaaaaattaggcattaatagccattgttgcttaatgggttacccatccccagtatagacagatgctgaagttttattccccagccttttagttcctatcattgtatcaaataagactagatgacggtatctccgtaaagccttcaatttcctccctggccccattagatgctctgtttgggttaaatgagaacagcttgcaaggtagttgtttgaacacgactgcattaatcagggtagaaaaaaacatgtagctgatttacagaaagcattagattaacaatttagagtaatgtgaggaaaaaacctcagtgccttataattatagataatatttataaatttcattgatttattaaaaatatatatatatacacacacacaaaacattcagattctagtatttgctatccaataggtacctttattttatattccaaaatgaaaatttatggtggaaatttcaactaaagtaggtatttaggcatacttggatagacgaactttgaaaatgccattaatatcacttacatatatggtggtaatcaaaactaaagctgaactaacttggcaaactctggaactgatattcatgtatggagtttgtcaatgagtaggaaaaatgtatcatttcagtgtgagtttatgacttcctttttgtaaaaggtggtatgggaacattgtctccttacttaatgaaaaatagtattagaatacacaagactgtcaggataattacccagtaaggataataactggaaactaaagacaaagagtaaattaaaaaatgggatgatatggctaataagatatgccctgcccaacagcccatcagactcttctcaccccaactcctgacaaattttcacatagctttggttgccaggagcctcaatacctgctccccagaaggtgcctgtgtgtcaatctctctgtactcaagggggcatgcagatgtttcctgtatcatatctctaggatatctaaggaccgactccttagttctcatttcctagggaggtcaagtctcttaccagaatcctttggggctggcaatgttcatcaccccatcctcagccctctaacttcagaggacagctgacttcttaaaggaatgaagagatctttttcaagtcactgctacttgaggcctcagcaaccaagaagttatacactcctcccacccccacaaattcacatacatgcagatagtagggtagactatacaggtgtgtgagtgtgtgtgtatgtgtgtgtgtatcctcctatatagaggcagaagatttcataaaatatatacatgagatatacatacatgattttatgtataaatacatatagtacacgcatataacattttacatatatatctcattttaaaacatcttgcttttgtaaaaattgtgtgagtatccgatcacaggaatacctttctaatcttaataatttagtggtttaaatgtacatgaaaggtcatcctagctcattataattctagaagagtcaatcatatatccatcaattactttggagcaaactaatggaatagttttaagcataataaagacaaaaggtgacactaaagaagcaaaaataagtctgttaatttccaggaagcttcaactatagaccaatcacattcacagggaacaacagaaaagtaaagctgagctgcagaaaaagtctgcactaccagggtaaaatagaaacaggaagattaagaccaagaaaacttacaaaagaatcacagtcagtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaacaaaaaacaaacaaacaaaaaaaaatcacagtggccctaacatgccaagattggtggaatctctatagcagaaactgtcagtctttatattattcttgctagtcaaattccactttctaaaagccagagaaaattcatgcagctgggtagtcctacagatttctgagattctctgagtatagagccatgcaggttctcctattctttccgagcgtctatattcctaagtagaaaatagaatttaagcctctttccaacaatcttaaagatacactagttttgaaattcagcaaaaaaatcagtacatttcagggtaccatatgctttgaaagggagaggaaggcagagaattaacatttcccaagagcctactgtaataaagacagaaaggcacattggataaaagcatagactaggagccaacctacctgtttcagatcccacctctgccattcacaagctctgccatagtgtattgagtgtattaaatgaactcataatattgaagagaaaaggaagtactcattatgaattagctgttgtttttgttactctgtgctgggcccattcttacaagatgcatggtctctcctgcctcagatatgtgccatgctgtttcatttatccaggcttttttttttttctttttttgagactgagtttcactcttgttgcccaggctggagtgcaatggcatgatctcggctcactacaacctctgcctcctctgttcaagcaattctcctgcctcagccttcatgagaagctgggattacagctgtgcaccatcacacccagctaattattgtatttttagtagagatggggtttcaccatgttggccaggatggtcttgaactccaggctcttctaactctcctgatcctttccctctctgccctcccttcatttcctccaacatctcaccttttccagggagcactgctgtgcctctccagactggaacaggtgccagccctccaccataacaatatttcactgtgtcctcccactatgtccctgagtgcagacaatttaagagcacccaccccactccccgatcgtctatcttagagccaggtacttacaaggactctatatgtaccaaagtcgtgagttcttcaagagtcccaactgttattttcttaattattgtataacacatgccatttttaattccctggctaacattcagtaagcaactgtgtgccaggactgttctaggaaatgagatacgataccacataaacaatgtctctgcctacatgttgcttatagtttgaaacattccaatcaaaaatttttgcttgtgaacaaaaattaagtatgtttcaaaaattgaaccaagtcacgtttgagaaacattacacatacggtattttaataattattataaaatatgactgtaggaataggaaaggaagcctcaaaacacttatttaaaaacccaccatggctccgaattctaaagaaatggagtaagcacactcccttgcactaactacaacaaaaaaactcctgaacaaaatacatatagcaactatttgagaactctaaaaataataacaataggtaacttggggagggtcagacctcaaagaatgactcataaagcagtcatttttgtgcttgtttcttgtaaatttcctggtttatattgaggacagccttgattttcaaactgtggaacagacacaaacagaaaatcaaggaaatccaatactttttggctaaaagaaaacggggtgtctgtaggctagagtagacagggaaatcttttttttttctttctccctttttttattctccctgccacgtactgagtcaagcaagtctcagcaagaactgaaaagtatgcaaggagttgcaaaaagaaaaaaactagagaaaaagatcccttaatcctatatatcaagtccttggctaacccctaaggtacacatgtttagaagtgacctgaagctgcataacaagagctttgaaaacataactagaatgtagaccatcgtgcaagtctcagatagtgccaggctggcacacattctgggccagtctgaacaggaccacaaaagttctaagagctaagccaacactggaaccacagctcacagaagggaaggtgaaactcatgttctaagcctaacccggctggctgattgctgaaaacaaaaagaatcatcaattagaggactttaacagaacccaaagtctctcaatgaaagacccaggatacaatccaaaattattcagcatacaacaaaatgaggacattttcaacagctctcgagtgtgaaacttgatcatccatattgggtcgtttttgtcattcttaattaaaacagagtcaaaaaaccagaagggaaaaaagcacccagggcacataacattgctccaaaaatgtaattcatttcaggactggttgctgaaaatgtctgctttaacctgaaaccagttgtatctaatggctactgaggcaaatggctgcaacttaagactagttttacctatcactggcactcaccaatgagagctcatgagcttcccaaaaccttaccagtgctgatatactttctcaaagagcaatagataacatttctcattttttctgtgtgtaaaacctctaaccatatctttgttctttggacatacaccaaagactactcagtttgtgtgtattccttgaattgcaattctttcctcccaaaaaaatatttgtctctatattttgactttgacaaaggagaaaaaacaatgaacagaaacaattcctgagatgatgcagatgttagaggcattagccaaagaattgaaagcagcttttgtaatgatattccatgaaaaaaaaaacaagaactttgaaataaatgaaaaaaagctttaagagaagaaatcataccaaaaaaccgaaaatttaattaattttttttgagacagggtctcactctgtcacccaggccagaatacagtggtgtagtcatagctcactgcagcctcgacctcctgaggctcaaatgatcctcccacctcagcctcctgagtagctgggactacagatgtgtgccaaccctccagctagttttttcatattttttgtagagaagggatttcaccatgttgcccaggttgctctcaaacttctgagctcaagcaatctgcctgcctcagcctcccaaagtgcaggtattacaggtgtgagccaccatgcctgacccaaatggaaattttagaattaaaaaatacaatcaataaaatctgaacattcactgaatcagcttagtagcagaatagaaatgggataggaaggaatcaataaacttaaagatggatgaatagaaattaccaatttaaacaatagacagcaaaaaagaatatggtctcagagacctatgggacactacccacaggtctaactaacacccatgtcactgaagtcacagaaaatgaaaagaaagagattggagcagaaaaagaatatttgaagaaatgatagccgaataccttccaaatttaacaaaagtcataaactgacaagtttaagaagctcagcaaatatcaagcagtaaaataaaaaacaaaaacaaaattaagaagaaccatatgtagatacatcataataaaatggttgaaaaccaaagacacaggaaaaaaattgaaatcagctagagggaaacaaaacattacatatttgaatgattcaacaatttgaatacctttagatttctaattagaaagcatggaggtcagaatagtaaaacggtacttttgaagtgctgataaataaggaactgtcaactcagaattttaaatccagtaaaactatctctcaggaataaatgtaaaataaagagattatcaaaaaaagagagagtaagttggcggcatgcctgttctaaaagaaatgctaaaggagccgcttcaagaaggaagatgataccagagaaaactgtggaacttcagaaatgagggaagagcaaatgacgaggtaaaatcgagataaatgtattatttttattcttttaagttcttgaaaatatgcttgactgttgaaagcaaaaaagaataacactttgatggggttttcagtgaaggtatgtgtaatacataataacagttacaggacaaaagggtcgtgcaaaggacctacatagttaaagatttatatgttccacttaaagaggtaaaatatcaactctaagtagaccatgaaaaattaggcattaatgttgtaatctttagagctatcaataaaaagtctactcaaagaaatacatttgaaaaacaatagataggttttaaattttcaaataatccaaaagtgggcataaaagggaaagagaggagaacaaaacagaaagcaaaagatgggagaaaaacaggccaaaaataaaatggaagacctaaatccaaacatgtcaaaaattacattaaaataaatggtcaaactacaataaggaaagagattgctggattagagagtaaaaacaagacacaactgtaagtcgggtactgaaacccacttcaaatataataatataaaaaagtgaaaggatacaaaaagatataccatgtaaatactaatcaaaagaaagttgggcaatgtttgtcttgttccaaagtttatcttttctgcatcccaattttggtaatgtttacacaattttatgtatttattaatatagaaccatacataaacaattaatttttgtgcatgcaaatttaaaaaataaattaaaaacctacttatagttctgccttcttaatttacttctttgtacactctatggttggcctccatatctgtggaattcaaccagcctcagattgaaaatacctatactgtatgtccaaggaactcatggatatagagggctgactggaggacttgagcatccaagaattttggtatttgtggaaggtcctggaacccatacctcagggatgactgaatactgtataatccaaagcatgaactttctaaattctaaataaatcttttacaatcacacgatccatcctacgtatgaaaaaaaaatgttgattttaaattcaaagttcaatattgcaattccatctacaattaggaacagtattcatctgcttggaacagaaactcaaattaacagtggtttacagaaattatggaattatttttgcattcacctaaaagaacactagaggtgggcagccccaggctgcatgaaccacctggatgatagtggtacatgataccttcagtgtctcagggttacactattactgtggtttgcaatcctcataactacttccatcctcaaggccatccatggtcacaggacggctactgctatatagccttcaggtccacgtacaaggaagcagaaggagcaggtgaagcagagagagcaaagagcctttctggaagttacatcaacaaattccactctccctcccactgaccacctctttctgcagaggagtctgggaaacgtggttttaaaagctacactcactgtcattctcaacagcacagaggtcttgttaagtgaggagaaaaaagggatagagaattactgggtaggcaaatgatagtctagttgtttaaaccactagccacaaatctggtactaactttttggatattcttattttagaaaagcaattcaagtcaggggaattcaacatgaaaaaaaatagacagcaatgaatttcattcatgtatttataaaactagaaccatgtttgtaatacttctgtgaaaggcagaatatgacagttattacaaacacagttgtttgaatacatactaacaagcacatcatatctcaaaattatggcatcattctatctttaggattccaagataatatgtttgagctaagtccaactggatttaaaaacggatgcttctagaccagaaaaagaaaagcagaaagacatgtgtttttaagctgagccttacttcttcatgagaggtttttgcctgctgaccctgttccggtagcttagatgcaggcggtgatgaaaggtcatttcacaacttcacatgttccagatggtgcctctttggaaagaatctctttctggtaaaagctagaaaaagaaacttctcactacttactgcttttagcattttgtttcctgccaacatgaaaacaagccccgatgatgggacaagacattttctcgtaatgtaattgtatccttcgaaacacagtggtgtagaaaacacaaggggacgcaaaactgaaaggaagaaagctgtatccaaggctaggcttttctgataaccagccattcaaactcctacaagttatttccctttagcttctgctactctggacagcttctgcacattttagaagaattctcaattttcttcctttttaaaatgaagcctagagtacagtgacttgtccaagactcagaagcagaacaggaacccagatctcctgactttcagggaaggtccttttccatctcaccaaatggatgatgcttttatgtctaagaaacccatagtcttcacttaaatgtcttcggcttctctgaagaaaaaagaagactgaaaagtgaggttaagagaccaacatgctggtcccagatctgtcaccaactagctatgggactttagggttcagttcctcagatgtaaaatgagagggctgtcccagactagggagagtgctgatgcccacatgtatctggccctgaactttgtcagatattttacatcacagcaggaactgttcttggatcaccttcttaggaaatgtgatcagtgcttcccaacatttcaagtcaggacacataaataaaatgaagatattaacattctacagtggcaaaaatggaagtggatgcttggagctgcaggtgaatctacctgggtgcaagaaggctgaggggaaaccagtgtctcagtgcatctgtaaactcacctgctgtacactgctgggaagtgggggctaagtgggagttcagatttttaatgttttggtagcagtctggaacctgtagctttacagtttttgtcagagccaactctgcatggggagattcccccaggacctctgctgctggatggtgagttggggaggaagggaaatacgggactggggtgaaggtggcaactggaagagctgaagagactcaatacagtgtgagagtagacagaaaagttgtcaaccctcaccaagacaaggagaatgagacaggcctcatgctccccatttatactaatcactcctcctatttagatcactggctgcctctttacaactccctttcccttaaacagtcttttagtattttctgttcacttcagatggatttcatctgggtaagaattttggcctatgaagcactataggatgtgttcggtatctcagcaacaagagatgccttggtgtgggccagtcagtacttacaggcttagataaatacccagtgctcatggaaagacatacagtctagaaacagcatgcttttcatattttatatgagatgaaagagagaaggaagacatgggatcataatctggaggaacgaggctcttagtaactagaaagttcaaagcactagattatttctattctctttccttgaactaagcaagcttttagaaaagaaaagaaatataacacaaactcactgacaccagggatttattcagccaagcaatttccagaggctatcctggaatcatttcacattcagctcaatactctgtatcttccacattcatatcttttgtcctatacaatgataattgatggtcagcattacagccctgaagtcttgcaacacactgaatcatcaaagggagattcaattatattcataagactggatgtgccatagcagcaaaggggacttggagattgagaagggttgaagcaaaagattttctggttaactcttagtaagccaaaattaactgaaaaagtttcagctctatgcaatatactggttgatggagaaatactttaatatttgaatgtgcacaaagaggaacatttataattttataaccaactcagcagcaatgttattggaagaagattttctatttttgcccagtagaaagtaatcctaaacatcttttcatgggagccatcttttattgtcagtaattttgcataattaaaaatatctcttagggttatttttgcttggttattttagaaaactatgaaatacaaaagcaaaaggatgaggaagatcttctgggaattctaccattggaaattccaaagtaattgctaatattttggtcaatatcattgtaatgttctttcatctatacatattaatacatttctaagtttcttaaaacacttgtataggtaaattttcacctaccttttcacttattacatttgaatatctttccatgtattcaaaattcttttacagtgtaagttttaatggttgtagaatattctgtcatacaggtttcagaatttagctgttccccattgttgaagacaagatttgttattcatttatctttctcgcaaacactattgtaatagcctatacctcaggctttgtttacttccatagagacccaatacctagcacaatgcctggtatgctgtaggccctgggtaaacagacagtgaataaattaatgatttcctcagcatactttccagaagagaactgatacatacaagaccatacatatatgatatgtaatactaaaatgcccccagaaatattgaaccaattaatactcctggcagcactgtgtgtatgtgtccagaataagtattacttttaaataacaacaacaaagtcattagttgattatcaaattctgagtaagcatcaaaacatcagtgggaatgtttgggaagatgtcagggcaactctggaatgatatttcttccttgaactggtgaacatcccatataatttacactgctctcagttagttaccctaaggttaaatggtatactcgagatgagagtttttcctgtgctttatttaaattggggactggtaaaatgtcacctactgtctgttttgtaaataaagtttaattggaacacagccaacccgttgcttacatgttgtctacagctgcttttatgctacaatggcagaggtgaatagttgcaacagagaccgtctggctgacaaagcctaaaatacttattatctgaccctttacaaataacatttgtcaacttctttaaaagagcacttcttaaaaaatgaaactaacactacaccataataaatcagctaacaagcatttattgaacactgtgaggcatggtgtctactctcaaggaacttgaaatataattgtggagtaaagcaaatacaaatgtaaaaattagccgaaaaaggtaccgtggcattaggagtcgagtactgtaatgaagtgaacaagtagtgaaagatttcagagacaggagggaaaaggtgggattggaaaaatggcaagatgtcactgagacacagaacttgaattaggctatgaatgaaaagaagggcttggataaaacaaagcagacagagcagactgttctggaatgaagagcatgggcagaagcaaagaagtggggctctgcacagtgtggagataccaggtgggactccatccaaaatgctggcggactagcacatcagaagcatgctatgtggtacagtatgaaagcaaagtgtatccatgatctgtgtatttcaaaggcattcattttccatgtaaagaagccctaaaatacattttttacttaagcaaaaaaaaactctcataaagcaaattaatattttacgctctcttcctacagtgcatattatctttcatctcctcacttctgattctaattagagttctatttcttcaaaaacttgaatgctgatgtaaaaactaaagtgaaagattaggaagactagaaagaaaataagatcagtatcataatacaacaaacaaaagcacaaaaggacaggcaaactgatgttcatcacttaatatttgccaaagcttcctaacaacacatttttctgaatcagttaaaaatacagtatctgcttattttctagtcccttgcatccaagctaacaaatgccattgtaaaattcatgtctttattttttgttgtggtgtatgcattttaaaattcaaaatgttttttaaagcttggaaagaaagatgtatttatagtatggcaattattattcaactcatctttacttagaagcacacttttacatgctacaggtgaggtgagatggatacaacattaaatatattctttctcaatgtcttatatgtaaaggtacaggtaaagatggccttttgggaaaatgtggagcatgggagaaacgttttcctccttttccaagcatagctccttcattccaaggtagtaacaatgacatctgccatcagattacccagacatcaagtgacacagaagcaaggcttatatagcactgtcacagttttaacattttagtttcaggggtacatgtgcaggtattttatatagataaactgaatgtcacaggggttcagtgtacagattatttctttatccagatagtaagcatagtacttgataggtggtttttcgatcctctccctcctcccaccctccaccctcaagtaggccctgctgtctgttgtgccccaatttgtgtctatgtgttctcaatgttgagcttctatttgtaagtgagagcatgtggtgtttggctttctgttcctgtgttaatttgcttaggataagatttcacagcagttttaaatgaagggtacattaataaataaatttatcaaaaatgccaccacagcatttttgatctcaatataaaatgtagcaggcattcctcccagcacacacaggttaaagactgcatcatcggttcagtccatgatttttctgttgacacacatctggtgaatacaatgtgctgaagcaatacaaaactaaaacaaggcttttgatggaagaggtctaagaatcataacatactgagtgtgtcagaggaagtcactcgtgctttttcactaaaagaagctttacaggtgggtgggtggaaggggatggagaacagttcacactctccatctcatcctgacctgggacctccttcctgtttccttggctggtgccagcatttccatctttcttacccacttctgccatgttgaagctcagctgggcattgtatccctggaggaacagtggacagagcaggggctttcctcttttgaggcacctacgtagacagactcactctctctactcggaaaataactgtccctggtgccaggttttggaagttgaaatgttttgagctaatgcctcctgtgattcccgatggcctactgtttaattgtgtaattatagacagttaaaaatgcatgatatgtgatggtgagaaaatagttggtgcttcgggagccattatggattacagtttttgaaaatttaaaacaatgcaatatttatatagacttggctgcactgagttattatgcaaatgccacatcccactctagggccagcattcctccccagaaacgaagaaaggcagatgagaatcaggagagatgccacagtgaccacatggttgggacaacgagcatcttgagtgtccagctgcaggataccctgtgagtttctgtgcctcagtgatgtctgtgcctctctttaagtggtgttaagaaaacccagtcaacaatatctaaataattatttgacagttgctcagattcgctgtaagagaattatatgagctttcttcttatggccacttgcatattagacagggccaaaaaaaaatcacaccaagccaaaagtaccttaggtattcccagagtcaaagcattggcttagcaactatttataggctacacagcttccttgaaggtttgatccactcaggggcttgctcagcaatggcctatctggtctatggacagcaatggaactggagtaatcaggggtgtgctggggactgaggagaatggtatcagtaaaaccaaatggttgtgacacaagacttaacagttggctaaaacctgaagctctggtgaaatattattcatatagggtccttgtacttatgccctacaagaactaggattgattccaaattgtttgtaaacctaagttaaaagcaatggattggcatggatcacgtatcttaccagacaggaagttatcagggtggtggtaggtgctggtgaccaaggcatagactgaattctgcagggagtacaatatacaaacagtgtgtgtgaatgaaaaagaaactctcactgttcattcattcactcgttcattcttttttcatccgtgtgtttgtttcttctgtcattcactgagtcaccgcaatctaaggtgatcccactatgtgtcaggatttgtgctaagtgctgaggatatagcactgatctttgatttcagttctaggaattcacagtcaattgaggaagaaaggcagaagaactttgtttctgactatcagagatatataaaagaacaactctggtgagttcagaggatcttgtgtaactgcctggaggagtcagaaatgacacctaagagaatgtgaacattgagatggtatcagaaggatgattaggagtttctgagcacagaaaacggggaaggcatccgtggcagaggctacagtgttcaacaatgcatggaagcatgaaagaacacagtgttttggagaactcacacattatccagggtggctggataaggaaaaagaagttgagggagaggaatgtggccagggaaccatgcacatgcctgggaatgggccttgaatgtcacagtaaagaaaatgaaacagatctggaatgaatggtgtacagtttcatcttgggacctgccatcatcatttagtgtaatgacatcatagaagtattcaccatgtgcagagcaaatatatacatgcaagaaacaaaatatcatggatagttaacattcagacaggcttattttcaaatctggattctatttactgtgtgacctagagcaagcttctgaaaccagcagaatctccatttcctcacctgtaaaacatggatgacacatatatggtgggcttgatttcatgaataaatgggatacagtgaggaaatgcttcactaaatgtcttcaccaggctctgaatctcattcttgcttcactaaccttaagcacatcgaaatggtataagcttctgagctttggttccaaaagttcagtctcacctctgcctttcaactgaaataaacttcatacatcaagctttccactactgaaagcctcctctttcaagagacttacagccaccattcatgacctcagcatcaggacacagaacatcctacatgcttagctgatacacttaggcatatgtttacatgttcccctcaaaaatttcaaatcgtttttcatatagagagacttcatcgccttaagtggaaggataatgttgaaggttcacagtaaatccaaatatgatcttgctgattacaaagtttaacaaagtttttattaaagggcctgatgtttaatattttaagctttgtaggccacataggtaggtctcctgcatattcttcttcttttataacaattatttaaaaatataaaaaccatttcttagctagttggtaatacaaaaacagtcagggtggggagatgggaagggtagttttggcctgcaaactgtagtttgcttacccttggattaggaaaataacataacagtatttgatagagctcataacatactgcttcagaggaagcaatggctaaaacatagtactgctaagaagtccccaaagtgtgtgaggctctcttagtaagcatcaggcacctaccacctgcagcaacattttagagatgatgcagcatttaatagaatcacaaagcagtaatggtctaggttgactttaaattgttttggtattctaaaaaataaaataaagaaacttcataataagtatggcaattttttaaacagtgaaacagatacataaccacacacaacatatatacacacacaaaaataaaatgtgcaagatttttaacagtgcttatttctgggtaatgggattgactgggggaagttaaaatgtttttcatactgttagagtttgaggtagcataaaaaaaagctgccagttccttttggtctggtcttggaatcaactgaaagagatatgtcaggtaaatgcagaatcaaatatggcctgtataagtgatgtggcagttagagcatgtgttataggtccttgagtgggcaagctggctaattaattcatcgctggtttccataaactggctcacccttggagaactgcaggtcttcgctgcagcagcaggacccctcctgtacagcagaggaaagatgagaatacacagaccacagtgaaaactagaaccagatgtcactccctaccctggggacaagtagatgagaaaaggtaaaggaagccaagagtccattacattggtaataagggtcccccaacatgcactgatttaccacagataagaaccaaccaggaagtgcaaaaattcccaagagattgaacaatcaatacttgctaccagaatcttcttctctcagtagtttctagttaaagaactgctacttctgtgtgactttggatcaatcagttcacagctctaactcatggttttcatgagcaagttgtaggagctgcactaaaaggtctattgaagtcctcttccgccattctttgtcaattactgagctctactgcataccaggtgctacccgtgctctgggaatacagttttggacaagataaactcagctgagaagttttcattttagtggagaaaatatctaaacaaacagctatttttatctgatgcccagctctattccattttccttctgaagcaaagtaaaataccacattaaagaaatttgaggcagaagtgactcacaccggtaatctccgcactatgggagaacgaggtaggaggatcacttgagcccaggagtttgtcaccagccagggcaaaataagtaagaccttatctctacaaaaaaatctttaaaaattaaccgggcatggtggtgtgtgtctatagtcccagcaactcaagaggctgaggtgggaggatcgcctgagcctaggaattcaatgctgcagagagctatgatcatgccactgcactccagcctgagtgacagagcaagaccttatctctaaaattataaataaaaaaaaatttctgatccattaacattattttgcttaattttctcaaaaataccagtagagagatcatacatgttttataacaacataagaaataaaactaacttttcatgtgtgtatcagcctgggaaacaactactaaagaggaaagagaaaaccggatttgttgaaagtttagggaacattgggggcaagaaggagatctgagatgattttagacacgaacattttatatttccatgcatcatctataatacaggtatatacttgccaaacagcaatgctatcatgttgacattgcttgagtaaatttttaaaaatctagaaaagtgatttttagatgagggagtgtgagaagcagaaaccaaggagaattctcagacacagaacttgttaaaacacctcatcttgagatctattaatctctgagtttaattaaaagtctgaatgaacaaacttattttatctgatttggttttccttctgataccaagttccatttggttttccttctgataccaagagaggttgctgaaactttctcacctatttacttgcatttactctttgtaattgagtgaagacctaatgtgcgaccccctggggcattctatagctaaactaaattactggtgaaatttacaaatccaatgacaaagtaacgcaaagaccaaaaagaacagtctaaaaaaattgctccttctctttttcaatcaatcctcaggattaaagggagaatttattgataaagacagagaagtaatctctgatggagcgagatggtgtatcagtgttctccatattcgttcaattaatagacttcactgtatgcaaactctgataagtggatgaaatgtgttgtttcttaatgatctaatttgtattccagcaggatgtaggctctgctagacaaacatttcgcttggctatttccctccaaacatttatgcctcttggtgtgctagccatttattttgacagtggggcttgatgcacatctctactgttaatagctctgcaaacattttacaacaaaaataccatacaactggaactaatctcattattttccatgttaataattcttacagcaacagaagatcattaaaacccagaatggtaatgcacagatgtttaatgtagatgttcaagagctcctagccaagtcattccttcactgcttttcacaacaaatatttactgagcaattactctgttgcaggcactgtgttgtttgtacatatttttaataaaacaggtatgatctccttctttacggagctgccattctagtgggagagagatcactgagtttaacaaacaagtaaatgactactcataagttgggataaattttaccagggctgtattttccctcaccataacctcccttaacatgcctcctctctcactattaaaaggcggcttctatcatttgcttgtatgatattcctaccacttacttatttttcatctccagttcaaagattaactgtagaatcttcacaccgatctgatgtgtaagaatcaagtaattggctcctagaattccaaataaatgaagataaacatagcccatgcttcagagttggcacgggcactaaacaaaggcatacctcattcacatttttgcagaagccccttgaatatttctatggcctccagtagttggtcctcattctcccactttccagtcttacctcatttgtcccccgtacgtgaagtacaatagctctttctgcaccaaacctctcacccctcttcttttcaaatgaacctcagggtctctaacaccaagctgttcctgtctgaacaagctctcctgccctctcttaattctccttataccttccttaccatacctcctactctaaccacccagagagagaatgctgccttcacattttaaactgtgtcatataatttatggtagtgttttccaaccccatcagatgcaatgttccattttataacaaatattatgtaatgctgcctttactatcctgaaatgaaattaacagataatataatttacctacaacattatttcaagaaaaaaatcaatatgctgccctaactgtaatacaaaggagaaataaaagggaagtcatctgtaataaaacgatatgtacagagaaatgctattctagaatatagaatgaattaagcagaagctcgcacctacctataatgaataattttgtatttaaaagaagaggattatttttgaacttccatacaaggcgtacaagaacataaaagaacacaagtagaagctgacactaaaataaaaactaataaaacagaccagacttatctgtatataggaaatagagggaaaccaccttaaataaagtacagagaagatgcagagacaaattacagactgtcaaaacagagatgtgagaaaatatgatgttcctataaatgacccaagacatatccaagtcttaacattataccttgagtatggcatgcaacagggtagtgataaatatcatagaaaatgtatctctcatcttaaaatcccaccacctgctgaagtttccattcagtctatagtactcacaacactttggggaacatactctttagtgggccattgcacataaaacatgaatgggaatgtgacaagtacttcatgtcaaaaatgagaaatatttttaaaacaagctttaataagtttcaatgaggtctattgagtttcatgtgtctccactaatttaatactgtttgattctaagtatgtgaatcatagtttcccatcttgtttactacatatttgtatgtggcaactataagtggagactgatggctcaaaaaaaagatgtcttcttgttaacttggatggttcaaatgatgcccctgttgagggcatagtctaccaaaatggtgaaaaacacttgtcatgctctgaataaaacaaagtactcttcatttacaaaagagatgcattctaggaaaattcaatgtacattgaaactatggaaaacatatcttgtgtctatacaaaaaacagagttaggttctagacattcatttgtacatacacaagtgtccagcagaaccaggggcaatttttgtttgggaatctttattgcatgctaaaataaccatggctttcctggttcccacatattaaaagatcataacacacccatgataactgggatgacaacaaaagttccggtaagctttcaatatattgctaatgggcagtactttcctagtcaagacctttgttttgtggagcgtttctacagaggagccaaaatctcatactattcagtcttttctttctcccctatagcttagaatcttcccaggtgtccttcaaaatgccttgctaccatgttctcacaaaatgcaggttctaggaattccagatctggcaggctggaaaatgacccctgaaaaacatatctaactccaggccaggtatgtgtctcatgcctgtaatcccaacactttcggaggccaacgtgggaggatctcttgagcccagcagctcaaagccaactggggcaatacagtgagaccttgtccatacaagaaaattaaaaaaaaaaaaaaaagaaaagtctaaccccagaactctttgcagttgtaattaggtaaaggatcctgagattaggagatgatcctgagatatctgggtaagctctaaatccaacgacaagcattcttataagagaaaggtagaaagagatttgagacaaaaagaagaagagaagacagtttctgcctccgtggtcacactgccacctcttcgttgtggaggcagtgggagaccatggaggcagaaactggagttacatggccacaggccaaggatggctggcagccaccagaagctaaaagaggcaaagaatagatttccccttcagagcccaagggaatgtggctctgcagacaccttgattacaaacatctggcctccagaactgtgagacaataaatttctgtccttttaagccaccaagtctgtggtaattggttatagcaaccaaaggaaatgaatacagcagatgagttagacactggccagggtagaagaaaggttaatatcatgctttgtttatgtgtttgttttgccctaagacttctacattctctgaacacggttggagacttggcgggggaaattacagaatagagaaacctctgttctatttcaaacgctctactcagcttccctccactccactgtccttcccaggtaatacctcgctgatgtggtttgggtctgtgtccctacccaaatctcacattcaattgtaatccgcagtgttagaggggcttggtgggaggtgactggatcatggaggtagatatcccccttgctgttcttgtgatggtgagtgagttctcacacgatctggttatttaaaggtgtgtatcacctccccattcatgctctcttcctcctgctctggccatgtaagatgtgcctgcttccccttctgccatgattgtgagtttcctgaggcctccctaaccatgcttcctgtacatgcctgtggaactgtgagccagttaaacctcttttctttataaattacccagtccaagatatttcttcataggcatgcaagaacgaacgaatacattcactcagcctatggatcttagcttgagatttccttccccatggaaacctttcctgtccctctccagctaagtgagattccaccacatgagctggaatagaattgttttcccattctgcagaccactcacctcattttaaaactaaacattgactacaatgagtcctcagcaaatattggtttaccccactagaatgtaagctcctctagataaagggccctgggtatatttcctcaccattgcttttctctgtggcctggcatggtactcacataaatattttatgaatgaatatttagatacagtcatttacagatgttttggtttaaaaaaagatgcttggccaggcgcagtggctcccgcctgtaatcccagcactttgggaggccgaggtgggcagaccacgaggtcaggagatcgagaccatcctgactaacacggtgaaaacccgtctctaccaaaaatacaaaaaattagccgggcatggtggtgggtgcctgtagtcccagctactcgggaggctgaggcaggagaatggtgtgaacctgggaggcggagcttgcagtgagccgagatcccaccactgcactccagcctgggtgacaaagtgagactccacctcaaagaaaaataaataaataaagatgcttgtcagtcagctttccagcagcagcaataaatttctttccaggataaagccatgttttgatgagtacattcttctagatactgtacttacaatacccatttcaatggtctcatcaccccaacctctgactcaatacttagtgtttgaacatgatcagttcatggccaccacagtgggttgaattgtgtctcctgtaaaattcatgtctacctagaaaaaacaaatatgaatttatttggaaataggatatttgtaggtataggcagttaagacaaggtcatatcggacctgaaatccaatggctgaaattgggcctgaaatccaattgggcctgaaatccaatgactggtgtcctaataaggggagggagatttggatacagcagaggaagatggcctcataaaaaccaaggcagaagttggagtgatgcagctacaagctaaggattgccggtaacaccagaagctaggaaggagcaaagaagaattcttccctagagccttctgaaggaactcagccctgccagcaccttgattgaagccatctagcctccaaaaccatgcataaatatatttctgatgtcttaaggcagtaagtcctaagttaacatttcaataggttcttggaaactgcaactttaagtgaaacaacatacagcaagtcctaaaataacataattttttttcaacgtcatttcattttaacattgatgaggaaaataactggtttcattatgcatcgttttgcctaaagttgcagttcccaagaacttatctactgtccttcattacagtggccctagaaaagtaatacagccagtaaaccactggtacgttttatggttttttgcccatgtttcttttataatgagtcacctcactgagatttgccttagtaacaccattcctttcaatcagttccagccattggctaatgagatggcacaatcagaattagaggaatataggggttcaattgtagaaaaagactgcaaaccagtataatctgagcaaggcagcagtactacacagaacagctcaggtgccaggtggttttttgtttgcttttgcagttcctgcctctttctagttacatgctgagctctgtgccttaccttcctcatctgtaaaatggaaataataataatcccttccttgtagagttgtgaagattaaattacatgctgcatacaaaatgcttagcatagtacctaggacaaggtaattaagcaataaatattagctgttactattgctagtagtggcaggggcaagggtcaaaaataatcatttcattcaattaaaaaacaaaggcctaaaccctaagtatgtgatggctgtggtagacacctgaaaaactgaatgcttttattccatgtagtgaagatcttatttttcttgcagattattctggagtttgactctaagagttatctttagatgcaaaaagtcatttcattttaaaacagcagtgcctgaataccacttatgttgcctgaatttgttcacattactattcacgaagcttgacatcctgcaatgacttctgcacaaaactcaaagtcagtaaaactttaggctacttaccatcaagacagggaacaaacccttctctctgcaaggtttttataattaaacatcatgacatctaatgatgtctacacagaaccgcttctcactagcacagaaaagttatctctaatagaaatgttctttctaaatggtaaaggagggagcatataaatatctctgcagtggtggcttctggtatagctggtcagagtggacaggacacataccaattactgttagggtttgcaaagaaaatagttcccattcatttactatttgatagaggagaagggatcaatgagcatgaaatatgccaacttataaattcatatttctaaaacctaaactaggcaaggagtaatgttcacaatgtataaccagtgaggatggttatgcctcactgtactgcccaatcagaaagagtggacactggccttaggcctggagcagtcctggaaggtccctaccactgcagatgtttgccctttacttgctagatagcaggaggtctgaggctctcagggagaggcaggggctccaagtcatacaggaatgggtaggcactccagttgactgaaggacacacagggggtttcaggcaatggctatttgccaagcaatatggaagtattttaatattgtaactgtgtggctctaaaggcaccaactagtgaacattgtcgccggataataccatgaagaattagactggcactgtgaaagtgaggtgaatcctaaggcagtcacaaagcagaggacagctgagagagatataggagggagccattgtggattggtgtatgcatggtgagttctacacagaatcagggagccggagggtttgatccctcaaattctattttagtatttggtattattttctaattatattgctgcagtaacaaaattcctttgttaaataattaaaagactccttttaaggctaaataccacctggctcccaaattttggtctactctccccggaaacaactccttattacaaatttagtagtctcattgcaggtatctttccatgtatacttatgtgcatttggtactgttttgggtgctatgtgtttacatatgtggtgggcggaattgtcaaatgctcccctaaaatgtcctctctcatccctagaactgtcaagatgatgagatatcacaccctgattatgttatgagacaaaaggaattttgcaaattagttaaggttactaataagttgactttgagttaatcaaaagagatcatctaagtggacctaatctaatcatacatgccctttaaaagcagagttttctccaggtggtagcagaagggaattcagagagattcaaagcataagaatttgatgcaccatcactggctttgaagatggaactgaccatgtgccacggaatgcagatgacccctagaagtttagagtagccccctctgagagcaagaaaatggggacttcactcctataacccccaaaaactgaatcctgccaacaatatgaatgagcttggaagcagattcttctcagaacctccagataagaaccaagcctggctggcaccttgatttcagccttatgagaccctaagaagagaacccaggtgagcccactgagacttctgacctccacacctgtgagatcataaacaggtattgttttaaggtaaatttgtggtaaactgctacacagtaacagaaaatgaattccatatatcatcctacaatttgttttaattcaatagtaagtcttaggaatctatgtgaattaattcattcctttgaactgttccatagtattccatagtatgtggtaaaccattttcaaggatggctgccaagaactgcccccatcactgtgcaaaccagctccttctcttgttattttcctgctcttagaatttgggtcaggctcgtgactggttttcatcaacaaaatctagtggaggtgacattcaagaacttctgaactcaagtctttacagaccttgaggcttctgcttttgcccttttgagattgaagaagcatgaataaaagctcaaactaacctactgaatgatgagaccccgcatggcaggggtgcagcccccagccaagcttcagataatctcaggagactctatgtagaggagaggaaccactcagctaagccgggcaacccagacaactgtgagaaaaactaaatcattgttgtctaagtcactgcattttgagatggttagtataactctctatgtgctcaatagagacataatagcacatacatcatgagtagataaattacgactatcccaattcatccattctcctattgataaacagtgttgtgttttccagtcattaaactggaccatacgaaattgccatttctataagtgaaaactggtctaatatcagcaatcttacaaacaaaccactgtgagtacttctccccatgcctctttgtacacacggtggacacatggcctcagggtgagaactaggcagaagaataggcatccacaaggttggcacatttaaaattttaccagatgctactaaattacccacagactgattcctatcagtgtataatacggtgttatatcccttgatctatacatctctagaaactccattataataaaaatggttatccaggcctcaaaatgcagcaaacctaatacgaaccaatctaaacctaaagcagtgttggcaaacctgatataaaatttctgataattaggccaggcacaatggctcacacatgtaatcccagcactttgggaggccaaggcaggtggaacacttgagaccaggagttcgagaccagcctaaccaacatggcaaaaccccatctctagtaaaaatacaagaattagacagatgtggtggtgcgcctgtgtcccagctacttgggaggctgagggaagagcattgcttgaacccaggaggtggaggttgcagtgagccaagattgtggccctggactccagcctggttgacagagtgagactctgtctcaaaaataaataaataaataaataaataaataaataaataaataagcaaataaaataaaatacagtacaattcttgataacccaaacaacatttttatttgacctttaaatattctgtggcaggtaattattttaggaaagatagatatggcttcctatttgtggaacagttaaatttatattaagttgagtttatcttccatgagtaggcctcccctaggtggtggaagtaaaactgaaatagggtatacagtgggagagttttagcagcctagaagttcatacaagttcaaaggtactagtcgctaatgaatgaagacacttcactccgcagataatagtgttatctatccaggtgccaatattgtgataacttggaggctgaacagtacaataatatttagaacatgcttattaaggggtgacttaataaacttttatcttaagcagagactctctatacaatacttatgtgaggtctattgtacttatgtccctaatgtaagttcttttcttcctctgcagtaatacaaatctagctgggcacctgaccacattgcccacgacatttggagcgaggcatagccatgcctagctaagtttgaactgacggaacaaggtgtgatgtgtcacaacttctagattttagcatgtgacacccttgacccttcacaatggcagggaggcaaggaggcatggagcagctgccttggactccgagatgatggctatgcacagagggtggcagtgtcaccccataagccctagtcatctacttctggatgctaaagtgagagacaaataaacctctctttttcaaatctctatagtttggagttttgtcattatggaagctttacaggtatcctgagttggatttcagggtttctagaaattcacacaaccaaccagcatcatctccatctctttacagattcctgaagttatgccatcgcaatttagtttctttggcttgtgatttccagcctctgatgaaatgcaagtatctcaagaaagagtaaaactgtaagctcctaagacattaactccttaatgttttcttgatcgtcagaacctttactcgggattcaataagaaagaaaggaaaatgcaagttccttgagtatttggtggatggctccaacagtaggggaacagcctcttaaaactaaaggaggctaaagacacaaagaatacggcaataatcaacacctgattcacagtgtggccacatgtgtctgatcccacagagactgcaaaatatgaacccaccttgccctagctgactgggagaatgctacgacatagagaggaaagaacatatgctgtggctagcttcatttatctggggacttgtcctcagagcttgtgttgtttgggattcctgatgagtaatacgtgcattttctacatctgggtgagtcctgttacccaggaaggctgctgacactaccttgacccagtgaaaaagctccatgatggcaggcacctgaaaagtcactggcttttggcaatctttctattatatgatctcctcaaaagttgcatatgtttagaaaacacatcaatttgttttcctcaaagcaaatatgcagaaataaaattttaagaaaggcacaaaagtaaatgagagctattccaaagatgaaaccgaaagtgccttctgaaataccagcataaatacctaaagtaagaaaatttccaacgtaatgtgtttttaatcagacacatcaatctaaagtttctgcaacatctgcaaacttgaatgctattgttaatgtgaccaacgccttaaaataattgcattagggtttttggcatcactttataataagtggacagttaattgttgctaaattacagctgaatctctgcagaattggatattacatccatattaggatcgaatgactccatcatgattaatgatactgcagtgagtaccaagagaattaaaattattaggcactaattttaaagtgttgacatttttccacaattttagagttatgtttcaacaaaacttcccaattaaacttactgctcgtggttactgggtaaaattccgagacaaatattccttcaaagatcaactttattagtgagtaaacattaaaattaaaaaaacattttgttgaactatccaccttatgtaactaatagcagatgatgtgttttacactctagttatatttaaataatacagccatgtaattaaagatagttggccataattaaaatattcataacaatttcctttcaaaacattatgtgcaattcagactgcatatttgtagtaagctagaaaaaagaaacacattattagttttagagaagtacatgcttaattatcaagggagtttctgcagattttaaagaaattaccaagagcacaagcataaattggtgtttaattgtttctggaagatgcttaggttataaaatatttcaaaatatttcctaggagacaacttggtaacaattcatcagacacagacttggcagtgtcacagaaaagtaatcatgtacctaaaaatgggcattaaacagacattcatggaaaatgacttatcttttacccactgttttagtattactgaatattagtttctaagtaccgtattgggcaagttactgtggttctttgaactagctattctaagtcccaagagtaattttgcaaatgaatgaaaaatgtaaataatttaagacagtaagaatatatagaaaaaaaagctctgagctcataatactaaaacagtaacaagttcaaattttgtattcatctctgatttacccagtggtctccacggaatttgttttctgcacctgaatttgattattttttttccagggtagtttcccaggtcaaaataatgtaaggaagataaatgagataatactgagaaaacattttaactattcaaaataaagctaatttatttcctcctgtgtttatcactgtgcttcaaaaccctgtcctgatattctcagaaactcaggtataaaatgaagagatatttaagtacatattggggtcactgccactaactagctgttgatctctgctaaatttgccccatgtagcttctaaaaacacaggtgatttctcaaacatctttgtttttgtggcccctaaaatgcctaccaaatgatcagatagatagtactatattctcaaaaaaacccttttcaggcttccagaattctggtagtcttcatcccacactcccctattgaaaaatcacaacttttttccttaaccatccctttttattgttaccccatcctcttttcttatttaattcactagaataggggttggccaagtatggcctgcaagccaaatatatactgctgtctgcttttgcacataaagttaagctgaaatgcagctcttcttttacctattgtctatggctacttttgcgctacaaagtcagaatgtctgtgacaatgatctacggcccactagcttagaccactcacactggctttttacaggagtctgtggacgctggtattgaatatgcgttctcagtgtttctgtgctgaggatctcctcctacctctctaaagtgcagttgaaaatgtctaagacaaaagttaacagggtagatgaggaattactctttgtgaaccatggggatacgtcaataacttccttcaaataatctacaagcatttcaagtacaccgaatctcccaaaagggagtccgtagaaaaggtaagctatggtcaaccacttgatctgacagctggagtggatcccactttaattaatcatgttagctactgattattaatcacctgataattatattttatccatcctattactctaagttcttttgctactctgcatcaaatattttatgtacattattttacttggtccaagcaataatcatatgtagttgggccattttacagataatgaaacagaaatttagaaggactttgttcaaggatggacaactagcaaaaagcagaactgggactgagccccggactccagagtccagacgtggtagggtaatgtcacctaggtcttttccattgcctctcaccacactatgggcactcaaatcaaaaaagtaaaaattgggttgtagcaacagcgtaagaaatcctttttggttataacaaacttggaagaagtatctcatttaaactccatataaattacattctcaaatgtaatttatcttttgatcaaattaggagtaatacttttcatttaagcagtttaaatgcactctcttctgtggcttggaaaaaaaaaacttttgtctcaaaatatttccttacaatggttttcccagtacagatgtgagattatagttacctttttaaaatattttgttgacgtttgtattcttaaaatatttttactatatgcagaagctctttagtttaattagatcccatttgtcaattttggcttttgttgccattgcttttggtgttttggacatgaagtccttgcccacacctatgtcctgaatggtaatgcctaggttttcttctagggtttttatggttttaggtctaacgtttaaacctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagtgcgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggaatgttataaagaaacagtgatttacaaacataaaatcattattttcaattcaattcaaaaaatacaaaaaacaaattctgaggcaggtagaaaggcaggctcttgatatcaaagtaagtttctggatgtaattgaaagactgttccaccaagtgttcacattcagatagtggtgtatgttgagctaagtgggaaaggctgttaagaagtaaacatgtctgacagggtgcgcaattgcagaatgtgatgaacctgactccgtcatgtagcatgcaaatcagtcactaacatcctcgacaatacataagccaggctcagcagagcactcccagattgtgaaaatttgggagaaaaaaggagtctctggggaaaaaaaataaaagactggaaaagtgattttcaaaactgtgtaaaaactaagcacataatgcaatgattataggagaaagcatgaggtcactaagaatgaattgtaatacactgattttttctttttttctttgttttttttgtttgtttgcttggtttttgaaacggagtctccctctgtcacccaggctggagtgcagtggcacgatctcggctctctgcaacctctgcctcccgggttcaagtgattctcctgcctcagcctcccgagtagccgggactataggcacgtgccaccaagcctggctaatttttttgtatttttagtagagacggggtttcaccatgttagccaggatggtctcgatctcctgacctcgtgatccacctgactcagcctccccaagtgctgggattacaggcatgagccatcacgcctggcctttctttctttcaatacactctttagcccaaggaaatgacataggtcaaagcatcagggaaggaaaaagggaagaaaaaaaccgttttgttaattagcttcctgaaaatattttgtaaactgctatttgtccaagatcattccgctctctcttaaggatctttattccaaagtccaggtgctttgctacatctccctccactactttatttacatctctgttacctccatgatcatgcctttggctctggcattgctaactggatcattcttaactgacaggttagacaagcatgtaaacacacacacacacacacacacacacacacacacacacacacacactgtacataaacacaatggctgcatgggttctgtacactaacaataacaaggctctgaagtggtatgagttcaagactgagctcccagagagctggattcaagtcccgtgaatgcaagaggagactttcgaaatgccaccttccctctttgagcctcaacctccccatctgaaaaatgatgagtttgaatccaaggatattcctttcagctgtaatattttatcacctagcatatcttctacttcactctatttctagagtgctaaaaactcatttcttttcatttttcccagtgagaaagatggatagctttcccttagcaatctcattacatatttttacatatttgttggttattatgttttccttccatcacttttctacatgaatgaatggtataagttatcttcatcttcaaaagttctactattctatgtttgactatttttctttacagttactttttgaatactatttcctaaaagctgtgtagggcagtggttaagaatgaaggctctgaacatagactgcctgggattgaagccacttgctcaaggtaaaatttcagacaggttatcaatatggttaaatattcttatttttgaaatgaatattataattgtgccaaactctccaacccctgagaattaaaagagagaaagcattttgagtgcacactggatgctgggcccataactggcattatttatatggaagctgttggctgggcttgattgcttatacctgtaaccttagcactttgggaggccacagtgagagaaccacttgaggccaggagatccaaaccagcctggtgaagacagcaagaccctgtctctacaaagttaaaaaattgactgggcgtggtactccagctacttgggaggctgaggtagggggatctcgcttgagcccaggagttcgaggctgcggtgaactatgattacactgctgcactccagccttggcatcagagagaggtgctgtctcagtcagtcaatcaatcaatgaaagctgttattattttgggtggtgatgctggttttggctcttcctcatccccacaaagtccgagagaactagtgctttaaatgtaatttaaccaaatgagcactaaaaaggcaaatgagaaataactctatcttcttaggtaatcatggtaccttcttttcaacaataaactgaggtgacttttttttttatcatgtcctacactcttatcttcaactcactgtgcccttaaagagtctttccatatttctggcccagagctgcccctcccaagtggggagaaggttcttaccttcttgacctgaaacaaaatcattacagaatggggaaaactatagatctaaaaaaaaaaagtataaggagtgatttcttaccaaataacagagaaatcagccagctccagcagcaccccaagttggacacagagcacagcgtcaaagagatgtggctacaaatcaaccagaactgctacctgctgaacacctaatttttgccaaatgtttaattgtacatcctggactatgtcctccatcagtgaacagaaaaccggagatgttattggtgagaccagaatttcactgtttgataaaggaactcagtttctacatttggagttggttacctcatcctgagcaaccaaattccttaatgaagccagtctgaagtgtggacttcagaatcttgactgtgcaaactgtacatggaaatgacattggcatcagtagtctgcaaaaggcagcagtgtgaattgccatgtttttcatttatatctcatgttttctttttcttccttaattcccttcagggcatgagcccatgatccattacattactgttccaacttcccctttgccatggccttttatatgttttacctacttatgcaataacaaaggtatccttattcatccacacatataattcctaaacactcaaagatcatttcactcactctggtgctccttcagctgtttcctttaggacttttaagtgaatttcactggacctcaatgatttcgacacattcaattattgaagtgtgccttaacctgcttcttccagatgtgaactcactcacttgttcattaactgttactgtattaccatccttttgctattaaccttccttgtgaaggctgaagcaaaggagctattaaggattttacagccttcctgccatgcgcctgctcacactctctcccgctaataagtagcaggcctcctcctttggggtaattctcttctgtcttgacaacatatgcaactactctgtttcacctcattttctaggaaatgcatccttttgtatcttttacttcatgcctttagtccttcatatttttattgtatctttagacaaacttcttatcaattacacctaaaatatacttatttcctcattaaaaattgttcatgaaaaaatgtatcctcataggagttattctttgtttttaacattcaaccactgaacacagatgcttagaattatttcatccttgatttgctaagggacattacttttttgtttacttgatggtttagaaagacaataaatacatggacataactactgtctttctcctctggttttagtttgggaaattctaattgttctcatctataagagaataaaatactaatttgcactcaaatctatccaattgactttctcactctacatgggagaatttcctctctctactcttttgaactctttatttccttccctctattcccttgcctctcaaaactggccttcgtctgtttttgccattttacttgcattggtaggttctccattcaaacaacccagccagacacagcccatccactgggcattccaccacactaaacagtgggatgacagaatctaagaggaccagctggtttcaatgattgaattcagtgagtgccgagtggtgttcaacatatgccctgataggcaaggagcaaatgggcagagggtctgaaggaagcatttaaatagcatctcttaaaaaaatgttgctgttgctcagtttaaactatctgcttatatattctgggattaagagtttttagtgattttttctccctcttcctaacatgtttatattgcgctttcacaggcatagaaataaaacataaagcctactcactgaagccaaaatattaccatatgtgctcttctcaccgacccatcctccttctacctaaacccgtccctcctttggaagctctcttctccttttattaaaaaaggaaaacttctgggaggtcgaggtgggtggatcatgaggtcaggagatggagaccatcctggctaaaatggtgaaaccccatctctactaaaaatacaaaaaattagccaggagtggtggcaggcgcctgtagtcccagctactcgggaggctgaggaaggacaatggtgtgaatgcaggaggtggagcttgcagtgagccgagatgccaccattgcactccagcctgggcaacagagccagactccgtctcaaaaaaaaaaaaaaaaaaaggaaaactacaggaagctgattgtattagagaagaagagcattaagtgtgggctatgccaggggatacgttttagtgggaatggagaaaggatcatcctactacaccctttagtaggcaacaggaccagaagcacctgctcagtgggcaattatttggggtgtatttataaggcatcagcccaaatgctagttcttccactctccagaggagagataaatgcttctcattcatgcagatcccgagtaaaggtcaccctgtttctgaaaacatgtgaagagtgatatttgagttaagtcatttctaagtaatgactttcttcttcttcttgaatgctattgggaagtggtgaggcagaacttgtgtgactgtaaaaacagcagtttttaaaaatatggttagactagactattggaagagggaacagagttgtggaaacagctgctttggaagtttgaaaaattttattgactcataaaatgttatagcgagaagtttattttagaaatgaggaaaccaagaccctaaagcattagagaaattattcaaggtcattaagctccttatttatcaggcagaatcagaatcaaaagtgaatggctggcaaaaaccaatcttgtgggttttccaatgtatgacaacgtctcccttcttttctaacgtgaatcttttccataacttatccttacatgggagcaatttttagcctgctccactgatgcctgcctctaaaatagtgtagagttgtaaaaaaaagtcatttttacatcatcaaaacttctgaaacactgagtcagaagggatcatctaaacgctcttctgcctgcaggtgaagctggagcaaactcttcacactagaccctgcaaagtccctcagggtagaagggaccacggccagcgcccactacctccttgtcatcatctaatcttcataacctaaaaagccaccaatgggctccaacagggtctgtgggtcatgactgtggctgcatgtcgagtcatggtctctgcactcacaaattttgttttgcataaaagctgtattactgtaaagttgtaagacttagtaaaattcacattttggacattttaattcgagctcaaaagcagcagagatccctatttaaaggagacttgcaataaaactacacaaaatgtaaatacatgtgttaatttaacgttagtaaatccatatgttcttttgctgaattatcatatttagaactttgtaaaatagcagtccatctgcatggagtgaagaaaatgcccttgaataacctgatcagccatgctagccagcccatgacaagcacctccaggcagacacttactgagagccactatgaggcgggtgctgtgccatgttccctagatacagatataaatatatagtgccttggacttgggaagctcaaatctggtaggggaaaatagacttttaaaaaataagttagggcgtcatctaaatggttttgttgggaatcatttcaccatcgtcttatttctgcccatcatgaaggcatattcctctaaggtaggaaataacctttaaacattatctagtccatctcactgaccctaggcaataataagatttaaccactcttgtcatttgaaaaactgagcctcttccaatagtctctaatatttaaccatctttactgttaagatatagttgtattacttacagcctaaatccctcatgctatttttcaagttcccttcccttctcttattgactctttggagatgatgataagcatttaataactctgctaatttaacttgaagatcatcttagtttgctgttttctgtgatccagagttctgatttataattaactaggcagtgtgcataattctcttctgtgtctgccctaatcagagaagcctgaatattgtgcacagcaggcattcagaaatacctgtcaagacaacaggcattccagataaggacggataagcactgaataagagagaaatgctagaggacagtatccccgatgcacataccagcatcccaggatagcacctctctttttaataacagtcttccacggagtcccttgagagactaagaaccatgctcctacatctccttaactctttcccttcatcaaacgcagtcactcgcacactacaagtcttcaatcaagttgaatgaataaatgaatgaatgaaaacagaatttcaactttcactattataatgaaccctgttagcctttccttacataaaaattcatttaacattcaagggacattatgtccttgccaatacttttaaaaaccttaactacagtcaccatgctatataatggctctccagaacgtattcatccttcatgagtgaaacttcgtaccctttgacaaacagctctccctttctctcactctccaatccctggcaaccaccattctactctgtgcttctatgagttcaactatttaagacataaaagtaaggttatacagtatatgtctttctgtgtctggattatttcacttagcatagagtcctctagcctcatccatgttgtcacaagtgggaggatttccttcttttttaatgataatattccattgtgtctgtgtgtatacacatattttctctacccattcttacactgttggaaatttaggttgtttccatatcacagttattgtgaataaagggcctataatatttatatgctctatactctttctccttcttccacatcttgttaaggactaaccattccctctcgggctaatttgtaaaagaagcaattccaccaagcccttcttaaaattatataaaaacttcccagcctgtacgatgaggcctcaaattatacaacaatataagcttcctgagcatcttgggataaacgtgctttatagaattaagataccacttacttgattgtaatatatcttagggctacatagtcaaacctttgaactcacatcaggtgatgcgtgctgcagaatatagaaacaagattctacaaagcagtctggaaataacatgtactactgaaaaacaaaaatactgtaaattagtataataaatcaaggaatcagcaactctctaccactaactaaatcagtaatgctttcttcaagagagttatgagaattatatttcccatgtggcttgcaaatgtaaagagatctattaagactgtctgatagttactgccgaaggatatataggaagtagaatactaggaagtattatattcatgacattgctctattttatttataatttttataagagcttaaaaatctaggtttcatttaagcattacttgtgtgatacaaaaaatatagtaatttagagtttgatattttttgaaaggctttttcaaataaaccattcttttgaattcaaatgattaagaggattaaaagtatcaagaatttatttcattaggcatttcccaatgggatcaagtttttctgaaaaaaaaaaaacttacgtaaaaccaagtattaaaacatttccactcaaatacattagggaaagtcccaaaatgaagcacagaaaaaataatggcaacataaattcaattattgtaccaagtaatcgcagaaacatgcagaaacatgggcattcaagtaaataaattattctgattttgctcctagctgacacaaattactcatttccttggacttgatacaagaaggcttcagagaaaaagaagaaatgcaatcaaagagcaaagcacattactcatcatctgccagccttgcagcaacagaggtttcctacagtccctccctgccacagccttgcaggatatgtctataagccagtctaatacatgcttaaatgttctcatttacagactcgatttccttttgcgggttcctgcaaaagttctcaatggtggtattgcaacttgcatccaatagcaaagtgcctgtagttatttgttactaataaagtcctgaagttttcaaatgacttgctttaaagaactgatcctggattatttctaaaatcagcaagggcaataaagtatttacaactagtagggcctggcatcaactaatcagaaaggacactggcctgagaagatgctgctgtctcaggtactagatggtggcgaggttcacggtatcacagaaggaatttgttagtgcaggggacactggggaggagggagagtcaggacattctaagctttcatcaaccaggagggaagtatttcggcattttaaaaacctagtgcatctgtctgttagggcgagaaaaagcagaatatcattccagataaattattttagcttcactcacatgcatcctggtgtgctttcttgagtggaagaaagtagatgaagtaacatgctggaaatcacacataacctatggctttcctcatttgtgaacccaaggaagcgtgccacatatagaaatacaaagtcagagttacaactttgcccccgtattctcacacgctgtgttagttaaggctgccataacaaaataccacagactggggggcttcaacaacacaagtttattttttcacagttctagaggctggatgcccaagagcaaggtgccgtcgttgctgggatctggggaagcctctcttcccggcttacagatggtaaatttctccctgggtcctcacatggcctctcatctgcatggccacagagaaatagtgttctggtgtctctacctcttgttacaaaggcaccatcagtcttatccgattaaggtcccatctataggtcctcctttaaccttaattacctccctaaagggtgcatctccaaatacagtcacatcaggggttaggggtcgaaaattcgaattttggaggtacacaattccatccataacacacaccacgtaagaggaaagagagaagccttctcccacacattttctgctttgaccaatttaagtgaaggtgaatttgtgattattactgtagacaaagaaccctctaaaagcagattgttgctgtagacctgccatatacccatctcaaaaaggacctcaccaaaccccaggccaccttggctaaaaccacacctaattactataactgtgcatctcaatgatcagccaacaagcactactgactaccaactatattcccagaaccaatggagagatacaagaagattcacatcatttggggtgaatgagagtatgcctgtgaattaccagtgaacaagatcaactcatttacatgtaatcagtggggatcagagccttcctgatggtcatgtagaatgtgcacaggtagaacctcactctacaaacacacccatgaccatcacctctctcatagccctctgccatgattctcatggcaacaagaacattctctgtcatagcggcataaccctaagcagactgggcccgggtaccttttggtgtaggcaacatccagatagctgtttctttctcactgtaatcatttccaatttcattcaagagcctcattcacactgggctgtgatgaacatttggctaacagattgcttaagtgaaaaacacaagagagtgaccacagagtaaaagataaattagtggaaaaaaatcacttgaaactttcactctaggaagaaagggacatagcacaggatgagtaatagaatctcccccagcccacagccactgccaatagatactaagattccaggtaaattaaaagaatacatgagaggtcactgaaacagaaatccagctgggagacagaaatgcaaaattctctgtagaagaaaatgggtagaccaagggcagtgcaacatatagaaaaaacatgaaactttacaattggaaaaatacacatcagaagttcttactggtcttatgaccttagccctctgagtcacagtttattcatctttaaaataggtatgctaggtatggcgtggtggctcacacctgtaatcccagcactttgggaggctgaggcaggtggatcacgaggtcaggagatcgagaccatcctggctaacacggtgaaaccccgtctctactaaaaatacgaaaaattagccgggtacggcagcatgtgcctgtagtcctggctactcgggaggctgaggcggaagaatagcgtgaacccgggaggcggagcttgcagtgagccaagatcgcaccactgcactccagcctgggcaacagagtaagactccgtcttaaaaaaaaaaaaagtatgctgttcactggttaactacaaggactacatgacaatacagaggcctgcaatcacacacaccctccaatgtctctggaacataacaaaaaccactataaatatctgttaacagtataattaggagctacacttccaatgttaacttgcagctgaaaccatcaactatcattcacaagaatggcaatgccatctgcagtaagactcagaagtattggaaacccttccaagcctttatgtagacagatgaggagcagccatttggtttaatatacaattattgtcagaactaccctataatttgcctcctacaaatatccaaatgccactaaatggggcacaaggtcaccgtggtggagcagactgtctcatagctgactgttttatttctattagagatgacccagggccagatgtgtgcatggaatcttctgctggccttacacttttagcaaatggatacgatgaaacgtgtccccagataacaggccatagggcagccagggcagttctccttgctgaattctgcttccagctgctccatgggatgaaactttgtgttctagggaagttttctgtcaacttgtcaaaacagtcgctccggccactcacacttacatttatgttatagggcccaagtgtttggacagtgaccctaccttgggtggtgctcagaatcctctcttcccctaaggatagtttacacaattggagtttttttttttttttcttgaatatgtttcaagctggtgttaattctacaaaacagatgggcagctaaatcttttgaagttgctaaatatattttgagagcatataatttttatacaactaacgttcagtttatatttctatcagctaaactgttattaatatttgcaaaagccaaatgtcaaaagcatttaaaaatgtcaaaccatgtgaacacgattagggaagggtttcttgtaagaattggaaaatttcacctaacggtattgtctctcttatacccaggcacaaaatgccaagctccaggtcctgagcttcagggggcttcactccgagcctcctctagccatccccttccaccaggtgtgggtttccctgcatcatggggttatgcccatgcagagtctgtgcctcccctctgcctcatgatgttcagggtatgctgaaccaggaatttgtttccaaatgggcccaagcctgcttccaggacctgctgggtatgtgtgcgcacccaagatccaaaaagtagccaaatgctggcagcaggcatgggatgtggacagagtatagacatgacagctagggtgtacacacatgtgcaccccaggcccttagtggtaatgggaacatggagctgggggtgagagaagaaagggagccaaccaaaccactgggctgcaagctgggtgttaggaattggctgcccctgtaccaaatgggccaaaatggaactccaaggactatgagaatgccatgcttgattcggccttccaggtcatgatgaagatacattcatcaaggagaacacattttacatggcattttattttgctgacttggtttataacttgtatatatttagacccgtagaatgtgggctgccatttatatactcttgttctaggccttgtaaatattaggagtaggactgcatcagagttaggtttagaaaattatagacttgcaaataagagtaattgtattaagttctgttaatttcttcagcaaaactaagattgcaactaataatctataagaaagcagcatgtcttggaggtattctcttcttttattttcataaaacattacaaacatctgcaaaagtaaaggttccagtataagaaatgctcacatgcttgattataaccaactcaaagccaattgagtttcaacattaactcctgatcctccctccaaattatttaaattacatcacacaagcatatcttttcagccatatttatgtcagtatggataggtatgtcttttaaatatgtcttttaaaaaacatagccatatgttatcacacctaaaaacatgaactatatcaaatattcagggagtagacaaatattccaaccatatcttcagattgtctcatttgttttcttttttgcagtattttcaaatcaggatccaaatagggttcacccaatgtctcacgacactattcttgatctataggttttctccccacctcttttttccttccttgtactttatttgttgaaaaaaacaggtcatttgttccgtagaatttcccatagtttggattttgcagaacctagtcttatagtgtttcctataagttgttcattgtatctacaggcttgatgagattcaaggttcatttttttggcaaagttgcttcatagatagttttgggtatttccatcaagagacacaagatgtataaatgtctctctctggtatgttagcactatttctgatgcactatttcattaaaaattgcaaaatagcttctaattatattcttctttctccatttattagctaaaatttcttacaaagggaaacttctctccactgaggatgatttagttacaggtcttaaagacagaatgcttctttctcattgcttatcaattttgaaaataaaaagttggtttcctagaatcccctaaaggttttcctggggttgttttgtattattataagtgaaaggatttaaacaaaagctgacatgctttaatacactgcagttagtattcttattgatgtatgaattgagctgtttttgattggtggaagacttttcaaattggatcctggacattttaacaacagcctcagactgctatgacaaaaacaatactacctctaaaaatatgaccactaaaagcaacgatattttgtggatttctttttgtcatgaatatggatcccactacaagtgtacaagcatctgttttcaagtcacttcaaatgattgttcactctgtagatttgccatcaatcacaattgcagttagatttactggttttgctttcaatctgggggaattttaaaattagatgttatgttacaattttattaaacatgtaagtatttataaagtcaaatcctcaaaacaaggtttattaagagaaatttagcttctattcttttcccatcccatcttctctctttctatttaaagttaacaacttcttaagacttacatcattcttccaaatacatctctttctgtatgtttgtttacatgtgtgtggacatacacacatgtacaaattccatttatctggaggtaaattgaagtatatatgtgtgtgtgtatatatatatatatatatatatatatatatatatatatatagtgttcacacacacacacacacacacgcccttctcaacctggtatggagattggtgatttgctttttccggtgattgattattttgttttacatgaaaacaagattgaaatattgaaaatgaggaactctagataaatattttttgtaaagtagtgctatggaaatgatgttgaactctctaagtcaccatatttaaatctaccattcacttcaaatttaactgaagatcaatttctccaattgttaagggttcattaatcaagtaattctggaaaagggcatattgatatttgaacttaattattacgaagttttataagttttagaatgaacttgaaaatgtatgtctaacttttttgtaacttacgcaaaataagaaaaatttgtggccgggcgcggtggctcacgcctgtaatcccagcactttgggaggccgaggcgggcggatcacgaggtcaggagatcgagaccatcctggctaacacggtgaaaccccgtctctactaaaaatacaaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagaaaaatttgtcagtcatgcagaacatacctcaagcaattaataaatacactgatatattctcaaagacactggaagaaaaaactttagtaaaacggtatatatctaaaactatatacttgctccaaacataaatattgcactgatgcaaacactaaatttttgagaagcttaacatatattaatttttgtagtgtacaacaggaagagaacccttaagggacagacagacctgacttaaatcctgattcagccattagtggctgtgtggcctttgcaaattgcttaacctttctgggctttattttctttatttatcaaatatggatgctaatagttcctcactggtctataatcaataagattatttgtttaaagcatgtagaaacacaactggtacaaggccagtgctcaataatattagctcacttgttcttttgtagacaacatacatagaagacagtatgaataatggttaagacctagggtatctgagttcatacaacagctacaatacatccaagcagtatgaagatgggcaagttatttaactcatgggagcctcagtttcctcatctgtaaaggagagaggctaagaatatcttccgtagaggactgttttaagaattaaattacatgtaatattatagttcgtctaaaaggaagggatgcttatttgtttcatttcactgttataacactggtacctaaaatagtgctggcacttggtaattctccttaagtgttaataaaaaataaatgagataactgttcgaatctcacgtatttcatgttactttcaagttgctgcttttcacatctaagagttctttcctcatgctctgagacttagtccttcgcctctccggattttattaaatgatggatgttctcactgtcagtgtaatctccaaggtcctggcctttcctgaactggggtttgggtgcactgagacggtaactacagccttactaccccactactcaattctttactcaagagaggctgcttagaaagtctgggtctgcagaatctcatagtgattccaatctattagatctgtaggatatttccggataacatatcatgtgctttggtgattgtttctgaaaaggcaatagacttgtaagtgttctatgtgtcatgcatattggaagtacactaaatatattactacttcactggggactctcttgacaataatgtgaattgctgagggaacagaaatcaatttttaaagtgtttctgacatcaaaggtgaccgctgggcttcaggaaaagagttcaaagtaagattgacttcgtgattgagatattcataagactcacactgcaaaggtaggttgggcattcttccactgcccaagatgcaagcgaatgatgcaggcagattccaagctgagtttgctgagataagggcctccaaggaactgagttccggcaacatgcattgtgagtacccataccatcaggtctgtctttgtattctgttctctgaacctaaaatgccccttcttcagttctctattaaaccctcttcacctgcacatgcttcaatactcatctcaaatgaatccatttctggctggcagagtttttcatctatcatttttttctccctgtcttatagcaaatattggatcctaaccttagttattttcacatgtaactcttttttttaccctacgatccttggcaacaggggatatggcttacttatttctgtgtctccacaccttgcttagcatagagccaaaccaattttttttttaattatcatacttcaggtttagtagtatctgcaaaaaaaaagtattctttatacagtattatctaagtggaaattttattttaaaattcaatagaaataatataaattagattttttttaaatctcaatatgatggaccaggttggccaaataccatccacagtgagggttattaaacggtagattcaaacagcagcatggtccatcagaaataatactttattcatttacttcaccatttattgtgcacctactatgtgccaggctaaaatcataagcagcttacattttacaaagggaagatataatatgcagctgcaaaatgccagcaagaaaaaaatataattttgtgataaaagtctgtaatcaagtgagtaaagtagaatattataaaaggcatcagggagatggtgaatttggagctggattttgttagctaaacacatattgtccaagccaacagcaaagggaaaatttgggccatcttagctacattaaatggctacacagtccatgtcataaatgcaattataagttgatggtggtctatgtatttggaaacactgactcaatcttcagcaaaagtggtttgaaaatgaaatgggaaaatacactaagcaagcagagaccataaaagaggcactaatgacataaacattcaaccttccttacaaactttgaaacagaaaaatggtggttgcccagttttttgttgttgtttgtttgtttttgagacggagtttccctctgttgcccaggctggagtgcaatggtgcaatctcagctcactgcaacctctgcctcctgggttcaagtgattcttctcctgcctcggcctcctgagtagctggaattacaggtgactgccactatgccagctaatttttgtagtttttagtagagatggggtttcaccatgttggtcaggctagtctcaaactcctgacctcaggtaatccacttgtttcagcctcccaaagtgctgggattacagacgtgagccaccatgcctggcccagttttccttttaatttgctataattgtatctatcccactggctcaagagtctcttaggtgcaatctcagcagggtgataataattaagttcaagaaattctgtaggtggcagagcatgtcaatctatgagaaaggatgaattctgcatgaaatacaattgcttagatcagtagggtaaatatagtttaaaacaatctattgtatatttcaaaatagctagaagagaataatttgaatgtttctagcaaaagataaatatttaaggtggtagaaatcccaataccagtaatttcctattttcaaattatacgaatgtattaaaatatcacttgcactccaaaattatgtacatctattatctatcaataaatttaaaaaacctccactttctattacagattataaactacaaaacaaataaatgatggaacagaaagagtgtgtgaccagaagtcagaagccctgggttctgggttggggtccacatagccatgtgatcataagcaagttacctcattttttaagcttcaatataatatttattattattaatatatatgattcgatatcatataataggctctccctatcatatgtaaggttataatgagaaatgaatgaaataacatagggaatgattttggaaatgataaaacataaaagtaaaaagtactgtcatttctgtaaccatggggatatcaatattaattaaaatgcttattataaaacacaactgctaaagcggttacagaaaataaacaaggaaaaagaaacgtatatttctgtcttgagaaaatgcatgctgtcagttgttactcctgcaaatgacaggtgaaaacctttggtcaggagaaatgtgcaaagaattctgaaacacagtttaatgaaaactacaacacatttcttttgtcagaaccccatagcttcagcatagctaattctctgcttcattcttaagaaacattcttaaaagcttgaggctgtttgttagcaacagatgtagacatttataaacaaggaccatcttaacagaattatttctcacgaattaaataaaggatcccaaagaatggttccaactgtttacagttagcacttagacttatactatgtgggaacagtgttcattaaatgcactgcctatggaccataaaggtaatcagaacaacaatctatactactgggactgctgcctctgcctctgccccatatgcaaaccttagagagattggtataaatgttatctgagagccataaaacactctcagaaagtaaactttagcttatgggaagtaaaccttcagttcaccaaattccatttagtgccctgcagaaagaattctgcaaagagtattctgaaagaggcaactcatcttttataggtgagcactccatcacagaagcccagagatgagaaatcaggtcttcatcctcccaggccatcacagtttataactctaagaatgatgactattatcaaaactttaaagatccccagaaatggccattctacaacctcccttggaagcaaatttctgtcataaacacactatctgtaaaattcttctatatgcttaacctaagtctagcagaattctggctgcatctttctactttagtgaagatattcattcattcattcttcaatcaacaaatttttttttaatgcttatgatggcaaaggttattggtgattgtataagagaggaacaggggaacaaacaatgtcccctggataggcagcgacctttaactctttatttagatcactattaggagcaatgtatgaaaataactgccaatttgtagaaaataccgatgccagaaaaacatggtgcccagtcccaagtacggtaatcaacaaaacttagactgtaggaaactctacaggtccaatattataggtctttaacgcataaaatatgaaggaaaaggaagggatggacagtaacctgtaggttcaaagaaacttaaaagacatatccagttgtttttttaacagatgcacaagactaaactgaagggtctgggaatgcacattaaatgatgacactattaaaaacacaggagggttattgccataaggtcacactaatagcttattggaaaaagataaaggttgaggctgagaagaggtacccagatgggattctgggtggccggcagagtctcctttcttgacctagcgttggttacaaagccattcaccttagaattattccttaagccagacatttatttattttgtgtggcttcctttgtctatgttttgtttttgaagaagcatgtatggatatgaagcaactagagctcctatacattgctacattgctagtagaaatgcaaaaaggcacagataatttggaaaacagtttggcagttccttatggaattaaacaaatgcttactatatggctctgtggtcccaccctagttatcttcccaaaaggtaaacactctaagacctggacatgaatgttgatagcagctttaatcacattcactcaaaacgggagggaatccaaatgtctatcaacaggtgaatgaataaacaaatagtagtatatctacataacagaatactattcacgaataagaaaatgaactactgatttttgcaaaaacatggacacatcaaaaaagaatcacacaaagtcaaagaagccagaccaaaaagttccatactttatgacttcgtcatttataagcctttctggaaaaggcaaaactataaggagagaaataagactagtagttaccaggggcttgggagggaaatgagaacaaagagggagggagagaactggtccaggacatgaaaatattctgtattttaattgtggtggtagttacatgagggtcaatgattgtccaaacttatctaaactataaacgtaagaaaagtggattttctataaaccacaccaaaaaataaaacatttattattgaaagtagaaatcaattcagttttcagttttaaaacattattctgtatctcacacattttcttaaaggaaaaaatgtgttggagtaggaacagtaatgtatcagaagttataatatgttattaaaacatatttagaggagagactaaatcattggtatttttattgatggctctttcttcagagaaattgttaaaaagtgaaaacaattctggttgtcataaagttatctctgtttagactttttaccaaaccagttcaaataaatcctaaagtggacaacatcagagccaagagcaatcttggttatatgttcacagcagagtatcttaacttccttttgccagccaagttccccagtatttaattttggctgttcccaacagaaatttttcatctaggctcggcagttttctaatctcaacttctccagagtcaagtaaccaaaatagacatggccaaaacccagtcccacagagcctccctgtgattacagcatggacaataagacagtctcctccaagacctcaacataaaactcattgttagaatcttcaagaaggcctggttacaaatgtgaaattattacttcacccaataagtaagtacatttcatttctaatgcagggccttttaaaaagcataaaaagcattataaaactataatgcaattgaatttactcatgttacagatgagcaaattgagacccaaaagggtcaaattacttaaccagagttattaagctacttagaggtacactgacaccaggtcctggacaacccattaaataagatagtgctctttgcaatgaaattggaactatactctgtgttaatactgttttctctacagggatgaataataggcaacatgactttcacgttgtctactcaaaaacatatacctctttaaaaaaatttaagaagaaacatgtgaccatttcatcatttattaggcagaaagagaaatacaaaacaataaagtaatgttcagctttcagtaagttagtatttgcccaaggagccgaaaacagcctttctttccagtttgctacataattggttttggctttcctttgcattgcttaagggagagcttacatgctagatcactaagatacaaacttctgacaccaaaatatgatccatattatgttatccaggcattttaaaagaggtcatttaaaatcttttcttccatctgttgtaatttgaagaaaatttatccttgaaccaatgttgctttaccatcttcaacttctggtagattcacacagagcagcagatgagaggccccaatttttatgaaaagtctcaggcagaaatattgctgatgatgtggaaatagcaattccaaatcaacagaaaattgccctctgtattcatcaggaggagcaaggcactcaggagagccagcctctgagacaggtcaaagttgacgaacagtcagacatgggaacaagtgcagaagaggagaagagctctgtgctgatgcttgtccaaaggtcaattgacagcttttctcatcttgttacattttcctccttctaaagatgcagagaaaatgttcttttaatgtaccagatacagaagcagaagggagtacatgggtagaacatttaagggcatattatcctcttcaacacacacttctatgccaggtgcctacagtttccaaatgggcagcagaaaatgaaccctaggattccataaagtctctgagaaccgataatgtgaacagcaatgaatgaacgagttaagcggtaaaaccatctccatttacgactccttgaagttcagcatgcagcagactgcacttaagcacagcaatcaactgtgataggagaatccccattacagtaagtaaagaaatagcttcaaggctgtggatgacggtgccaggggagaaggtcagaacaggtgcaaagaaatcctgaaggtagggagtgaaagcttgagttccatgtgggtgatttttaactatcctggtcaaatatgggtggcaaaccttaattattcccccttatttagaggtacaatgactggtgtaaacacacaaggaacatttcaaggctgaagaggcctgaaatcaagtatctttattcctgatatttgggttgtaaaatggtttgctaagaatgtttacaaattatgtccgccaggtgctaaatctcccagatcaattttaatttaaatcttcaaacacgctgcagcacagagctgtgacacaataaaatgtgtagtattactgttgtcactatgcaatcattaatttcatctgactattcatgcctcagcataataaaccattaacaagtatgaagtctggctgttctgaatctggacagaagtcctctttatttacagctaagctataaatacggtgttttgttcatatatgtacgtaagacttctctatctaaattctactttttcttgagggcataaacggtgttactaggcacacaataaaagtgtttgtttcctgttgaaaatagcagctttcattactaatctacaaactgggcctggcatggtggttcaccagcacgttgggagactgaggtgtgaagatcacctgagcccaggagtttgagaccagcctgggcaacatggtaaaactccgtctaccacaattacaaaaattagccaggcgtggtgacacgcacctatagtcccagctacttgggaggctgaggtgtgaggatggtttgagcccaggaggtgtaggctgcagcgaggtgaggctgcaccactacactccagcctggggaacctgagccagaccctgtctcaataataataatcatcatcatcatctacaagttgattagattatttccaaagggaccaacagagatacctttgcaaatcctgcatgatatgcacaattatatatatgaaattggtactctgtagagttgcttatctcctcactttatcacctaagtgatcccattactctacctttttttttttttttgtaaatcactgttatttcaactcaacgtaccccaccctaacttggagacaatattcctcaaagtgctcctctaggtgaatctaactgatacacaaacacttcattacctcaacatggataataaatccaggggtccaaacagtgattgtctttacatacaagggaagacagttccatagtctcatctacagcattcaccttggctgtctggacaatcacaattcaaacaagcggttagaggagtggggagagtgggaagaatttggaattttagatagttacaaagctaacccctcataaaatatgcccagccacacagacaatgggttaaacaatcactttcacatctggaaagcacctttgatgtatattgccaaataataagataaagtggcagccctaagatatcaccacctgcctctaactactaccttattgaagtgctctctcaactgtgaaggcttaatttgcaagtacctttctttatccatatttacattaaagaatgtaaatggtctgaaccaagtttgttatgcctgtctgaatcaccctcattgcaggcaatttctgatgtatgagcttatggctgattaggtaacctctggtggcatatccaatttttttttattgcctaaatttggaccatttctgatcattatagcctaatcagaggtcaagagggaagaacagattgtggctgaaggtttggtggtgatataaaaaaaaaactactcattcaagcatttgtatagatttttatcacctcagcgatcccattactcattaatagagacaatcacaaatgttcaggcttgcctggtgccttcaagccatcaggctcatcacacagctgaaactgcataaaattaagccatggaccacctctcctgaatcactcatcctgacacctgaactctacttcccacgtgtacctaactgtcccagcatctaacttcattctccgcttctccctccattgactcaccttgttactgaagctgagactgggaatcccataactactgtttagagactcccatgcctacaaggccatcaaacataccaataaaacacatcacccagcctgggccaggcgtcagcatcttatgcctctgtttcccacattcatagtattagaaaagcacatgtatatatctggagattcccatgaatctgaagtagaatggttgccctgagaactttaagcaccagagtaccggagtagttcctatttcacttgtgatctcttagacatgacccagcattcttattccatatattaggaaattgaaaaactgctcaactttccagatataagtgacatagtgaaagcagcagcccttgcaagaattaatcctaatttgcaccattttgggccacgtctactgtatccttcagtgtcttctataaagtgttctatgtgatacattctattatgaatttattaacagagataatattcctctctttaaggagtagtagcctttggccatgagataataattacatattacttgtttctttttttcttttgatcttgtctgccaggaatcttagagctaaattacatgctcatactcagaaaacttgttgggctatgtgaaggtgataacttgccacattctcctttcatgacctttattttgtttttattttatcagccctattgtaaatctaccttttattgtaagccataccacattctttgagaaagtggttattagcttagtttttaaaagtaacctcagcccatgaacaatgttcaaaagtaatttcacatcccagatatcatcatgcacaaaatgaactcattggcccaagagaaaaaaagaaaaaaattatgaatataaaggtttctaattcaacagaataatttatattatggaaattatttagatgaccatattggatgctaaccccgtccaagggtgatgcaataaaggcttattctataatattgagaatttttcaaagacttaataagattatttaaacataactagaaatatcttaaaaaccaaagtttaaactgtgaaaggccatcagaaatggttcagtaggtctactcaaattattgtgtaattatctgttacatatgcttttcccctccatgtcttttactgatttgcattagttctctggctgtaactggacttgaacttttcagtttcaatgacactttacatgagaaaactaattataataggataaaagtccttcacaaaagaagtatgtaaaaaccaaccactacttattgtacacataattatcttctctttcagcctaggatgtagtcttggctcttgtgtaacttaaatctgtaggggattggcatctgatttacagcagaagacccagcatcatatgaatataatttactatgccatgtgtctcctgccacctaaatctatagcttgaatatagagacatctcaattagacagtgcaaagagagcaagatctgcctcctcctatcctgtgccattaaaacaaccaatattaccaagcagtgcttgttttaaattcactttggaggggtggatctattattttaagttggttaggagacacaaagggagagttgccatcaaactgaatgaaaaatcgagcataaggtgatataagtaatagcctatgaggggtgggacatgcatttattaaagtattgattggtgtatttctatagcacctgtgtattatcatggacttgaggagttgaactggtgttaaattataatgctgacacacaggagtcatccatccttcttgtcctgttcctccatgaactcctacaccaaagttgaagcacatacacagtattggccataatgaggtaaattatctggaggctcaactgtgtttgttctctccctgcaacacatctaaaaattaagctgtcattataaaaacttcataatgacaaagctatattatttatcaccggtcacagtgttctccaaatcctggtgaaaagttaaagacaagacccacacagttttctcatgacgattttagggcaacttctcaaacatggatactgcctgggataatctcaggagagaaaagtgaaacaaattattttcctgattttataaatggtgaagtatagaaatgaatgcagattgtccttcacaaggttcctatatctggtcccaaggctgtaaatgcacagttttctgggggattcctcccatggaattgaagggattttaacataatagtttgaaccatcacctaccctcatattaactataattggaaactgaaagattccaactgctagaattaaatctaggagctactttttcagaatcttcctttcaaattctttgaaagagagattctagtgatctctctctctctctttttttttttgtttttgtaatggaatcttgctttgttgccgaggctggagtgcagtggcgcaatctcggctcactgcaaactccacctcctgggttcaagtgattctcctgcctcagcctcccgagtagctgggaatacaggcacctgccatcatgcccggctaatttttgtgtttttagtagagatgaggctttgccatgttggccaggctggtcttgaactcctgacctcaaatgatccgcccaccttggccttccaaagtcctggaattacaggcgtgaaccactgcgtctggccacattcaagtgttctagtgatatctttttaaggacagaaactcactgattttttttttttttttttttttactactccttagtgtttcctctaagcaatgaggaagagtttattgaatcattagagtcacatactctctctttgtcttaaaataggattgcgatgaccactgaaatctcatccttttggctggccttttttttttttattattatactttaagttttagggtacatgtgcacaatgtgcaggtttgttacatatgtatacatgtgccatgctggtgtgctgcacccattaactcgtcatttagcattaggtatatctcccaatgttatccctccccgctccccccaccccacaacagtccccggagtgtgatgttccccttcctgtgtccatgtgtgctcattgttcaattcccacctatgagtgagaacatgtggtatttggttttttgtccttgtgatagtttgctgagaatgatggtttccagtttcatccatgtccctacaaaggacatgaactcttcattttttatggctgcatagtattcaatggtgtatatgtgccacattttcttaatccagtttatcgttgttggacatttgggttggttccaagtctttgctattgtgaatagtgcctcaataaacatacgtgtgcatgtgtctttatagcagcatgatttataatcctttgggtatacacctagtaatgggatggctgggtcaaatggtatttctagttctagatccctgaggaattttggctggccttttaaaggacaagcctactggctgcaaagccaccacaactcacttgaagacccttaggaaagccatcaggaaagaaaagacaaccagtttcaataaagctcatgtcaggtacaaatggaaagtttcagaaaattggtctgaatgccataggatgcttcagtcagaacagaaggtctaaatggttggtaaattagctcatcaaacacaacagaagcttactcaatggacattcaatccaaggtgttactggtgcagagagagatgcacctcaggaagcaatctgctcagctaagaacaatacctggagaactgctgctgcaagctacgcatctgaattctgttgcgttcagactctagggtcacctcctgcaaccgcttctcgctttgaagacgtaagtgtctctcctcttccagttcatgtatcagcttctcatgctataaaagacacaaaggggatgacttttaggaaggtgtttatgacaaaaataagaaatagctggttatcaagtgataacttgagctttatatatatgaatttcatcctttgaacaaccccacgaagtaggtcctattcttaatctcttgttatagacaacgaaaccaaggatcagagacacctaagtaatttgtgcaaggtcatataaaccagaaggtaatagatcttgactcccaggtgacttaattctaacacttgaataatttccactaacccagagagcatcctgtgaagaactatgacccaaaaatactattgaatgcacaataagtcagataataattagtaagattattacctgttcagaattatttcatctcttccatctctggtatatccttgaaagagaaaattactacttttatagaaggaccaaaaatttcaagttaattagaatgtgaagctgatgagggtgaggctcaagaattgtttttcattttgtccagttaggtcttcagatataaaactaggccaagccacccactgtttttataatcctagataactagctcatctcacgaacgggtatcagggactgaaagaggaactggatgacacagaatagacggttcagcagaaactcattcctggaactggtaaaaagcacacagctcagatcctcctgatagcactgagtcagctacactaatgtctttgttgttttgtttttgttttgttgttgttgttgttgttgccttttttaaaaagcatgccatgctgttattgttactgctgttactacactaagcattttgtacacaggatatacactctatgatgaaaactatacatgcaatgtctgatcatgagggacatatatacttaaaaggaaagaaggcaaacagtgacctctgttttgaaataaaccaaacactatgactgtgtaccatgcactatggattaaatatgattcatctcatgtggcatattcacaggaagtgatagcaatgacagattttctccagctctaactcatgagaaaaaaggcattctgaggatcatgaaagaaacattagactagaatctagatgtgaatcctgatcctctaaaaatacttacacatcctcctgcctctgtacctttgttccagcgtgaaaagctgcctaggtctctcggttgaaagcctagggttccttccaggctcagttgcaagccatgtcctctacaacttatccctcatcactgcatttcctcccttccctgaattccaacatcacctaccatctttaccaccctttaggtctttactttttctactgttatttttcatgtgaatttatcataattctccacctggataaatatttgttcaagatgccttatgtgcagatatattttacatttttagcacattacctaatatgcagtagtgctggaaatatatttgtttattgattctgaagctggccttttgcttactcaggcctgactttttgatggtctacttttaactcccataatcagttacttttactgaaatcagaaaaactaaaatcaaaattaaaatcaaatctttattctgtcactttggaaaatgacattctggaagcgctggaaagaaagaaaaatgtggttgtggaagataaatgggttaattaaagttaactctttacaaaaatggtcaaaattgcaaatttcatgttatatacattttactataataaaataaactctttatggttatatacacaattgacattcctctttttattgactgattagactaaaagaaacatggacaagtcaccaatactacagaatttggaagatagtgcttcgattccagaaacaggccaaaaaaaaaatgtacgctaaatagttcaaaagtacatgctacgaagaatgtgaagttcacacctgtaatcccagcactttgggaggctgacacgggtggatcacgaggtcaggagttcaagaccagcctggccaagatggtgaaaccccgtctctactaaaaataaaaaaattagccaggtgtgttggcgggtgcctataatgccagctactcgggaggctgaggcagtgaattgcttgaacccaggaggcggaggttgcagtgagccgagattacaccactgcaatccagcatgggtgacagagcgagactccatctcaaaaaaaaaaaaaagaatgtaaagttttgcagagaaaacagcatccctccttccttcaaaagcaaagaatgctccatagattcactcactgccatatcaaagagtcccaaaaacatgatcatgagagaaccttttccacatgaataatcttttctcttcaatttatttatgccttttaaaacatgaaaaaaaaagcacacacacacacacacacacacacacacacacacaaaccctgataacacagagaaaattctaaggaattaagactatgagggcaaaagctttttactaaaatatattcccttcaaatgacgtgtatttctattaatccatcaaaacttgacaataatccacacctactaaatatgaaaaatatttgtacccaattttttttttttttttttggaggcagagtctctctctgtcacccagactggagtgcagtggcgcgatctcagctcactgcaagctccgcctcccaggttcacactattctcctgcctcagcctccagagtagctgggactacaggcacccgcaaccacgcccggctaattttttgtatttttagtagagacagggtttctcgatgttagccaggatggtcttgatctcctgaccttgtgatctgcccgcctcagcctcccaaagtgctgggattataggcgttagccaccacgcccagcctgtacccaaatttaaaaacaggctacacatagaaaaaatatagtatcaatagattggctattttttttctgtattcgctatattctggatataaattgatctatccccaaagtaattttaatttgtctcccaaatgttggctctggatctttcccagcagaaagtgtgaaaggcaatgagagatggagaacagttgctgttatttacacaacgccactaggtactgaagagcaataagtagaggacaatatcctgggaatctgggttacaaatctgacaggaccacatttccacagcaacagctctctttctgcagagccactgagctgggatggcttgaagacacctgcctaggagagcctcatgatgattttcaaagctcctcaatcaccacctttcaattcttcccatgttcttcgagcaagatgctccatgttcgtcacctcttccctttctctttggcttctcttagcaaagatctcaaatcgctgcaccagaacacaagcaacagctcaaaggctgagtctaagcagtgacattacatacatgttcaacaaaacttgccagtcacaggctcttctttccctttacagaggtgagctttgttattagtaaaaaggtaggtttccctgtttttctgaagaaaagctgtgagtgggttaactttcaactctgttattcgttagctgctgtctctaactccgaaatgagcaaactctgcaaaaaatatcttcaatctggagaatattttacattttacaaaatgtgtccaccttcattactgtattcagtcttcagaacaattcagcaatagtggttattatcacctccatctaaagataagtgcagaggactgaaaagagaggcaggaagcttgctctgtttccatggttagaaatagcagctctggagctagaattgagtttttctgaccctaagtctcccacttttttcccctactactgtcagctctgctgtaacatttcttttaaaagtgctaatttgttccaatgcaactgatatgttgtgaaaaaatttaagcatgacacaaatcttaggtttgccgattgcctgatttcattcatgagaaaaattaggtgaacacagaaaactccacccagttgaactgcatcgaaacacacaaaacacatatttcaaacagacctcagtccactgtgtgcattacgagccacaaccatccacatgtggtgtttacaacttcccctccaatttcagacagcgttccttccaccacttcacagtaacttctgaactgcatccctgttgatatccacttccacaaaaaactctttcaaggtaaagcaccatatttattgtagtatttatgtattttttaaccactgaacacatggctgccaattgtattaggttcctacctttttgtttttagtgtgtcactgacaaagttttgagtatttttcccatagtcctgtttcccccaaaagctttgtggttttcactgtgtggttttacagagtgcagtaattttcagtaacacacatgttataccagagctgactggacaccatggtggagaaaaagaagtccaaaacaagagtggaattccaaaatacttttcctatttggacatgagcaaagagttaagttctagacaaagaatcaaacatacaaagagaaagacaggtatttcctccatggttctacagaatgatcttgtctatacctcatagcctacacatagcaacagagctcaaactgagccatcctctgattaaacctcaaatgcaggagattcctccatttccctgggtaatctatgtttctgaccttttctcctgataattttgtaaaacttgcttaaatcattaaagtatcaaaaggtcctttctacatgcatgttccaaggaaatgaagcaaaatctatatagattctgataattctctaatttaatagagaactgtgcgtgtaaaagcagctatgtacccccaacatggagtcgtttacttacttggcccacaaatgtttactgagtagctgctatgtgccaaacactgaactagagatggaaaccaacaatgagtcaaatggacatggttcccggcttcgttagacttacagactaatggagagggctggcgctaaataaacatcacacagataaatacggcagtataaactgattgttaattaagagtatgctgaaaggtgaaagtgacggaaactgattttgtttggtaggtcagggaaaggcctctgaggaagtaatattgaaactgagacctctgtgatgaccaggtgctaccaggcgaagagaggggaccagcactgcaggcagagggagaggcaagtgcaaagccctttgtcgtgtagggagggaggaagagaagcccagtgtggctggaagctggtgagccaggggacaggagtggcataggacgcaggtggaaaagaataagggatagaccacgtaggaccatgaacatgacatgacagatttgggactgtagcctgggtaaaatgatgactcattaccaagggcttaatcaagtgaggaagatgatttcagatttggcaaagttcattctgactacggtatggagaaagaactaacaggctaaattatagaatgggaaaacatttatataaatatttaaatatttaaaataaatataataaattaaataatgctaccagcttttagtttgtaccacaccatttactagagaagtggttttgaacaagccacttaacttaaaacttaactgctttaagccagtttcctctgcatactggggacggtgaactcatccaagccaatttcatagtatcattgtgaataatagatgaaataatgtatggtaaggcacttcaaaaactcaaaagtcctatataaaaataaaatatggctaactaaaattgtacagcttatattgtctaatatacttcagctacttttgataaactctgtataacatttgtctttaataaccattacatattaaagataatcatagatatttcaaaaagttcaaaaatgtgtgtctaagcagatcatacattaatcttgaaagaaaacacattttaaatatgattttgatgtaagaatggagaggataacttaatcacaaatgccatctagaatatatataaccctgtgtttggccttccctaaaatacattattttttattctcatttcctagtatgatttcaaacagatggcttgatgtatggtatgagaaaacttcagaatgaaattaaaatattaacacttgattcaaatatggaaagccaataaatacctctattctaggtctaattatagttggtgattctcattatatcagtgggtggtaatactgccagagttaaagacaattcaaaaatatgaaaaagaaagaggaatttatttggcttggaaattctagcaccacattatgtggcatatatttgacgaaacatatcaggcataacaagaggcacgtcccacataggctccaagccctccgtgagtcctgcctcgttgagtgtcatgaggtaccagctcatctcaggtgtcctatgctggcttgatgtctgaagatacatgataattgagaagtaatcgctatatgtctgtttcaaaagatttcctgaaatgtgtccaagtgataatattcgaattgagtcatactttatgaccaaagaatcatggggaaaacattagtactcttggataataagaggatcttaaggtaagaaatgaatagaggccattagagaaggacaaagggattcaatgatattcctgtatattgatagaaaaacacatgagctcatttgagaaatgtggaaactgagaagcaagctaccaactagaaaacgtgcccagtcacaggtatctccacgtattcatcaaccaacatccaatgtgcactcaaacatcttaagaattacacggagacccagaacaatccttttaattctctccctacctattgagaatctaaattgacacctgtgttttttcttcagaagtccataagccaaacacatcagcagaaaaattaatgtcttcatgaaaactagtttttaatgggaaaactctattaaccaactctgtcaagccagtatgaaatggatctaaattaagctatagttattacatctaattgtagccttgtttttgttttgcacacatattgcaatacagtttcaccataaagctctctgaattcaatatccccattagttatgaaagatttggtcatcctagaagcagagaaacagataaggaacttgaggattgattttttaaaaacccgtactcttggctgtaacagaagaatcagaatcagattttgagatgcaaggatagaaacagccaagtatatatctgcagtgctgataacatcacccaagagagacaaagcttttattctaactaaaaaaagatgcagagcttggttttgtgtgtgtgtgtgtgtgtgtgtgtgtgtgtgtgtgtgtgtgtgttttggaaaagaaaggagaaagggtgagataaataaatacagaagaggagaagggtggggtagagggtagaaatttcaagggcaagtaagacagatgggcacttggatggatcttaaaaatgtcctcaatgctagacaggagctctataacagaaatggcacaggtgaagcaccccatatgactaaattttcttagacaaagattatatatgtccttattatttagcaaagggatagagatgtgaacttgatgaaaggagtttttccagggtgggttgtgaagaaaagcaagataaaatgaaggtgttaggaataccgctcaaaatcctaaggaaattgaacactcgaacaaaggattcttagcaaagcaattttacttccgcgcagaggggtgcctccttggccagttgccatgagaacacacctgaacaaaggggcaggagagcctttattcctgacgcaagtcctgcccctgtaccctttccccattggctgaggtggggtcgtacaatctaatcttggttagctaaacatttgattttttttagatggggtaggcacgtaaaagaaagtggagggaaaggggaaggggtgtctgtaatgagctagaaagttagtcctctttccaaataaggaaaggagtgtgagctggtactgatagtgcttggtactgtggtgtgcataggcatctatcaaaggcaaaaaggaaaaaaaggagaaaaagaagggggggtactatgaattaaagaataaaagattgattcgattattcgaagagaaacctcatcatatcccacaaaggtctggcacgtggagattgatatgcactataaagtcatggtggaaaaaattacaacaaattttgggatcctaccaagagaaagtaagttgtttactgcatagtcaatggtttttattatttatcaactagggctacaaatgaataataaaatggtaacactgtatttacaacaaaaagtaatacagttttgcttttaatatcatcctacagcagaaaaaaaataggatgaaaatttatatattgatcaacttctcacatttttcatcagtctaagtgtcattttcacatcatgattcctacagtggagaaggcatgaggctaacagactgggctagagtttctgtcttcccattaacttgataagtgaccttgggaaatatacttactgtctccggacctacttctaaactgctgtagtaagttcttataattttatgttgccttggcctccattttaaatataagttggattctctcataccagaagaagggctcagtcatccttggcagaatttccagttctacgcctaactcacactcctagttcctcaatgtgttcaattcagatatctgcattacacagttgctcactacgggtcagctagacacagcctgcttgactggccctgctgctcctaccccctgcatgagctgtgcagatacgccacagtgactaaccctcagtcacagtgtggccacctggaactcacacctgttgctttaaactcacgaattaacattccccataggaaacctgtttggacaacaccctggatgccagtaaaggcattggctcatggatctctctctacatgtgctcctagacctccatatgtgtgaccctcaggtgtatcacataccccgagggcctgtaaacaagaaaatctgtatttccctcttgtgtctcttctaatcattggaaggttccctccatctggaagattctaaattaacactaatgctaaggtcccttccaactctcacattctatacagcaatgaaattagccacaaccatatcaggaaaagcataagcaattacaaataacattagtggcataaagagattaaatgcaatgtctacaagtggggtgtgtgtgtatacacatattttgggggttagtgaaagtataagtttcacttaatactgatgaaagtgactggcatccttgttttggataattagtgggtgaagatttaagaggcaaagggcacagtttttgggttaaagagagccaggcaatgttaaaacaatgatattgcacattacacaattaggaagaggagtgataaaatagacacaccaaaggcattggttttaatttgattctgaaatgattgggagtatcagtagattttgaggagaatgacagaatctaaatgatgtttaatctaaatctaaaggatgataattcttcctcagagtggactctagaggtgagatactaccataaaaggaacaatttcctcactgtcattcattagcaatggttccttgggttggaaaaggcctttccacagggttttctacctcactgactttatgacttctataagcttctcagaaaactaattcttctcaagtctttgaatatctgatgtttacagaggctgaccaaggaaagcaagacattgagtaataacccaggtaggtagtaagcttgttatcaatagtcaactgcctaattcagactctctttcccttacccgaatcttttccttgagtttattcagtcaaaaggctcaattctcagcttgacttagaaaagagctttatttactcaaccagtgggtcctttcataaaaagtcaatgactcattcttctcccctggtcacagatctttctttgttgtcatgttaattgatcacaattaacagtagctacttattattctatccccttgaagttttcagaagttgattttattaaatgccttcatacttgactgaagtcttaaacattgtttccttttctgtggagacagtatattctatgcaaagaagacacagcatttcaggttttttgtttttgttgtagcaacttttgcttccagttctgtaccctgaaccacatgtgcactttcagaatggctacagatctatgccccattttacccccaactctgttccttttctgtctgtactccacaacaatcggtgaacaacaagtgaattctctggctagtttcattttcatttcaaacttttggtccctatgtttctctcgttgttctctgttatggaggattccaagatttttcatcctcccatctacgctctagtcttgaacttcagctatatttactatgaaggttaacacctgttctgcctcaactctgatgtctctcttacttcactgcccgcctaatttatggtttataaaacatacttgtgctcttgctttataacttagctttatacagaatatataatgccacagtctttgctgtttcacatacatatgacgtattaatcattatataatgatatgtataatatatattatatataagtaagcttgttaatataataaattatattaacattaataaaatgaataacaaattatatacaaaataatatattactatatattcagtttaatgtatattataaccaataatatattattccctgtctcttcaaagagcacactttccttcaggcagggattaggcctcaaacacagtcacaaaaccccatagaatattagcatattgctgagctttccagaatgttcaatacatacttgttaagctccacatgaatcctcttgaccccccacgaccttagtgggcagctagctctaggtttataaagtttctctcggtaacaacttttagtcttaatcctgactgaggataatgtgatgagattttctctggtttagaaactccacagatacatttctctctgtcatcttctttcccttaccattgccttctcccaacagcccagggattgcaatcccaacttcatattcacatctcttaactgatgattcactttcgctcaataactattaagtcaaaaatttaatttctgagaagatgtgcaggagtttccaaacaaagccatttataattctatttttaaggatagtacattgtaccgttctttttgttcgccctactagactgtacagagtagtggaaaggaaaaaaaaaaaacacaactctattcagactaagaatcctttttatcctgtagctggaatccttatattccttccttcagtgaatgggtataattatgtgtattggaaattagagtattcgctataattatgcactcttttaaagtgggagaataattataatgtctacaaccaactgtacaaggtactactgaagcttttgttttaaatctgccagggaggacctcagtaatgattaatttcttacaactactttttattcatttggagaacatactaggaatgccttcacacttcccgtttcattgtggaaagtttctttaaacaagaatatttctttaaacgaagacttgagaacaagtgggttggtttttacatagccagcttccattatttcatcgtagattatatgagaaacctaaaaattttaaaacaggacttttagcagcttcccttatccttgttagcaaatgcaaacttttacattttatcatgctgctaaaaggtcagctacaacatttaaaaactcaatgtggaactaatcacaagctttggttcaatgctttagtattttatttcatacaattaccaaagttagaagaaattgaaagcaccaaatattaaagaattagagattgtgttatttctgggaggtaaggttaaacagaaatatcatttttatgaggaaatcattaaagacctataaatgagctgagtgagtgcagttaatctacagaaggggaaaacatatactcttaaaagacaaccagagggcctcttttgaaagtatatttaacccttggttaaccacatcagtcaaggagaacatcacaacagacaatctcactttctcaatgatcgacacagtcaccagaggaagcaaatggaaaacacagtttcacatggtctaaatactactcacaaaagataggccagtgtggctacaattactactattaataatagaatacctgcctggcccgttgttgggtatagaaaagctcacagaagaaacgcttacatcatgactgcaggtcttttgcatgcactttatgtgagtgtcagaaattgtgttctcaggtgccctttttgtaatctcctggtctctccccagtttccactcctggcaatgtttagccctttctcgttcagaagtggtctctcctggaaggctttgtcagacttgactgaacacagcaagagctatttttccacatggacacattaatatctgcccctttctagaggtcttatgatcaaagggaaatgaaagtttgcagacctggaagggtgcttgaggtcactaagtccaattgaggtcctaaaagataccaatttgtccagggtgatccagcttaccataagcctttgtcgctgtggacagagaagattcaaagatcctccaaaatctccctttccaggcagtcaacaatagagcaaattttcaagactttggcagagttttgcatttggaccagttagatttatatgtaaaactttcatataaactactttcctctgcaatatagacctttttataagctcaaaattaaactgctgcatgaagatggaaaagtgatttggcaagaccataaaacattttcatcctttttatattagtgtcttgaaagcccttctagaaaattttgcctccttcttcagaagacaacaatattaaaaacgtgttttttttttaaccaggccttgaatgttatgtacattgctccacaaatgtacatttttatataggctaagactctatttatgatcaaagaatcagattcaacatgcacaaagaaaatggttccaattagtgagagttacctgccatcttagtaccactgtcaatcagaacaggtgtgttattacaaaagtgtgccattacacaggttataactcatccacgtgcaaatacctacaacagaggctctccacctcttaggccaggaagaactgcaaagcatccacaaattacaaacggttcagtgtactgaacatgatgtattgacaggtattgaataaataaaaacacaactgctataacacagaaatctgtggccttattttttatggaaaaaggatccatgtcttcataagattgtggccactggcattaaatctgaactacagctagtgccagcagccctactgatgatacgtaagacagggaaacatgtatgtacaattaaagtgcacctccttattcacagagaagtcacaaagtaattccaggacaaataaagtgaaggaaaataagagagagagagaaaaagagagactcttcccagcatcacaaataagaatgataatgatgaaccctggctgagagttctaagcccttttcacatagctgccactgaacccttgcaacaatactagacagttggcactattcccaaccagattttttttttttaagattatgaggctaaggccacagtaagtaaatagcagagccaaggtttgagcccatgcaatctgattccaggaacctagggcttgactgcctctctttacaggtatgaaggagtttctttcctggtctagtaaactttcatcgcaaccagcaaaccaactgatgcatttaagcctctccctttccaggaccttgttagagattgtagggtatagaagagttccaagagatggtctgaaaaatagagagacagagatggtctttgccattaaaaatattgtaatcttgttaggccaagattatcacacattcaacaattagctagtaaagtatgaattatctagagcaggggttggcaagtttttctataaggaaccagagggcaaacattttaggcttgatgtgccacacagtctctgttgtaatgactcaattctgctctggtagcacgaaagcaggtatagataatacatagactaatgtgtgtggatgtattccaaaaaaactattacaaaaataggtagggagggaaatagctcagccatagtttgtggactcctagtcaagattaccagctataacaaaaaaataatcaattctaatcattcattttccaggaggtgacattccctttctccaaaatgcataaactccctagaagccatggggttgcagaactgtcttcttactgttaagaaacaaaaacaatttgaaacctcttccccgaaacttaatgaaactgtagctactgtcgaaaatgaaaaaattaagtgtgtgttttctagaaaggatgaactttcagcagtgctgaaaatcacgtaatatttgtgcttgtcagtgtgctagaaacaaatcttttatctatccctgtgtgattacgtctctgtacagaggcacctgcgttgtgttatacatagaattatattttaccctttggtgttgaaccattagccagtgtgtcttcttattctcaattaggaacagagttcctcccactggagggagagcagaggctctgcagtcactcgctgccgtgttagtgttgttagagattatacaagtcactttaactcaacaacttacaaagggtctacattttacgtcaaactaatctcaacattagataattttgaatactggtcataatatacatacaggtagatgataatttagccatacagattaacattttgttcttttctaacactttgagagcctatgagatttaatgttgacagatgctaacacctttaaatgcttttctattttctcagatgctgaaataaaattttaattttattatttaaatacatttaatttattaaaaacaagttggaatatacagtaaggctctgtagtgcatggattatacaggttgtagcagaaaaaaaaatctatctccctctctctaccaaaagttttatatttactatgtgctatttaataaataagttaattttccaatgagaacacatggacacaggaaggggaacatcacataccggggcctgtcgggaagtaggggttaagaggagggagagcattaggacaaacacctaatgcatgcggggcttaaaacctagatgatggattgatgggtgcagcaaaccatcatggcgcatgcatacctaggtaacaaacttgcatgttctgcacatgtatctcagaacttaaagtaaaataaaataaataaataagttaatttccctgcacaatcaatcattaagtcttctacctcccaatatatgagctggcctaggaggggaagagtagtaagtttataatctaaaatttgtgtacccttgggtcgtaacttttaccaacaacttaactctccatattgtgcatgtagttcatattttaaagacttcaaaacttcagacgtccttttgtctgttacacattgattgctgttaaactaaatgtttttcactctgtaatcaatactttcttacaaaaataagcccaggcattgacaaacaactctgcagcacattgcagctttcctgaatgaaaaactaccacccccaagaattaaaaaagattgcatcgactccagtgcttattacaatttttacaagcttcttacagctgaatcattccactgtaacaagactttattaaattagacagccattgaatcttaagctttctgagaataacaagtaatatgcctttgtcctttattattgtttctgcaaccatactgctcatgttcatatttacatcttctcttgtgatgaagttattaaaaagcaacatctagataaaaagcaacatctagataaaatgggagggaagcaacatctagataaaaaagcaacaactagataaaatgggagggaagcaacatctagataaaatgggagggaacatctagattagaaaagcaacatctagataaaatgcaacatctagataaaattaaaagcaacatctagataaaatgggagggaagcaacatctagataaaaaagcaaatctagataaaattaaaaagcaacatctagataaaatgggaggagggaaggggtggtataacatgtaaacgatgactttgtgtttcatgcgactaccattctagatcaattttaaaaagcactactaccttaagaaaatgctgttgtacttttagaccccaaatgcaaggaatcttttaatctgggacttttattttacacactgtaaagtgtgagttgcttttataagcatttgccttcaaattatttgttcatcacatggttcactctcttaatacaaccttccagtgagaatccatggtgaatgcgaggggcaagcagccaaccatacatcaggttgccaccaacatgcaccaagtatataactctccctccaatactaatccacacaaacaccaaattcttaaggcatataaccctatattccatcagtaggcatttagtggtctgggtaaaagctaaagcaagttgagaataataaaaacaaacacttccaaatacaacaaagagaaaagccctcacgtgcatacaccttaaacaagctaaggcatgttctcaccttcatgtttattagcaaaaaagaactcaagaaacaattgtttaaatcatttaaaccttgcatgtatatatccatggcaaacagcaacaaaggcatttacaatttttattagtgggtgatatttcctgtcaacagaagtggttttgtattacagtgacataagtcaatgtacagactccaaagtttttcacaaaaacactttctattttttgatccaagatagcacttctatgcaatagctcaaaattgccaccaagtggacggacaaacactattctggttgtagttgtagagtaaacagctgcttctgatttgaagagtgttgaactaatcacatcaaccagtgtttactaaatattaatacctactaagcacagggtgctcctctatgcaccacagatgaaaggcattctgatcagagtgagaaggctaaagccctgtcacgggcaccgcatcttgcgtgctaatgttctctggacttcaataggtaaattattccatttatctctttagaggaggaaaaataacctattaaggctactgtgagtgagcaaaacagcaacatccagtctgggaagggcattcatatcgctaataattgttgaatgatatgaataagctccagaaggtataaaattggagtcactcctaaaatcactgatagtgttcaagagactaataaattagaggttatgtggaccccaccttacaatctttcatggagacactgctctagacatagcagtggtgatgtataactcacggtaggtctataaccaaggctagataagcatatggatgagcaacatctacattcccagctagtaagcggcctcttccccatgggtacaccctgacctttcacatggaagagtttagtgtatgtgaaaccccaaaggataggaatctacatacatatttgatgagccaatttatttaataaaatatctaatttttccaaatgagtgactctaagtcctatttaggcaaatcctcagcttctggcattatttattttatgttataaaacataccttctctcttggaagcatgggtaccaaagggaagaacagtaacttttaatggatgcagttagatcttgaaatttttatctgaaaaccataaagcttttaaaaataaatttgcaaatgtaattgagcctctaatagctgctactgatagtaattaaagaaatctcatttccctaaattaaacataatgaaatgtttttcaagatcaaataaaactagaaaatgctatcagcctgatagaatttgcctctgaaagtggtgttctggagtttacagagaagcctcagttgccagcaaaagtcaatggtttatagggttacgggcaatatggaagccatttccactgtatcatatcaacttttattggctgataactgatctgaaagccagtatatggtacagcttcacattgcagtgcttatgcaaatgaagcagacactctaaaattcttcctttagtgcctttaaagagtttgttatttaattaaacgttgtcagcatatcttcagttcaacttacacatttcacactcttaatgttcaatttttacattacttttgcttttcttaaagtgaaatggcatttgggcatcagagtgaccatcttacccaggtctctcttaagcagggaagtgcttcaatttgctgtcttagtatgggctactataacaaaaatcctacagactgggtgacttaaagaacagaactttatttctcacagttttggagtctgggaattccaagatcaacttgccagtccattcagttcctggtgagggctctcttcctggtttacagatggacacctgcccactgtatttccatgtggtagagaaagggcaagcaagctctctgaagtctcttctgataaagtcatgttaatcctatcataagagctccaccctcatgacctaactgcctcttaaagacccaatatccaaataccatcacattggaaatgagagtttcaacattcgaattttgggaggacacaaacattcagtccataacaattgctcagaattgatcattgtcttctcatttcttgatggtctccagacaaaaatacctagtttccctgttatttcagcaatgtatcatcgtggtaatcaaaaaggttttccttatgtttgataaaaatattttgtgtcttaattccttgccttattatttgggcttctatgaatctaagaaactgttcatctctaaactcttcataacaaggctttattccaggaaaatataattaagccaaccattagccttctgttaacagacaccttacctgtcacatacatagaagcttctaacatctcacttgagtatgataagaagtatgatgtatttatgtcatttgtcatccattttttatcacttttgccacatttctctatatttttacattctctttaaaactggtatatccaaaaccagatgtaaagctacataatgggtttagttaatgttatgctcaggcaaagcatggactgatcttactggtgctctatgttggctccatacttccctaaacgaagtaccactcccatccccaccccacccccaccacacaaacagctcttctctactgagagcctctcatttgctcgtcaaattgcgcataacatgcaggcaacaaatacctatcttggaccaattaatgactcttatctaactcttaactacaacgatgccccaaatttttcttctacatatgttccttgattatctccctgctgaaatggtgatttgttttcttaatcctaatacatcacactgctctcactaattattcattcattaactatttagtaattacttcttgccagacactcaataggtattgccattcaattcagaataagacaagtttcctgtcctgaagatacttaaaatctagtccatgccccctacttaagggggactattgttgtaaatcattctattttgtgtctctgttgttcaaagtataaattaactgttctatgttaacattctttcaaaccaatgactgagcatttgctgtctccactccattcttgccccaccctcacctccagatggatgtcagtctttagcacaatcctccaatcaattgtttattcactgatagccttgacaggaaaggtgattacaaactgctagcttaataacagaaacaacaggatttcttcaagtacttaagggggcaagtgtattcaatactgcagtatccccttacctatgatttcagttactcaagtcaactgtgatccaaatataaaatggacaattccagaaataaacaattcataatttttaaattgtacatctttctgaacagcatgatgaaatcatgcacattctagctctgtcctacccaggatgtgaacctagtgtatccatactatagcggatacctgcctgtcagtcactaagttgttgtctgggttatcagataaaacaagcaaagtgtatctagggtccagtccagtccacaatttctggcatccactgggggtctgaatggagcatatatactgaagataagggggaactaatataaagtgttctttacctccaggatttctaactgagttggggctgagtctcacatcttacagtttgtccacctttctttgcctcttttcaaaggagcactttctgtcggtgagggcttcatctacatttttacctcctagttcatgttttcctagagcatcattatttagggggaaaagtaagctgtaacatttttaaataaattggtttgctgatgggagtttaaattggtgcaactgctttggaaaaccatctgggagtatctgattaaagctgaatatatacatcacctgtaacacagcagttccagtttaggtgcatatgtttaccatatatgtacatctgctcacctaaagtcatatactagcagcattattcataagagccccaaaatggaaacaacccaaaggtccattaacacagataaattatgggatactcaaacactgtaatagcatacagcaatgaacaaactacaactacatgcaacaatatagatgaatctcacaatgttgagtgagaagagtaaatactgcatgatctcactttatattaaagagaaacaggcaaaggtaatccatgtcattaggcgtctactgaaggggatttggtttggtgcctagagaggaacttctaggatactggtaatattctatttgttggtttaggtgctgactcacaggtgaacttgtgaaaattcagtgagttaaccaatatgtacgcttttctgtatgtacattatacctcaataaaaagtttttttaaaaaaacagaagaaaatctaggtgaccttgagtgttgtgatgactttttagatacaacaccaaaagcatgacctgtgaaagaaataattgataagttggacttcattaaaatgaaaaaccttaaacttctgctctgtgaaaaatactgttaagagaatgaaaagacaagccacagactggaaaaaatctttgcataagatacatttgataagagatgggtatacaaaatatacaacgaatgcttacagctcaacaataaaaaaaaccgcgttaagaagtgagcaaaagatttgaaagaacacctcaccaaaggtacgcagagggcaagtaaaaatatgaaaagagtctagggaactggaaattaaaacaatgagataccatgacacactattacaatggccaaaatccaaaacactgacaacaccaaatgctgatgaggacctggagcaacaggaactctcattcactgctagtgaaagtataaaatggtacagctagattagaaaacaatctggaagtttcttacaaagctaaacataggcttacctatgatccagcaataataattctagttatttaccaaaatatattctaaacttacatccacacaaaaaaaatgcacatggctgggagcagtggtgtgcccctgtaattgtagctactcaggaggttgaggtggggggacctcacttgaggacaggagtttgagaccagcctgggtaacagtaagataagatcccacctcaataaaaaacaaaaaccaacaacctgcacatgaatgttcatagcagccatgttcataattgcagaaacttgaaaggaatcaagatgttcttcattagatatgaaggaaaccagaatatttctccccaaaatatgaaggattattgagatgaagacaagtaaaatgcagggtagctctctgccttccctctgtttacttaaagcagaataaagaattacaaagacttttaaaaggtcttttgatctctccctatatcccacctaaagaaaaaatgtaaatttccccttactgcagacaatctcgacaaagttagggatggcgccagaggaatgtgagctttactttactttgccacagttttcccccctttggaagcctggaactaatttcctttgccctgtaatttttctaaaatctattgctctttgttgaagattttatgtaagattaaactctaaaccactgccttaagttactttactcctgtgagatgtacgccgaatgcattaataaacttgagtgtttttctcttgttaatctgtctttggttgcagaagtctcccaactgcaaatttatgaatactgaagaaaaattataatttctcccattcagatgaatgaataaacaggcgtgatacatcctgcaatgaaatattattcagtgatataaaggaatgagctatcaagccatgacaagacatgaaggaaccttgagtatactgctaagtgaaaagagccagtctgaaaaggctatatactgtatgattccaagtatagtcatgtgccatataacaaagttttggtcaatgactgaccccatatacaacagtgatcccatgagattatagtactgtaatttttactgtacctttttgtgtttagatatcaaatacttaccactgtgttaccattgcctatgatattcagtacagtaatatgctatacaggtttgtagcccaggagcatgaggccataccatatagcctaggtgtatagtggagtaggctgtagcactaggtctgtgtaagtacactctgtgatgttcaaacaatgacaaaattgcctaatgacagatttcttagaatgtatccctgtcattaagcaatgcatcgttgtacacaaagttttggcaaagttaaaaccatagagacactaaaaagatcagtgatttccaatggttcagagctaggggtcatggatgaatagatggcatgtgaaatatttttagggcagaaactattctgtatgctactataatgctgtatatatgacatttttatacatttgtcaaaacccagagaactatataacaccaagagggaccctaatataaatgatagagtttagtcaataatagtgtagcaatattgcttcatccattgtaacaaatgtaccatattaatgcaagatgttaatcatggtcatgggaaactgtgttgggggtgagagtggagcaggtaatataatatgagaactccctatactttctgcttaatttttctgtaaacttaaaacttctctaaaaaataaagactactgattttttttaaaaaataaactcatttaatagttacaaaataccaaacttgattcactcaaatctattcaggttaatccagggatcacaaagcccttaattttccccttctaccttcagaataaagttcccaaacccccaggcatacaacataaagccctcacccatcaatccagccccatctttaaacactctctcctgtgtccactgtgcttctggcatatctccatgctttcctactgttcttttccttggtcctagaatgccttcccctcccaacacacccctaatcgccttagtttagctggtgagttcctatgcatcttccgaggcccacttcaaatagttcctccttcttttttttttttttttttttgagatggagttttgctctttggtccaggctggagcgtaacggcgcaatctcagctcactgcaacctcctccccccaagaagggttcaagtgattctcctgcctcagcctcctgagtagctgggattataggcgcccgaccaccacacctggctaacttttgtatttttagtagagacggggttttgccattttggccaagctggtctcgaactcctggcctcaggttatccaccctccccggcctcccaaagtgctaggattacaggcgtgagccaccactcccggccagttcctccttcttgaaactctttactgttcttgattaaatgagcatctctttcttctgtttcctaatcacatgctgtgattatgcaactggctcttgatgaaatgggcatcgctttcttctgttttctaatcacatgctgtgattatgtaactgtttgtgtttctgcctcatttgtgagaatgtgaacaactctcacaaatgagggaccatgtcttaaagccacctctggtgaacactggtgccgagtgcataatcaacaagactttattaatcaataaatgacatagttattattcaagttgttattagcactggtacagcaacccatgtgagctgaaggtataacataaatgttaactcagtaaagtcacttctgcaaggggctgagataatatggcttaggtatttgacatgctgcttctataacttaccatggcaataacacttaaagtcacagaggaatcacttgctcattagacacactctctggaagaccagatgtctcaaggaagactttgataagtgctggactgcaattgattcatggctgaattctctgaggagcgtcacaatggtagataagctatatgttggggatgaaatagggatgcatatgctttatatgccagacatgcatacatcagagggagtggtctatttgagaaattaaggactctaacttacagtttttatctggcaaaaagccagttcagttcagcagtgagagttcaaaatataatgcgatcttagaagaaaaatcacagatgcaacccaccacttaaacctgtaatattacacacttaggctctatacctgggccacttttctttcctcttaaattctgctttggcaatttcatctactctaaggtttgaaccattatgcctatgtgaggtacctcctggtatatatctcccctaatgcaggagcagaacaccttccacttgcttttcctgacccttctctactctctcccactctgattcctgccctgggaggctaatgtttgtgccctcatcaataatctgttttctgcctctggcttcctgtgaagtccaaccttggaggagctcaaacaggagatcagaggaaggaccagggagggaggagttttattcacctgactcaatgattcctaaactttagagtacatcaaaatcacacagatgaaggcctgttaacagagattgctgggccccactcctggcatttctgattcagtactgctgggatggggctgagaatctgcacctctaactagttcctgggtgatgcggatgctggtggccaggactccactttgagaacccctgccacagctctttccctggaaggttactgagctacttctaccaaaagtctgtgctcttctcaaggtgacccactctacaagactgtggtgattaatgttatgtgtcaaattggctaggccaccagtacccagatatttggccaaacattattctagatgtttctatgcaggtattttttagacgacattaacatttaaaccagtagacttgtagactttgagtaaagcagatcaccctctgttatgtgggtgggcctcaaccaatcaactgaatgtcttcatagaaaaagactgaccttctaggaagagggaattctgccacagactatctttaaaatcaaactgaaactcttccctggttctctggcctacagaactaccctgcagattttggacttaccaagcctctgcaatcatgtgagccaaaataagtctttctctttttctacgtgtgtgcacacacatccagttgtctctgtttctgtggtgaactctgactaatataaagaattcatccctccaggttcaagtaactgctccctactccctatacagctcttaagacagggcaatgacagtttgactgctacaaagtccccagtttctgtactgtctctcacctgtttctacacctttgcaaacagtccttgtagagtaaacccttgttgaattatcctatttcagatgtgccatctatttcccattggactactctttggtacaatgcaccttaaattagagggaaaactcaccttctctgctttctttctaagcctactgcacctgctgtgttccctcttgtgattaatagcatcacttcctcccaggaacccagacgcataagctcagcgtcagtttttcacctcttgtaattgctggtccagctttccgggttttctatgattctggaagctctttagcagaaagtttatctacttcatttctgtatctccagaccctaacacagcatgttccaggcatctccaggtagcccaaaaatatgtgctgagaaaacaaataaattaaaatgtgtatgaaatcttaaaaattgtatatgcctttcatatacaatgtttccagactccaaattccagtttctttccctaacgctttgctccacacaagcaaagattcactgctaacatactgagtattggttcatcttccacgacaatgcttgtatctattccttcccgtttccacaactctgcttcctgtttctattatttgtgaccgggataattgggtattagcattctaacctgcttccttgcctcctaacctgcttccttgcctccaatctccctgttctctaatccatcttatatcttaaatctctgatcatgactttgtctctatttaacagcttcttattacccaatgaacatgagccagattttttagggtttgcatgcaagatccttcataagctggtcccaagctagcacgccaacctaatcttaccattccctcatatgaactctccactccaggtgctgttcacctgtaccttgcaatctgaatatttccaactctgtatcatactgtgtatgtcccttgcttaaaacagcatgctactcatttttgttcacatctctcagaacctagctcctgccctgttcccaacacaatgccaacccacaataattccattttgcctcaaatactgtcaatagctattttctatatctcacatctggaatctaccaattttattgcttttgaatgtaagtatatcttatctttcaaatcaggctgtaggtaacaagcgggcccatcaaatggtggtctactttcttctatcctccaaacctcaagcacagtcattggaacagtgcaataataagcatttgctacattcttcttcagtgagtatctccaccacctatgaaaaggcatgtctgtgaagaactagtacttactgtgttcctaccagagggcattaatacgtagaggaaaggtttcccatctgcctggggttgacagatttcaaaggggcaggaggctctatatttagctaatcttattgagtgtttgttaggaaaagagcaatgcattctgtgttttgattaatggttttcacgcttttgtttgtggagattttctttgtttctaaggagtattttttctttcacaataaactcccgagaataaaactcagaagatttagacatgcccaggaatttctctatttaatcagcactttaggtgcctcaaatgttagtggctttgcatttggcactcactttgagaaacgctgggatagtgtataaaaagaaactgcatagaagagaaagacttcatgttaattatggagtggtggtaaacaacattattaaatgtgatctactaatgggaatgcttgctcaaattaatgttttcattaaaaaatccatgtaatctaataaattaaggtatttttccaactgagaaagtgattctccacttgccttacaatcaccccatataactggcaggtccactagttaattctctacctcatgaaacactgagagtagtagtaatatggttgccacatgatacaatgcatgttgtatcataaaaatatatttcaactaaagggtagatgtgcttctaaatgaaagaggatatgggtagccagagagagcagtattgctccaaacaaaaatcggacacttgtcctttaggaaatttaaaatatgctgtccttcctttctgtttgctcttggttagggaggttttcactggaatctatttgaggcaagtgctgagtatatttgctgtcattgtgttctttgatctcagtatattgattggatgcagctgcagaaacaggtaatgtgggcaaatatgaagaaaacaaactgctgcctgcagataattttttctggagtgttaggggaaatccaagataattacacattttcttccatttatttttaagaatatgaatagcaatacacacttcagtcttcagaatggaggctgcaccttttaaactcactttgaattatgatttaaaatccattgtgctgcattcattcacttgcttgttcaaaaatatcactgagattttgtgttggacacataaataaggggctacctactctaagactagcatccaggtgtcctattcacacctcagaatgatgcttctctattctctatttccacaacaatcccagagttacataacccattacctcatttatatgttatctccactacttgccagtctagacacctctagtattttgtggtttcaatctatcttatattcaattaacaaaacaatctttccaaatataatttagattagccactggttcaataacacaatatcatgcctcattgattacccatcattcaattaatcactcaacaactaaagttacagagaacctactgctcttctgggcactggtgctagggtcaaaagggagagggaataaagaagaaatacaatgcatggcttgtgctcttaagggctacagtagatagaacaacagcctaccaaagttgtccacaccctaatccctagaaaatgtgaatttggcaagagtggttttgcagatgtcattaaggttacagactttaaaataggaagattgttttggattataagggtgaggccagtctaatctgggagcccttaaaagcagacaatttctccggctggaaacagagagatgcagcaaaagaagaagtcagattccaagcatgagagggactcagtgcgcccagtgctggctctgagatataggcccacatcaaggactgaagagaggcctttaggagctgaggttggtccccggttaaaacaaaatgaggtcctcggttctgcaacttcagggaaccagattctgccaacaacctgagtgaatctgaaagcaaattcttcccagagccttgcaataagagtccagcagaccaaaacttgatttcagccttgggagacctggaacagagaaacccgtcaaggtatcccagactgttgacctacagaatggtgagatgccatgtatctgttgttttcagctgctaaatgtagactgtttgctatggcagcaataggaaactaatacaaagaccctatgaacgatctatagggagggcagtcccactccataaagcaacacattccatcattaagtacaatatgcagggttggtgagaaccactggcatgttcctgtaagttttgaaaggattcagaggagagaaaagtcaatgaggctcatggtagttagagaaggctttatacagtaaatagtatttaaattgattgaataaagatgttagatttttttaagcaagcatttcaaaaaagtagaacatgacagtgacaggcacaagcaagttggaatgactgtgaaagaaaagcttgactggaatggcaaatatagtccaatagtacacataatgagcctcctaaattaaacagtggcttgaaaaatgttctcaggggtcactctaggcaaaagtatgatggggagcaaaaggaagggaactgtttgtacacatgatggggatatgtagtccctctctccatcttctccccatctggtcttcaatcagagtacctccactctgatagcttttacatagcaatttgaacaaagattcagcagctgtattagttttctaaggctgctgtaacaaagtaacacaaactgggtgacatagaacaatagaaatgtattatctcacagtcctggaggccagaagtctgagtctgaaactaaggtatcagcagaccaccttcagggctccctgaaggcagtagggaaggatctgctccaggcctccctcctagcttccagtgggttcctgagcttagcagcatgactccaatcttcacaggacattctccttgtacatttatagggttcactctattccagtctccaagatgacttcatcttaataaattacatctccaaagactctatttcccaataaggtcacattcttttttttttttttcttttcctttctttttcttttttttttttttagcagcgtttatttgatcaaagaacaattcatgaatcaggcagcccttaggatcagaaaagattcagagaactcccaggtcatattctgaggtactggggaccaaataaattttgggatttacaatccaacccataacaatggctgaaataaggtttgaaagctaaatatataaaatagcaactctgaccagcatcgaaagctcttcagccagtaatttaccctccaatgtggacagactggcccttttaggtgcacaatttactcacccttcctgctacttactacccttttcttctcctagaactttccatacccagttctgaggattagtcccagagttttctcctttagaagaaatctagatgataatctatttctagggagagtcttctactttacaggttatattagtagtaaactgtcttatgcttactaaactacttagtaatcactgaactgatatcctctgtgacaggtgtccccagcccccaagctgtggaccggtagcagtctgtggcctgttaggaatggggccacacagcaggagatgtgcagccagccaagagcaagcattgccacctgagctctgcctcctgtcaggtcagcggccgcattagattatcataggagtgcaaatcctattgtgaactgcacatctgagaaatctaggttgcaccctccttatgagaatctaattcctgatgatctgaggtgaaacagtttcatcctgaaaccatctctccaacttccacccccagcccatggaaaaattgtcttccacgaaactggtccccggtgccaaaaagtttggagaccgttcctctatgagactggagccaagatgtatgactcatcttaatcatgctgcacccaaaatcagtgttctacagccagcacaaaccctatatatgtttattgaaaattagtccatctaaaaatatattcagatgttacacacctaaaaacaacgcattcaaggctaaatttagactttgtcccatagaaatacacctctagcccagattttaatttaagcacttcagtgtgtcaatcactttggcaaatacagccgggtacccacatagctctgtactgttgatgctaagtcagccttccagccaaaaccagagaggcaccacctagcattgtgatgtcagtattatgtgtcagcaagatacttagccctgcaacccttaggtggtcatgctttctcccagcccatgaatttctcatgtgaaattttcaagatgtaacaatttttaaaattaagctttagaaactctcaactgagattcacgtttcaaagtaatggcatcctgaaagctcaggcctgtccaaggaaggtttattttattcttttatgccagaaagacatgaggtatatagggcccagaactgtccacaaagacatcttctcctatataggatcttcttccatataggatctcctgtatcagggatctacaaccagggagaaaagtacagagtttttaaactttttctagaaatcccttgaaaccttaagtttagagtcaaggggcttcacctaattcttcctatctccaaggaactatttaaagcagatttgcacttactcattcttggccttttctgtgccctcttgtatagttcatatatagaacctataattaggcactcactactttcaaaagcatgtgtttttcacaccataccaccagcctttggaaaaaggatgttctacataaataggcaaaaggccaagaacaaatattttttaagttttagataattttttatcacatccaagggtggcatttgcaaagactttttttaaaagaagtcatttaattactgcatttaaaattcacataaagcactgtgctagagattaacgatctatgtggaaaaacattttgaatttaaaaagtactgtaccaacatttacaagagttgtagcatcttaagttgaaaagggattgatctatggaaagtagaagtataaatacatacttaaagctgcagaaacatatttgtttttgaaaaaagaagttgaacatttattcatccctgtaaatatagagtgttactatgagagaaaaaaaatcagcataatctacagaagccctaaattctttcatgaacacccttgagaccgtcacctattacttggatcaatcttcacattctataatccatttttactcttaaggaaaaatttaattgacttcttgatgcaacattgtttttttttgtttctttttttttaatttaggaaatgttcaagtctttacatctccacaatacatagtcttataagaagacaattcaggaaactgagagctttcaaagccacttgtggctactcttaaattactttctgcagttaaaataactgtgtgtttgtaaacaaagtgcttttcaagagtaagatccccaaacagtcatacgttatttttttccatgtgagaaaatgcattattgtgaaggttcagagacataaagatggcactagagaactaggatgatgctttcacctccataaaaggagaagtataaaagagaactgcccaaggaaactccaatattcagttgcatgtcagcaaatgggggaaacgttctaaaatgccctacctttatacatttaaaaagatgaaagattaagtttcaaggaactcacagcaaaaaaagagaaaacaccccaaacagtactttgactacctccagaggaattaaagggctatcattccacatgaaaatatcccagcatttctgttgttgtgtctctgcctatgtgattggtcccgaaggccccatacacactggtgttctcagatcacagctgcttcttgtgctttaacttgattgcctctacacgtacagacacagggcatgaagcccatttatcgcaggctcaaatctctgttgatgtcattggaatctaagccttcttgctcctgagctgcaacaggcaagtatagaggcccatagaagacgggagatgaatatttaacttgtccagagttcccagacacctcagaaaatattattacatctacttagtactgactgttgttatcagcaccaagtcaggacagctttatatttttgctggagtaaaatttcagaataaaaaccttttggtattggaactcaaaaatgcgtaacttctgcctgaggaatttcataattcagagatgctgagatggtatctacctatgcgttcttgtaaaggtgcagtgaggaacagagcttagttttgttgttgtttaaactttttccatgttcccgttgacttctattctcatttaaaaggaatttttattttcacttctcaaatatcctcacacttgaacttcaacttttagtttctaggtcaagtagtaattgtatgagatgaattccaattcaaagattcctgttatttggagccagtcccgtaactaggtaagaaccttttcttgtacatctacactaaataatttgtctgttttgcaaatgtggattctcaaaacatagatatcttaaatatgggcatatctcaactgaacaaagcaagcatcaattgaacgcctactttaagcacagcaaggcctcagaaaacagacaatataaaggaagtgagacgcagcaaacagtgagagaataattccaagcccacaggcgagaagtcaattttcaaacagttcactgtgtacaggtccatgctatgcaagcacaggatattttttcataatatataaattgatgccttcaacaatctgtggtggtccatccacacacacaaaaagaaaaaaaccaactatggtgccaagtagtataaaaagttatttatccaaactgctgcttttgttttgatattcaaatatagattgtagtcacaggaagaggaaagatgatagaaggtaaaaacgagctctggagtgagagctgtgtttgaatcctggttttgactctttctagctgtgggtcttggcaacgttgttcactcctgggtacctcatttgcttccctttgtttttgctgaagagtccataaaatgaattgcagagcactaaacaaatcttatttattattatgtagtcttgttgttacaccttacaacacaattgtataaaccatagctttttatgaggttttaaagattgtttgatgagaacctgctctgcatcttgtctttcaccatttctactccaaatcaagtccaagttcttgccactttccttgtggctttgggattccagtctgtttaaatggccacacaccaacctggctatccaggttcttaaacccctatccttcagtgtctcgggaatctctgctttccatggatctttccagatgaaaacttaggagacccctgaagattggaaatgaaataatgtgttttagaagagaatcttgggaaaatatttaacatgaagcaataagctgtatttggatgcctgaagagatccctcatccaaggcacaggacgtctgtatcaacatgcctggctttgtgctgttaacaggtatgaagacagactaggtaacacaaagtgttggcaaagaaagagcagtggttctcaaatgaggatgattttgcctcccctcttctaggtgacatttggccatgtcttgaaactttcgggtgtcacagctggggatgggaggaggtgactgccatctgcaaggtgaaggccagagtgccaatgaacatccatcaatgcacagacagagcctactaccccaacacagaattatctggcccaaaatgtcaatagtgtcaagggagataaaccctgacaaaagcaaaagtaactctcaaacactgctggtgggactgcacactgtacaatccctttggaaagcaatttggcattatgtgatacagctcaggttcaagatgctcacagcctgcaacccagcttttctcctcctgggtaccttcaagaaactcctatgtaagagttttaagaaaatcttttaaaagtcatattcagtattgtttatagaagcaatccaaatttctattaggggaatggctaaattgtggtacatccatgcaatgtgaaaccatctagtagtgaaaatgaatgagctacagttgcgtgtgtcaagagaggaaagcacagaagcagactgactttctcagatgaaaggaactgcagaaaatcaaaagctggggtgatagaacaagcagggtgtccagtgctgacaacagagacagtgatgggtgtaagctttgggctgtgacacacagatgcttctcctgtgttatgagcatgcaagggtcttgcctttaagatcacctgccatctttggtatcagatacccaggtcatttgctggctactatttggccccttagatcccctggtagaaatcctaagccttttgttctcataaaaggaagatatttcactataatcaactaagttgatttcatcatcaacttctcagatcagtttatacaaagattatattattttttggtgaattccattagcattccactagtcaaccaatgtttgagtgcctgctctacgctgtgttccatgtttggtgctttaccaacagtggggatgaaaagtatgtggtctttgttttcagggaccgccagaaaaactaaagaacatcctctggcagtatcaaatagggccctgcagtggaaggaatggggtgaggtccatcagagaaagtctatcagaataggaaacagctatagagaacagaaggatgaaaaggagtcactcatgcaaagaactgggagagaaacattccacagagaaggaaccctgaaatttgagaagataaaacaataatcagtaaaaccattactttaatgtagcatacttcatgtgagtcattttgcctggttcatactttatagagatgcaatcataatttacatacaattttatatcttgctcattattatatcatgaataactttttcacgttgtaatatagtcttcacaaacatttaaatggatgcattatattccctagagtggttaaaacatcttttatttaattagtgttttggggcttagtcattcttattacttgttctttgtccctctagtgtaaagatgaaggtctctctttatgtaacttttccctatgtcttttgcattattgccttaggccagcttttcctaccttaaatttaaacacatatacacacaaatgatgaagtatgtttcattcctgtttcatcttaatcacttttatctttaaaatccttaagcttagagaatagttcacattacccaagccatacaatgtctttcatttcggcacagtcttggactgtctttaaaattcatcacatacataaactgaaaaactgaactacagctaccaaaaaaggttttaaaattgaaatctggttttagggggctgacatttcttgagcttgtgatttaaagtacattttttctttttgtagtctctggcagtcaaccttacagatctcccgtctgagctggtttatgatcagcaggctacattctagatgacaggattacctactaatgtcttagaattaagtaccactaacttgaatcataagcaaattaaacatttcagctcaaatgctttcctgtgactccagcaactttcaggtcttaagattaacaggttgtggtctgtaataaaaaaataaaataaaatcccctacaacttcagcttccctcaagaatccacttacctaagagcaaaagaggtatcctgtgatgggactgaagccctttggtgaaaataaaaagtttaagtgacaacacttagtgtcagcatgacaggttataacccagagaaatctaacccacttggcttactcatcttagtatcactcagggtggaaggcagcataatgatttagctattatttaataactaagataaatcattgaagtaaataatatccttgccatcattaagaataatcccagtgtaagtcatttctaaactacttcacggtgtatgatgcaacaataataaaagcttacgttcacaaagttctttagttcacaaatcatattaatattaacatatttgatccccctaccatacatggtagataggaaagaaagcttctttatcttgtggatattttagagcatcattttcaaggttaagagacctgcttgaagtagtatataatgaagtgaggcaacgaaccctggtctcctgattccaaatcaactgttctttcaactgcaccatgataccctggatcaaagcgtagaacacggattagcttctagttccagctttgacatgaactagccatgtcaccttatacaagtcaagtaactaagcctcagtttattagtaaaatgtcatttgatcacatgatctctgaaggttgaaaattccattttctataaaagaattttctttttacttccatgggaagaaagtgtcttcccactacagattcctgctccccacctctccatccaattattcccctgcaagtatatagatatgatcgattcattaagtcagcttcaatgctataacattatcatcataacagtgataaggtaatattaatagctaattttaagtgtgtgtttactgtttgcaaggtactattttaagcgctttatatgataattcttttaatccttacaatggccctagaacaagctgaaattattattcccactctccagattagaaaatgcaggcctgaagaggtcaaggaatgtgttcaaagtcacaatgccagagctgggattccaactcagacagcctggctcttgagcccacgcacttaatcactaccttacgaatccacattccttgacttaacaatttcacatactttctaagagtgaatttcaactgataacattttttttttttttttttttgaccacagatgttgcctgaatctcactttctggaacagtagcatatgaccatatataaagcccccaaccaacactttccctaatggactattccctgctcattcctgacagaggtgtccgcactgtttctggggttcctttcattatacagactctcaaaaccaaacaggttatttggtaaatggaagagatctattacagtgtggagtcattaaaacagtccttcccagtatccagctcccttccgctttgcctgcttgactttctagagagcccacctcctctttcgagtcagtagagagtcactgagttcaatttgctgcaaactaattaattcctaagaactttgacactagaagctaagaccccaaaacagctcctcctcctttcatcctgagagaaaatatttcagatataatacatacattttcaatttccatatttaaaattcgcttcaatccatttttccccatatttataaggtcacatttgttctttatgttaatggcacagatttcagagccaggagactcaaagtacttctcaaataaagagtgtattcctcactgtgtggtaaaagagtttactcagcttcctctttgaaccatagacagcatttccaccttctaaacgctgtatcccaaatggacaggctgcccctcttgctggacagccctgggacccaggggacatgctagtcgttctccatcactgtccttgtaaagttgtacaaaccagtcttgaaccaagtatttcagcataagggggactatacaggaaaaatataccagcatctgtcagtagcagtgaatgtataaaataaacatcataaagtgggaaaaagacttccaaacaactctcagcaatcttgtctaactatcctgaccttaaaatgccaaagtacactgcagtaaatgggagagcaacatatcaagtgctgtcactatttgccgttccattctagaattccaccacctcgatcttgaaacctccaatcagatgtgctacagtaaatctcccttccactaatcaagatggaaatcttttctttcccaatcaggtccaattgcacagacaaagcagtgcatctgtttccctttcaagacagctcacccaggggatggtggagctttaccgacagaacagctagatggtttgtcatatatcttctcctctcgcagagtgtctctgccatcttttatcagtggttatccagagcttccctttttgtgacaatattaacccaggactgctgccataagcattcagactccacttgctgcctgcagggacttctgaggagagtttatcaagactgctgagcctgatgcttttacgttaaagtggctcccactcgcagttattagtgtgtgcggcgagcccacacccgcacacacatgaggccaactccccacaagagtgctacgcagagcagtagcaatccatctgttttcagttagaaaatacaattgcttttgcacagttgaagaactgatctgatatgaaatgaccctggcagttttgaggtgatagcaaatactctgatgtggctgccaaggtaaggcattaaaggggttacgtaagcataaggcatccctgtgccacttaggaatgtccgtaaagcaataaacaaacagaccaatagacacagaagttgcactatattcccaacttacaatacaaagagcctgcaatcatcagaccctgactttcagaacactgaaatgcttaccttggatgatgttttaaaaaataattttattatgggcatattatattttataattctcagtgattcatacaaaagcaatactctttaaaatggccagaaggatgggcattttaaaagagatgatattagaggaaatgtttaatttcattgcctttggggctccttgtaaggatggaaggcaagattgtgcaacggctgggaacgtgggtgagggcagagtgggggcagatagaactcaaaaaccagctctgcatcttcctagctgtgggacctgggcaagttatttaacccctctgaactagtgcaactgggtgttaataaccacagctacttctctgggttgtaaaaagcttgtgcagatgctgtgcagaaatggtgtgtcatgaatatgaggataatggtttgtcatcatcatccatagtatactatggtttctatcattgtgagttcccaaagaattctgcaatgactgtaacgaagtaatctgtcccatgccttgcagaatcatctctacctctgtgcctttctttattccacactgtgtttgtatttttgccatagaaagcaaagatggagaaaaaatagctagcattccctctaaagagaaatgtcattctgccctgtaacaacaggaacatacacagcctattttgttgaggcattgacaagactccattcacagcaatggcgatgggagtgactattccaaagccatggcttcttcttttctacatttcattccatattgtccttgtggatgtcccatttcacttaagctttctttttggccctgagacatttatcagcatagcctacatgcagatctaccctcccaagcatgccccagcaataactcgtctccagtcctctttaaaacacaaccttctcctggtttactcaggtgacaagcttgctaagtctaataaactgatctagtatacatacatagctcctgatagattaatatattaccatactggcgatactgacaatttttgaagagactatctgaagcaaaatgtaataatctaaatgaattactttctcacgctagaattctagacatttaagcaggtcagtagagagataaagggagcattttgaggcagggtgcttttgaaggcatctcaagttataataaaaggcaacaacctgtttttcatactgtgacatgaaacccacaaaaggagacagttgtttttgtggaatgataaagagaagtaggccattacatgcttaattaaagattcaatccttttaatccagcagaaatgtgacccccaactgagtagaaacgtggtcttcagggaataagcatgttttttttgtttgttgttttgttgttttaatagagaaaagcattaggacaaatctctttattacagggctgaatgcatcctcatgccattggcctccggtggtggtctctgaggtggtctctttctcacccaagagagaggtctggttccatcatgcccagagcactatgtcacatgcattcaacttgccaagaaaagaaagaactcaactaggattatggatgctgttttaaatgaatgtggctccctcttctggtggaaagcctgaatcaataataaaatcatctcaaaggagaaaaggtgcttagcttcttcctctcccagctccagaaatatatgtcaacacaataccactaacaagtgaaccagacaacaatagatccgccgtagttctcatattctgcaaccaaggctaagtggtgaagagatccacaactgagatgcagcaacaagagaagagaaaaagaaatggactttagagggctggatctcttaaaaataagcccttcctataaatatatacatggatatagggaatggagaactaatgctgctttggaaaactactgctaacagaattcttctggggaacaagttaataatgataaaatgtctatttgacatcttgatttttagtgaggtcaaatctacaatattaaaagtatcttccatcacatttcagtaagtcctatggagactctggacactttgaaaacacttttgtttactagaaataatgacttgagccccaactatatacctatttatcattaagccaaaaatgtagataaccttacaaatggcgtaaaatatctatacttaaataaattccaaagcaaagcaaacaaaagtatatgttgataatgcactatgctgcttcctaaataaattctaacaggctgagggttatagaggcctgagaaataaacacggagaacaaaacaaataaccctaacactccaaacagaggagcccagttagactcccacattttgtgtcttaacacttcattgattgttaaattatattcactcctgaatgaccccaatgtttctgcatcacaaatcttgccacttgctggaggctacaacccatatcttttctttttgagactgagtttatcatatctgtttttttgagactgagtttcactcttgttgcctaagctggagtgcaaaggcacgatcttagctcactgcaacctccgcctcccaagttcaagcgattctcctgtctcagcctccaagtagctgggattacaggtgcccaccaccacatctggctaatcgttttttttttgttgttgttgtttttgagatggagtcttgctctgttgcccaggctggagtgcagtggcacaatctgggctcactgcaagctccgcctcccgggttcatgccattctcctgcctcagcctcccgaggagctgggactacaggcgcccaccaacacgcccagctaattttttgtatttttagtagagacgggttttcactgtgttagccagggtagtctcgagagatggggtttcatcacattggtcaggctgctcaaacacctgacctcaggtgatctgcctgcctcgacctcccaaagagctgggattacaggcgggagccaccgtgacgggctatcatatctttatggaagggtttcagtgctggaagcaatgcactgtgctgtcaggcagaaggttcaggttcaggagcactgagggctgcatcctcaagccaggggcaaccagtaaagactcaggtgagattatgtttgatctctgaggagtgcctgtctcctcattcccacgaagattaagtaaagtctttagatttggggatggcaggaggttggggtgggatattgccagagacaacttgatagtggtcatattttctgttctttcatataaagaggtagatttcaactctggggggagctggaagaaagaaaatggctatggaaatactgagcatcattcatatagacaaaaagtctctccttgactgaactccactcaggttattttgaacttttatcaatgaagccctgacttgtgaactttcatgttcatctctccattgttgattttggcaagaatcctgctaagtcagtttagacagaattccccagcctccaaatctgatcatcctccaccatcccccaggtgatgatgtctgatcaccctggcctgtcttcagcaagaatcctgtttggctggtttaccagaatccccccttaccacccactggtccccctaaccctggctcctttgctataaattcccacttttccttgtcgtattcagaattgagcctgaattgagttctatacagaggcctcttgctcccattgcaatactcgagtaaaatctgtttttactattttaaccatggtctagctctggcttttctttgacaatatccacatatgacagatttaccaaaaataaaatctgtttttgccatttagtcatggtctagctctggctttctttgacaatatccacatatgacagatttaccaaaaatctggacactgggatagctataaacgacagatatatgagacatttggaaatcaggagaggggataaacagaatggagagaaggtagaaaaatacatacgctttttttcccccagtgattaaaaacacaaacctggtacaataccattaactgaattaaagtgtttatttgaatttcatcaatttttctcctaatattctatctctgttccagcatcctatccagaatcccatgtggcatttatggccatgtctccttagtctcttctaagctgtagcagttgccaagtctttccttgacttttatgaccttgataaaataccctccagtttgggtttttctgatgtttctcattattggaatgaggttatacattttagacaagtatactacaagaaaaatattagtgtaccttatcaagaagttcatggtgccactagatcttaatactagggatgtttatcttgatggcttacttgtagtaggctctaccaggtctctctactgcgaagttactattttctccttgtatttaacatatatcatggaagagataccttgagactaggcaaattctattattcctcatactttcacccactaattttagcatccatcattatggactcaaggaaatttattttattctacaggctaaaatccatcaccgaggttaattgcattattcattttcttgctcaaattgtaccagctttggttattaaaagctccttttaggttgcattctgtgtccttttgagaaatccccatctatttgggaggcatttccctattctcaggcacaacaaaatattccaagtaacatctttttttttttttctcccccctgctccagctttggaatcaaccatttctccaaagagtcccagttcattttactctacaagaatggtgtttagaaaccaagattggtctctagctgtactctctgtaatgaataacctcatgcgtgtttacttctacaccaccgcagatgcatcatgagggtagatccctaaaccgagactgccaagtccaaagatgtaggtaatcttgttagatgtgactaaatttccctacagaagaattgcaccaatttgcattaaggccagcaatgtatgagtgtctgttttcccacagcatcaccaacagaatgtggtgtgatattatttagttttcaccagtctgataagtgagaaatggtatctccatggtttttaaatttacagttctctaactactgaacttttttttcatatgcccaggggtcatctgtatataacttttgtgaatcatatgtgcatgtctccttcccataattgggtttttctattggatccttgaacctaagattttaagggtttaataccatagacatgttaaccctttcttgtgatatatgttgcaaatacacatttttttgccctagtttgtctgttgtcttttgactttatagtattttttcatgcaattttttagagtttttatataaaatccatcagtcttttgttgcatccagatttgagtcataattagaacgtttttctgtactaggattagagaggaatccagctatgttttctttggaattcttctgtcttttcctctagtacttagtttcatgtactgttcttcacagtgatttgaagtaacagatttttttttggtggtgatttcaaagctgtcagggttatccaaaactttctgagaattgctttaatatctgtactcctacttagaccaaggctaactccaatagtatatatttcacttggagtcactagtaagaaggaattatttgattgaagaattataatcctatctcttctgttccatgtctgcctctgtctcttactctctcgccccacagatgggaaactagaattcaaatgataagcctaattgggttaggagccaccatggaataattcccaacagcccattctttatttgagggtacactctcagctccatataccaaccttcattgtgaaggatgaaggccagaaaccacggtaaatccattcataggacttgcttccccattattagcaccatctgagtctgttaaaaatcttaactaggagtttaatttctctacagagggctttaaattaattagggatgtacatgctaacaaagagcctgatgcatccataaatcaatctggggtaggaggactagtcagggaggatcgtctattcagtggagaccgcatatccagcatccctgttgggttcccaacaaaagggtgcaggtgtggaataggccactgtgacaaggaagccccaataattattttgcatcacttaagccacagcaggtaatatggcaaatcaaagtcccaggcgctcaccaagtgaaacccatgttgccatgaaaagccacatcatatcactttaacctctataaatgaattgccataacactgtgatttattttataccaagcctaagaattaaaagggcattgatcaaaatgatctcctttttccccttttgttaagaatagaaagtaacagatggaaccacttttttttttaatgtgctgaacattatttagaacaacctcggaaattgctggtgtcttttattaaatatacttgctttaaggtttacgctcacatacaattatgttctttggatagaatgttacttatattccattagttaaacacagcactcatttgaaatccactttaaaactgcgtaacaacaactcccaatattcaaacacttccatgtgctagtaacctggtttctagtctttgattagcaaacatctgatgaacaaaagcaaccatggatccttttaaaacaattttgtattttatttgccataatatcatctatatctatatgacagtcatgagtgtatgtgaatgaaacaaaactttttaaaaaatctataaacaatgcccagtttcagtgtggttacagtctctcttgcaggaatttctttgtccatctaaactattcagactccaccccacttccccaactttagggttctgaagtccatatgctagaaaagcaaatacatttaattccatatagggaatattctataattaatccctctttaagctaaaaatgtgttattacataagccctcactaataaagttaagaaatcagtgattttaaaatatgaagcccaaaaagtctcatgatgacatctcaaaagttatcactgatttaagctacattatccaggcggcagatatttaagtttagaaatactggagtcaacactctaagaattttagcgacacaggaggttttgttttctatatatatatatatatatatatactcaagaaacttctgtaaaatgcatgttttccatctctccatccgtgatcacagcgttgtaaggcttacaatgactcaggccctacagagttcacagacatggcaagcaaagaaaagaaaacgaaaaaaggaacactctgtacaaaagatgagagatttaatcacattccctatactgaaggccctggaccaaaccatgaagatgaatgtgggggtgtggggaggggatccagtaatgtactgtccaagccattcatgtgcaaccccgcacagcttcactttacccccttaaaccacacagatgttctcagaatgcaaacatggattactgccagccatgttaaataacccttatcccatatcctgacctaagctctcaccccaactgtttggctactttcataccacaggtttgtaaaactgtggtctatatctgaggtctccactcctacaccagatattttctagtcgagacttccatactagggaggctatcatgaggcaccccaacaacacccatgggagtggtatcagggaaggccatgaagggagccaggacttccatcactgccaggtggtaatgagctccccatccccacaatgtaagtggagaccacctgggaagtctggacttccacctctacccagcagtaatgaagcatcagcccacccccaacaattccccgttggggtggtgtgagaggaggcctggtggagaggcaggatttcatcaatgctgagtggcaaggaggctgcctacctctcctgtcaacgtaggccaagtggatgacaatagcaaggcccttcttcccatcccaataggggtgcagggtagctgtggaagcctagtagggagccagaagtcccacacctgcccagcagaagttcccctttggtatcaatggaggctgataaagaacctggactagtttcccaaactggcagtaactaggcagatcctcccttttctcctactggagacgtagcaatagatgccaggcagagccgaaggtttaaataagaaccagggctgggagcagtggctcatgcctgtaatcccagcactttgggaggccgagcaggtggatcccattgaggtcaggagtttgagacgaccctggccaacatggggaaattctgtctctataaaaaacatgaaaattatccaggtgtggttgtggtgggacaatcctgtagtctcagctactcaggaggctgaggctggagaattgcctgaacccgggaagtggaagttgtagtgagccaagatcaggccactgcactccagcctgggtgacacaatgagaccctgtctcaaaaaaaaaaaaaaaaaaaaaaaaaaaaaaaaaaaaaaaggccaggcgcattggctcacgcctgtaatcccagaactttgggaggccgatgcgggcggatcacgaggtcagaagattgagaccatcctggctaacacggtgaaaacctgtctctactaaaaatataaaaaattagccaggcgcggtggcgggcacctgtagtcccagctactcgggaggctgaggcaggagaatggcataaacccaggaggcggagcttgcagtgagccgagatagcgccactgcactccagcctgggcaacagagcaaggcaagactccgtctcaaaaaaaaaaaaaaaaaaaaaaaacccaggtctctcctaatataaaccagcagggcctaagcatggtagctcattcctttaatcccaacactttgagaggctaaggcaggtggatcacttgaggccaggaattcaaaaccagcctgcgtaacatagggagaccttatctctacaaaaaatatttaaaaattatctgagcttggtggtgtcagcatgtagacctagctactcaggaggctgaggtgggaggatgccactgcactctaggctgggtggcaaagccacacagaccctgtctttaaaacaaaaccccaaaaaacaaaagaaagcaaaaagtaacaaaaataacaggttgagtataccttatttaaaaggcttggaaccagaattgtttcagatttggtttttttttttttttggattttgcagtttgtattacacttaccagttgaacatccctaacccagaaattcaaaatgctccaacaagcatttcctttaggtggtatgttggcactcaaaaagttttgaattttggagcattttcaattaaggattttaggaatagggatgtttaacctatactccaaaagtccaggtttcaattaaaaaaaaatcactcataaaacaaaaaaccaagatctctaagtgaatggaaaaagacaatcaatagatgacaacgagaagacagagatgtttgaattatctgatgcagattttaaagcagttgtgattaaaatgcttcaatgaatagtaatgaacatgtttaacaagtaaaaaccagaaatccttagcaaagaaatacaaagtcttagcaaagaaattaaagatataaacaagaactaaaagaaaatttagtactgaaaaattcagtagccaaaatatacaagtcaatgagtgggctcaatcgtagcatggaggtgcagtgaacttcacagacaaaagaaaatacacagtctgaatgaaagagagaaattcaactgaaaaaaaggaataatgaacagtgtctcaggaatgtgtaggaatgaaacagagggtttcagatttacgtcctcagagtttttgaggaagagaaaagagactgaaaaagaattcaaagaaagaatagataaaaaaaaaatcaaatttgacaaaatacatacagatttaagaaacagagtaaaccccaaacaggtaaacccagcgaactctgtgccaagacaaaccatcgtcaagcttctgagaatgaaagacaaaggaagtcttgaaagcagtgagggaggaatgacaccatacctacagggtaaaacacttgcattaggaatcttggagggcagaaggaagtggcacaccatttttcaaatgctgaaaaaaaaagaatgccaatcccagaatcctatacccagtcaaagtatccctcagtaatgaaggagaaatcaagacatctcaaataaaggaaaactcaagaaaatctgttgccagtagacttatcctaaaagaatgattaaagacgtttttttttccttttcttttctttctttctttgaaacagggtctcactgtgttgttcaggctatagtacagtggcatgatctaggctcacggcagcctcgaactccccaggctcaggtgatcctccccactgcagtctccgtagtagctggagactacaggaacacaccaccaagcctgcctaatttttgtatttttttgtagagacgcggtttcactatgttacccaggctggtcttgaactcctgagctcaggccatccatccgccttggcctcccaaagtgctgggattacagacgtgagccactgtgcctggccaaatggttaaagaaagttttctaaataaaaacagaaatgataaagaagtaaccaactcaaaacagattaaagatacaaatataagacctgaaaccataacactcctagaagaaaatataggggaaaagttccttgatattggtttggcaacaatgtttttaatatcaggcaacaaaagcaagcaaatgaggctatatcgaactgaaaagcttctacacagcaaaggaaacaatgaacaaaattaaaaggtggcctatggactgggagaaaatatttgcaaactatgtatctaataagggattaaaatccaaaatatataagaaataaaataaaaataaataaaaacctatgatgcttatttacacatacacactcaagaaggaatcttggaacatcgggggaaagaaagaacatggtaagaaaaaatataaataaatataatgggtttttattctcatgagtttctaaattatatttcacaactgaagcaaaaacaacactatgtgatatggttctaaatgtgtgtcaaggaaatctttaagacatttacattataagcaggacaggtaaaagggacaaagatttctgtactttacttgaactggtaaaatgatgacactgatatacttcttagttatgtatatataatgtaatacttaaaggatccactagaaaagctacataaaccgatacactaaaaaatactctaaatacatcaaaacagaatcctaaaacatgtttacatgcaaggaaaaaaagcacagaaatgaaaaacggagggaaaaatggaaggcaataaataaaatgacagacttgaattgtaatacatcaataattccattgaaagtaaatgatctaaatgtgctaattaaaatcatatttctctgggaggctgagctgggcaggtcgtttgagcccaggggttcagggccagcctcagcaacatggtaaatccccatctctacaaaaaaaaaaaaaaaaaaaaaaaaattagccaggcatggtggttcatgcctgtagtcccagctacttgggaggctgaggtgaaaggattgcttgaccctcggaggcagaggttgcagtgagccgagatcacaccactgcattctaggctgagtgtcaaagtgagactctgtctcaaaataaggataaaaatgaaaaataaagacagatttgtacttgtacagtggatttaaaaacatgacagacacaagtaagtgctatctacaaaaaactcacttaaaataatataatgatatagatagggttaaaagtaaaaggacgaaaaaagatatatcacactaacattactccaaagaaagctagagtgactatattaatatcaggtagacttcagagcaaagaaagtgacaagagaggtacatcataaaattataaaatggtctattcaccaagaagacatagtaatcattaatgtgcaccaatcaagagctggaaaatatgtgaaatggaactgaaagaactgaaaggagtaatagacaaatacacaattatagttgtagacttcaacactcttctcccaacaactgatagaccaactacacagaaaatcagcaggatacacaacaatagcattaaccaacaaataggatctattcaacatttatggaacagtctacccaatgtaattaatacaaaagtacataaaatacactaaagaaattcaatgcacatcttttctgagtgcccagggaacatttgccaagatagaccatatcctgagccataaaaaactcagcaaatattaaaaatttgaaatcatacggactgtgttctccaaccacaatgggattaaacttcgaataaaaaataagagaccagtaaaatatccaaacacttgaaattaaacagcacacttctaaataatttatgtgtcaaacaagtctcaagtgaaataaaaaatacatttgactgaataaaaatgaatatatgacatatcagaatttgtgggatacaactaaagcaatgccatgagggaaatttatagcactagattcatacattggaagagaagtctcaaatcagtaatgtaagttcccaactcaaaaacagaaaaagaacaactaaatccaaagatgtagaagaaaggaatgaataaatataagagcagaaatcaatgaaactggaaacaaaagcaataaataaaataaatgaaagtaagagcagattcttgaaaagttcaatcaagttgacaaatttctagcaagattgcaaaggaaaaaagagaaaagacacaaattaccaatagtaggaagaaaacaggagctatcactacagacacagcagatatcaaaaggatagtaagaaaatactatgaacaacactgcatacataaatttgacaactttgatgaaatgggtcatttccttcaaaaacacaaactaccataactcacccaataagaaacagataatttccatgaccctgttaataatattaagaaaattcaatttataatttaaaaatccacacacaaaagaaatctccaggcacagatggtttcactagagaaatctacaaaatgcttaaagaagaattaacaccaattttatacaatctctttcagaaaatacaacaagagggaatacttcccaattcattttataaaattagtattaccctgatactaaaacgagataaaggcaaataaaaaaactacaaatcaacatccctcataaatgttaatgcaaaactcattaccagcacactaagaaacagaattcagtaatacataaaaagaattatgaccaaatagaattcatcagagggacatgagaatggaaaaaaatatccatcttatcaacagtctaaaaaaatcaacatcaattgatgtgggaaaaagcatttgacaaacttcagcccattcatgatgaaaactttcagaaaaatgggaatggaggggaacttcctcagttaaaagagcactggccaaaaaccaaacaaacaaacacctcacaaactacagataaatggtgaaaaaagactgaaagttttctcacaaataatgagaacaaggttagactgtccactttcactaattttgttcaacataatgctgaaagatctagccattgcaatcaggcaagaaagcaaactgaagtcatacaggttaggaagaaataaactttctattttcagaagacattgtctatataaaaaatcccaaggaatctacaaaacctcctaaaattaataactatatctcacagaatcataggatacaagattagcacccaaaaatctactgtatttctatatattatcagcaagtatgtgcaaaacaaaatttatatttttatttttattttttttctacttttgtgttacattcagagtgtacacgtgcagggtttttacatgggcatattgtgtgatgctgaattttcaggtatgaataatcctgtcacccaagtagtgagcacagtacccaacaggtagtttgttagcccactcacccttcctccctgctctagtagtccccagtgtctattgttctcatctttacatccatctgtactcaaattttaactcccacctataagtgaaaacacaccatatttggttttctgttcctgtgttaattagtttatgataatggcctccagctccatccatgttgcttcaaaaaaacatgattttgttcatttttatggttgtgtagtattctacggtgtatatgtatcatcttttctttatccaatccaccactgatggacacttaggttggttccatgtcttcgttattgtgaatagtgctgtgactaacatatgaatgcatgtgtctttttggtagaacaatttatattcctttgggtgtatacccagtaatcggattgcggggtccaatggcaatctgttttatgttctttgggaaatctgtaaactgctttccacagggactgaactaatatgcattcacactaacagtgtataagtgttcccttttctcaacaacccctccaacatctgttattttttgacttttaaatagtagccattctgactggtgtgagatggtatcttactgtggttttgacttgcatttctctgatgactagtgatattgaacatcttttcatgtttgttggctgcttccatgtattcttttgagaagtgtctattcatgttctttgcccactttttaaggggttggtttgtattttgcttgttaatttgtttaagtttcttatagattctggatattagaccttcgtcagatgcatagtttgcaaatatcttctcccaacatacaggttttctgtttactctgttgaaagtttattttgctatgcagaagctctttagttaagtctcatttgcctattttttattttgttgcttttgcttttggggtcttcatcttaaattcattgcctagaccactatctacaagagtatttgctaggatttcttccagaatttttatagtttgaattcacacatttaagtcttttgtccatcttgtgttaatttctgtataggatgagagctaggggtccaatttcattcttctgcgtatggctagccagctattccagcatcatgtattgaataggattcctttccctattgcttattttttgtcaactttgtcaaagatcagatggttataggtgtgcagctttatttcagtgttttctattctttctcactggtctatgtgtctgcttttgcaccagtaccacggtgttttggttactgtggcactatagtatagtttgaagttgggtaatgtaatacctccagctatgcttcttttgctccagaattctttgactatttacgctcttttttggttccatatacattttagaacagtttttttttctatttctgtgaaaaatgacattagtattttgacagaaacagcactgaacctataaattgctttgggcagtatggccaactgtaataatattgatttttctgatccataagcataaaatatttttccatatatttgtgtgatccctgatttctttcatcagtgttttatagttctcctttagtgatctttcacctccttagctgtattcctcgatacttcattttttatggctattttgtaaatggggttgtattcttgatttggttctcagctagaatattattagtgtaaagaaatgccagcaattttttacactaattttgtaccctgaaactctattgatgtaatttatcagttctgggagccttttggtagaatctttagggctttctaggtatagaaccatatcgtcagtgaagagagatagtttgacttcttcttttcctatctggatgcctttttatttctttctcttgcctgattcctctggctaggacttccagtcctatattgaataggagtggtaagagtaagcatccttgtcttgttccgttcctcaaggagaatgcatccagctcttgcttgttcagtatgatgttggctgtaggtttgtcataaatggctcttattatattgaggtatgttccttcgatgcctagtctgttgagggtttttatcatgaagtgatgttggattttgtttaaggctttttaggtgattaagataatcatatagtttttgctttttgtttttatgtgatgaatcatgcttattgatttgcttatgttgaaccaaccttgcatctcaggaataaagcctacttgatcatagtgaattaactttttgatgtgcagctgaatttggtttgttaatattttgttgaggatttttgcatctatgttcatcagggatatcggcctgcggttttctgttttcactgtgtctctgcaaggttttagtatcaggatgatgctggcttcgaagaatgagttagggagaagcccctgctcctcaattttttggaatagttctagtaagactggtacaagtttttgtacttctggtagaattcggctatgactcaatctggtccagggctcttttgagttggtagattttttaccactgattcaattttggtgcttgttattggtctcttcagattttcacttttttcctggttcaatcttgggaggctgtgtgtttccaggaatttattcatttcctctagattttctaatacgtgtgcagagaggttttcacaatactctctgaggatcttttgtatttctgtgagattaattgtaatgtcatctgtgtcatttctgattacacttatttggacaatataatttttcttctttgttaacctagctagcagtctgtcaatcttgtttattcttttgaagaactagctcttggtttcactctttcttttttacaattttttttgcatcttaatttcattcagttcttctctgattttagttacatcttttcctctgcaagcttcgggtttggtttgttcctctttcctagtttcctactgccatgtcagattgttaatttgagatttttctaacttcttgatgaaggtgtttaatgctataaactttcctcttatcattgctttagctgagtcccaaagattttcataagttgtgtctctattttcattaattttaaataaagttttttgtttctgctttaactttgattttcacccaagagttattcaggagtaggttaatttccaggcttttgtatagttttgagagatcttctttgtactgaccaagaacactgttgtactgtgttctgagagtgagcctgatgcaatatagatttttaaaaatttattgatacttggaaagcacaatgtaaaagacaatgccatttataatcacacaaaaaattaaaatccaggcatgctggcatgcatctgcaatcccagctactttggaagctatagtgggaagatcccttgaacccaggagtttgagacccacatgggcaaattactgcgaccccatatataagtatacaataaatatttagatgtcaagctaacaaaacatatataagattgtatgccaaaactatacaatgataattagataaatcaaagataatctaaataagtgaacagaaagaacatacttatggattggaagacttaaagatgtcaattttcccaaattgatatttaaatttaatgccatttctataaaatttccagtgagatggccttctttgtctcttttgatctttgttggtttaaaatctgttttatcagagactaggattgcaacacctgcttttttttgttttccatttgcttggtagatcttcctccatccctttcttttgagcctatatgcgtttgcacgtgagatgggtctcctgaatacagcacactgatgggtcttgaatctatccaatttgccagtctgtgtcttttaattggagcatttagcccatttacatttaaggttaatattgttatgtgtgaatttgatcctgtcatcatgatgttagctggttattttgctagttagctgatgcagtttcttcctggcatcgatggtctttacaatttggcatgtttttgcagttgctggtactggttgttcctttccatgtttagtgcttccttcaggagctcttgtaaggcagacctggtggtgacaaaatctctcagcatttgcttaatggtaaggggatcaaatcaacaagaagagctaactatcctaaatatatatgcatccaatacaagagcacccagattcataaagcaagtccttagagacctacaaagagactcagactcccacacaataatgatgggagacttttaacagtccactgttaacattagacagatcaacgagacagaaagttaacaaggatatccaggaactgaacccagctctgcaccaagccgacctaatagacacctacagaactctccaccccaaatcaacagaatatacattcctctcaacaccatatcgcacttattccaaaactgaccacatagttggaagtaaaggactcctcaacaaatgtaacagaaaagaaattataacaaactgtctctcagaccacagtgcaatcaaactagaactcaggattaagaaactcactcaaaaccgctcaactacatggaaactgaacaacctgcgcctgaatgactactgggtacgtaatgaaatgaaggcagaaataaaggtgttctttgaaatcaatgagaacaaagacacaacacaccagaatctctggggcacatttaaagcagtgtgtagagggaaatttatagcactaaatgcccacaagagaaagcaggaaatatctaaaattgacaccctaacatcacaattaaaagagctagagaagcaagagcaaacacattcaaaagctagcagacggcaagtaataactaagatcagagaagaactgaaggagatagagacacaaaaaactcttcaaaaaatcaatgaatccaggagctggtttttcgaaaagatcaacaaaattgataggctactagcaagactaataaagaagaaaagagagaagaatcaaatagacacaataaaaaatgataaaggggatatcatcaccgatcccacagaaatacaaactaccatcaagaatactataaccacctctacacaaataaaccagaaaatctagaagaaatggataaattcctggacacatacagcctcccaagactaaaccaggaagaagttgaatctctgaatagaccgataacaggctctgaaattgaggcaataattaatagcctaccaaccaaaaaaagtccaggatcagatggattcacagctgaattctaccagaggtacaaagaggagctggtaccgttccttctgaaactattccaatcaatagaaaaagaaagaatcctccataattcattttatgaggccagcatcatcctgacaccaaagcctggcagagacacaacaaaaaaagagaattttagaccaatatccctgatgaacatcgattcaaaaatcctcaagaaaatactggcaaaccaaatccatcagcacatcaaaaagcttatccaccacgatcaagttggtttcacccctgggatgcaaggctggttcaacagaggcaaatcaataaatgtaatccagcatataaacagaacaaaagacaaaaatcacatgattatctcaatagatgcagaaaaggcctttgacaaaattcaacaatgcttcatgctaaaaactaggtattgatgggacgtacctcaaaataataagagctatttatgacaaacccacagccaatatcatcctgaatgggcaaaaactgcaagtattccctttgaaaactggcacaagacagggatgccctctctcaccactcctattcaacacagtgttggaagttctggccagggcaatcaggcaggagaaagaaataaagggtattcaattaggaaaagaggaagtcaaattgtccctgtttgcagatgacatgattgtatatttagaaaaccccatcatctcaacccaaaatctccttaagctggtaagcaacttcagcaaagtctcaggatacaaattcaatgtgcaaaaatcacaagcattcttatacaccaacaacagacaaacagagagccaaatcatgagtgaactcccattcacaattgcttcaaagagaataaaatgcctaggaatccaacttacaagggacatgaaggacctcttcaaggagaactacaaaccactgttcaatgaaataaaagaggatacaaacaaatggaagaacattccatgttcatggataggaagaatcaatatcctgaaaatggccatactgcccaaggtaaattatgtattcaatgccatccccatcaagctaccaataactttcttcacagaattggaaaaaactaaagttcatatggaaccaaaaaagagcccacattgccaagacaatcctaagccaaaagaacaaagctggaggcatcactctacccaacttcaaactatactacaaggctacagtaaccaaaacagcatggtactggtaccaaaacagagatatagaccaatgggacacaacagagccctcagaaataataccacacatctacaactatctgatctttgacaaacctgacaaaaagaagaaatggggagaggattccctatttaataaatggtgctggaaaaaactggctagccatatggagaaagctgaaactggatcccttccttacaccttatacaaaaattaattcaagacggactaaagactgaaatgttagacctaaacctataaaaaccctagaagaaaacctaggcaataccattcaggacataggcatggacaaggacttcatgactaaaaaaccaaaagcaatggcaacaaaagccaaaattgacaaatgggatctcattaaactaaagagcttctgcacagcaaaagaaactaccatcagagtgaacaggcaacctgcagaatgggagaaaatttttgcattctacccatctgacaaagggctaatatacagaatctacaaagaacttcaacaaatttacaagaaaaaaaatcaaacaaccccatcaaaaagtgagcaaaggagatcaacaacatttctcaaaagaagacatttatgcagccaacagacacatgaaaaaatgctcatcatcactggccatcagaaaaatgcaaatcaaaaccacaaagagaaactatctcacaccagttagaatggtgatcattaaaaagtcaggaaacaacaggtgctggagaggatgtggagaaataggaacacttttacactgttggtgggactgtaaactagttcaaccattgtggaagacagtgtggcgatccctcaaggatctagaactagaaacaccatttgacccagcaatcccattactgggtgtatacccaaaggacaaatcatgctcctataaagacacatgcacacgtatgtttattgcagcactattcacaatagcagacttggaaccaacctaaatgtccatgaatgatagactggattaagaaaatgtggcacatatacaccatggaatactatgcagccataaaaaaggatgagttcatgtcctttgtagggacatggatgaagctggaaaccatcattctgagcaaactattgcaaggacagaaaaccatacaccacatgttctcactcattggtgggaattgaacaatgagaacacttggacacaggatggggaacatcacacaccggggcctgtcatggggttggggggagcagggagggatagcattaggagatatacctaatgtaaatgatgagttcatgggtgcagcacaccaacatggcacatgtatacatatgtaacaaacctgcacgttgtgcacatgtaccctagaacttaaagtataaaaaaaaaattccagtgagatattttttaaatatatgcaggattattctaaaatatatatggaaaggcaaagctaaaactaatgtgaaaaatgaagaataaagtgagatgaatctactaaattccatgacttattatattgctgcagtaatcatgactgtgtgttatcagtggagggacggacatagataaatgggacccaataaagaaaccagaaatacacctgcatgaataagtccaactaatttttgacaaatatgcaaaagtaattccatgtgggaaaaacagtcttcaaaaaatagtggaaaaattggccatctataggcaacaaaaagaacttcaacctaagtcttataccaaatgtatcacaagctttaaattgaaactgtagatcttttagaaaataggagaaaattgttgagaactaaacctacgcaaatagttcttagacttgctaccagtagcacaaatccataaaagggaaaacctgggcatcatcgaaatgaaaacttttgttctgtgaaatatccatgttaagaggatgtaaatcagttatacactgggagaaaacatttacataccacatatactaccaaggactagtttccagaatatataatggactctcaaagctcgaaagaaaaaaaaatacaattcaattagaaaacgggcaaaaagacatgtagagacatttcaaagattatacacaaatgacaaataagcacataaaagatattcaatgccactaaccattagagtaatgcaaactaaaacgacaatgagatatcaatacataactaccagaaaggctaacaaaaaaacagtcataacacaccaaaggctgatgagtgaggatgtgcagaaaccaaatcactcatacattgttggtaggaatgtcaagtggtacagctgctctggaaagttaagcagtttcttaaataactaaccatgcaacttagcacactgcaatccctgggaattgatctcagagaaatgaaaacttatgttcgcacaaaaacctgtacacaaatgtttacagcagttttattcataaataaagccccaaactgaaaacaacccaaatgtctttcaataagtaaatgattaaaaagttgtggtacatccatatcatggaatagtatttggtgattaaaaagagaaacaatgcttcatgcatacaacaacttgaatgattctccaaagaattattctgagagaaaaaagacaattccaaaagattatatactacatgattccatttatgtaacattcttgaaatgagaatatgatagaaatgtgggaatagattaatgggtgccagagttataaagggcatggggagaaggggaaatggttgtggctatgaaagcacaacgtaagggatccatgtggtggtagaaatctttgtgttttgactgtatcaatgtcaactgataccatgattttggtatagtttttcaaagtgttgccatgggaggaaattgggtaaagggtcctctgggctctctctgtatgatttcttacaacttcatgtgaatgtacagtagttatctagcaatgaaaacatctgttaaccagctagagaaattattaacttttgcaagaagacactttcacttttcaagcaccttaaaatttagtgtattctagtgattattataattttatgagatttataaatataaacactagtagtcggtataaaaagcagcagttcaaataaaccggagaaactcaccatcttatatgcctgtactagcgattcaaccaacatgtaattgtattagaagctctgaggagtcttggtgagtagacagctaactttgcttaactactgttaaactttaaactcagtggagccagagtatttgtagtctctgtgtcacttggatgtactttgtcttttgatatagaaagaaaatttctgatttaattccaaagtatattttaaaagactgtttctacaaaataccaacatattttagtcaaaaattaagcatattgataattttctacaaacaaattggatcagcggctgtgttacagttgctaagggcaagctgacagtgactttactgcttttaaatttaatacacagttatgcacaaatatacattgatatgcataagtgcatatgcgtatacatgcatatacatatacacccgcatatatgatgttctcattagtatgcactcgggtaagaaagtgaaaatttttctaaggctcctttttttaaaataaaaactaatgaaagctagagaaaggtggcactagctctctttgaaaagggtttaaaagtggttatcctatacctgaattaatcactcacttaggctggtgtatttcagtttacacatcatgaagcaatagaacacagattagcaactatgatgtaatcctatgatttttacccaatggctgaaaaaaaaaatcttccaccacacaaagctgttgaaatgcatcttattccacacatacggtaggaacaatacttagcatcaggaaccaacaagtcagtttcctggcttcctgacttcttagtttaattacgtgtaggacaagcacatcctcctctgtgatctcacatctggcaagcacagctctcatgccaaggacactgatgttacgatttttatttctactattccaaggtgaacttctctcctgaatttccatgttcctactatctatccccgtgtttcctatttctggtaattatacacctcttcctataatcttttattttctgcagctttggtcttgctcacttttacacctaatactaaaatttaaattttatataactaaatattggtgctaatcatgtgaagtgaattattttaagaagaatgcattcatattcctgcattcacagacccagaaaataaagaggtaattattatgctagataaaagagctcgtggaagtatagacagatactagataacagattgttcataggtatatatgaaaaaaatattctagctccattgagttaaaatttaacagtagttgagcaaagttagctgtctactcaccaagactcctcagaacttctaatgtaattacatgtcggatgaatcactaatacaggcatataagatgctgagtttctccagtttatttgaaccactgcttctcataccatatactgcaggtgctatgagccaaaggttcatctcagaagcagtaaccaacagtaaaaagccgcctcacttacttgtgcacgaactctgcagtgtagctagagctgtgtgccaggacaacatgaatgatcagatgggcacaaaatcaagacactcaggttatgagctcaaaaattaggttcttctaaaaagtgtggctatcgaaatgacaaaagttaaaagtttcagaatatatgattattaggtgacacagatttccaagaattgagtgaaagcacttttccaggatgtccagagaatagacgaaatcagaatcatttgcagcacaggctccttgacaacagaaagctcttcaaaataagtgtaaaatccagcatacatgtgtcatgctttcctcttaattcattctgtcttccactcaagccactatcaatcactaggcaaaaggtatttggatgaaagttctccataaatactgaagaggatattttccttgtctgggccattgaagaatggcaaagataaggatggaaattaactagtgtagaaatcaagataattacacttgaaaagcagccttattatggatctttggaatatcatgaaaatcagaaattctgaaattgaattttaataataatcagaaaaaaaattgtgacaaatatgccaaggcaattcaacccataagagaagcctcttagacaaatggtactgaaataactgcataacatattgacaggaaaaaataaaacttagcttgtgatatagtgtatctcaggaaaacatggttaccaccttaacaaggaaaataagactgatagagtcaagattataaattttaatgcctgttagagaagtaaagccattaagaaacatacatcaattgaaacccaggaatggattccccggccacccagcacccacaaggaaataaagaggagacccatggcttccttctttctgggtaaaacgatggacagaagagaaggctgccattaataggagttagaagaaaccaggtaacgttttacaaaaatataaaggttcactatgctcgtgtgttggtttagaatccctaggcagttcctctacccacctgccaatgttttgccatggaccttcacagaatcttcaactggaaatgatgggtgagagaaagaagaacttctaaagtgtatgagcttcagtgaccattgaaagctaagagcagggaacaggaacccctgaggtatatatctgggcttccaataagtactaggcaggaaatactggtggctggggatgggtcagggagagctaagagagaattaccctcaggagccaaggcatagagcttcctaaagctggggacaaaagtaagagaactgaggcacacaagcgcttgacatcttcactgaatatactgctacagcctctaatgcagagaagagcactaaggtagaaaggctgggagtagaactaccacagtctgtaccacagaacacaaatataaatcctagacatggaacatctatctaaggattctggaaagtaaacagtagcagtggagaaggaaaccagaattagaagttccgctgaaccagcagtgagcctaccatttttcaccgcctggtatcaccgggtctagactcacagcccaaaactcagaagtatacaccagatgtggacagaataagctccagaagcagcattctttctagtccaaggagcaggaaagggagccccaaaggatcagagaagcagggacttacaatgtttagttttttcctagtttcccttctcttgttccctagccccagaaaaatctgcactgatggtggcagcagaaggatggcactcagatggcaaggtcatcacctaaagctctgaaggagggggaccttgttccttcccagaggagcttcaatcagaagagtaagaaacaaattcctaatacctttttccccctctctatcttctgactgttttgttccagacatagatgtaatcatgagaagtgggcagaagagaagaaaaactaatgttccagctttctagataaaagatcaggaaaggaggctccaatgaggctaaaaatgccagagagctccacaaagagagggaatcatcaaaggagcaataccataaagtcgtgcatgaagtactatgcttgcctctgagctacacctatgtggatctgatcataaacaccacaaagaagaccagagacgagatcacactggcctcaggtagtacacacatggaataaatccaaaaagtattgtgaacactatggaaagtcaggtgatattagagccacagcccacagaaggcaggtcagaacttgaggcctgaacctcacctggccaattgccagctaaaacaaaacaaatcaacattatcttttgaattaaagcaagacaaagaataccataatacaatatccaaaatatccagaatactgtccaaaatcactcaacatatgaagaacagggaaaatctcaactcatgagaagaaaagatcaacagataacaaccccaagatgacacagatgttggtttaaaaaaaaaacaaaaacagggctttaaagaacgaaatataaccttcttttcaaaagaagagcaaacagctgggcatgatggctcatgcctgtaatcccagcactttgggaggccaaggtgggcagatcatgaggtcatgagatagagaccatcctggacaacatgatgaaaccccatctctactaaaaatacaaacaattagccatgttttgtggtgcgttcctatagtcccagatactcaggaggctgaggcaggggaatcgcttgaatccaggaggcggagattgcagtgagccaagatcgtgccactgcactccagcctggtgacagagcgagactccatctcagaaaaaaaaagagtaaactcttgaaaaagcggaaagatagaatgtctcagcaaagaaacacaaaatacaaagaaaaatgttaaaactgaaaaattagagaaagcaaagtaaaatatttactggattgagaataccagaatggagatgatcaagaatcaattaatgtgaaaatatatagataggcattatccaatatgttcaaaagagaacaaaaatgaagggcaataataaaagttatagcatttatatcaacagcctcagaaagacaggagaaaaagtgtggtgcaaacatacatgtatctgaagaaataatttggtgaaagacaaatttgctgattcaagaaactcagtgaaccccaaacaggataatttcaaagaaatctatgtccaaacacatcataaccacactgcaggaaaccaaagaaaaaaataagaatatattgaaaattgccagagaaagaaactggggaagaataactctaatgactgtaggtttctctttagaaatcatggaaactagaaggaagtagaacatttttgaagttctgaaaggaagaaactaccaacaagcttttagaaaataaaacttgtaacaagttttgtttcattgtcatcaaaaagtaaaaaataattaggattcaggagctctatgccaacaactatcaaatattgctgagagatattaagaaagacctaaatgaacagagatttacatcatatttgtggattaaaagattcaatattttaagatgtcacttctgcccacattgatacagagattcaatgctattattaaaaagtcactggaggtagtgtgaggaaattgacaagctgtttccaatactgacatggaaattacagggacctagaacagcaaaaatatcttggaaacgaacaaagttctttttttaaaatcttattacacaatcaaaataatcaaacagtgtggtatttgcaaagcacaaacaaacagaaataaaagaagttagagtccagatattgagttgtgcatgtagagacaaagggttttcagcaaaggaaccaagaaattcaataaaggaaataaattcatttcaaaaaatgatacaaatgtggatatctacatttaaaaaaatacaacttaacccctaaacacacatcatagataaaaattaagtcccaacagatcatggacctaaaacataaaatctaaaactataaaacttgtagaagaaaacacaaaacaatattttttgtaaacatagggtaggcaaacgttcctagaatacagaaagcataaactagaaaaataaatagagttttaatactagactgcttctgttcacctaaagacgccattatttaaaataaatatgcaaaccaaagaatgggggaaaaattgcaacacatattttgacaagagacttatattcaaaatatgtaaagaactcataccactcaatgatttctttaaaaagcagtcacctccctcaaataggcaaaataatttaacaaatacataaatggacaataagcacatgaaaagtactcaacatcttttatcatcaaggtaatgcaaattaatgcctgagatataaatacatatcaattacactggctaaaaataaaactgactatttcaaatgttaacaacaatatcaatcaaccaaatctctcatatatttctagtggaaatgtaaaatggaacagctactttgagaaacagaatggttcattattttaaagtaaaacatatacgataataccagcaatttcactcctaggtatttatcaaagagaaataaaaatatatgcccataataatgacttgcacatgaatgttcatagtagcttaattcataccagccaaaaattggaaaccacccaaatgtataaatgtgtgtatatttatacaatgaactactaatcagcaactaaaggaaggaactacttactaatttatataatgacatgaatgaatttcaacaacattatgctgtgtggaagaattaagacacacaaaaaagcatatagttcagatttcattcatatgaaaccgaagacccaacagaactaatttgatccattcaatgcaattcctatcaaaatcccagttggctttttttttctttcttttttttttttttttttgcagaaatgaacaagctgatgctaaaattgatatggaaatgcagatgcaaagagcttagaatagaaaaaaatctttaaagaaaagagagaacacacacttctcaattccctcaattctaaagtttactatagtagtatttgtgttatttgattactacagtaacctagagagtttgttactggcacacagatagactaatagatcaatgtaatagaattcaaagttcagaaacaaaccttcacgttcatgttaactgatttttaaaaagagcaccaaagcaattcaataaagacaaaaatattcttttcaacaaatgatgctaggatgattagatagccacatgcaaaagaatgaggttggacccattccttaagccacacaaaaaaaataattcaaaaaagaccacagacttcaatgtaaggaagggctaaaactataaaacttttacaggaaaatcttcatgactctgggttagttaaagccttcttagagattataccagaagtaaaagcaacaaaagaaaaaccaaattgaaattcttcaaaattcaaaacattcatgttttaaaggacaatatcaagaaagctaaaagaatgcctacagaataggagaacatatttgccaatcatttctcgtaacagactgatacgtttacaaaaacaactgcacaagaatttcatagcagccttatttgtaatacgccacactgcaaacagcccaaatatctgtcaaaaggaacgtggataaacaaattgtagtgtattcataaagaaacataccactcagctattttttaaaaaccaagctatagttgtccccgcttatccacagggaatatgttccaggaccctgaaaccacatgtagtaccaaaccctacatatactatttttttcttataatacacatgtacttatgataaaatttagtttctaaattgtgcacagttaagagattaacaacaataataaaatagaatcattacaacaatatcctagagtaaaagtaaaataggtgttccttggaaacaagcactgagataccatgatagttgatgtgataaccaggctggctactaagtgactaacaggcagtggtgactacagcgtgaatctgctggacataagaatgactcacatcgtcagacagcacaagatgccatttgatttcatcacgttactcagcagggcacacaatttataacttatgatttacttacaggatgttctactcaaaattttcagactacagctagacacagataatagaaatggcagctactgaaaccttagataaaagaggactgactactgtaccaagacacacaaaatatagatgaatctcaaaaacattaggttgaagtaaagaagccagacacaaaagagtacacactgtaaacatttacataaagttcaaaaacaggcaagactgatacatatattacataaagtatatcaatgattgtttatgcagtggtgggtatgtggctgacaagagttaaaagagaatttattgtggtgataaagatattctatacctggatcagggtgttgtttcacaagaccatataaactcatcaaattagacaatgaagacatgcatttcaccacatgtaagttttacgacaatttcttaaagtaaaatggaaagaaagtatcatgcttcatggtgtcctatgcttctccgcctcatttcaaaaacaacacagagacatagaaggccattccagccacaagaggaactaggagattctgcgcttaagaaagttgaaggagaactacaaaccactgctcaacgaaataaaagagaacacaaacaaatgcaagaacattccatgctcatggataggaagaatcattatcatcaaaatggccatactgcccaaggtaatttatagattcaatgccatccccatcaggctaccaatgactttcttcacagagttggaaaaaactactttaaagttcatatggaaccaaaaaagagcccacattgccgagtcaatcctaagccaaaagaacaaagctggaggcatcatgctacctgacttcaaactatactacaaggctacagtaaccaaaacagcatggtactggtaccacaacagagatatagaccaatggaacacaacagagccctcagaaataataccacacatctacaactatctgatctttgacaaacctgacaaaaagaagaaatggggaaaggatttccctatttaataaatggtgctgggaaaactggctagccatatggagaaagctgaaactggatcccttccttacaccttatacaaaaattaattcaaaatggattaaagacttaaatgttagacctaaaaccatcaaaaccctagaagaaaacctaggcaataccattcaggacataggcatggacaaggacttcaggtctaaaacaccaaaagcaaagataacagaagccaaaattgacaaatgggatctcattaaactaaagagcttctgcacagcaaaggaaactaccatcagagtgaacaggcaacctgcagaatgggagaaaatttttgcaatctacccatctgacaaagggctaatatccagaatctacaaagaacttcaacaaatttacaagaaaaaaaatcaaacaaccccatcaaaaagtgagcaaaggagatcaacaaacacttctcaaaagaagacatttatgcagccaacagacacatgaaaaaatgctcatcatcactggccatcagagaaatgcaaatcaaaaccacaaagagaaactatctcacaccagttagaatggtgatcattaaaaagtcaggaaacaacaggtgctggagaggatgtggagaaataggaacacttttacactgttggtgggactgtaaactagttcaaccattgtggaagacagtgtggcaatccctcaaggatctagaactagaaacaccatttgacccagccatcccatttctgggtatatacccagaggattataaatcatgctgctgtaaagtcacatgcacacatatgtttattgcagcactattcacaatagcaaagacttggaaccaacccaaatgtccatgaatgatagactggattaagaaaatgtggcacatatacaccatggaatactatgcagccataaaaaaggatgagttcatgtcctttgtagggacatggatgaagctggaaaccatcattctgagcaaaccatcgcaacgacagaaaaccaaacactgcatgttctcactcataggtgggaactgaacaatgagaacacttggacacaggaaggggaacatcacacactggggcctgtcatggggtgggggaagcggggaggaatagcattaggagatacacctaatgtaaatgacaagttaataggtgcagcacaccaacatggtacatgtatacatatgtaacaaacctgcacattgtgcacatgtaccctagaacttaaagtataataattaaaaaaaaagaaagttgtcttctaaaattcttgccttatttgaaaatggaacaaaccagtataaaatctccatgtttcctggaagaatgctatctctgcctccggtatctgacttggaataaaagaagggaggaatttacctaaatctaagtgtcggcagtcctggagtcagcaggggttacctggagggcagagtgctatacaaaaagaatacgatctttgggaatggtatttttccttgaaagaatactaggaaaatctaaaggtttcaaaccattccaacttttgaaagatagtttaaagttggactaaatcagctatataaatccacagcattattctgaagatttctttgcaaattcctagaattttatctctttacaagtgttttatctgttggaataaaaaagagggtgtttaatttattaacttggttttatgtaaccttttgctcaacagaagttattgctttttacaatatctactctctatcttttaccttcacagtttatgaccctagtgtcaggcttagacgtgccttcactaaccccagatcataaaaatgaaaaaacatattctctaaaatttcccctaggaaagctaatattttcttctactttcttgtgtcttcttttctgatggtattatggttttatttttaatttcagcatttttatttaaattttctatcagattgatactgataaaatattttaaatactcacaaaatgagacatcagttaataccattcagatttcacaatttttaaacagttttaggatatctgcttcatcaaaacattaaataaatggacataactgaagactcccccccatcagaggtatccaaatttggcgtgtgttatttccatacatgttagatttttttatgttgtttttcacatccgccaagttcacacacacagatcgacttcattttaactgctggatattatttcactgtttgaagaaatcagtttattcatttgtcctcctgaggggccttgaaattgtttgactttctcatttttagaaacagtgctaaagagtaaatctttatatgagccacgtttcgcatatgttagtgattttctaggactgaaacatgtaagtgggattgctgggtcacaggctgtgttttggcttcaagtttactgggaaacagaaattaaaactcccactgacaatgtagaatttccatttctacatatccttgcctactgatgttttcagacttctaaagttttcccaaataaatgggcatggggtgctaacccagtgatgttttgacttacaatgtgcatttctctgaaagagaaatttcaatgtttattggtcatgacactttcctaccagctagctttgcatattttacaagtcttttatttatccaaaatttacttttggccatggtgtttgatagcaatgaaatggtatcatttactatataaattgtcacagcaagccaggcatggtggctcacacctgtaattccaccactttgagaggctgaggctggtggatcccttgagccaagcagttctagaccagcctgggcaacatggtgaaaccttatctctacaaaaaaatttaaaaaaaaatagccaggcatcgtggtgtgtgcctttagttccagctacttgggaggctgaggcaggtgggtcgcttgagcccaggaggcagaagttgcaatgggccaggttgtgccactgcactccagtctgggtaacacagccagactctgaaattagatagatagatagatagatagatagacagacagatagataaagatagatagacaggcagacaaaaattgtcagagcagccttttaaaattgtccattttattctcactaaattgtaattctacttccattatatattcctatatatgtgtgggtctacttcaaggtttttcattctgttctctagtttacttgaatatctttgtcccaacatcacactaatttgctttaccttcaaaataaatcttcaagtgtagtgggacaccatatccttccattatcttcatttataatcatgtcatatgtatttaaacttatatattttcatagtaatatttgtattagcttgccaaatgctgtgaaaaccttcttgggattctcattaagattatactgaaagcataaatcatttgggggtaagctgatatctttatggtattccatcttcccttccatgaatatgccatatatatatatctctttttatatccattaataattttctccatcaatatctcatacatttcttcttagatttattcctatatgccttttttactattttaaatattatagtttaaaactatattttctaagggctgatgattgatatgtaggaattctattaattcattttatatacagcaatcttctaaattttgactaaagattcctttagattttctacttagacaatcattacttgcaaataatctaaactatgctttttgcccagctcttatactacttttcttactccagtagctaggatcagaagtacaacaataaaatgaggcaatgacagaaggcgttctagtctggttatggtttttaaaaggaatatttctcacatttcatcattaagtacaatgtttactaaagattcttagtggggatatcctttatcaatttaaggaaatttccattttttaaaaaaattataaactaatattacattttatcaaatattttatactatgtgtgttgcgggaagtcagggaccctgaacagaggtaccagctggagccgaggcagaagaacataaattgtgaagatttcatggacatttatcagttcccaaaattaatacttttataatgtcttatgcctgtctttactgcaatctctgaacataaattgtgaagatttcatggacatttatcacttccctaataatactcttataatttcttatgcctgtctttactttaatctcttaatcctattatctttgtaagctgagaatgtacatcacctcaggaccactattgtacaaactgattgcagaacatgtgtgtttgaacaatatgaaatctgattgtaaaatatgtgtttgaacaatatgaaatcagtgccccctgaaaagaacagaataacagcaatattcagggaacaagggtgactgcttgcagggtcaggcagaatacagccatatttttcttcttgcagaaagcctataaacggatgtgcaagtaggagaaatatcgctgaattctcttcccagcaaggaataaccctgggtaaggaatgcattcctgggggtaggtctatagactgctgctctgggagtgtctgtcttatgcggttgagataaggactgaaatacgccctggtctcctgcagtacgctcacacttactaggattgggaaattccagcctggtaaattctagtcagaccagttctctgctctcgaaccctgtttcctgttaagatgtttatcaagacaatgcatgcacagcaggacatagacgctcatcagtaattctaattttgccttctccttgtgatctttattgccctttgaagcatgtgatccttgtgaccttctccctgttcatgcaccccctccccttttaaaatccctaataaaaacttgctggttttgtggctcagggttgtcatcatggtcctaccaatatgtggtgtcacccctggagacacagctgcaaaatttctctctttgtactctttctctttatttctcagaccaactgacacttagggaaaatagaaaggacctacagggctcttttgggggctggtttccccgatatatgtgtattgagatttgttttcccctttaatctattattactgtcaattatattaatgatttttccaatgttaggcagtcactgcattcctggaataaataccactttaaataagccttataaatgtgggctggtacacagcaccaagatcttggtttcaaataactctgtccattaacaggaaccaggtgaccttggaaaaattgctgattctaagacgggggtaagaaatacccaagataagcctggagcatcttacaatgccagaaagaaagaagaagtgctaagagaaaaaggaaaaacaacaacgacaacaacaacaacaacaaaaaacaagatgggagcatgtcaaaaagaccaaaagctaggataaattgagccaaaaaataaagcagtactgctttacaatgcaaagtataaaataaataccaatgcagtcatataaataaatgattgaataaataataaggaagaagagacaaacatcccatgcaggagaattcaaaataatttctgtagatattccaccctcaatgaagtggagcatatttcccatgtccataagtatgcgctacacatagtgacttcctcccaaagagtacaggagagaaagggtggtggggtggcaaagagtaactttacagcagagaaatctgacagacactacttccgccaaatgaccaagattcatctcaacagtgacaagctgggccaggtgtggtggctcatgcctgtaatcccaacacttcaggaggccaaggcaggcagatcacttgagcccagaggttcgagaccagcctggacaacatggcgagaccctgtctctacaaaaataacaaaaattatctgggcatggtggtttgcacctgtagttccaattactcaggaagctgaggtggtagaaactcttgagcccggcaggagaggctgcagagagctgacactgtaccgctgcattctggcctgggcaacagagcgagaccctatctcaaaacaaaaaaacagtgacaagtcatgttgataatatatacttttgatatggtgtgataaaaaatggcaatttaactcatggtttacttcccaaaaatatacccaaatctaatcgtcagaaaaacatcagacaaatcccaatgagacaaatgccacaaaaaacctaaccagtacttcttaaaactaccaagttgtcaaaaacaaggaaagcctgagaaactgtcaaaaccaagagaagctttaggagtatgataagtaaatttaatgcgtttcttggattggatcctggagcagaaaaaggacactacagaaatctggataaagcatggacttcattaatagtgtatcaatattagctcatcaactatgacaagtgtaccatgctaatgcaaagtattcataatagagaaaactgggtagaagatacacaaaaacactctagactatatttgcaatttttctgtaataaaaagtgtttattttttaaaagtgagttgaggatctcattttctattttcaggactagtttgcgtaacagaactttcaacagaaacgtataagcagtcaagtaattgatgcaggttgatatgagcatttgtaatatggtaagggtagtaataaaggctgcactgttcattaaatgatgtcgaaaaattagctattaatttggggaaaaatttctctctgatctctacctcatgtcaaaataattccatctgaaatttgcaaaaaattacattaaaaaactataaaagttctagaagataatgagaatgaataccttcatactcttggggtaggatggaccatttttatgcataccaatattgaagacaacactgaagtgttaaggacagaagaggcctctcagtaaactgagccagtgatatttcagcacaagctgaaacaacctcccagaatgaacagaaatataatctcagagagtttgtaaaaaatactgaacagtaagtatgaaaaacggtggtggcatttatttcctggaagaggaaattaagaacaaagaaaacaaatataaaacatctagtatgctgaggaaagttgccaaaaataaagatctgagttaacagaacaaaaaagcagacaaaattgactaaacaaacaaacaaacaaaaaaacagtgaagtaacatgtccaagctaacattacttaggtaactactggtggggatggactttggatccaggctggtctcactttcaagctcgcattacttctacttctacatatgcgctcacttagccattaaaaagaagtcatcttctttttagaagaaaatgcagtgtggtaccctgtactggatcccagatcagaaaaggaacattgctagaaaaactgctctaataaagtcttaagtttaattgtagtagtataccaatgttaatctcttagttttgacaattacatcatagttatgtaagatgtttaatgctaggggaaacagagtaaagggtaggcaggtgtgtaacttttctgtaaatctaaaattatttcaaaattaaaagcttattaaaaaataaaagaaatctcagccaggtgtggtggcttatgcctgtaatcccagcactttgggaggtcaaggcgggattacctgaggtcaggagttcgaaaccagcctggccaacttagtgaaaccccatcactactaaaaatacaaaaatgagctgggtgtggtggtgagcacttataatcccagctcctttggaagctgaggcaagagcatcgcttcaaccaaggaggcagaggtcgcagtgagccgagaccgggccactgcactctagtctgggcaacaagagtgaaactccatctcaaaaataaataatataatataatataatataacataatataatgtaatgtaatgtaaaataaatctctcaaaatgctgctttgggactatcttaaaacttgtaagtgtagagatttattgcataaaaccaaattttaaagaggcatgctttgtattgaagattttgattataacaggtttgttgatgactttaaaaataaatatcagcctcaatttaattatatagcttttctgtaaagactgcttacataatttcttctataccatttttcctttcatgtgaataaaaatataaaaaaaactgtaaacagtagtctctaaatacacatggtgatctagttgtgatgaactgttttccatttctgctacagacgtaacaaaagttctgtgaaacaaaccttgtaacagcaataattaaatttaaaggattaatagaacagcctgattttttaggagctgtcagatactgaaagaatcaggacttcagaaataaatgaattctaggagcagaaaagctgaagcatataattaaatagaaaagtcagaagagtttgactatgcaaaggaacagggagaaatagttactgaggaacagggagaaaaactaaaataaattaatgaaagtcagggctcatggtgtctccaaggaattgaaatgtgacaaatcatggaatgggaagggagatgataagaataaatatgaatagtattaagttcaatcacttaatacttaggccttgttagaagccctccaatggttcccatctctcaaagcatgagtcagggatccgttgagaccttgagggtgcacccattcccccaaccctccctacccccccaaccccatcacttttttctttctcttttactcttcaccttctcccctcactcctctcaagccagccctgcccgcatgcagtcccctggcactccaggcctttacatttgctgatacccctgccagaatccccctcccccagacatccccatggtaaaaactccttcacctacttcaggttttgctcagatactaacttttcagtgatttactactatgcctgttctattttatttatttatttagagacagggttttgctctgtcacccaggctgggatgcagtagtatgatcatggctcactgcaacttctgtctcctgggcttaaatgatcctcttgcctcagcctcccaagtagatgggatcacaggcatgcaccaccacgcctggctaattttttatatttctgtagagcagggttttactatgttgcccaggctgggctcaaactcttgagctcaaatgatcctcctccaatggcctcccaatactatgcatgttctattttaaatggtgagctcctataactaccaaactcccctaccctgctcttttattttctcatagctgcttctatgtcctaacattttaattacattgaatatctgtctcaccaatcactagactgtaagctgtcagattttgcctgtgttcactctttctccagtgcctagaatagtgctgggcacataataaatggtttttttataaacatttgcctaaccaatcaatacaaacgtgtgatttttcattaccataattaaaattagaataatgaaacattcgtaacttttccaaagtcattttttgagcaactgggcttgtccttgtgcctgtgttttctgggtattttctacactgaacttctataatgttttaaaaaggggttttgtctttgtaaaagactagacagctgtctgagatcatttcaactcaagtacattcaatgtcagagtgagaaagaattaaagttcattctttcaaggcctgttcttcctgtgagcttaaatgaaatttagttattacctgaaagagattcatatcacgaaaacttcacacgggcaaatgctcaaaatcatgatccactaagttaaaggaatcacaaaattcccaccttcccattttaaagatgaggaaactgacctacgaaagttaagttacttcctcatattcaactagaacgtcgctgacgaagtggtgagcaggagctagtcttaaacaaaagactgaaacattacagaatgacctagcccatcaacattttgaaatgcagtgaaaagtccagattggaaatgctcagtccaccatccaactaggcctttattttctccctcttgtttccatttcattgctcaaagatgcttgtgaaagtttccttatttatttgtttgtttttgggagacagggtctttggagtgcaatggcacaatctcggctcgctgcaacctccgcctcccaggttcaaatgattctcatgcctcagcttcctgagtagctgcaattataggtgcccaccaccacgcccagctaatttttgtatttttagtagagacagggtatcaccatgttggccacgctggtctccagctcctgacctcaggtgatctgcccacctcggcctcccaaagtgttgagataacaggcgtgagccaccacacccagccgtgaatgtttcttcataccatttgaacattcaagattctttctgcattaagatccctagcaaaataaacactgtgatcaccttcctaagtattttagcatgttcaagggccactgtgccttccagaccccactcaacatttggcatcttactctagccctttgatttccctgttgacagaagtatgaggccagcatattttacaaatgtcttacccttttcagtggatggcctgtcaattaactctcatgaaatcaaatggaagcagacttcagggtataaaaatgtactacttatctaattcttttactgaaagcttgcacacattccattgtttttccataagtggaggaaaaaataaatctggtgctgtattttcgtttcagaagtagcaacagcagttactccacgcatgcattccccaggtccccagacagtcatctctgatgttataagaggcacagaggcagatacttcggcaaagacagtctataaaatgaagttgctatggaccaaaataactgtattgatttttagtacaattcaaaatacaaggaaacatcagttttccaaatggcacaagctgaaaaggacaaggaaaaatatattgcaaatagtgaagagaaggaaaataataaagacaattacattagcaaacatcttggtgttcttttttcagaacactaagatggctgttgtttgttttttaagttcaaagagctgagaggtttgaattatgttgaactgttgctcatttgtggacattgtgcccactgctggaagtctgaccttcagaaaacaaagccttataatccttggacatgtgaacatcttatttaaagcctcatttttttttcaattaatatctctcactctgatggcaaatggcagagctgtataaattctattataaatacatcatttgccaaaatatcattaagtttgctgcaagcaaatattttccttagatatccttaatgaggcaaagtagctttcaagccagagacctctggatgttgtggaatgaggggacggcagtcaggacttaccatggccccctcacttgttctttgggcaacttctcgctgtagtcgggccactgccaacttctccctgaagaaacaaaaacacatgattagttgaccattctcagggtagaggtgacactggcatggccgtgaaacattcttttgaggtctctagaggaattccttccttggtttagctcacttcctcctctatactttctataaatatttaaactgattggtcatgaatgcattgttttcattgagtgtcatgaaatttgccatagattttacaatagccaaataaacgttaaatggtgagtagatgctttgcttttagttcattaacatatatcactcacaaataaatttttcatggctatagtattttagttgacttttctctatcaactttgcttaagcatttttaattatttttatttcttttgttgctctccacaccaataatattaagaagcaaacaaaatataactccttactacttttaaaataacaatagaaaatcatttgcatgcttgctacataacaggcatcatgctgggcaatgcacctgttctcatttgagcctgacaacaatcccatgggtgatttcattatgcccattttatagatgaagaaactgaggcccaaaaaggctaatacactgagtcctcagctggtatatagtagttttttggaatcaaattttagatttccttacttcaaagcctaaataaaaagtctgcttatcatttcttcagtgtgtaggtaatataaaatgtagacttaaaaatcagattatttatttattttagtactccttatttaacaatggggttcatttttagatcccttataattctgctttcacttaaaatatatccaatattcaccaaaatttttagaatacttttgtaaagtgatagatgactgcattttggacagcttttcaattgttctttaaaataattgattagatgtcataggggtaagtgaattcttctggtaatccctaaaatgttagctttagtaagtatttcccctgatattcttctactactatactactatcaagatgagaaattatttgagtgacatttcatcccttagtcttctctttgcccaggatcagctatatgcaatcagctatatgtaaacataaaggatgcagttcaatccccagaaaattttcccactggggaaaagagaagtgaaaacttcttctctcctaagtgcttggatctttgaaatgcctaggactaccaagaagacacgtgcttttgtttggttgcagctgggcagtcttttagtagaaatagttctctctgaataaatacctaaaggcacagactagaagaagggagactagactaggagacattccaggtatacaagttttgggagcctgtggcagcacctgtgagtacacttctaagaaggggcaacagagtagataggaaggagccacaaagggatggaagccatgtagagaggccaagtaatcaaggcagaaagctcctgtgtgttctctgactcaagttctgatgaacagatcaaataagttcaatgaaaagaacaaattaagggaacaaataattgaaaaagaaggatatgaatgaattctgttttaatatgaaaattaaacacatgaatttatctcttctctccccagaaactgttaaaaatgtagtatagaggtaacactggcaaatacttataaagtcaaagaaaacaggagaatcacatactccatactctatgaaccagcaattccactctgagctctaaactgaacagaactatatgttcaccaaaagacatgtaccagaatgttcataacagcactttagtaatcttataagctgaaaatgcacacacccattaacaatagaatagatatgtcaactttagcacagttacatgatggaatactatacaacactgaaaaggaataatctacacttaatcacaacaatgtatggaatactgcaaatatgctgttgagtaacagaagcaagtacaaaatgtatatactttatttcctatttatataaagtgcaaatagaagcaaaactcctataccatttgataagacaagaaaaagaaataaaatacatggatatcaaaaaggaaggggtaaaactgtctctatttacagatgacattattttctaagtagaaaatctgatgaaatttactacacaacttataagtgaatttagcaaagtcagaggatagaagccgatgaacaaaaattaattatattttactagcaacaaacaattggaaaataaaattttaaagcatctccttctaataatgtcaaaaattaaaacatttagcaaaagatttgcaagacggccacactaaaaactacaaaacactgctaagaaggattaaaggagactaatagaaacatatatcacattcatggattgaaagacttaatattattacactgtcaaaatctgtatcaaataaatctataaattcctattcactgatacatataactctaccaaataaagagcaagactaggtaacgagaaacaagaaatccaataaataattggatttttttttcttttcttggtaaaaagaagctcctggacaacagctgtgtaagaatccagagaataaccaatctggactgcagcaagaggatggagagcctcaggaggatgactccaagaataaaacaaagttgaaccaaaataaattacctatgtgttcgtaagtattgagaagagatgtagagttttattttaaagcttaagaacaagaaattggaacatgaaaacgtaagccaatggcaggaagtgacaattattcatgctagtaaaaacaaagttattctagaaatgcaattctaaacttctactagactcagctgtgaatgacatttatcattttaattattaactaaattaatttactatttagtgaaaaaagtagagaaagggaagcacagagaaacagttggtacagaaacactaaattcttatcttccataatagaaagataatacataatgtttaaaagtgatatagaaacagaagttcaggcatataattcagatacaaggaggcaaaacttagaaggtagatctagaagaaggagagtggctgtgtcggaggagtaagatgcagaggtagggaaggcagtgtgtacatcttacagatgttaccattgcatttgatttccaaagtatgtgcatgtactactttgattaaaaaacttcgcaaaacatgtatttttaaaaaccaactggctcatgttatttttattaaaaacattataataatgcattactagaaagataaaggatagattattcaccaaccgaagattcagcatcaaatgactcattgcctcggacctgagaggcacctattgagaagctttggtaaattaaggcaaaataagaagtcactataagcaacgagtctttggacaaacgtttttaagtacatactgcaaacagtttaacatgttacagagatattttaaatttaaaagtttctctttacttttgtaatgaagtataaagtacgcagaaaaatatcataaaagcacaggttgctgaataatcacaaagtgaacatgtccgtattagtcccacctaaacaaaaaaacagaaacactgccagaacaccagaagctactttgatgctaatgataattaacttcctacaccaatacctgaattcacttgccacactcttttctctgtatactgaaacatggagatatttaacttctcatctaaagtatattaaacacattgtctcatattttactcgactgtttattcaatatatttttcctctaaataagaccataaattcctccttgaccacaacagtagcaaccaaaaatgatgatccattcatttttgcaggtggtcagttgtggcgtagttagtatcttactgtaacagccggttgcctgagtggagattatatttagttcatctctttaacactactaaggccccttagtaggaacaaaataaatatttgtgatttgctgaatgaggaatcagttacagaatctaataccaacttgcctggcataacagaattttaaataatattaccatcttgcatttacatagtacataacgcaggtacactgcacacatataccctgattcccacagggtatcctctggttctggttaaccacaaaagcttttttacatacattctaaaattacgaaaagtacaacttccataggccaccagataaatatgtgagtaagcttcaacagagtaaattcctaagtaagagcactgaatgaggggactgtagaacagtaggtcccaaatatttgaatactgagttctcaaatatttgatccttttgtatgcagaaaaactgaggatcccaaagagattttgttgttatgggttattatctattgatatttatgacatataaataaaaatgtaatttattaaaatatttattaaatcaccaaaaagccaataaacccatgccaacataagtaaaacatttttattaaaagtcatcctaaacagtaattccaaaacaaaaatacactttgcaaataaagggaaaaaataaattttgtgagaagaatgatactgctttagaattttgcaactctctttaacgtctggcttaatagaagacacgtgtattttcacatccgcttcagcatttaatctgttatgacagaacatgtcataagacttctagaaaactccactcatggaagctgagtggaaaaggcaaatatcatcttagtgttatgacaaaaatagttttgatcttgcagttcctttgaaagggtcttggagatacccagggtcccaggaccaaactttgagaacttcaactgaaagacagatacggaactaggaatgtaagaatgttctagaaaattgccttgaatcctcattcttaattgttgaagcttcagagaaaggtttaatatatatgttaatggtatgttaatttctcacaagagcagtgtaacataaaagagacatttccaggaacagatcaaaagccaatcttatccccaccatcctactaaatgataaaagagtcctaatacagtgtaaatgttaggaacatcactactttatgcttaaaagagatggcctttataaactattaggactgtcacactgtaatgtgcttctcaaatcttattaattcaatttgaaagaaaaccataatggttttagtcattacatagtttttaaaaaggaaaatactatattaataaatcatgaaattttgtagactgtccacacattatattctttggcattcaataaagaaggaacaaaatgaatgaatcaacacgaatgggctatctctaaaggggcagcattctagccacttgatttggtgaaacagagagtaaaatacataaaaactagaaacaccgttttatatctgacctaccacatgagtggaggaatgcccaaattcaaacagccacgtggaaacaggtgatgcaaacatggaaaatttcagagtagtgtaggccacaggggaggcaatccccaaccccagcccggctgctagccttccgtatcgacaactggggaaattgcctaggtgtagacaactggaagttaccctgactcagggcagctaggtgatgaaggagcagaatttgcaagaacagcaaacacaaatgtcttttggggaccatgctccgtaattgttttaagacatttatgcaggaaatgcaacctattagattatccaacaaagatctctcaggggtccaagggacagttcaggggcctcccatggagtcagtgggcaaagccagtggcagctaagtcccacgacagcaagagcactccaactctaagttattttatatattaggcttctgaattatattcccttttaaaagtgggtttccaatgctaaaacacaacaaataagggattcctcagtaacttgtatattccaaatatttcaagtccttgtgtgtacattttacatcagctggagttttttttttttaagtagaatttgtattttatttttgcatgaaaacgttatttttgtatgaaagggtctttcttttctaaaactaaggaagtggtgaagttcttgacatggtaaaaacttctatgataaaatactcagtatttctagatgttatttctggaatcaaattatcaactcaatcaaaatattaaaaataaatggccctgtctttttcacagaatctcatttgtccttgcgtttagtagttcctggcacgccatattttcaaacctccatggtcccaatatatgtgtgaaaccaattgggactagtatctttttcatgcaaattcacagttcatataaacagctttgtgtagaaaataaagaatgctggatttgcaagctacccaagacaaattaaatacactcacatacacatacacccttgctcccatttaaaggcctcagttcatctgctggaaacagacaactgtgcttctgcaatgcatcactgttttgttttgtttgtggcaaagccagtagctcattatgaagtgggtattgactttatgattgccaaacaaatgcacagggatattttatcaagagctgtggattcttatttactgaacaggtataaaaaaagaatataaagaaaatacaaacgatgaaacaagagaccacagtacttacttctcttacagttaaatgtaaagacaacttttctctccaggaagaatgaaacagagctactcttcttactcaattttatatccaaatggacaattagttccaggtttctaaagcccttcaatatagccccagactatctgaactaaagatcataaacaacattttataggttttatatattcttatatattcttcagaataccactgacacctctgcaagttaagcctgtggaaatagtgttcccaatgaagccaacaggatgttggcattcgtaaaattcagaaaagacctgcaaggtttgcatgtttaaaaaaaaagcattccccaaggagaaagcagcttgcagaggaggaatatattcagtttgtgttatgtggagacctcaggctgcagggtgctacagagccatctgttgcgagagtgtcccagggcatgcctgttgggagacaaatcaatgttcccttgccactcttcaggaagcccaggacttatacccaacctgaatgggagagcatggagatgctgtgtgccccactctccaccaggcagatggtgcccctgtgaggatgccctgatggaagagcagcaacggcacttagtgtaagtgggaagaattatttctactcattgttaagtctcacggtcacaaataccctatatatgcaacgcacttaaaaggtatgaatccagctcacgtcaagcaaactgttaatatgtgaaatactctgtgagttgatgaacatgcaggatgatctgtgtgatcacttgatctttccaggaaaataaagtataacaaataaacatgcttacatatgaatttaaaaaggaaaaattttcttgggcatcttagcaatccaaagtcagtttcctttactgtggtaaagatattgtgatattaaagaatcccataatactctccatacaaaactctaggttcatgttagttttgatttttaggttaagtttctataaagtatttaaaacttacttatgtttatgtattaaatacacctatattggtttttattaattcagaatattttgctaactgaaactatataatccaacaataatggaaatttttatgcattcagcaaacacttaatgtgagtttactacaggcctggtaccattctagggtctgagaaataaacacaaataataatacagttccaaattcaaagacttcaggattgatagacagagaaagcatgcctacgcacatgcctacacacgagtgtcataagacgcagtaagtacaacactctgtattcaaagccagattttaaaacatggtaggtggctattttatcaaaagatcaaatctgaacttcctttaaataagaaggcactttctgctatttctaagattttttcaatttcagacttttcagcaacaaattacataggagaacagatctgtcctcacaaatattttaattaggaagaatgtctatcacatattctatgttattctctaacttcattaagtcttttgaatgcaatgctgttagacttttgttcagcaccatggtctgccactttggtgccaggattttattccaggtcacttctttgagagatactggacctattttacttttgcatttaaaaagataaccataatagctgatatttattgaatagttgctatgtcaggcactattctaaacacttcacatgatatacttaaacctcagagaatcccatgaggtaggtattattatcatctctatgatataaaagttaatcaaactttttggattaagaacccctttacactctgcaaaaaaattactgagaatcccaaagagcttttgtttttgtcagttatgtctattgatacttaccatctccaaaattaacttaaaaatatatattaatttaaaatagcaatagtaattatattacaggttaacataaacataattataaaatatgactataattttcaaaaatataataaaacaagtggcactgttttatacttctgcaaaagtctttaatatctaggtaacaaaaatgacatctggattatcatatttgcttctattaatacattcaatatgctgcaatgtcacatatggagtggactctggcaaaccactgtatactcatgagagaatgagaacaaagaaggcaaatatcatcttagtattcttataaaattctaagtattcttataaaaattcttttaaaatattcttaaaaaataacatcttagtattcttatttaaacaaaatagttataaaaacagttttgaccccgtggatctctaaaaaggtcatagggcccccggaggctcctggtcaacattgctaacatgcagcaatgcctgccttccatggataaatggaggctgctcatgcagactggaaagcatgcctattatcccactgctcaaaagtttaaatatggccattcatgctttaacaaatatgtaaaatagcaatgaatatatatttagctataatcctatttgttagaacttgtgcctctgtagctaccattgcctgttaccactgtctctactgccagtgaggtcatcacaaataatgcaagaatttggggtctccatggacacaacacatttttgaccattttaatgtgaatcaatgggaaaaccaccattacaaatttccaggaacacattgaattccaaatactataaatccacatttttgcagagtagaagaaaaatactaatcaaactcccaatataaacctatgctcaggcataggttttgttgtcagttaacaaccccctccaccccatattgtttccctgtgaagatatcaccaaatgtctatattgaaattagatagatgattactctcatttatgccttggggtacagagtcatacactaaaatcttaaacagaagattcaattaatcatcaaccttccccatttctggtggatcccaagaataagagcccggtggcgatctggtatgcatgtggggagaacaggtttgctcctctgaggaggccaagacccattctctccccacacagaagtgccctggggagtcacccgccgcagaggccatgacaatgtcgagtgccaggtgcacctgtcgtgtgggcagatggggagaccagcgacggcagtccctgagtaatggttaagttaattagcctttccatggcagatcatttaattactcatcccctctgacagggtgagaggagattttagaaaacttttagagccgcaactcatatgaaagaaatgtctttatatacttttttccaatacgtaacatcactgttgcccccaaaactttaaaacagcaacaaaatcactctgattatatgctttaggagactctatcaacatccataaagcataaaagtcggtaagtttagagcgtgttctaagttgtggatcttcacaggattttgtgcagtgaggtcagtcagcaggaaactcaacaggactggcatgtaaaactcaccaacattggaaaagcacaagactttaataaattgcactatgccaattaaggaatgtaccccaatcctcccaaaaattaacacagagactttttaaagaattcagtgtgttggaatacagagatagttagtaaacacaaactaacaaaaatcctaattttagtggcctgactttctgaaggtgtgttatccacaggcttgtccttaactagctttctggagctcctggaaaataaaacgtagccctctacatccttatcctatatatgtattctcaaaattgttcttctgctctcaagaacggtgcctcgaatgacacccacattttcattcattcgttcatttatccatccatacagtcactcatgcagtccatgaagtaacaagtgccttcttacctatttatctccttagtgggaggtaagtccctagaaggctgtgactttgtggtctttctgcatccagagcacaaacatatccttaataaatgaacgatcatgcttcagaacaaagatggtctcactgacttgaggcaagattacaaacgccttcgctcatattcaatatcagaaactaatcgcatgttccagatcttgacaaaataagccaataaaaccacacaagctacctgtactccctactacaacagtcatatgtgtagcattttgtacattttagatgctccatataatattggtagtaaatatccagtgaagaagtgcatttgtccttctgggttttctcctttttatttctacttggaactgtgagctttcattagaataatatatgctttcatcctcaaatttttgataaagttggaagagcctgaatttagcacaatactgaattaaagtaacccattttctcctcctcctctctggtacagagtgaaatcccaaagcactcctacctaaaatgtttctaaaatacatattagagcaaaaattcgcctaattttaatacagatatttctaatcttaactcttgcaattacttcttcctcgagtgtaaagtcaaacacttcaaaaaaaagctttccttgagatatatacttcttataaatcattgaagaaacacttaatttcttaattattgtggaaaatctaggtttctgaatgggtattccttatgttgccacgctctctaagaaacttggaattccctatgtttccaggtatacccctgcctctgcaaccccactttgccaccctgatatttcttctttaaattttaaaattccactaaaataaatctaggtttgtgttatgtctgacaattaagacaaacttttaaaaacaacagaactttattaataatgttcaagttgttccatcaattttggtaacattcaaaacagatgaactatatgtagcttaatatggaaagggaattcttgagggaaaaaaaacatgctaatcaagcatgctaatcatctcctaaggagcattacatacctgtggggaaagggggtgacgatagcccttacatgacaactaatttagttttcacgactttcaattatctatgcctctgaaatctcattctgtctctgttttgacaacggccccaacatagtatctgtgaggaggcttgagccatttatctaggctcagaaaaagaaggtttgtgagttccaaagggaagagttgaaggaggtactgatggaatccctgatggactgtcacacaggaaagtttatacactaaaacattccttcatttgtggaatgatttacacacacgagggtgagttcagctcaacaaaatggtggttttattatcattatttttttgagatagggtctcactttgttgcccaggctagagtgcagtggtgtgatcatggctcactgcagcctcaatctcctgggctcaagcaatccttttatgtcagcctcctgagtaactgggatcacaggtgtgggtcatcatgccctgttcttttttttttttttttttttttttttcggagtctccctctgccaccaggctggagttcagtggcgcgatctcggctcactgcaacctctgactcccgggttcaagagattctcctgcctcagcctcccgagtagctgggactacaggcacgtgccaccacatccagctatttttctgtatttttagtagagacaaggtttcaccatgttggccaggatggtctcaatctcttgaccttgtgatccacaagcctccaaaagtgccccagcctcccaaagtgttgagattacagccgtgagccacggtgcctggctgccacactcaatttttaaaaaatgtttcttagagacacggacttgctctgttgcccaggctgatcttgaattcctgggctcaagtgatcctcccacttcagcctccccaagtgctgggtttataggcataagccgccacaccgggcccaaaaaggtggtttttaggctaaattggaaatgctatcaatctattccacaaatattatgttgcttactaagttggaggggctttgctaggctctatggaaactacaatgatgagtgagactcagttcctgcagttacagagcattcagtctcagaaaacagataacacacctatggttcagcattatgagttggaaagtgtcccccaaaaatgcatatattgaagtcctaacccccagtactacagatgtggctttagagataggggcctttacagagttaatcaattttaaatgaggtcactagaatgggtcctaatccgacaggagtggagttcttaaaaaaagggaaaatttgaagataaacacacacacacacacacacacacacacacacacacaggaagaacaccatgtgaagatgaaagcatacattgaggtgacacttctacaagccaatgaacaagaaagatagccagcaaaccaccagaagccaggagagaggcatggagcagactcagaggcaaccaaccttgtcaatgcatcttggacttcagcctccagaacttcaagacgaacttctgttgtgtaagccacccccatctgcagtactttgttacagcagctctgacaaactaatacatccagatatattttaatataaaatctatcaactatgtatgtttgtacataatccatctctatacaaatatacatatacacatagcctgggaagatataatgggtgctccaagcaaagtgtgatgtattttgggcagaaggagtatttgattccgaccaggagaatcaaggaaaccttcatagaggaaatggcagtcacattttacaaaagttaagagcacaaaagtcagatgtcaaatatgaaaatttataactctagagttataaaatctttactgcaaagtgggtttttttccaatctaaggaacttcttcaacatgccatttctcaagagttgaagatgactatatgaatgattcaaatggcacacttcatagctaaacatccacaggcacacataatctcagccatagacatttttggtatgtccatcttcatattctttttactaagtctactgctatgcccagtataagatgctacctcagtgctttattaggggaatattgacttagttcatattccagagtggagacggtttgcaaacacatgtatatactctctggctgccccattattggagcatatgttggccacttgtgggtgtaaggagttaggtgacctgtggtcttgaaactggtctgcccataaccaagccttcactaactcaggtctctacccaactgagccattattaaacctcaggagcactataaatttactgacttttataaaccattcaactaaatagccttctctaaagcatttggtaagagtaatttgatgctctgatcatctgccaattcattttatgagtccataacctaacagaacccatctcactttcctttcagagtcattttcatcattgagctttgtatcctgtttagattcttcttttctaatcttttcaggactgtatgagttggatttctcctggttgcaagtaacagaaacaaacttcaggtacaataagaaaggggaggtatttattgaatgcggtatggtatttcaggaggaactgaaccaccaaactctaggagaagcaagagctgggtaagcagcaggggtctctgcagcaagaatttatataccacttggcatgacactccaacgatgccctagttgagctctggggactcttggtttctattccatcagttccacgttttaattctctggagtaagatcctgattggcatagcataggtgaggtacacaccctgaagtgaccagctttgacctgggagcagggtcatatagcacagtcttagatgtggtcctgtcccttataggttgggggcagttctaagagaaggaaataattgttagagtctaccacatgggtcgaaaatttatacttctactataccatcctttctttgaaaagcactttttatatatttcttaattaatccttacttggacctgtagcaaaaaaataaccggatctctttttgtttttggaactcaatagtttttgcatccatttcaattatattaactccatttgaggtatgccattaaataccttactaacattgagcctacatcttgttttcttcatactatcttgaccccttcctagttattgtgacttaacaatttatattaagcacattcttcattcttccctctacaacacttaaccagcttaagtctatatatttctgtgtattcccactgtcaccaccatcagcacgttttatactgtgcacattcctagaaaagttaactatgaaacactgtgtacatgttcacaaaattgtataatattagagccagagagtacagtcttaggaggcacacaaacaaatcagaaagtatctttctgttctattcctatccttcacaccattaccaggaagactgttcaaaataacaagatttcaagacacagacccttttaaaagaatgtccattgtaaaaatccagagaataaaagagaaagccagacttccctatattctttgtaaaaaatcaaatcgtgaccaaatgtggacaatattcaattagtacctgatttgacaagtagctgaaatcaacaataaagtcaacaatgagaatcttcagagggaaaaataaaagaacctaataacagacagcctagaatcttaagagaggtgaaatgaatggaaccaatctgtaaaataatatctattccactacgtaaaactctgaaaggaagaaaaaattcttagatgtgtaaccacctaggacactctcaagagaggtaaaagtgtttcagaaaacaggaaagcaattggtgggcaaacaacaggaaatgtttttgtagaaaaaaaataggataacaaccaggcaggaaaattctgtcaaaacaggctactggaaactttctgtttatacataaataaatctaagtattcataattatcatctatttcactgacacagtgagagagaacaaaataagaaatgagggcatttcttgtatcttaacacaagagaggggaaaagcaaatagtgagttcagacacagagccaacaaaaagccacttcctaaaggatatgagatacccatcgtgcccgaaggcagatgatagctctggtgctgagcacagtctttgaacatattttgtttacatttaagataaaagaggataatgataatgatgaacacttataaagtaattacattccgagtactttacgttagttattaacttgtttaatccttaccccaaccatgacgtaggtgctattattttccccattttacagatgttgaaaataaagtacagagagattaagtatcttccacaaggtcccagagctacacctggacacaggcactcttggcaccaaagtcctcattcttaaccttaatgctatgctagcaacatgattctagctggagttatgatttttatattacatataattgttcagtaatccggacacacacacacaaaacctccatgaatttcatgggaacctctcaaaatccattttaattcatcatgggagtcagacactgttctgcttgagttcagactcccagctcttccacgtaccagctcactggctagggaaagttactcacactctctctgtgggagtgtatctttatttacaaacacacactgcccctttctgttgggaagattttacttccccaccccactgatactagacttggcatctcacttgttttgagcaataaatcatggataaaagaagcacacataacttctgtgcagaaaacactaagagccagacaagatctgccatgttctctcattatgatcagcaatggtcaagaaggacactggcctgggtcctgaagtgcatataccttggagcagagcagctgacccaccacaggcatctggtgggcaataaggatgccactgtagttataacccactaggatctggaggccatttattaccataacataacctcctctctccactcatatactctctgtgccttaatgtcctacctccttctagcgttgctgtgggcattaaatgagttatttttataaagcatgtagataagaaacaaagtatgagtgagccagatactaacctgaagagtgcaattagagaaaagaacactagaggaaacattaccaatactaatcaaatcaaatgcttttctggttctcaaatccttttgactgagttctaatgttacactggtcaccctgagagctttttgcaaacttcttctcttcaatgctcccttcttgatccagtaataacacatttatttacatataattcagggctttactcttgctgacccaaaggctccagacagctttccttctgcaaagtttggttgtttacttagaccatgaagatattcctccttttcccattttcctcttttccctcagctatctttttctgaaaccgacttcaacactagtttcccatatgtaggaggcaattttagtgagatattaataactggtatctctttgtttttacaggtaaaggattagaaatcactgtgacaagtttgtttcttgagtttttacaggcttcaatttgctaatgtacaaaattttataataaagcatcttaccaattaatgttccacacaaatggtttttaggggatgctgctgccaaccattccaaatatgttgtaatgagcagatagcaagacatctcatgcccaagggaaagatattgtgaggctccctccaaaccatcttataaatcatagactactacacgaaggtcttcgagaacaataccctcattttagtgacaagaaatggaggctcaaagaataaagaatggagaaaatggaggctcaaagaggttgagtattttattgagaaaaatcaaagtgagttaaagagtaaaactgattacaacagagtcatccatggattcaaactagtcctctttccagggatgactgtgtttaaaaggaaaacacatggaaatatgagtacctctgtctagactaaaagacatgtttaaaaccaatcaacatattcaccctttgttacctaacatcttactgggttttaatctggcccattcacaaaagtcaaaggggttactagggaaggtgacaattaacagagcccagtttaactacgctcatgtgtgaagcaggttggaagggatgaatcaggatctaggcttatctaaactaagatataacacagacagcaagttactcctgctatcaaaaggctttatttggtacttacttgctgtataaataactcactagctatttgctctgaaacaacaatgattagaatggctctcatatccaacaaaacactgaaacaggcaacagacagggtccatcaaaaaaaaaatactaacggtacctatgactgcttttcactgttaacagtggcaaataaaaccaaaagttattctgcacacttaccactctcatgatctctaaatttgcttgtctgaaagaaatgtaccaaagattaataaatcttacaagaaaacaaatggaacatgtaaattgctgaggagtttgttccctttaattttatgctagtcattttccgaaatccagaagaaagacatttgctaaagctttgtgtgtcttctagcaaaaatcacttcgcatgtaactaaataggtacagaaaggacacactttttaagtgtataatgataaaactcagatatgtagtgtatgtcattctcgatcacaaaagctgtgtgggttttctctgtttcttagctaagttctcctgtctaaaagacaaaagagaaaacaaaaccaaagagaaaaggattctgcaggcatctatacacaagaaaggcataatattcaaaagtcacagagccaagcatggcagtgagtctgtagtttcagctactcagaaggattgcttgagcccaggagttcaaggccagcctgaacaacatggcaacactctatctctaaaaatatatataaattaaataaatgtttaaaaatgttttaagtcacaacaaagaatggatattgtcagagatcggaattccatttaaaaaatatatttctgctttggagaagggctcaagccattgaaaagaaaaagaaaagcactaacagacaaagttaggaactgaaatacatttaaaaggtcaaagggaaaacaactagaaatgtcctacttagtccaaaaggaaagaaaacccagcaacaaacagggactctcacaaatggagaatgtctttagcacaatacaataagaccgttgtgtgtgacaccttgataaattaaagaaacagaaacactgtcaccaaaagaaaaggaagaaaggaaggaaattcacaaatagtgcccacaaaagatggataagaaagttttaagagaatatgagcactgattaaaggcaagcaagaaaaacaagataggctctatctagctaagcccctactgcacaagcctattgtcttatttcctttggcactgactacaagagaatttcatcatatgtctaataatagtattatttataaaatagaagaataacatcttgataagaatatacctcaatggcaaaatgtctccttctatataatctgagtgtatagatgaaaaagaaatgttttcaaagtaataacaattacaaggcaatcagtgaacgagataagcacttgcagaaggagccacattaaatctattcaactgactggcttctgtgttatgtgagtccaagaatggataactgctgctccctggaaaaacctgcagtgctgtaaaaaccagcccatgccactgtgtctgtgggacgaggaaaatgttaaagaagcaatagagacaaatgggaaaggctgacaacacaactccttatacttcttaattcagcattatattcattgacctattacgtataggtcaatatgaagaaaaaggattttagaaatcacacactcacagatatggtccctgccctccgaaagctagaagttgttaaacactactttggtcattgaccttaccaatacccattttatgcaagcataaatagtgtctaactctataaagttatgttcaacactggccagtatccctatattattttgctgacatacatacatattgcattgaaataaaaaaatcaaaagagtattttcacaagtccgagtttataaacaattgaatatattcatccatatataaacatctatattctgctgaatatagatgcttcctatttcctagtttcatatacattatatgtataacttaactacatttaaataccaattttatataccaagtgcagcctgatgagctatttcaaagcctatgttgacaatttgctagagttgggaaaaaataaaataccttcaacataattagctggtaagtaccacattaagccatcactgtgtagctgctactattctacatgcttttacatgcatcgtcttattgaatccatacaaatctcttctttttatagatgaggaatcagaacttccaactgagcagcccacactctaaaccactgtactatataccccttctccccacatacctacagaggcgatttctttggagcctaatatttgttggctattaatggaaattttactttgctgtggaaacacgatcaaaccaacaatgactcaaatcattgaagaacccatcaggactatcgaaagaagggccagacaaccagactaaaacctgggagcaaacacaggctccaaactgcagcagataggagcactcctcatgagagcttaagggaggatcgcatgagagcttaaggagttcattttgtgacagggtttggccagaagtgccagaatgtcaggaagggagactcttatgaaggggatttcaaggctggtcatcagtggagagaactggatagaactccaatttctgaaaggtctgatggccataacataagtcctttagataaacaaaagtacactgcagaatttcaagacattcacacagcatggagcaaatcagcaacaaagatgatctgaacacattgcggggctcttacatttctttcccaataaaactcataaccattaaacaaaatgtactagtgtgctattctgccaaactatgagaccattagttctctggaccctgacaagtctgccttgaaatacggcagatctaggtctccacaacactgattctccatgaggaataagctagctcttggaacactaattccagtactgaccactgtatgttctttaacatgtcgctcatatctggagaagtgtgtcaggaacaaaatataaaactgttcgcagattttctgactttgacctccatctctcagttctcggctatgggctaaactgtatgcattctttataattttccaggtgcttttgaaagaaatgtagttcatcctagagggtgacaagagaaggctttatgtcaaattttacttttaaaatagttacctaaagttttaaagactgactttacttttcagaaagatgaaaaatgttaaggaaagaacaaagaaaaaatacatttagacacagtaagcaattcattcttaagtaaatatttatataaataagtgtccctcagtcgagacttatgaccctggttgttaattggccttaagacagaaattcttaaggccagttaacaaccagggtcataagtctcgactgagggaccccatccaactcagtacatcctcaatgcacgttaggtccttggtagagtctcatggaactgaagctacttaacatctgagtcttggattccttatcttcaaactctggtgataatacagtcagtcttcattactcacacaattataaattggtaattccacaattagaaattggtctgctcactcaaatgtatttgcaaccccaagatcaatactcatgatgccttcactgtcccttgcagacttgcacagagcagtgaaagtgtgagtgaccaatgtgcacattccaaactgaggtcacgcaaggggtgacgctccacagctcttggtgtccttttcgtgatctatttagtgccactttttgcatgtttgtgctttctgttggtgactgtattgattaaaatggcccccaattacagtactgaagtactaagtcctcctgagtacaaaaaggcaggctgggcatggtggctcacacctgtaatcctagcattttgggaggcagaggcggtggatcgctttgagcttaggagttcaagacccagactgggcaacaaggcaaaaccccatctctacaagaaaataataatgccagaaagtggtggctcaaaatacaaaatacaggctgggcacagtggctcatgcctgcaatcccagcatgttgggaggccgaggtggcatggatcacctgaggttaggagttcgagaccagcctgaccaacatggaggaaccccatcagtactaaaaatacaaaattagccaggcatggtggcatgcacctgtaatcccagctactcgggaggctgaggcaggagaatcacttggacccgggaggcagatgttgcagtgagccgagattgtgccatcgcactccagcctgggcaacaaaagtgaaactctatctcaaaaaaaaaaaaaaatgcaaaaaaatggtggcttgtgccttggtcccagttactctataggctgaggctggaagattgcttgagctgggaagtggaggctgcagtgagccaagatcacatcactgccctgcaacttgggtgacaaatcaagaccctgtctcagaccaaaaaaaaaaaaaaaaaaaaaaaaaaaaagctgtgatatgtcttatggataaaatgtatgtgttagacaagcttcaggtatgagtcatagtgctgttggctatgagttcgatgctgatgaatcaacaatacatattaaaaaggagtctttaagcagaaacatacataaaacaccataaggttatgcactgatcagctaaaaaaccagagccagaggctcacaggaatctaaccctgtattttccttaggagcaatggttcagtgtttaaggtgacttcatagaacataactactatgaataaggagaactcagcatatataccctaccagttgtttttaggttctgaaaaaatatacaggttaatgacctgtgaagtgaccagcataattaggaacgcaagggattttacctacctataagtaaaaggactgttctcttaggtgtctgacaaacaccacaactaaaaatatcaaactgagatacagcatatttcatagatgatgataggaaaaatgaaatttcatttgaatgtatcacttaagtcaatacattagaagtgggaaatattaagatataatttaaaatccatcaaaaggcatttggattctaaatcaggttaacattgttagacaatatgctatcaactctgctaattagaaagtcacagccttttattcataagccttcaagtaaatccaattaaaatggaagttcaagcttgggaatctcagtcacaggtctattacctctataggcttcaattatgaagctgtcccgaaagtaggaaacacagggtttcaactcaaagtccacataagagtagaaattcaccatttacattaggtatatcccctaatgctatccctctctcctctccatgtcaagttaacgggtgcagcacaccaacatggcacacgtatacatatgtaacaaacctgtaccttgggcacatgtaccctagaacttaaagtataataaaaaaaaaagagcgaaatctctgtatcaaatttaaaaaaaagagtagaaactcaccaagaaatgctcctattggctgaatctagaaaatttactttatgaaacatcagtgcattgcttattttaaaaaaaagctgtactttgataccttgattaattatgacaaattattatattcctaagcagagatagattttttaattttgtgtacaagtataacaaagtaaacccttgcttgatggagttaagaccactttaatccagatctccttaattcagaaccaagaacctagacaagtatttctttgttctatgaaaatataagaataaaaggatagcaaaagaataagtgacattaaaaaaggctaaagttttagaacattgcattaaaaactgaagaaaaaacttcaagactttgaaagcacccatttacatatgactttatttattcattcaatattcattaattccacacacacttattgagttctgctctgggccagccatcagaaatccccaggagaagcagatactgaacagcctttctgaagctcacagtctagtaggtgagacacacgtgtaaacaaatgcactgcaccgtgataaagacaattgaagatgtaactgcaaagaaaaatgttactcagcagaggctgctgctttgaaaataaccctttaaaagatgtctcacctcagcattgaaggctcctcctggggacacactttactaactcagctctagttaataggaaaactgcaaaaatgatgcagctacaattctctggaggtaggagggaaacctcatgcactcagactggattgtaccagcacctctccccttcattctcaagtcacttttgccacccaaacctcaactaatggaaagtaaccaagttaaccagaaggtgaaggcacgggtcctgcaggaggtgtttctggctgttacaagcacgggaaggaaagctccaccactgtggccaatgaaaacttgtcattcgctctcatgcaaaagagaacacaacttccatcacttgactaagccagaggttaactcacttagtcaagtgatggaaagtttcctcactttagtttttctcaaaaaagtgacactttaattatatgagcacacctattttatcctttcttacctccccctctacttataaaacaatatatctgtgattctatgtcttttcccaggtttagaatctgagtggctcatgtgcttgaggctcctggagagaaatagaatcagtggatagaactcaatctcccacatgggtcatggcgaaggcagtggcttcaagcccagcctttggtaaagtctctggtagtatcactgccagggccacaggaccgcagagcctatagcattctctctatgactaactatagaaggctctcagtcttgtggatgagaaagaagctccttcatgaaatggcttgtctccctgttaaaaagaagacacaggcaccgttgtttttgcttattttttctcactcagtcagtaccatccagtacttacttacatttgtctagtctctcctaaacgacttctggaaaagactccaaaatctttttaagcagccccaactagctacattccagagcaaagcattctttatttataaatgaaagggctcagcagtagcttctagccttatctcactcttctctagacaagggggttccatgaagacatgttccacaggtaggtttgaaaaaacatttcaagtatcaggggccaaggtcctgcttccagttcctctaccacataaatgtttagtcctacaacctgtctggtcctggttttctcattacaaagcaagaggaatgaatgaaagagggtctgtaaaatccccttcccattctctcagtctgtatgtaacctggtaatatatcttctattccaggttaatagtgaaccccaattcctttatgaggtccttatgttatacatacaatccctaatgttaaaacaggatttaaaatactattatacagtccatcatgttggattcctataaatatgggtttttcatacttgccaatcaaattaattagccaaattcacttatcaaagtccatttaatacattatgtgctggcatcttctaaaatatgttcacttattatgtttactagaaagaatttttaatgagcagctgcctcaaaattaattaatgtatatagcttccactataaagttacaagccaaatcccactaatacaatttcagtgaatagctcagactgcaaaatacagcaaaactccaactgctagcccatttatttagagaagcatgtgaatcaacaaatttacaagagcatgaaacaagcagttatgatattcatgtagattttgagtactatattccgtgaaataccacaacatggaattctagcaaatcaaggaaactctattggtacctcatatcttcctgtatactctatacaggaagtagaaatacttttctgttatagaactagactataggaaaatcaaggtatttgactgtaccagctagattctgattttttctattctctaaaaatctcacaccaaagaattattttacagcccattaactgatttccttcaaatcctgctaccttttatttatactctgtttatgtgctaaattctaaagagtttctgaaggaaactaaagtaggttaaataaaactgaaacactgctttgccaacattttttaaaaatcaaagtcaggtgtaattaaaagaaaatgattatacagcttgctagcacttgttccatttttaagaacaaatgttcagacttacctaggggatgtttccatctgcttctctcagtttggtttccatgctttagctttaactattatatgtaggcaaattaccaatgtctgactatctaacaataaataaccctggccttatttttttttcaaataacccttaccaaaactgaaatcatattttctcaaatcatattttaacagctagtcttacattagccagaaaggagacctcaccatcacaatttggagaaaataaacacctcattattgataacactgtctagagttgcgcattccggagttacgaacttagccaccatgcagatagaatacctactctcctaaaggctaaaatccaaaattaatgtgaaggtgtattttaagaaatggtaaacaataaagataataaaatagtaagataaaaccattaaacagacacccagtggccaatatattacaattggagataaaaatatatgcatttctggcttaataagttagtgacttagaacagtacaagagtgacatggaatcacagaagtgacaaaacttggccacaacaaagccctgatgaaaagcaaattgctccaatacagtgtccgtacacttcacccttgcatgcccatctctgatgccccccaaagtagctgcataactgatttatttttcatccagatggctggcgtcctgtacagacttacaatgctgactgtcttggggatgcttattcagtgagtcttgaaagccattattcactaatttcatgtggaaatgaaatttcagcctcccattgtgtacgtataacttgggtacttccaccacatacaaaaagtgctttttgccaggcgggagaggatgactggaatgcaaaacccttcctgcatgcctccctggcccagacccaagctggcatatggcagttccaccaaccacctccatatagaacactaggtgaatgctttaagcaagtcctaataatgtgatttacaaagcactcactggatggctgtcttctgcctctattttcattcaggataggagattaatcttatttcatgaaaagcattttactacattctgtttcttgcattcaccctcctccctacatcttttttaaaagaaaaaacaattttgctaaaattctgtatatctaaaaagaatcatgagtttccaagttttcttaccttactattttcttattctagaacttaatcctcaacacaggatttactttctgtttcaagcctgtgactagcaggcaaagaaaactggtctttagagagcaagttaaacgttttagctaaattcatgtgctttgaatgaaacattcccacgctgtgcttataaacaactattgatattttctgtaacttcattccagaaattgtttgcttttaaatgtcagagagctctcttcctcgccctattttgggttttatttcagtcggcagtgttgctcatcagtaataaatacaaattcttatgtagagacacactcacatcacatgctggagctgaggagctcaaagtattttacaaacatgatcaaaatcactaatgacttccagctctggaatctgacttctggatctgtctcagaagacttatttacatcatctttgcaaaatataatttgtatttataaacacaggcatttatctagtacttagcaatgaatgcaagtcatagccctggcactgacattcatttccaactgtggttccaactgaacttcccagagatgtaagatatgactgtctatggtaaccttcctcctttgattctgaggagtaaacggcatttcctctcctcttctattttcatctactctgccacataactcttcctcaccagtggcatctgcagggggacaagccctccttctttcacatatcccaggaacgtggtttgtccactaggccttctccaggcttgtctctcagatatatgaatttcagaatgagatgggtgatatgcatgtagggatattttgcatattaaaagtaaaaatagccgggcacggtggctcacacctgtaatcccagcactttgagaggccgaggtggttggaccttgaggtaaggagttcgagaccagcctggccaacatggtaaaactccatctctactaaaaatacaaaaattagctgggcatggtggcgggtgcctgtaatcccagctactcagaaggctgaggcaggagaatcatttgaaaccgggaggcagaggtttgcgttgagccgagatcacactgttgcactccagcctgggcaacaagagcgaaactctgtctcaaaaaaaaaaaaaaaaaaaaaagcaaaaatgaccaaggcaaaatagctccattctgaattacacatccaccttctgaaggtaaccaatgctgtcagaatccagcttggtaaatactctgtttttcttttcttttcttttcttttttttttaactgagagaacatatacaaaatcaactttatcttatcctggaatcacattctactataatgaaagacagatagccttgtctcaagaaaagtaaaagcaagaaagtagctctagcatggaggtgatacccaaatataaacagggctggtttcagaatttctaagcaggcttccaagaaacaatctgattggaagcagaaggcaacctattggtcttgaagctacatttgcagaaccagatcacccttcttacttggattgtgggtttactaagagtgttggagtgggtagctaacggagattctacctttaactatattaatgcaaactgtggtatagccctggaaataatactgctactgcatgcaatatcatcagccagatctttcttagaagacagctccaatctatcgactttaaaagaaatacaaatgaatgagaaaatgcttttgaaaaacagcgaagacactcaaggatgcataaatgtaaactgacaaacatgtaaacaataaagcaaaagtgaatgtctatttctcctcctctcatatcttgcagggcactaccgggaaagtttttttatagtaggcctacatgatagagtactttgtacaaaagatcagagcatgattagctcaagcgttagatgaccataaaactggagttacacaatataccccaatgtacagtttatgtcacaaaataaaaagaaagacttcctcataatcatgtttctttcacattttaagtgtttggtgtttttgactaaccatattatgctataaaatcaaaagtaatcacttttagggtcctttgagaaatccttcttcatacttatatatattttttaaaaaggctaggagcaacaaatcctggattcttccataatttaagtgcaacccccattttttaaatcatgaaatagagtttaaattggcaggagggggagctgcccaacaaagttgtacctagagagaacctttcctgtaagtcccttttgaacaaataagtggttctaatcaaattgtggatgtatgatgagattctcaaaacaaaggaagtctactcctctaggagacactagattgaatgaagcatttcatagcatttcatctatggaagaactaggccctctcctgaaaaatacttgctttggtccctaccataaagcagcaaggtagtaaaggagaaaatgctgtgacagtgttttcttttgattcagtccagtagctatggaaactatcttttaaatgccaattggtcctcttccctgcaactacataaaataaaaccatttcttaccctcacggatgccatggctggaagctccatttttcaacacgttcaactaatctaagccctctcccacttttgctcagtatttgcaagctgaagctatcatatttgattgatactatggatttaaattagaatacacatgaatgtacttctaactaaggctgcgaggagtaataatgcccaaaccacaagtaaacatttgttaaacctgcttgatgtgctccaagaaaaacaacgtttgcttctttctctttccctatatctcttcttctgaggtaaaaatgcatgtaattcccatcacttgtaacgtgtttttcttttcagtgcctgtgcatataccataggccacaagctgcaattcagggtcaagagtttccttctatttacaaatataaaaaattaagatttttcttttgtggctccctcaataggaaaatggtagacaagctaaaatataaactgatactagggtctgactgtttttctgcatggatttcaatcctatcccattcaaaacagaatcatctccagagatctatttctagatttattcattgtttaattttttgagatttgtcatttttatttccttcactatatttaaacttttctttcagtaaacaagtttgataaagatggatattctttgtgtacagcttcctacttcaatatcaccttagttcatcatctttattgtcaaattcccttgtaatctatctctttgtaagatcctccctaaaattttgagatttgcaaatgcaaaatacaacaaactgttatgttccaacatgcattaacttttctcactgatttttttcagtgtgacttttctctttaacctccaatctgtctcatacaatttattggtagtatagtatttatataaccctattttatgcacagttagcatgaatcttaaaaaattaagggctacaatacccaagacaattctaaaggacaacagaattaaaggacttaaccacaccttaagaaatgccataaagatatagaattaagacagtgtgtttgaagcaaaacatataaatatatatttaaaaaaacaggcccatgggagaaaaggaggagctagaaagagactcacagttaagactgtcacttgatatacaacaagagtgacaaggaaagtatgggaaaagtcttctcactatatgattatgggtcagttggacacccatatgaaggaaagtaactcttaatctttaattcataccacaaacaaaactcaattcctgagggactgcaaatataagagagaaaataacaaagcttctgtaaaaaataaaacaagaacataagaacatatcttgatgactttggaagaggcaaaggtttcttaacacatagcaagtactaagcataaaggactttattaattttaataaatctataaagggaaaatgtatttgcaatatctacacccagttaaagacttgaaaataccaagtgtctgtaggcaaatatgtggagaagacagaggtctctgccactgctggtgggagtgtaaactggtacaaacactttggggaactgatagaacacgtgtatacccaagagccaacaaaatactcaccaaaaatatgtacaaacctgttcatagcagcacattacacagaagacccagaccaggacatacccaattgtccatcaacgatcaactacatcaataaatcatgctatattcatttaatgaaatgctgccccgtaactagaatgaagtgtttacgactacttgcaatgatataggtaagtatcacgaatacaatattgaatgaaaaaacagcgagaaaaaaacaaaccataagtattgaattattctatttgtattgaattattctattcatacagaggtctaatatggggaaaaaccaatttatggtaacagaaatcaggatagtatttgtgcatgacaaacaaggcatggagtgaattcttggattctttttcttgacctgggtgctaattacataggtgttttcactttgtgaaaaaccagtatactaacacttgatttgtgtgctcttccgtatgtatgttacacctcaataaatttttttttaattaaaggcgcaatccctattttcaatgaacatacaattaaattttgaaaccagaaaacatagaggaaaaacaggagaatgttaacaggaaacaggccacaagtagtttcaatcagcacatattcagcaaattcctatgcttgtggccaatattttaggagtgattgaaacatttataagtattgaaaaaattccccctgctctccaggagtttataactcagagcaaaaaaggatttttttgatttgatcaggaaaaaaaaaaaaaaaaaaatggaggtggggagagtcatagcagacactaaacaattataatgctagggcagtcaactagcatatgttgcaacagctgtgctgtggggattgagaaagaatcatggttggggtctgaaattatcaagaaaggcctcatggaagagacgaatgtgaccgtggagtggaaacatgcatagcatctgaattcacagtgtgaggacccagcaataggaatgattccagggagggaggctgtaggggcaaaatgaatggtaactgagtagacggagctttcctggtgaggtaggtaaaggggagtcactgaggaagaaaacactgaaaaccaaactgtattctaatggaaaaaaaaaaaatcactgtctatcctcaaatggagcaatgacatgaaaaaaagcttgttaaaaatatgtatccctttaacaatactgcttgtctctggaaactttttcaaactgtaggtcacagcaaattagcaaggagtaaaatcgctataatgtatggtaacccattttccctaaaagtgaaatagaaaaaaagcagaaaacaccacagtgccctacacagatccttagcaagaatgtacgtattccagctgatgctgccgccaattgctggaatcagtgggtaagacatggtgtgggcaacgtaaggaatacatacaatggctgcctcatccagcttcattttgtgaaatagcattgtttcttgaaatttttgtttttgtgatttacatgtgtgtgtgtatatatttgcatttatatgcataccgcgttgaaaataaaatgtgtttctcactgcggcttccaatcaagaaagtctgaacaatattcttccagaagtggagttctgcagaattcatttgaacaaggagtctatgcccaaataacattaaatgaggagatgcagaataaatgaatgagcaaacaggtagtgttaaaagtctacattaagacatgtagaccctccccaggttgtgcttcagccttaggattatttactcctccttggattccctgtatcccagaagttactcaatccagcatccttttcaataacatgaaatgaggctggaatttaaccatttcctaaatccaattcttcctgcctgcctgatctatctagcacgttgtgaggccttgcaaatagaatcatttatatcacatgcactatttaaagtaatgttagtttgtatttttaaacactgttccatttataaacacctaatacacacagccctgcttaaaaagaatcaaataactggcaatttggggcagaactgtgagatgtcttcactttaaattatcttgatatttgtcatgtttcttcctgattttcaacacacaaatctagcttcagggtggctaatggctgttttatgatagtctcattaatgacgttgttataaaaactgtgagaagcattaaaaataaatttttacataaagtgattttattctatgttaatttcctacccctttaaaattttgcagcattcaattaaaatcacataagaatttccaaaccccttcaaattttacagcattaaattaaaatcccataagtagcctccatccatgtttccacccccaccactttaaattaaaagggaaactcactagaaacccaaggtcttacgctattaaaagcattccaatcagccacacaaagtatttattgtgggacaacatccatgaatagttaaagacccacttaaaaatatgaatatgttttctttatagaagcttatcctaggagcagagaaggccttcattcattctgaaacctggcaacccggaagtaggcagcatgaaatctctcaagtgtacactcacttcctgttttgcataggttagcctttctccatgctccatagttctgcaatttctcccttccacatcctattttctattgcggctacttcaagtcatgtgtgtctcatgttacttgttccagagttaccctaaagtattttcatatgtgactatactaggaaaagggaattggaaattgtaaagtcctatgaggggattagcagtctccctgccaatgaggtcatgtgttgactagtcacattactgatgaagtgttcaaagcaactaagaaatttatcccaaaaagctgcattgatattctggagaaactgtttgttattacttaggaaggaagttggctgcatgctaaaagggaaaactagaacttgtccatgtgcagttgctttcatatcagctggtcacacaactttcgttgatttcattacagcccctgggagaaggtggtggaatcataaagctaccttgactaagtgtggtgagtgatctgcactgcctctgtttgggactatttattcctaaatctacaccccacgccacagaagttgggcgtcttccacttcccgccctatgctattcagaaagggtttcttttcttctaccttatcctcaaacaaaaccacccagagttccatcacaaggccacctgctatttttagatggagatcctgggcatgtgccctgggctcgtctcccatgcccttcctctgcagtgtgcactaaacagggcagggaatataacatgtgagaggatttcagaggagggcctctggtccactgggaaaaaggcagcattggtgccaggaccctggtttctagtccaaattctgaggtcaactggccatgtgtccttgctcaacccatttgaactttcctaggtcttagtttcctagtttataaaatatagggacaagactggacaatgttgagctgcactgcagcttttaaattctcttcagtgtagagttggataattcatggttttacagggacatccttgactcagactgatccagcccagagcacatgtctaacccttgactgctccggttcgttccccaaccagatcaacagacccaaccctggtccttggaaaagtccatttcttccttccttcctgagttccaatttatcacatcttatcctgagaaaaatcatctgctcctcactactcagttttaaattggcagtatccctgaacatttcttggtatcttacttttaaatttgtttttcttgctcagcgtctgccagagagatgcctctaaattcatttaacctggaccgtgtcttcccctttagccattcccttcccccatcccactacctgaatcacccctacttatgccactgcccctgcccctcccacccaataggtctgcattctcatccagaactttgaatgagttaccttacacggtaaaaggaactttgcaggtgtaactaagttaaagatcttgagatggggaagttatcctggatttttttggcagggctcaatgcaattaacaaaggtccttgtgaaaggaactcgaaagagtcaaagcttcagaaagagatgtgaggatggatgtaggggtcaaagtgatacctctgccagaggccagaaaccaaggaatgtgaacaaccactagaaagtggggaaggttaaattctccctgagaacctccaaaatgaatggaaccctgccaacagcttgattttagcacttttgacccccagaactatgagataatacatttcttttgtctcaagccagtaagtttgtggcaaattattatagcagcaacaggaaaccaatacactttatctctgattgttctaggtacaaccaccttcaggctgacttgacgttagtcacccttcctccttcaaagtaactgttgattgaggacctcctatgtgccagctctgtgatgggttctgaacaaaagacaacacagattcaagctctatgtctacgaagctgacaatctgacaataaattctgacttgaaaccaataactacaaatataatgagatctacaaaggaagcacatacgcccaagggaacacaaggtggggcggtttgggaagggccctaacctagtctttggaggaaggaggttgaagctaagtcctgaaagatgaggtggcagtatcctggagaaaggactcaaggcagccagcaatgtgcttctgaagcaacgtaaagaaggcaggtgaagaaagaagacagaaaaggcagaacatgtaaagccaccaccaagggttttattattattattattattattattattattattattttactgcaacctaagaagagaggttttaaacagaggaatgacaggaaatctgaaaacatcaggatcctgagacatcagggaaggaatgccagagcacaaggagaaacaatgggtccaagcctttgaggttttgtttcaatgaacagatattccccaggaaggaatacctattaatccacagctatgtgatcaacctttatcaggaccttgacgtgagggtgaggcagccagggaacagcccaggtctaggcgagcggggcaggcagagcggatgatctgcttcaccaccgtacatttcctatgggttggagccctggacagctcagccctctgcctcaccctggacacccaccaccagcttagggcatgtaagacagcatgcaggtgtggttcctctgcctcatcctgggtacccaccaccagcttagggcacgtaagacagcatgcaggtgtggttcctgacaccatgtggagggccagccgagggcagggccacctgcttctgaggcaggctctgctctcctgaggttctcactgcctgctattttctcagtggaaacaggttctaaattgaaaacaggttctctcgcaatttttaaaaagcatttaaagaaaatacagccaggggcaatggctcatgcctgtaacccggacactttggggagccaaggagggaggatcacttgaggccaggagcttgagaccagcctggacaacacagggagcctacatctctacaaaaaattagttgtgcatgatggcacaaacctgtagtctcagctacttgggaggctgaggtagcaagatggcttgagcccaggaggttgaggctgcagtgagccttgatcatgtcacagcactccagcctgggtgacagggtgagaccctgtctcaaacaaacaaacaaacaaacaaacaaaaacaagaaaagaaaatatgctttcttcttaaaagagaaagaaaatatatgcccctccatatctcaaagtttggcatccatggattcatccaaccacacactgaaaacattctttaaaaataaaaaaaaaaacccagcataacagtaataagaaaacacaaagaaaaaatacagtgtaacaactgtttacacagcatttacattgttttaggtattataagtaatccagagataacttaaagtgtacaggaggatgtgtgtaggttatatgcaaatcctatgtggtttggtatcggggacttgagcatccatggattttggtactggtgaaaggtcctggaaccaatcccctgagcacagtgagggatgcctgtatctgctgctagccacatacagtggagtggaaaagaaaacagacaaattttttttttacccagaccctaaaactgccattgagctcccccaaagataggccaagccttgcatgaatttgccggactttatttggccacatggttttgacttcattgggcacaggagtgttaaggaggatgacaacactaaacacagcatttagcacatagcagatgccaaagtataaaaaaagcatataaaatcattcattattgactctacaaggcactctatcaaactgtaacctaaagcagagatttgctatgcaataatagttcttatttaatagatgtgaagatgagaaaagccctcattcactactatgaaatatatgcatctaacaaaattacacttgcatcccagtaattcatacaaataaaaagaaaaagaaaatataagtgaaatcagtgtatagactgtaaagaaacatgaactcaacatttatcttaaaaagcatattccttttaacagcaatgaagaccagacacaatccaaatgcatatttctgccccaagagtaatcaactgcattttgtttattggagtggttctttgaaattgaggccagaggccctgaaactatgaggaagtctctcctaatgtttggccacagtcataacccactaaaattttaatttttattttaatttctttaggaaaaataatatttcacagacctttagtccaagaattggaactgcataaggtaagggaaagataggctcagtgagttaaaagtgtccttcctatactggaagcatcattattcagaggatgatgacattttcatccccacatctcctgattaaacaaacaagagaacagaagcttggttttcagatgggagaggtgcttattatcaatgaggagagagttcctggtagtaaggattacttagaagagctataaaatcactttgcccagaggcccttaaatggaaagaaatccatctgctcatgttcgtttggatgtaaccattcctagaagcagttgcagaaaagagatgacttgaacttccattttcactacggggctctctttctagtcacagccaagtagaaaacacaaaagcacaagctcccaacaacatcacaactcatagacatcctaccattggctggagctgggtcccctcagcagcacagggactgtcagatcagaccacgagaggtctttgcgtacagtaatgctgccgtgaagcagtcccttttaaactccaatggcatgtttcttctgccctgtcactgatttagacaaaagaaggtgccctaagatttttctatgcccctgggggtctgagcccccatgagaccagaggttttttaggccaaagtcaggctgcccatgggcaccaccaaagacaaatggagaaagctttcctcaatgccagccaaaaatagggtctacaagggttctaaagttatagtgcatgatgcccataaatttaaattcatgacttacttgcaactggcagaattcgttccaatgtccagaataatatgctgaagcagccatttacaaaagcaagccacaaccctttaccattgtccttcagcaggcagccagcctcagggggtctgcagatagcaacttgtggcacgtgaggtgaagactctgtcagtcccattcattcacttcgccagccttcttagagaataatgaatcctgtgtttcagggtaaagatgccaacctcaccaagactgcctcttgctaaagtgaataaccataacagagttcctgctgggcaatcaggcaagcaatccccaacttttccactcaacgatgcaaagtacaccaagaatgcccaatgcatttcaaaatgtaacccaggttcagctctgtggctcagaaagcagattccttaagaaattctgggagagagggaaagagaattaatgtgtctagaagactcactctgtgccaggcattctgccggacctttacataacttacttcatcaaacactgatgataagcttacaaagagcttaaggcaagtattgttcttccttatttcatggaagaggcagtatatcccacaaattaagtaaatgaaggctatagaagacagaagttaatcactgggtttcacaaaggcagaaagtggcagagctagataagatttatgccctctctaccacccaaggcttcctttcaatgcccccatgccttggactccctcaccccccgtttcatcatatttatcccttgaatggaaccaggatggggaagcaatattccagttgtagaaactctggggtagagcttgagttctgcctttttcaagctaggtgacattttaaagatcatttaaactcctagtctcagtttccttatatgtaaaatgaagatgcaggccaaggccaaatgtgtattttagtgagaaaaaaagggaaaatatatgtaaaagtgctttaaaattataaattcaaatgtgagaaagtgtcatcacaaaaccactgaaggacccatgccagacatgtcccaccagctcccctacaatgtggagctcagagtaagagataaggctggactccagcatgttctttaaagagcaaccaggatatctgccttccgtcaactccaggagtaacaaaaataagcagaaattcacttctctcactggcattgactcattcattgctccactgcaaaagcctgggaaacatgcctaaaaaattttagatgatgataactatagcagctgatctccaaagatggcccccaatgacccctgtctcccaatattcatgacctggtgtaatctcctcccacagcgaaaacaggttggtcctgtggcatgctgtgatctatagaacatgagagaagtgacacaatgccagctccaggactaagccttaggaaggtctagaagtttacacttttgccctgaaccaccatgtaagtagtcctgctagagagagcatgtggagagatgatatggagggaaaaagacacccagtcaccccagaggaacccagctttccatgtctgatgcttcagtaggaagcatcagacatgggagtgacccatctcagatacttcgacgaggctgagccctcaggtgactgaagtcccagacaatatcatgaggagcagaagaaccacccagctgagtctaatcaactctcagaattgtgagagatagtacagttgatattgttgtaaaccctaagtctggagattgttattcagcaacagataatatcaacaaggaggaaaaggtatcatcatctgatcctttactatgggtttcgtccttcacatacataatctaatttaatcttcactataataatttgagataggtattaggacaccaatttataggagtttgggtgaagttacgtaagttatcctaggtcaggatttgaaacccagctgtggtttgtaactgcaaagcccattctctcaatattcttgttatgtttttcataaagtatatcacagaattactggtctctaaagagttgaagaactgggatgaataaaaaagaagtgttactaaataaacatttattttaaataatataataaataatgtaaatggaagcaatgcagtacagtgaaaaaagagctttcagttaggagcctggaacttgaattcaacttctgacctaatcattagctgtgtgaaactgaacaagcaatttgactatgaaaaaaaagttttcttttataaaataataaaataacttcttagatttttgtggtggttgtcagaataaaatactggacataaaggacttctgcaaacaaaaataaaagaaagaaaaaaggaaaaatgtcctatagatacataaagaactgctgttgaattaacttgagagttctccacttcatagttaccacggaagtattcagttcccaaatatttgtattttcctgcctccttccaggataaatgttcttataaatactgttttgtttccagagctttgggacacatcactcttttaaaaatgcaaaataaaataaactgaaagataactatttaatacatcacttctttattaatatttttggaagcaaagccatgaaaagcagaaaccctgtggtttctactgaatagctacattttcccaccccattgatccactcacttatgttagtttccttggggggaggggtgtaagtgacagctttagggaatgtgtgtacaaatacagtcctgacacagacaaacagagggctcctagtgcgaatggatacgaaatgaggtctacaatagataatggctgttctgttcagtggaatgagatacaagatgtcccataaagacaaactctgccccttgggtgggcagtggcagctaagagtattaaaatagcccttgccaaccattgcttagaatccttgcagcagcttttatcctgttttggaaaccaaatggtatctctggtagtctcagcaatttatgtaacattctgtcatcggaagtaaaatctaggatcagaatgggtatacaaagcttacattacagaattaaaaacaagtgtttaattaatgaacaaattatgtgcaaactcataagtatgaactgacagggagtaaggaacatgctttcccttaaagatttaaaattttatttttccaaaggccccaagtctgtatatatatcttctattatgtaaataaacatcgtgcttcctatttcaaagtggaaggaatgatggttaattaaacccgaaaaaagcaatctgcttgatgaaataattggaaattttaagtaaaccaaagaaatataatctgatcaatttaattttgagtttttcacttagtttggggttaatggtactaatctaacactaatatgtacaataattgtatgcttatatttatgtgatatattctcacttgtttgacatattatcattgaacaaataggagccttaccccctctattgaactcgataatataaaaatagaaattacattgaggcatctagatgaaacccttcatctgaattaacaaccccattaggaaaaattgtgaccccaaaataaccactgtagagtgattatggctcatttggcatatgtttattccaatcttcctaaattgcttgtaattgttttattataaatgttaataatatataatgtttacatctgtatttttatcaaataacatttaggaaactttagaaaattatcctaagtccacatattaaaaagcaaggtcaatattctcacaagcatacacaatttgtagtttaaaaaaatagataaatgtaaaatatcttcagtgtattataaccacctaattagaaaatgaatgtgcccacatgaaccagtagagacatatcattacctcacattcattggttgtcactctacaattaatggaagaaatgtacagtcaatagtttaaaacaaagtgaaagttcctgtttcaatctagcacactagaggccatttattaacataaatgtgctcaggtaagtgccctttggggctgcagccctcatcctctgtgtcttctctcctagattcatatagtgacagaagaccatttaatcttggctagtcaaacagtgacaatagttagataatgaggctggacacatcataattttccctacttaccctctacagactgtaggacctacgcgcgcacacaatcactactcaaaagaaaagtgcgaattttgcaattataccatgactttatctaatgtagacagccaaaaaagaattcaggaatcaatacgaactttttcagcttgaagtagtcaacatgctcaaggacactgatatgtctatgtagcacaagttaatttaatattaagataccagtggtcagaaacctgtcaagcaagagcataaagaaacacagctgaaggttttcaaggccatgtgaagtgccaacaagcaatataactaggaacaaaatggatccagatactttatgaaattgcaaacaacaaaagagaaaaacattcagaaatattcacactaataactactagtctgaatcatttgtaagctcccaaatgcaggaacagaatcataacaggcgtaagaatggagagaagcaaatacagagaacaaatgagttattaattaagcagctaaatgcatttatattcataaatatataagaaaactaagacacttacgataactactctgataaacaattctagagaaaaagcagcacagcttttcatcatacagtattgctttattcctctgccttttttgtaaatattgagaacatttctcaaaaatagaaaataatcagggaaaaagaaaatcattattccgtgtaatctcacataaatagctgaaaggccagatgcttaactttgtgtacatagacaaaggagaacatgaagattgtgaacaaacctagaggccggttcttggagaccagagagacaaatgaagggacccaacattatgtgctaaaatctttgcatagaaatgaataaactcaaaagagctggcagcaacatctgtgtgacctttatactgtgcccactctcctttcagataaaggtcatgatgaggaaaaccagcagaagtgcacctgggccacgcaaagaaccagattcccaactgtagggtgtagagtctcttttccacattgtagatactccctcagcctacataagcccattccagtgcaggaagcgctaaagactgcacagagtcactaagggcactattacttacacttgacttttggcttgaattagctgggttgcgttttaagtgcattttattgagaaagcatttggactatacagtgcccaccaaaaacagacaaaaaccaaaaacaaaacagtgcatgcttgtaaagacatccctgtctcattgggtttggaatacccttggagcacctcactgtctttgactactgcatagaagtagtttagaaatctgaactacttgtgactaggcccctaatcactccttgctcctcactcaaatccaacctctgcatcattttcagattcatgttcctaaaaccacctacccaacatcacctctgactcaaaattgtcaatggcttccaacagcatttcctaagatagcctctacaaacagcccccacaatatgttcccttaagaataaattcagtggctgggcatggtggctcacacctgaaatcccagcactttgggaggctgagatgggcagattgcttgagcctagcagagtttgagaccaacctgtgcaacatggcaaaaccccgtctctacaaaaagatacaaaaattagccaggcatgatggtgcatgcctatagtcgcagctactagggaggctgaggtgggaggaatacttgagcccagggaggttgaggttgcagtgagccgagattgtgccactgcattttagcctaggcaacagagcaagatcctgtctcaattaaaaaaaaaaaagaagaagaagagaagaagaaaaccaaaagtaacagattcagtgatcaaaactattttaagaaattcttagagagaacttctgtaggagagaaacattttttaaactttctcccagcttttcttactttttcaaccatggggacttcttttgactaacagttctacaatatccaacagaactagccttccagaaagaggggtcttgggaaatgctggcccaaaaggtgaagttcaaattccttagcatgcatgtgatgacccatattaatgggtctctgctaccgctccacctccacctcccaccctctcttccaggtgctcaggtccctgcctgagctcaagccctctgcggggtagagtgctctccctcctcatgtctaagtcccactggggtcagctgatactctccttcccccagctggcctatcccaaccacaccagcctcatccatcactttatcttccaatctcccattccactgatttccttcttctaattcccagctccacattaagtgttttgggggaatcttacaggctttgtgtcctttttcttcacctaaattttaagttccttgaaggcatttgtattttataaataattttataactaacttataactaattacatattataactaattactatgaactcatgaaacctaagatcttgtacgtatgttaaataaatggtatgttttaatgaaaataagatgagtttctccaactatgtcagtgtagcaagaggaagagggagatcatgtcaaaacagaataaaaatctcagagtaatgtaatttagcagagtgactgagggatgtcctcaaagcaacatcaggattccaaagttctacaaaatcatcaccagtgccaaaatgttgaacaagaaaccacagatacaaagtcgtggtgtgcaccaagccctgaaattgactgtccagtgaaaaaagaggatatattccctaatctgatctaaagtagacacaacgattcataggaagagaagaaaaagagggacaggtcttttggggtctgttaagtgccaaatcagataatttgctaatttctaatacagtaaatccccaaatttccttcctttctacgtgtcttctattcaacacatatttattaaacacttactaggtatcaggcactgagaaaaaaaggcagctggaaatgtcttggggaaaattgggataaagtatgaggtacagagacacaaaggtttcttccttctgaaagccctagtaaaatgagaaagcaattttttaaagtatattaatgcaatgaggatgaggcagcctaaaataagtaagtctcatctaaaagctgtcaaaagccataagtgggcagatgcatgtgatgtcaactttatgtgtttctttcatttctttcaagaaccagtgactttctgttgccaaatgttcaatattagaataaagaacaccagtggtaatcactcttttaagtccaactcattgcctgacacatggtaggcacctaataaccatctgttgagtaaactaataaatgaacagatgagtgaaaaaaggcaggaaaggaggccttccacctatgcacagaaatgcagtgtttagttggaacttatttggtgctgtaattcctttacactggaacacagtgaagggtgggttatacagatcaatcaatgccttcttgagttaattcacaactcccttaaaaacattcttattaaagatcaaaattcataggtgaaacaaaatatttagatagccctacatgattcttctcccatgtcacagtaatgcaggcaaatttaggactcctacaataaaagtaccatgccagaattttgaataaatagtccattttatacaatcacaataggaaaaaacagtggagcgagtgacagctgaatttggacgcctgtccctcggacggaggtaaaaagaactgcactacgatattagtattttaacaagtttatgttttaaaaaagtgactaagaggaaaaacaaaagtagaacagtctgggagaaggcaagctgatacaaatttgcatcaggtgaactgtgtgttatatattgaatctgactgtaatgccagtaggttgaattaattcatcttatcttacttacaatgccatgcttaacatttggcacatgtgggcatatgtgtgaaacttgatacaaattaaattagaaaaaaatgttggtagtttacatctcattaatagaaaaaataaaccagaaaaattactgatgataatgtggtctttagactaggaagaaccttacaaggaaggtgaggaggatcttttcccaggaggtatttgcaatgaaaatgagcaaagaactgagaaatggaaaagaataaattctttgctgtgtgattaaaaaagcccaatcttttctctcgcatttctataatgctgtgaacggagtgtaggggatcaagagattgttgaacccaaatacaaccctgtatattgtagttattacagaaatcaccttcaagttttccaaacgattcaaagtaccagcaaaaaccacccaaggtaggcttatctcataggataactctctcctttgcaacccacagtgttttatttaataacaccgctataacacttaagtttaccttattatataataattctaacataacagagaaaatatctatttcacagatatcaatactgctgtctttgaaaaggtccaaagatatagtatgtttctgacacagaccaggtcttaataagtgacagatgtatttattatgatgatgttccttactatgatgctattattatttcttatcatacaaacccctcttccagctgagaataagactgtgttcttcatctttgcatcccttgcagcccaagcacagtgactttttacaagcatttgatgaatttaatgttaactgaaatgtcgaagcttatctttaaactaaactggtttatctcatgaactgacctgtttgtatctcaaggaaagaataggtatcatcttccatcatacttgcggagggccacactccctctaaaagtagctgcagcaatatttaataacccagagacttaggttagctctgaactaaaatgctataatatttagaaatgaaaataatacccaggaatgccaatgtaatgccaatgccaatgtaattgcttcaggttataacttccctattaatgattgttctctgtagggtgcagggaggaggttgagagacgaggttaatgtgaaatagccagtctcatccagtccaaagtgatatgaaaattatattaaaagaccatagctgctaacatctgttggctttcttgtgtgtgggccactgtctcatgccctaatatgtgttagattttattcttaacatcttataaatgcacataatttttttttatttttatagatgatgaaacaggttagagagattcataaactggccccaaatcacatcaataataaataagggaatcaggctttgagttcagacctacatgttcccaagtttgaaggagtaatcccacataacatgtgttcttagcaacattctgagttcccaaatctccggctatttagaggccatagttttacctatagcagcaagtgctatgacttatgttcaagacctttcaacacaacacaaaatgattagcttctctcccgttctctaagcccttcccacctgctacagtacctggaaatctaggtaccgacatgcttcttaaagcactttgtaggctatgttcatgtctgagatgagtaacaagttcacagagcctgttcatttatgccacctactctctgagagaaaggaccatgtgaaaacagtgtttattaggagaaagaggatggaagggcgtaatatccaggaagcaatccccgtcggggcaacagccttcaggagcaatactgcacctctaccctgcagcaagaaagtctcaaccacccacattcttattcatctacagaaacccaacaggacaaaactattaaacgttttaaaggaacaaggtatcagctaagtatgaaatggcacagttccacataaaaagcaggaaggcttgttctccaaaaatgccccttggtaaatatttactgggtgatggcacaaataatagggccgctgattagggggttacaaagaagactgacacccctgagcccggatgatgttagccatcagcacagtgctcttaactttccctgctcaagtctctcatgttttatagaaaaatttgaggagtatgcctaaggttggaatcagcctcacctctctctcaacttcatttgaaaacctgaagctactaaagtcccttgccagaagagggctcacccgccccactatgcccaatctaacttcccaaatagatctacattgtttgcattatgtgcttttcattgacatataatcaacctagagatttaggttagctctaaactaaaatgctgtaatatttaggaatgaaaataataaccaggaatgccaaatacagagtcacaggcttgagtaaacaaactctctaggaaaaaaaaaaaaaaaactctacatgtctaaaacttgccaccaaccttcatggttattaaacaataaaaagctcccttgggcatcttgaaccttcctcataacagaccttgccctaggattacttcttggcttatctgttatctagtcatacccaaagccagcccccagccataataatctccctatggtataccaccctgcttgtaaaacttctttgaacaaaagttttcaaaatgatacacaagatcagcatgatatctgaaatgcaaaccaaaatttatgactatcagctagcattataaaaaccatttctggaggaaagtcatgaatgatattcacaactaccaagtcagaagggctgccctccatgttcaaggagtggagaaaaggaatctacacaaaggccttctgtacatcctccctaaaaattattttaaaaaagagaaactgccatttatccatgtgagatatgactggttttcaaagtaatgggtaaaaatgaccaaaaccttgattgtcttcattatggctcacataaggcacacaaactcttttttttatattctaagtacagaaaattgcttcatttctcaagtaaatatatgctagaaacttgcggatatctcaagaatgctttgtagctaaagaaagtaacatcattgcctactcattttgcttaatttgctagtctcccagcaactttgtgctaacactttcatcccattttagatcctaggataaggcaatagtccagagccctggaaagcctccacctccagcagttcaccaggccactgaagccccaggatggagtttctctccaagacacccttctggtaatatacatgttacgtgcatttcacttatcttctccaagttacattccagtaactaagcttcagaagcttcttatgaattgtttattctgtgttttaaagctccatcagctgttaggatgatttgcaatatttttctttttggttaagcaggattggtgagcattactgggccttttggtggaatccttgctatttaaaattcctgctgctgggattaatggagataatgtctttgaaagccttttgtaaactgtaaagtcctagtcaaatgtagtgtgctgttatcacattaaccatcatagcaataaccataaaccagctgtaatgggggctttaaaatgctgaaacccatttgggtcttgtctttgctccattcccacccccgggggcctacaatggtgcccaacatatgggagcctctgaaggaagttttgtttggaggaacaaatcagtgactcagaaacatcacatggttttccaaagtaatgtccataggcaaaaagaagctaagtacgacaatttaaataatgaaaatactctgccaaaaatattggggtcctggaaagaaatgctacagaacaaagttcttctaaagagaattgatttgataatgaaatctggtcctttacagtcagactgggaaggagaaggagtagagacaggtgcagaaatttattagtccagaaaatgttagtccaggatggctcagagaaggaggctgccatcccagaaaagggaagggaggctgcagtttgagagggagtatcaaacagaaaacaaaaaacaaacaaaacccccacaaaataggcaaaagctactcctgcaaagaacattataaatgcaggctttttatctagactgtgtctttaaagtggtggaaatgaccaattctgtgtcttaggagggaggtggcatgaagccgggaaatgactgaggaagggatactgatatgaaatgatttatttctggaaaatgctcttgtaagcgtttgcaggaatagttctggttactagaggggtagtctattttaggtacctatgtataaggaggagtgaacgagtgaacaagttagtggggatgaaaataaaaagggaagtggtagcgtccagcaacacgggcctcattcataaaactcagaagcctcaaggataagaagagaaattccggggtggctgcctgttactcagcaagaaagcgaacactggcttgctggctcagcacttaacctgagatgaggatgtcctaacagccctttttctctaaggggtagtgtagggtggggtggggccaaaaggagaggaggaggaaggcctgccacccgggaggtccctaggactcagcagcagagagggccttgcaccagcgctccgctctgttccagaaaatatcctatttctgaccatcaatcagcattaagccagtttgggggctgagctttaggcacaggcagttgccagtagcaacagggcacacgctcctggtgagctgggcgggaggtggcaacaagggaggggccgcctgggcaagtggcctgcagctgggcagacaaggtcagggatctcccctacacgcgcaagggaggcagtgcggagggtgggggaggggggatcgtggcattaggtggggacaggcgcgccctgctggggccgggccagggagtggcccaggcctctgacctcgctggggagcagggagggagttttcccagtggcacagctatgcccctgccaaacccaatggcctcccggcccgggaaaggcgccactccagtggcccctagacactggagtcaaggccaagcgacaggagaggcgctggccctctgcttgggaggaccacagaactcaagatctgcccctcccctgcagcccctttacgcccccaccctttaggagtctctggaagatgccaacgtggaagtgtttctgcacgtgtgtgtgttttcatttgtgcttcccacacaaaagcgaggccccacaggtggagaggagggcgtgtgtgcgcgcctgtagagcggggctcgggctgcgtgggagctgggcggggatgcgcacacacggaccgactcccacagactgtcccccttcaggtgtcctggtgcaggctttcagggaagggagagcccctaacctcgccccacctcccaaaacttctccccctgccgtcgggctatggtaaaggggaaaggacaggactcaggaccttgagggaggcattgagtcagagggcagagaggggtcaaggagacccaggcgggaggcgcggaagcatacagtctgcggggacaaggactgaacggggtagtgggagccaggtgccgaagggctggggctagggtggcggcgcgcagggggcgcgcctgggcggggagtgggctggcgtctccttacctggccttcggtggagcatgctgctgcgggctgggggcggggtgggcgctgcgtccccaggggttgactccgcagcgccttcacttcgggggcagcaaggcgcgcgctgcagagccgggagttgccaaacttgccatgtccagagcgcggaggcagcctgggccacgcgctcaccgcagcccgggcacctcgcgctcctccgctttgttgtgttccgccgccagtccccctgcgcctgcctgccagtgtccccgagccctctcctgccgcgggacgtttcactggcgctcagggaggcccctcgggtgggcagtgccactttcctcctggaggcgcgcgttaaagatctgcctgggagcgcccggcgggcggctcggcttgcgctctgatgaggaggctggggcccatcgattcccaccccctacccactccccctcccctcccctccgccgggcccccccatcagaagctgcttaggatcggcgctgtcaaatccagcccatctgctgcaatcataatcagtctcaaccgaacggttctgacaaatctccgcctggagctggagttggagaagctggagagtgaggggcggggaagggaggtgggggtgaggggacgatggggaccgggcgccctgagagggggcctggagccttctattgtctgcccctaacggaggaactgaaaagggaagcagggatccagaaggggaaatagtgctttcatttcctagtaagaaaaaaaaaatctattcccgcaggtccctggttcccttcacgcccccacccccagcctcagctctgtctgggtggaacgaatgtctgctaatgaactaaacaaacaggtctcttaatcttatcatggagctgacccagagactggcacagatatccaaagtatcataattggcaggtaagagctggaactaacagccatttgtctggagtcagaagttggttcccaagtgcagttgggaataaagctcttgggggggagaacggccgtgtagtgtagtgtaattggccaggaagcttggcccttggcctcctgttggcatttccagagataaaaggaaatctgctttgggcaagaaaacgctgaattccccttagcctcattttgaatttaaaagattcgcatatttttttttctttttctcatgaaaatactatttttcaagaaatgctattttattagaaaataatgacttcaaaaattgaaaattttccaagcagaaattgctccacctgtagatgaaatgagatgctcctttcaataatatactttgaactattccaaaaattccactttaatacaatcacatatatttgtactggtgatagattcacaaggattatctcaaaaaaatgttttcaagtataatataaatggcagtagtcctagagacatacaaacaagtcttaaagcatggaagaacacaaccaatgggattatgtctagttttatacattcttctcaagtgctgggaaatgtccaattaccttgaatgacagtatttgtttgggaaataatttgttggataaacaaatcaccagtggaaaagttgaagaaaattttaagccctttattcagataggtataagagctaagcaaaaataaatataatttactgtgaaaactgaataaaattctaaattagggctcaaatcattcttttgctttatgctatacttgagaaatgtgtgcaagccacattaagcactcacttatctaggcagagactgtgttttccacttattttatagcccagtggtgcttacaacagcactaggcaactatggacactctatgaatactgatggtttgaaattttgatttacaggtcagaattaaaactacatacatcatggtgactttatagctgaggcaaagtggagctcaagtgttactttcccagtaagcaaatcatgtaagtcaaggacaactactggttagattttacagcctttttttttttttttttttttgagacggagtctcgctctgtcacccaggctgcagtgcactggcgcgatctcagctcactgcaagctccgcctcccgggttcacgccattctcctgcctcagcctcctgagtagctgggactacaggcgcccgccaccgcgcccggctaattttttgtatttttagtagagacggggtttcaccgtggtctcgatctcctgacctcgtgatccgcccgccgcggcctccaaaagtgctgggattacaggcgtgagccaccgcacccggccgattttacagaatttttatgaatatttaagtttagagtttttcattgataatttgtttaatgtgtttattactattcaataaaaattttgctaaaattaacatggtgccaagaaatgagtatttcaaaaagggtcctctcttacagaatgaagtatcatgctggtgactaatttaactaacattgtccaggaaattgctgttgtccaggaagagaagagttgagccgagtgtcaactactaggcttctggcaccatcctgcacaagaaattggtaagttctactgtgttatttcctagcttggtggtctcagttgcatcacagctaacttatagcctaaattgacaggcccacctccaatttattaattccttggtcttaacttcaaaatatatcatctcatgtttactcaattatttattgaacaatcactatgtgtcagtgttggaatatatgaaggaaaaatcaaacaaaaattttttaccttgtggagcttacattctggaggagaagacaagttagaaaagagtacataagtaaattataatgtctattagaaggtaatcagtgcaatagagaaaaataaagcagagtgggctgggtggtgcacaagtttaaatacaagagttctcagtaaaaatctcactgagaatgctaagcctgaatgaatgattaaaggaggtgagggagcaggcaagccatgcaaatatctgggaagatggtcccaggaagtgggaaaagcaggtgtaagtggcccttaaatatgattgcacctggcaaggtctaggaacattaatgaaaccttgagaacaggacacagtgaagggagaggtcaatgagggtaggcttagaagacagatcactgggtggggccaattaaaggacttggaattttactccaaatgacagcggaggacacaagacacagagggagtgacatgatcatctgacttttgtttaatagatcactctggctcccatgttgagaattaattataggagcagagaagggagcagggagatctgttattaggctattgcaagaatctaggtaagagatgatggcttggactgggtgatagcaagaaagataatgagaattggtggtgattttgaattgctttgaatgtagagccaacaatgagtggctcgaaagaaaagagggagtaaagagtaactccaagcatttggccctagcaaccggaaggatgaagttgctattaattgaaatgagaaagactatgggtggagcaaattttggtggaagaatcagcttatatgggttaagactggaatgcctattaagttaaattttaaaaataacttacgtaaagctcttagaatagttcctgacttttcgtaagtgccatacaaatgtttatggtggtgattattattgttattaatgtttgccaaccaaaatgagatgttgaatagacaattgtaccatgattgtggtggtagttgcaaaactatattttgttataatccaattgtacactcaaaaattggtgaattttattgtacgtaaactaaaccttaaaaaaattattaaaaaacaaagaacttactctcatgttttaaaagggagaatatggaactttcccatctgagaagaagcagcttcggaagtatcaccattttgtatacccattgaaataactgatgtaaataaagatcaccaatagatgctaaagccattaagtaaaggtttgatggaaaatagtgaggtaggtgaatagggtctggaggcagagaacctaaggccgattcacgctgacttcctaaagctaaatcaaaaggaaaaccccaactttccacacttaagcaacaaaagtactggaggctgctccctttacaaaccaccctctcctttctgcgtggcagatggaaaattgaaagtatctttgattggttgctttccacaaccaatcagatgcttgcatagggtgtaacctttgtaacttcacttcagcctgattggttgcttccctccgactgattgccggccactccttcatttacatagggtgtacaccaagtaaccaatgggaaaactctaattctgtactggggctcttggatcctattcttggacccgctcccaccctgcggagtgtacttttgttttttgttgcttcaaattttttttttttttttttcttttttgagagggagtctcactctgtcgcccaggctggagtgcagtggcatgatctcagctgagtgcaagctctgcctcccgggttcacgtcattctcctgcctcagcctcccgagtagctgggactacagtggcccgccaccaggcccggctaattttttttttttttttttcctatttttagtagagacagggtttcatcgtgttagccaggatggtcttgatctcctgacctcatgatccaccagcctcggcctcccaaaatgctaggattacaggtgtgagccactgcacccggccttgttgcttcattctttccttgctttgtgtgttttatcaagttatttgcttaagaagccaagaacctggacaccctccaacagtaacaatagaatattccaactacaaatactgcctcctgactttttgttaactgcgaaggggaaaagctgtattagacaagggagaaatcacctgacatgtttctccttatgtgatgctgtatgaaaagttttttgcaatatatttttgcaaaaaaacatgtttaatctgagtctgagcaaggcctttgctataattcccaccttacaggaaataaagatgatagaggaacagataaatgacatcacaaggaaaccattaggcatagcggaatatggaacttgctagaggtcttcaaaaagtcagtgttcatagagaattaaaaaagtagaggcactatcatagattgaaagagacgtgacaaatgcaactaatgggactgggcatcagtgcaaaataagcagctataaaagacatttgggacacgattagagaaattcaaataagactggtattagctgatataatagaattttcattaatttttctgggggtaaaagtgatactgtggttataaagaaagtagtccttatttttaaaagacacatactaaaatatctggggttgaagtatcatggtatctaacacacattttggaaaaaatatctgtgaagtaaaaatattaacatttgttgatgctaagttgtgtgcagataaatattttattattctggtcttttaatttttctatatatttgaaatttttcttaataaaaattgagcaaaatatacttataaaaatccatgctcaaaaagtaattataggaaaattagaaaaatttagaacttgatgtctcaaaaatatccaaattataagatggaaagaaaggagtatgtagaaggagattaataattttagtggacatgtagaaatgaagaaaaatggaaataaatgttcaaagtacccaaacaaaacagaacaaaaaaaaatagaataaaagaaatgaaatcaaagtctaataaaagagaacacaaatcaatacaggatcaataaaacaaagtctggttatatgaatgaaaaacagtggagacataaatcaataagcttagggataataaagactatataactaaggataaaatagattttaaaaataggactactttactatgagcaattttatctgttttcaaacttattgacataaagtgatcaatgtcctaaaataaacttttaataaaattcaataatccacggaatcttgaacaatcaaatagattgaatcagtagttgaaaaaaaatttgctgctgcataaacataggtccaaaattttaaacttattccttgagataaaatttacccaagttgaatttgtttttagcatatgcaccgttatgcaaccatcaccatccccttagaacaatttatttacccccaaaaagtacctattaacattcactcctcattctccagccagaggcaaccaacaatctgctttctatccctgtagaattgcctcttctagacacttagtataaatggaatcatacaatgtttagccctttctctggcttctttcccttagcataatgttttcaagttttgtccatgttgtagcacgtattggtgcttcattccttatttccaaataatattccactgtcttcatgcaccacattttatttatccattcatcagttaatgggcatttgggttgtttctgttctttagctattataaataatgcttttgtaaacattcatgtacaagtttttgtgtgggcatatgtattcatttcttctaggtatatacctaagctgtggaattgctgagtcctatagtaagtgtttaacattttgaggaactgccaagctagtttccaaagcagctgcaccattttacattcccaccagcaatgtctcagcgttctaatgtctccacagcctctccaacacttttatcctttgtttatagtcatgctagaggatataaagtgatgtctcatgaattttattcgcattttcctgatggctaatgacgttcagtatcttttcatgtgcttattggtcatttgtatgtgtcttctttggagaaatttcttttcaactcctttgtccattttcacattgggttatttgtcttttgattgttgagtcaggggctcattacccaatcttcacaaaacttgaaaaaatacagaaactctaataacccatatctcacagagagttacagggaattttttagaagggggaggaggagaaaaaaggaagaataggaggaggaaaggggaaaactaggggaagggaagaggaagaaatatttttatcaggttagaaggactctgataccaaaagtaaatataggctgtatgggaaaggaaaattaaggaggctctcaaaaattcttaagaaaacttaatccatcagtgtggaaaattataacagtagtaataataatggttataattaaatggtgttactaaataagatttatcctgcaatgtaaagatgatttggccctagaaaaatctattaatttccaaaaaaaaatttgggggaagataaaaaaaattaaaaagataatcatttcagtagatgctggaaaattttaataacattcaacacttattcagggtttaaaaaaaaataaattaaaaaacatttcacctccccaggaataaaagggaatgcccttaacctgataaagtttgtctaccaaaaaaaaaaaaaaaaatctataacacgccttatattaaatagttaagttaaagaacatttcctttaaatttttcctctagacaaggatccttccatcaccacttcattttctctaaggtcttagagcagttattatttatcaccaatattatcagcatctccacagaaaatggaagagaacccagaggcaaatcagatatagtaagagagcagtttgtttactagataaaagaacaatataccaaaatggatagtgttcttaagatatgtaccaaattattagaagtgtatactttttaggagatcccacttaaaaatagtaagaacaaaaaaaaatttagaagatacgaataaacttaaagatgtgaaacacctttatagagaacactttgttgaagggcttaaaagaatggagtaaatagtaaaacatataaaagtgatggattggaagactcaatcttctggcttaatctttaaatgtgaaacattatcaaccaaaatctcagcagatttatacactcaacttaccagcgagtcctaaatttatttcaaaaaaggaaaaggcccaaattagccaaatatatttagtaaatgtgaaacctctaacattccaaaaagggtcaggtaccttactataaaacaatgtaattcaacaggtaagagatgtgggttaattggaatagaaagagaccctagaaacagactcacatttatggactcagggtatatgaaagaaatggcattattaattattggggaaggattactgtcaaaaaatggcaccaggttaactttctatgtgataatggaaaaaaaaaaattagaatcctacctcaggccatttgcaaaacctaaactcagattaaaaactaaacataaaaagcaaatttataagactttttgaagaatgctttggaggatactttcatatcaggcggggaagtataatgaagcactttactgtattaaaattttaaaactttgtaaaaaaaaaaccataaacaaaatgaaaagtcaaggcatagactagaagaaccatgaaaaatatgtattataaacagaatacatatcctaaatttgtaaagaaccacaaatcagtgggaaaaagtgaaaaaaaaagtggggggaagcatagaaataggcagttcatagaagatagttaagtggcaataactatattaaaactgcttaatatcagtactggggaaatgcaaattaaaacaacaatgaggtagcatttcatgcctatcataattccaaaatataattcttattacactatgtgttggtgaggatgtgtagaaagacctcttccacattgcaggtgggaataatttggatatatttattaagttgaaggtgttcgtactctgtgacataggaaccccatatctatgtactcacggaaaaggctcacacatacacacatacacacaaccacacatggaactcgcacgaaatccattatattaaatctcaaacttcagtatgttctggaaagtataaccattataaataccacctgttgataacaatgcaataaaacaaattatttaaaaataaaaatagaaaactaacatttaagcaactcttcaatgaaagagattacaaaccaaaatttctaaatttctgaaaaatgacagtgaaaactaccggatgcatttacagcagtggttacagaaaaattggcagtcctatgcacgtgtatcaatgaaaattaaaaaatataaataaaatttcagctcaaaggcacaaaaggaaaaataaccaaaagaaaggaattaagggtaacagtaaaatgtagtaacaaattaacaaatcagaatctagttgcctttcttttttaaatagatcactacataacttaatcatgaaaaaaatgagggaggtgaataaatcaccaataaacagttgacccttaaacaacacagtatgagctgtgcagatctacttatacacagatttttttttcaataaaagttatacagagtatgcctgtctcccgttctacctcctccacccattccacttctatcacccctgagagagcaagaccaactcttcctctttttgctcctcctcctcagcccatttactgtgaagacgaagaggatgaaggtctttatgatgatccacgtccatttcatgaataggaaacattttctcttccttatgattttcttaatagtacttccttttctctagcttactttcttgtaagactgcagtatataacacacataacatacaaaatatgtgttaatagaatctttatgttatcagtaaggcttccagtcaacaataccatattaatagttaagtttttgtgggagtcaaatgttattcagggaattttgactcttcaggggtcagcacccctaactcctatgttgttcaagggccaattatacaagataggaaatgacaaatgggaactaactacagaaacaaaaattaagaggcaactttatagacgtcatatacatggaaaaaacttgaaaacatggacaaaattgaaactttctttggaaaatacatttaccaaaattggctctgttagagatagaaagattaatcaactcttctagaaaaaaaaaaataccaccccacaaaaacatctctaggcccaaaacaaactcccaaaggcagaccactccaatgctccacatttacttcaggacatggaaaatgaagaaaaactttctaattatttttataaagcaaatatagcattgataatttaacctgcaaaagtcagttttaaaaaaatgaaatgacagggtgatgtcactatatatatcactgcaaaaatagtgaataaatatgaccaaaacaatgtaacactacattaaaaaaatatcacggccaagtgacatttaatccaggaatgcaagtttggctcaatattaattgatcctttagtatatgacaccctgttaataaatctaaaggaaaaaaattacaagattctctacacaagtgtttaaataatctttgagaaaactgaaaatttaacactcttcctgatgaaaataggaattgatgtatattttcttaacatcataaaacatatcatgcacacatatgcttagtcctaacatcagtatctcacttaagggggaactacttgagacactccatttgatcaggaacaaggccaggatgtccgctgcctccacttctattaaacattttattggattcaatgcaattatgcaagataaatcaaatggaggcataataattggaaaagagcaagtaaaaactgtatttgtagatgacatggtagtactcctggaaaatgaagaaaattatgataaaaaattaacttgataaaatttagattcagtaaaaattaatatatagaagtcagttgctttcacagacattgatagtaaactggtggaggatatactgatagagaaaacctcatttacattagcaacagagatgaataaatatgtagggaaaattagaagtcgaaatgtataaaacctatctggggaaacgttaaaactcctgtaaatcacaaaaatagatgtgaagtaatagagacattggctgttctataacagaatgactcaagattataaagctgtccgttctaagttactttataaaattaacacgataccaataaaaataacaaggttctttgggagctagactagttaatacttaagtttatgtgaagaaacttccaagaaaaggcaggaaaacactaagaaagaaaatccaggaagagaaaataaagtatacagtaaatttactataaagtttctaaaatgaaaacagtgtggtgcaggtgcgtgtctagacaaccagggagaaacaggtttgaaaatccagaaatagatccaattatctatggacattcaacatacaataaaggtggcatttcaaatcacaaagaagggactttttaaacaaacagtgctgggacaattcgttggccatttgaccaaacataacattaaatgtatacctcccaaaccatacacaagaataaataaatagatccaggatctaaatgtaaataatgaaaccacgccatcacaaggaataaaaaaccacaggtgaattcctttatcagctggatgaaaggaatggttacctgacaatgactcaaactccagatgccatacaggattagtaaatttgactatgtaaaatttttaaaatagtatggtatatcagctttctatggctgctgtaacaaattatcgcaaatgtagtgacctaaaacaatacaaagttatcatcctacagttctgtagattagaagccccacaggcctcactgatgtaaactgaagatgtcaagaggactgcatttttttctagaggctctaagaaagaactcatttctttgcctttcccagcatctagaggctgcctacattccttggtccatggccccttcctccatcttcaaaagccaggaactttatgtctcttacccttttctgtagtcacgtctccctctgcccacaaccaggaatggctgttagttttcaaggacctgtgattacactggacccacctgattaatccaggataatgtcttcaactcagagctcttaccatctgcaagtcctttttgccatgtaaagtaacatttttaaaaattctaagcattctgatatgtatttttttgtgggtaattatttttcctaccacacatagcaagaaaaaactcaaaaacaaaccaaaaaatatttttaaaataaattgaaagacgtctgacaaaatgggagaaaacatttgtagtgatcacaaataagaggctaatatccatccctaaactacaaaaaaaaaaaaaaaaaccctcttaaaataagggggaaaggccaaaaacttaatagaaaagttggctatagtcatgggcaaacaattcacaaaacgacacgcaagtggcctttaaacataggaagaggtagtcaagctcactcttaactagagaaataaagttttaaactacgctgagatactatctctcattcatcagattgggagacatttagatgttgatcctttattctattggtgcgactgtgggtaatcatgcagtcttatacattgctggtagaaatataaattagttcaaccattttggaggaaaatttgacaataagcaaaactctattttcatttaccatttgagtacacattctcactttttggagttaaccctgaaagtgtacttccaataatacaaaagtgcataggcactttgtttattgccgcactatcactgcccactgttgcttaaaatgtcacttaactcatccttggtcactatatatccatttgtatccctattttatggcttatccgtcaggtttggattgtatactacaattcagatttgcagtccttcattgggcttctacaccactctctgcatagaactgagtaaatgtttgctgatttgaacatttttagggctaaacaatcattttgttttcaaaaattttattttggaaaaaagttctcctacataactaatatcacatagctttattaattttgaatttaacccagattgttgtccaatatacttttttttcacagttgttactaagtttctgttttatcacagccagtcttaagtaaggaaattagatttatttaataattaaacctctatgacaatggcccagggccaactgaattcagcacagcaacttagaataagattctactggactttctatacttttcagccacaactgagcacaccgttgttctatgatagcattattgtcattaatgaaatgtataaatggaatgcaactaaatagtgcctggttaaatagttcctggggcttggtaacaaaacaaataaatacacaaccatactctgaagatgaatgttcttgtcttaatttagttattcacacaaccatcattcattaggaaattaatacaatcaggttcatgtgtcaggttcttagaatgagaagtgtatgatccttaagccaaaaaaggttcattacttcaatttttaataatacatcttctagatattttattatctgtatccagatcctctttagactgtctcctgaaattactatgcatatatatacacatacacatatatagtacctgtatttattgttatatgcctatatgctacttttactggaatacttccctttatatttgaggacctctatttaagcaaagtaataacctaagtacaaacagggaaaaaattctccctcatgtacacacatgcatatttttaaagtttgtccaaatccatcacaattgaggcttagattagcatccacatgtctgaaatggctgcataagggggaagggtggtatatatttaaagaaaacttgcatttaagaaattcattattgaccccttaaccctagcatagggatagtttcttttgttttctgttcgtttgtttatttatttatttatttattttttgagacagggtctgactctcttgcccaggctggagtgcagtggtacgatctcggctcaccgcaacctccacctcccaggctcgagccatcctcccacctcagcctcctgagtagggaggtcccggggcttagcagagtggctccaggggatggcttagaaggacatgggcacaggaaatcaaatttgtgatgacttagatccttcttatttacttatttaggagttagtacatcaaggttgcaaaacatcccaagaaaacaatttttaaaattcattctagatcaggaattggcacccacaggccaaaccttgccagttctatgtaaatagcgctttattggaatagttatacctgttcacttacgtatcctttgtgggtgttcttgagctaagattacaaaattgagcaatttgtgacagtgacgatatgggtaccactcagaaaaccaaaaatatttactatgtggtccttaacagaaaaagtgtgctgaccctgctacagaaaatattgccctcttacaagatgtcataaacaggaatgcatactttcaaaaaactattaatgattataattttgagttatactgacacaactagagcaattaaatccatgttataaattctaaggagtcttcaagtttctgatataacttgttctacagcacatacattgctgctgaatatcagtgacattccgtttttaacagtaagaatagaagtgattttagctaattaacttttgaaattaactttttatagccagcaataactacagcaagattatttctagataattaaaatacagtgctcctaatgaatggatatctactataactttgtttataaagacaagtatagttgcttatatcatttcaaattgtgctttgtgtattcaaaattatatttttttcaaaatgtaaacttgggttttttcaatctatttatttttatgaactaggactacaacagttgccaaatttctaaaatatcttataaaatcttaaaattacaaagtcactatttggtaattaaaccgttaaaaatatcaagaagcctgggcctcagaatttcttatgaaaggaatagagttttgagaggtattctggagagatattggaaattaacataaaggaaataatgaaagctgaaattgatacctacggaattgaaaaatgttagcaccatcacaagttcttaaaagttaagaactatattctaggaacttaaagaatgtgttctgcctttctactatttttggcctgtgtaggcaggatattttggaaggataggctgggttgtaccatggtgacaagcaacccctagatctcagtggcttgaaacaaatgcctatttcttcttcatgctagcttttggtggggactctgctcatggtaatcattttatgaccccagctttagagaaaccaccatcttgagagctgctggttgccatgcaagaagaaagagcatgttgggcagttgcagacccacagttaaatgcttcaatttggagtgtcacttttgctaacaattcattggccagaacgtgtcccatgaccccatccatcctcagaggagcaggagttgcaattctatcacgtgcctataaggaagagggctggatatatttagtgacaactcattaaatgtttagggtaatgattaacgacccagccctccagccaaactagttaattaatgtttgtgcttcatttccctcatctgcaaaatgggaagactaaacctcataaaactgtgatgattaaatgacttaatacttgtgaagtgtttagaacaatactgtcatataatgataaagtattattatttctttttaacttttgtacctgccaccctggtcttcagtgccaaaagcagagatgagggcaaaaacaaaagtgggcagtcttaggaatgctgacctggacccagtagggatgcctacaacagatattcttgagaaaagacccatgaccaaatgaaagagatcaaagatgctaggatttccttataagtaacattgatccagaaggtatgaaacaagccattagcagagcaatgatttatttttaacgggaattggaagataagggggataaaaacacctaaactgaaaacaggacttttgtaatatgaaggccagaggatgaacttagggtgtggtcatataatgtataacatggatgcaatcagtggaagatgctgaatagggctatcatatagcatgcatatttgggtaatacggtatatgaatgaatctcttctaatctgtggtttagaaggcttacaccaggctaaacaggagttcaagtaaatgactcccactagaaagagctacggctacaaagaagagaaatgggagcaaagtgaaagtcaacccaacaattatgtagaaacatagcaagtggtagactaatgacatggttcattcctaccagaattcctgtttcctcagtactggcagcaatgagattgctctgaatccatgatcatccatatgtattaaaacaatccttgactgttggacaccaaggagatgccaagataaacagacatgatttctctcttccaggggcttattgtttaacaagaaagacatagggtattaacctaccttaacataaatcagaatgaagtaagttttatactactcacataagcagaacattatgggagtagagaaggagcagaggttcatttttaatatggaatttgggaatgcattttggtggagatggcattttaaatgagattttaaagaagaggaagggatgaaaatggatacaatgaataagataacataatatcatgagaagccaggaaaatgggtaagattgaccatttgaaggaggtagaggagaaatagtttttttttaaaaggaagcttttgttcctttgttccttttgtcctttgttcacccccagtaattcagcagcacacactagactgtctcattctataattgtatgtatttctatcattctatagattctatagatataattctaaaatcattctataattttatgtttatgactcccttttatttacctaaaacattaactataatttttaaatggctatttgatgttaattttatttctgtaatctttaaatgtaagcgctacagttcacatttttctagatggtcacaaaacaaattcaaaagataataaagctgaaaaggattttttttttttttttgagacagagtctcgctctgttgccaaggctggagtgcaatggcaggatctcggctcactgcaacctccacctcccaggttcaagcgattctcctgcctcagcctcccgagtagctggaattacaggcacctgccaccatgcccagctaatttttgtatttttagtagagatagggtttcaccatgttggccaggctggtctcaaactcctgacctcaggtgatccgcccgcctcggcctcccaaagtgctacgattacaggcgtgagccaccgtgcccggccttgaaaaggaattttaagttaaatttttgctttatagataaagaatccagtgatcaaatgatttcctcataattgtagagtggcagactcaagaacttgtagaactcatatcctaatactgaatgtatttgttactttaaaagataaaataatcaagaaaacaacaaaaatgagtccagggttactcttgtggttgctctgtgagtatcatttgtcagaagcaaggtgaatgatgcctataagattgtgcatatatatatatatgattgtatataatataaatagaataaacatagaattaattactaacccctaaaatgtctaattgaggagtcaccaattcaagcttgtctgtgtttaggacaaataaaaggaagccctaccccatagagtagggattaagttgatggaactctttacccaacaggaggtagaagaagttggaaataaaaacagattttaaatggcttatataaattaatgactggcccatcacacagttaataagaaaaaaatagtatgtgtgggtcatgttatgcatgtttgaagttgacatcaaagaagtccttgctttgccaactctgccaaagacagatggcacgtggccatgatgcaccgtggcaattcttgcttctgtttgtgaaactctccaaaggctgtgttttggaagtcatgagaaattgctaggttcctgggttgtgaatagaagatggacattcaaggaaccaatctctatctgtatattaaccaagacaactatatctaacattttattcccaaacaggagcataagggacatttccacattctaactttacatgaagactcaggactttgaaagcccatgagaaagttttcataaggatttatccacaatttcttctttgatttgctcagatgtgaagcaggaaaccttccagacatcctgaacctctgaactttttgtggattgcccatcaacacaggcaaacattcatgaagcaattcaaaaatctcttctcactgcattataagcatgtccttacgttattcatatatcaagagcatgcccattcccaacccacaatggaatgtgagcctaattacatgttcctttggaataagatctcaccagcccaggagtgtcagaaaccctctatcatatatacgtatcttgtttccaaaatgatcttcccaagccaccctaacaggcccccttcagaatgcttcctgctgacaagtgaatctgctttttgcctttcacccaatctcagctcatgctttctctgtgaaaatatcacagaccacatctgacagtggtccagctaattaatgtactccaatgtctagcaagcatttgacaggaaaaataatctatacagtatttattgcaaaatcttcaccaatgtgacaaagatgaatgtaaactttacataatcatttttcatttgttatccaaagttgaaagtgattttcaaatgctaactttaaaattatgatgaggaagataacagctctgctttaaaactgcttggcaatggaatttctatagtataatggtttagcaatgagctagaaaaataaactctcttgctaatgtagtaaatgggccagaaataaacttctcagggatttgggtggtggggtggggtgagggaggggcacacagaggggatagtggaattggatttctggaataaatgatctgaaacccttagcacactatatcttcaaaaagcaatgtcttcctttatataatgcacgtatcaccatcacgatacgagagcaactcgaagaatcttaacgtataccacggtaaacacctacggcacccaactcagtctacagcaggacacccaaaagttaaattcactttggctgtggctgtgctccaggtacatattttctcatgagctttgtttctttgttctagaaccatccttcccaatattccttaacattgaaattatacatgttaaattaattattgttcatttaactgatgagctgaaactcacgtccttccttttgaaagctaaagtaatcttctaataaaaggtcaggaattatcaaatttacttgtaattattactaattcttctgtgacttcttttttttttttttgaggtggagtcttgctctgtcgcccaggctggagtgcagtggcacgatctcggctcattgcaagctccaccttctgggttcacaccattctcctgcctcagtctcctcagcagctgggattacaggcgcccactaccatgccaggctaattttttttgtattttttagtagagacggggtttcactgttaaccaggatggtctcgatctcctaacctcgtgatccgcctgcctcggcctcccaaagtgctgggattacaggcgtgagacaccacgcccggcctcttctgtgacttcttaaccacaaataaagtcttggccttggaaaaaggaagatctgaaacagaacaaggcaattaaaaagtgggtggaggaagtataggagtagtggagaaaaaagaaaggaatggattttctaaatttaaaacactctttgccctttcctgaaataatgacttatattctttgagttcacaagagagtaattggatatgcatgatgcaatgctggaattttaggtattttgcctaaaggttattaacaattagtaccactaggggaaaaatcataaagttagttagaataacaaccctctctcaaaggataatgaaaactggacttgtaatctggtcataataaaaatatattatgtttatattggagcctcacatgtcaagaggaaaactcacaaactagaatatgtccaacaggtggccatgactaaatgaagactgaaaaacaagttgtatgaggaccaatgaaggaatcttcctttgaagcagtaaagactgcgaaaaaaaacatgaaaaactgtctttagataaatcctttaacaggaatggtacacagaacagggagatgttataagtggagctactgatgacagcattagagccaaagggtgaaaggcagatgttgagtcattcaatagaagaggtgtctgatctcttcctatccaatgtagcagaatccatcccatactatatctgaaagatgaccactttgctttgacatttgcagtggtacagaactcactatctcaagaataccttcctcgggatggtaataagtatgagaaatgccctttctagttctaaatttcttctccacaagacaactcattccattttcaaacaattattagatctatccatctcttagtcttctatttgtcaagcaaacatctccaattcctcacatcattattaattcagtattgtgaaccttgtaccattttagtcaccagctttgtggataatctttggattgtagtgtctgtaactgacatccaaattaagtgctcttgatatggtctaactagcaactgaccccatccatatttctatttccaaagcagagaaacaagaaaatcaattggccaatataactgaataaatccaggtaaatacatatttggctttcaattagtcaggaagtctgaatttctagaggatattgaagatacagcatcagacaatgcatttgtctgattgctgacaacttttaatttccctgttcaagaaaatcgatcaatgtgtgttagctaaacacctgttatgttcaaccctgtgttagtcatcatttgatgtgtaacagaagtgtaaggccaggtacctacaatatttgtagagtcaatactaaggtacatgaaataattttagagtttttacaagatatacatcattatgtatacttatatgaaatagtctcaagttcagcagggaagactgggcccaggtgggctgaggaatgcatgtgaagaggtagggaggcaggaaacttgaaggatggttagggcttgtctatttggaatggagagagaggccacaaaggagtgcgtgtgtagaaataatgagtaataaaggaggtcaaggttagtagggacgtgtgtggttacaaatagaaatatttggatttgtaccataacatttctattacaacttcctttctcccattccaaacatgcttggttttacagaaaaaacttccaggactcagatttccatgggtattagtttgcaaactaatccctgatgagatattatgaggagctaagagagtgatgctagaattctcaagtggcaatggcaaatttcagggctgacttcctggataaccaattctttttttttattctgagcatgggaatttcagttcatccagcagaagaaatgttttttgatagatgtgacttttggtacattttgaattatgtcatcttggggacaaatggtcccaaaagccaaggtcctaaatgtgtacatctgatccaactctaagaacttttgctcagttgtgacgtcaaagaatttctattttagagtggtcttctgcaactgataccatccatatttctgtctccaaagcagagaaacaagaaaatcaatttgccaatataactgaataaatccaggtaaatacatatttggctttcaattagccagggagtctgaatttctagagaatattgaagagacagcgtcagacaatgcaatttcctttaatagggaccataacctcagagttgctgctctgttttttaatattgtacaattaactttttttttttttgcagcacactctgcttatagcttctgtggaaacttaaacattattcaatagaataatttcctggaaaatcttttgaaagtggtcacagccctgaccttgctctggtgccctgggtccaccagcatgctgtttcattacctcaggaaggtttggtgccaagagacagtccaagagttagtgcataaagaaagctaggttcataaaagaattaatatctgccttctttcaaggagggaaactgccacttccaaccattttatgcatctatcacttctcttctatcttcatcattcaacccttcaactggcctacctagatgacaggtaaaaattatagatttttaactcttaagaaataactgccgaagtcatttcttccaaaccattctcattaccaatgggaaactcaggcccagaaagcctaaatgacttttgcaagaccacagagtaagtagcagagtcaggacttaaactccacattgcagaagatgaaccagggatgatatttttaaaacttagcaatggtatgacaaaatcaccaaacagttagaatagagcctctgattgtactggtgtgccattaaataccagccccaactggattacagtgtatatcagtaatactttaagggataaagagaaaaaatgtgccacttactatcaagctatttaaaggagctaggtaataaaataatcataatttatttttactgttggttcttccctttttcatctttttgccttttttttccattgtctttcttgttactaatcctgtgaaaattcaccctctgtttggcagcccgggtcattgttatttgtgctaagctcctatattattagtctgttatcatattgccataaaaaaactacttgaagccaggcgaggtggctcatgtctgtaatcctagcactttgggaggccgaggcaggcagatcacttgaggtcaggggtttgaaacccgactggccaacatggtggaaccctgtctctactaaaagtacaaaaattagctggaaattgcttgaacccaggaggtgaaggttgcagtgggccgagatcgtgccactacactccagcctgggcaacagaacaagagtccgtctccaaaaaaaataaaaacaaacaaacaaacaaacaaacaaaaaaaaacagcacaactacttgagactgggtgatttatacagaaaaaaacattttattgattcacagttccataggctgtataggaagcatgggtggggaggcctcaggaaacttgcaatcatggtggaagccaaagcaggcacatcttacatggccagaggaagaagcaagcaaaggtggaggtgctacacacttttcaaccaccagatctcatgagaactcacgcactatcacgagaacagcaagggggaaattcaccttcatgatccagtcacctcccactgggcccctcctccaattctggggattataattccacatgagatttgggcagggacacaaatccaaaccatataagctccattctgcattcaagtgtatgttggtcttgccaaaattatcaataccttctccgtaaataccactttcaagccttgtaggttaagccctgattatgtttgtaaaagtagcttgatctacatgtctacaattgttctctaatttgctttatccaaatggaaaaaaaaacacacaatattttaggccttgattttcatcatgaatttttaaaaatctaaaattgcctcttcattgtgttatttcaaaatcatgagatatcctttcattgcttctactgataaggttgtttgtaactcaaaatcataattggtagatcaacagaataaaattatgagatacaaatatacatttgattattattgctactggttagagccttcactatgacatgcagtgacatgctcacagaaatgacaagccctaaaacttcttgctttttggttaaacactttatgattaaacatttcaatctttaaactttctaatagtatcttgaaattgtgtatctcattttaacatttttaagccacttagacaaatgactttttgccatgcttgcttgactttttttcttgcatggacttacagataaaggtggtctcatccctaatgaacatatgaggccacaagaatttctcctttttttttttttttttttttgttgttgttgttgtttatttttgatacagggtcttgctctgtcacccaggctggagtacagtggcaggaacaaagctcactgcagcctcagagtcctggactcaaaccatactcccacctcagcctcctgagtagctgagacccaggagcactcaccacttccagctaattttttgtagagacaggatcttaaactcctgggttcaagcagactgcccacctctgtctcccatgtgctgtgattacaggagtgagccaccatgcttggacagtttctcctcttgaatcatcaacagtccctgtaaagtctcaagaaaagtgtttggagtatccataatgtgctaagtcacttaggaacaaagttacacaaaacacatccccagtttttgtctctatgctttcaagatgggtgaaactttatgtttgaagtttcatgttttatgccaagcatgatgagagatagaggaatgggaagacttggtcttacaggttaaagatgtgaaacatacaaaacatgctctcatgagataattagacaaacaagtcagtgtgattgagagcaacatgctgggaactggtttagaggctcctggaggtaaggacagagtcactgttacatgtttggggtattttgctgaagcatcgcagaggcagcattgtcctcgtcaacaggagatggggcgggaggaaaggagagcagagggctgcaaccaaagcaacccagggtccaggtgacagatctcccctattggtaaaatgtgattcatgtggtagcaccgcactgggagcttcagtacctttaactttctctctcaggcttttacacctggtgaacgtctagaataactgccacagaaaatacatctatgacatttaatcactgagtgttcgagagaaggcaaagcccggacaccaagtaagccaggtacccctgaggcaaactccagaggcttccctgggccgtgaaaccagccaaagaaggcaaaattcacccaccctccaaaagacgtttgcgttcccacgcatgttctccgccctgagatagcttagaacacagctctaccaacgacttttcatttccattaacctattcctgattctttgattcaaggaaccttgccatccttagctctttggattatttatgaggtctgatttataatacaaaattatacagtgtaccatagttaaaaccttgaaggaaaaaatgcattttgtatttcttcttcttggagaggcccaaacacccctccccagggttggaaaggagagtggaggtagggtaatggaactccctctcaggcctctgaatatggagaaattaagaagaatgggatggggttgggggacagaggtagtaagcaaacaaatgacttatttttaatctagagttacccatttggagagagatacagggttatatcctaacggtacctttttaaaaaataagtcataagtatgctcatgccctaacaagttagtgaatttttccagtaaaattaaaattaaatagaaagccatggtaaattacccatttcatttctccttctagatttaaaaaaaaaaaaagaggcactttgtcgcttcttactgtgagtgcacttcagccttaatacatgcatttatgtcaagggggccatttacactgttgtctgctggagtttttcttctttcaacttagtagggaatatttgtaatctttattaccccaaataaatctacaaaatgccttttgcttgaggccttttattttaatttcagataaataaatcacattaggttcctggctgtcatattaagataagcatggatctaaaaataacaaaagtgtgttttaagctaatgtctttagattaaatagtggtaaatttctctgggtgacccccaaatcgtattgatgttgggatattttttggtacttttggagtgtttcttgaagaatataaacctgtttaaactagaagtggagtttttaagtcatgtatgggcctacttgtacagtattattcaaatccaagcttcttgcggtggcagtaaatctatcttttaagtacgaatatttccccagttacattagggatcaattttatatctttgttggttaatagtgactccatctatacagtggtttatttattaactataaagatcctagtcctgaatttctcgtcatcctctgtactgttagagcttaaagtcttaaagacaattcaaattcaatgtattccattactgactcttcatcagccctcactccaattctgctcctaatcaagccttggttcaaaatgccacctcctctgggaagccttctttggacttctgcaggacagagtctcctaaaatgtgttttatagaaccccctccatccctcaatgccccagtggaataatcttgataaatgtgaaatgtttcttgcaaacaaggtttagagtgaagaggaagggataaactcccaaggttaggacctaaatatatgttctatgatgaattaaagaacagtgggcagatttgataagaaacaggaaatcacagatagaaagtgagtgcagagttttaccctgaccctttttgtgtctccttgccccagaaaacctggattcaaactctaggcaccccctaattagacacatgcatatcacatacaggtgacctaagtaaactataatgaagatcgatcccaaggtgcaaggtgatatcttctgggtgatctggttcaatcaaaccagatgtctttctggacgtagttctactaaaccctgttgttgctggaagaaaggttcttggaagacagtgatgttatttcatcaggggcttcatggttataagaagcctgaacactcccttgcttctctaaagtatgaccagcagtctataataagtatcctttggtggatagcttatcccatagctctccctacgaccgttcaggaataacataaccattgaagcatgtggcaatacccaatttcgagagccctggtttcatctcccttgtgctggacagagggcatagctgagaggccagactcttatcctggcaggggtctgggactgtctgcatctctgaaacaactcctggtgggtaattggggagtgacatttgatgggtttccagggtggctctggggtctgcacttggctgagaatacagctatgatttagaaattcatcccaagggttgagaacagggaaagataatgtgaggcacgctagccctggtctcctttgacctcagcagggtgaatcagggatgcagaacaggaaaccatgtgctgttattgagttggcatagcgtgatgttttgctttcagagcttttattgctattacagagcactgagctctctctttgtttgctacacattctctccccaagagacagcctcttttcctcttgagggatttaaaaaacaaatcatagttcttattttattcagtgtccaccattaagaattcatgcagagcaattttacttgttgccaattaagagctcccagtggaggtctatgattacagtgaaggcaacctgtttaatactcggcgtccccttagtctacataaattaaccccatgaggatagaggcatgctaattcttaagatgcctggatgataggattcttagatacaggatacacagaaggtacatcttcaagaggctctgggcctgactcttctcagagagcatgtcggctttttcttcttacctgtattttacaactacaagataatttctagataacattttagcaaagaatatttcttcctcaaggatagaataatggcatgtggcctcgcagcaagcaatttctctctctcaatttagagctggagggaacgttagaggcaccagggccattaacctctagctaaaaatgtatagatatatcaaaattatggagaacatgaatgagcattttgagcatggatcattttatttcaatgttcactctacttagttaagacatatttgaatcataaggagaatgaaagcaaagtttttacccaatgttttcctatttctgttcttagaataagaatcacatgcaagccagaaaggaaaggtaaaattccattttaaaaatcttggatatataaaagtaattatcttttttttgctagaagggatgagccttagaggatcttcttctgactagggactatacatgctttaaaaattagtcttttactccccctggtgatgtaggaaaccatcagttcccccgccttgggaagcaagagttaagtcttttacttgggcaaatggtttgtaatcagtagtttagattcttggaagtttgtactgaggctttgacttcccctcaggaaattagtgaggaacttgggattgaggttcctacaggttgactttccccttttaccaacaacccagactcttttccccttttaccaacaactcactgctagatgcccttaagtcacccagcccagtaccagtgaagcaggtggtacaagtcatatgtattctatatttggatagcagttagatagatcaccacttccctcgatatgttccttgaaccttagagtagatgctctaagacagataggatttggagttttatttttaaagtaaaaaataaaattttatatccaatatttgcatatacgcagcacatgttagcaggattaatggctctgagaagttctacaattaaaacaaaatgtttaagacttggttttacctaaaattttaaaaatttatttgaccatggagtaccctcatttttcttaaaatatctatgacatagtgacgcagagtattggtgtttcttggaatatactcaggaaaatgcttgcatagattatttagaccactgatgctcaactgtgagaggggacgactttgtcccttagggaatccttgaaatatgcccagagacatttttgttgtcacaactgagggatactactggcaggtggtgtgaaagccagggatcatcctaaacatcctcccctacaatgaagaattgtctggccccaaatgtcgacagtgccttggttgagaaaccctagtgcagatatagcttgttcaaatgaggcttaggtgatctggaatccgtggttggtagctggcactctgcattcagattttgtcatttgattttgatcatggagacctattactcattcttcattaccttaaggtttttgataaaactgtcaccaatttgacttatgaaaatttgaaataaagatgctaacagtcctttcctgaaacaagcccctccttggctggggaccaaaccaactgcccttataacactaacaaattagccaacaagattagaaattatggctcaggagtcatgcagccagaggccgcaagattcctcacatgtccagctgctcctgtgggtaacatcattatggtaaaaccaaagattggtatttgaggtgtttttcagaccctgcattctcatggatcaactggcaccatccagaaaggtgaactggctcatcaggtcttgcagcccccacccaggaactgactcggcgcaagaagacagcttcgactccctatgatttcatcccgacacaaccaatcagcactccccattctctaacatccccacccccaccgccaaactatcttttaaaaactctgacctctgaatctcggaggaggctgatttgggtagtagtaaaactccagtctcccattaacacaaaaagaaagaatatcttaagtgaatacttggacattatctagttgagctactggcaagttgttagattgttccattagtcatttctactcataggttctttgaagctttctatgacatttgtattatgtagctgtatcattgcataatatttaagtgttatttaaaaacatgtgttttataaatgcaatataatattccagacaccatttcataatctcagtgctgagtaatcttaaatactagctatattaataccttcttttcacagataagaaaactccatttcagagatgttatttagcagccagtttatgcaggccagacaagagtccaagtccccaaaacctccagtccagttttcttcctattgtgtagtattatgctgctctcacttttttatatataattttacatttgtggcttgaaagtaatttcaatgccataagcattcataaattcaatttgtatattccacctgtttattctaaactcttaatatgaggccgcaaatggataaagattttttatcacttgttaggaaagacattttcagcacttttttcttatgtttcttgtcacaaatatatttagccaaatcagaaatagcaacaaatgatataaaaaaattctttttctcctaatattaacttttcacattagaacaaatagaagtacaggaaattatggttgtgtttcaacctgaactagtatacaggttgtcacagtgtgtgtgtgtgtgtgtgtgtgtgtgtgtgtgtgtgtgtgtgttttaaatcaagcagggagatacagagcagattaaactcaccccgacttatgctcaagtcttagactaagttctagattctgactccattctcttctttagatgaattctcagttttcctctttaggaaggatttgttgctatcaaaaagacaattgagcttttaaaggactgctcattgctagacagttatttatgaactccataaattcctttgcaacttgaaaacccagagatagattataggtctatttcaacagaatattagacaggaccccaaaataaccagttatctcaagagtgttattgcaatatatttttgtgtcacagcagatggttatgctataagaaccaactaaagttggttaaagactagcagccccctccatggaggaaaggaaactttttaatctttgcacctagtcctatattatttatccaagtcttattcaccaagtggcaacaagagtatgccttatttcaaccatgcttctgatcagtcctcaaaggtggtagccataaattaatcctgaccacaattattattggaagatctagatgttcagaacttgactctaagttagctccagtataaatggaaggccaccagttaacattagcagcaatgacaaatagcccactccatgacaatggtagcagccacaaatcaaaggcatataaaatcagagaaggagcctatactgatttatgggagcatttgtttaacttcaggcaatctggttgtgcttgtgaacatgacatgctattcccatgatcccctgtatatcacagattctattctaacttatgaacaagcacttaaaaatttaatcataaccagaaaggatttcctacactgttcactgtcactcacatattcttctctaaaaacaatttggctacagttgttgttatgaaattgtaacaaccatcataaagcctgtcactttaagtcagtgaagtcaggatctgttggcaaaaatataatcaaaagtaatttcatgattcaataaatagtatataaatctgctattattggagttcattttctttcaataccacccatttccatcttctcaatggaattattctgactatccaagtgtcattattaccttctattgttatttaaatggagcatttttattagatcctctgacactatatataaggctttgcttcctcagcagtaataattccatttctgaaggaaaatagaagtaactgtacagaaaattctaagctctcactttatgttaactccatgcctgaaatggaattttaatttaatcatatctgagaagacctaggtttttattagctacctcaagaaagtaagaaaaatagccctttccatgcaggttgttttggttcaaagagcccatgaaaccattattcatctataataatgcgtgtaagatacacttactaaccaaattaaactctaaatttctttcatcagatggcattcattattttttgtaaatttttcttttggaagatgggaaaaataaaatattccgtataaatagttgaaataaaacattataccggttatacagttttaaaaatatactttccaagagatctatggaaaatataattaaaaggatacaaccatacatgttattgctgatttaattaatacattggttcacaaaataaaactatcagaatcaggttatagttctcaaagacaaatctagcaaatattgcatcaattacataaaattaactggtgtgcaacatgacgcatgtatacatatgtagtaacaaacctgcacgttgtgcacatgtaccctagaacttaaagtataatttaaaaaaataaaaataaataaataaataaataaataaaaattaactggtgtgtccattagggtcgaacagacttcactgaatttttgttgtatcctaccagcagtttttctatgtatagaaatagaatattctctattactgtaatcagaggtctgtcttccagtataaaaacaaatataagaatataacaaattaaaacatatagcactttacccaagacctagaacgcctgaaagaagataaattttgaggttattagaatttttacagtggcgcaacaagaagaggcaacccggcctggtgaggagccccatggtgatggatttggatgaggtctagcaagaaaacaagagagttagtaagtatttacctgccatctctgtgtacagagagagcactctccccatgccgcaaggagatgaaaagaaataaaggggccgggcccgggggctcacacctgtaatctcagcactttgggagtccaaggcgggtggatcacctgaggtcaggagttcgagaccagcctggccaacatggtgaaacactgtctctactaaaaatacaaaaaaaaattagccgagtgtggcggaaggcacctgtaatcccagctacacgggaggctgaggcaggagaactgcttgaaccagggaggtggaggttgcagtgagccaagttcctgccattgcactccagcctgggcaacaagagcaaatctctgtctcagtcaatcaatcaatcaatgactttaggggcttactgagggtgggtgagacaaatgtacttaataaaacaatttcggtacaatatgaggcatcacgtaattaagcaccagcatatttatttcatagaccgctagcaagactaatgaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctctctaactcattttatgaggccagcatcattctgataccaaagccgggcagagacacaaccaaaaaagagaattttagacgaatatccttgatgaacactgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaattaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagcgcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaagcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaacatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagattaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattgaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaagaaatgctcatcatcactggccatcagagaaatgcaaatcaaaaccactatgagatatcatctcacaccagttagaatggccatcattaaaaagtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcacaagaacaaaaaaccaaacactgcatattctcactcataggtgggaattgaacaatgagatcacatggacacaggaaggggaatatcacactctggggactgtggtggggtcgggggaggggggatggatagcattgggagatatacctaatgctagatgacacattagtgggtgcagcgcaccagcatggcacatgtatacatatgtaactaacctgcacaatgtgcacatgtaccctaaaacttagagtataataaaaaaataaaaataaaaaaaataaataaataaataaataaataaatcttgaagcaagcaaggatcaaataatttgggctctagttttcacattacaattttgccattccaagatgatagtttcttagaatctaacagtttttagccagacaaggacttagtatatattctgtagtctaactgaaatattttagatcagcaaagctataaaggatgctacctgagcaagcaaataagaacatgaattgaactcacctccagagactcctgtgttgctcctcaagctgagtcagcagatgctcaatgtatttattggagtccatgtattcctgcacaagcagacaaagacagatgaaaactcactatgacagtccccaccatcctaagaccctgaccttatctctacaaggagtatttttgacaacattatccctacttcccttccggttctaggattctctgcttctatgacttgcaatcatatgtaaatactattttttcatgtcctatgatagttttgtaaacaaatcacagaagtgaactgtcattacactgagtcagcattacaatcctcttattcacagaagaaaggcctaaatttcatagtcatctaaactggagtctgtgttctactgtatataaatatttctgccaattatagaaaaagaaaatagacaaaacagttcttgattttactggtcttatgacagtcatgttccagcaaaagtaatgttttcaaactatgtagaatgttttatataaatataatatatacccatattcattgggcacttgtatacactaatggacatgtccatttttcttcaactccatatatacacacaaaacagtgtatttgctttttttttattcttaaacataaatctttggcttctaaaaagacctgaaaggtatggtgtattctgctctatagaaatgtatatgtaaatttatttctctaaatcaaactattttcctgaaatgtatctgaaaaaaaattaaagaattcacgtgttacatgagaagtaagcagaaaaatccataggttattacaatggatttaatttgtgatttctgcatacgaggctcatatgcaatggtgtttcctttgctaacctggagcaaatacaacctatacaaattcttttgtattgttttcctctgaatctggtattttattccctttctgtttagaggtctaccgtgcaggcctctgcttctacattatagcagccgtcgatggaacagtattcaatgatttcaatgttaaggcacccaagaaagctagagttccatttctatagatttgaaataaactgggaactttgattaacagtgacatttttctttcagaaatataggtttcttttgaaatgctatacataatatactgctcttatagaaatattcactataataaggtgaggggctgggagaaagacaggagttgatcccatataatggaaagggaccagtcctgatttcttttgatcctggatctacccatgcggccttgaaaagccttttttaccttcccaaaatgtttgttagactagagggtatactaagtccttgtctagctaaaaactgttatgattctaagatactgtaattctgttatagataattagctaagaagttttatgcttattgaataaacatttattttcaggtgactactcaatagttatttaaacaagaccactgggaatgttaaaaacaaagcagaaagctctgctactgcaggaagttgcaacatacatggttacgcttttaactgtcctgatcaaggctaaaccatgatttagaacacttgacactatcaaatacatgaattctcaaatatgttcagccaagaaaaactaaatacgttgttcccaagtagaaataaatgtacagatcttaaagttattcattttttcttcacttaacaactatttttaaacatctgttagatgcgaagagctgttctaagtgctgcagatacagtaatcatcaagagggggaaagccactgccctcaaggagcttacagtctgtcaaaggggttatactaaataagtgaacggattcgtttcatgttggttacgtgctatgaagtaaacaggtgataggaaagactttgggaggagcagctttgtcacgtgaagactccagaagaagactctaagcaagtgatatttgagctaagacttggaagaggagaaggaaaccatatagagaaaagggagccagacattacaggcagagaaaacaccatatacaaaggtcctgaaatgtgctgttggaggaacagaaggaagccagtgggtgctgggaacagggactcagggatactgggtctaaaatgaagttggacagttaggcaggaccaaatcatgtgcaagccttagaaagcagcttggacttgtcattttgttcattctgattatctcaagtcagaagttgaagctgaaaggtgtagtgatgacaaatgagactttagtatcaaagagactgaggttcaaatcctggttttgatacttactagctatgttcccctggtcacattattaaatctctctaagccttagtttcttcatcttcgtcagagggataaataatgcttcatttatggaggcattgtaagtgttaaacaagaagtttaagtacatacataccatcatgactgccaaatagcaagcatggcctttttcagagtattatgtacctcttttcaaaaggaagatcactttacaaggtgaaggcattattcattttctcttctcttgccaaacttcaagatttttaagtgtacagttcttaggttatacacactaaatattagaataggcagttaggcagagattgataatactgatctctaatctgaatgtagttgtcactggcttgtgatttcaaagctatttcaaataaaaatactagctgcttccatttaaactagctttatcctgttttccatataaataactatgatgacaaatcttaaaccacttaaaaatgggaaactaagattattgattcttcatccctcttttcagctttattttttctctatggcattcttacttccaacattcaatatattttacttatttattaaggtattgcctcaatataacgctaacaaaaatggattgcgaaaagagacattaatcttacatatattttttgttaagtgaaattgtttttgctcaacctgaaataggaagtaccttcatacctgtatcatttctggaccctgaactggaaaagttagttacctaatgtgaaaacactatcataggattataaaataggattactcctagggggaattttgtggatccctttggagattaactccaagaaaacaatggagggtggtagcattggggctggcagtggttaagaggaaactatggtcaccataagtaaaatgctattggcacagtggctgcaagagctttgggagcaagtacatacaggaggttattgtacagagacttcagtatcccagcatgcctgcaaaggcgaaagaaaaggtccagagagattttttcagagtaaactgaaaaaatgcaacatggaacccatgaacaagtactgtaggacaagagagaggacatgatccttaatcataaaagagggtgtgacggtgaaaattatttacataagaaagatatgtaagcattttagaaagagcctcagacatgctgactagtatccagaaagatgtggtctctctgacacatgtgaagaaagttcttttttaatgttgagatgaaaagacagcagaattagattttaaaagataatagggtgagcagccaagataataaaatgacataaaataaagacagggctgagtgagctaagaatttcagggcaacatacaccttacaggcagaatggaaatctatttattgctgtcctgtgattcttattatgaggtgactctccctaccatgaaatggtgcttcagagaaagcaggcaacaggttttggtgtattggcactgaatcgttcatacagatgaaagtctatttctcaatatctcatttgggaaacaatcaaattccccaacccaggccaggtacttacatactcctcttctcctatttctacagtataagtcaattagtgtacgtatcattcagttagtgaagagcaagcatcctgtcatctagggagaaaaaataaacacccatatccacatatcccttgatgtcagtgttcactattcctaacacatatctatgaaaaatatcaatttcccaagccttgctttgttcagcatgcaacttcctacctcattcagcacaaagatactattaaactattgttactaacttgatgaacatcctattctactggtttctgttagaattacgaaacccaccttagatacaataaacagtagaattgacaacgaaaacttacatacagtcctgaggaggataaacttaatctgtaactaaattaagaaataaaggataaggatgaaaatgaatgcagatgtgattgataaaaaggccagaaaatatcagtttgtcaaacaatgatagaatttgagtacttgataagatttgaaatgcaaacaacaaacaaagggataaagaaatatttcagcacaggggaaaaaataaggacgtgattatgtacatcaaaaggactcatcactttccaggtagagttaacggaaaacaatccacacatctattggcacaagagttgaaaaaaaatagtgaagaaaaaaaagggggacttgtttgaatgcttatagctcaacaaggagcaaaaccacatagctccatagcttccagccaccccaaatgcccattgaaattagtttatagacaaaccataaatattattcccaattaagtagctcctatataacaaagcaacagaaagacattctcaggcattcatgaattcataaaatacaggacctacatcttttaattaaaaacttatgtttttatgcatatgtgtataaccaaaaggtgtctgtgtgcaggtaagtatatgtacatatactatgcattatctatgcacatatgtaatacctgagcaaagaataaaaaaatatggaattcacaatataaaaagaggcttcaaaggaggttcatccccccaaaaagatgttttaaaaagtaattacaaaacaaacataaaatcccagagagaaaaagtggaatatacattatctatttttgtgatgggcagaaggaggacaagagggaaagaaagagggaactgttaatagaagggtgcataaatcactttgaatataggggaagaaattattgttctatttttttttttttttttttttttttttgagacggagtctcgctctgtcgcccaggctggagtgcagtggcgggatctcggctcactgcaagctccgcctcccgggttcacgccattctcccacctcagcctcccgagtagctgggactacaggcgcccgccaccacgcccggctaattttttgtatttttagtagagacggggtttcaccattttagccgggatggtctcgatctcctgaccttgtgatccgcccgcctcggcctcccaaagtgctgggattacaggcgtgagccaccgcgcccggctattgttctatttttgactcgataataaaaaatgcttaagtataagggtgtgttttgcctgtgtatgtacaactggggaaagcaatttggtgatccatgttgtgattttaagacatccgtgcccttttgatgtagaaactccctgtctagaaatcagcctgaggaaataatcagatgaaagcaaatgatattcattgaaatactatttgtgacaatatgaaaagactgggtatgtcttattttccaaaactatagaaataattaaaataaagcatgcttttttcgtttgaagaaatacaattcttttttttttttttttttttttttttttttgagacggagtcttgctctgtcgcccaggccggactgcggactgcagtggcgcaatctcggctcactgcaagctctctgcttcccgggttcacgccattctcctgcctcagcctcccgagtagctgggattacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccgaagaaatacaattcttaaactttgtaaagaatatataataaagtagaaaacagtgtaatgctaagtgaaagaaggataaaaaaactgcacaatccctcttatcacaatttagaaaatatatatgaaagattaaaagtaatatcctacagtaaatggtaatattatgggctaatttaattttcttctgtaaattttttctttgtctatagttttacaaaactatatgctcattataaaaatttaaagtaatggatattatatagaaaaatacagtcccagaaaataatgtccatgaagatttgattataaattttagaaagcttgatctgaaataccacaaggaaaccatttcctttatattattctaaagctaggctcatgtttgaaacaatgaacccccctttccacttgccctcgttagtgttctgataaaagcatttcaccaaagttaggattaagggggctgaaggtggggggcaccaagttacaccaagtcatattttatgttttaaaaattttacaaaggtacagcattaaaaagacatctgttccctggctaaaacttatgcaaattagaatcattttagagatatatttcaggaagtttgcctttcacttcttttaatgcacatgtttcagggcaattagtatgaaacatttaaagtgattagaggtttatagatacactgaacattgcaggtctttgtagcataagcccatttaatgtgaatctcctattgtctgaaataggtcagttctgagagaggcccattataaatgaattctaatgatgtgaggatcttaagtatcattcatattaagtggagtttaaaataaaatcgtgtatcaaagcttgcagagatccaaaaatccctccaaataatcttcgtattataatcagcataacttatggcagagcttgtgaaatcctgccagcaattttgtgactagtaacatagaatccccaattcacctttgggcaaagcagcaccagcaaggcggccagctgttcaaatcaacacaactatctgcaattaggaaatgactaactaccacaacaaagtaatttttaagcgggggagggcatcagttcttctcttaataaaaaggtatacctgcatggtgaatgcaaaaaactcaaataaaatacccactttgggaactatacagacaaggtaataaatagaaaggtgtctcataactaactggcatctgtaccaatataaattcttccgaggagacttttttaaatgttaaacaccacaagcaaatcaatttaggagtcccagcttgaacagatccatcctcccaccgccatcttagcatcagccatcttgaattcctctttcccattgcctcctcaaacagctgcaacctggcttctaaggcagactttctagtggagctttcccattagagcaaatgatggcctccgcaaggtggaatcccaggattttgcttggtccttgtcttatgaccagtgcctacagcacttcacattttaaaatcatactctccctccctggtattctctgaaagtgtctccccgtattccatcactctgaggtccagcatggcctgtgctgctcaatcacgctctgcaggtccaatcctgtgagtctggctatttcccaaacaggtccctttggatgtgccacatactctttcgagtaggccatccttcatttctgtgtcctccaacacctaccacagcccttggaacatctcaagcactcaaaggtgtgttaagtaagtgaaagagtgaattaattgtctggatgtaaccaggctcatgagagaatctgagattaggctataagtggtcttggtcttccaaaacttttacttgtaaaggttttgatgatcatggagacattaggcagtcatgacaagatggcagaaacagtgtttttgttttgttttccctctcctctcatacaccactcaatgtgatgcttctgacagcagatgaatgggaatttttccctatacgtcaaccaaacaattctccagcagacaccagctaggtgtcctaaaatttaactcaattctgacacgatctacctggagatagcatcacatccctcagggtgagggctcagtcccataagactgccccggcttcagacaccaatcacaagtaccacagtgggctgccacctataattctgatcagccagctataaatcagggttcccaccacaacatcctcaagcttgattaatttgctacagcagttcacagaactcaaggaagcattttacttaggtttacccatttattgtaagtgatattacaaacgatacagataaacagctagatggaagagctgcataggacgaggtatgggagaaggggttcagaacttccatgctctctcctggcacactgccctccaggaacttccatgagttcagctatctggaagccccttgagcccagtcctcctgggttttatggaggatgtattaggtaggaatgactgattacatcattggccattggtggtcaactcaaccagagcttggtaggtagggctgaaagttccaaccctttaatcacatgtttggctctcctggcaaccagcccccatcctgaggctatccaggagcccacagtcttctaaatagaacaaaagatgatcctatcacccagaaaattctaagggatttaagagctctgtgccagatgttatcactcagaaaataagaaacgttttaggatctctgtgtcagaaaccaggagtcaaagaccaaatattagaacaaaaggttatcctagtaccctatctacaagggttttaggagttctgtgccagaaactgggaagcagagaccgaatatatatatttaatcctagcagttttctaaattactttttactcatgattttattctattggtactagccagaaatgacattccaaactattgataatttcacaaaataagtgcgtttttctaatcttgcaactctgagaaaaatttaggtacattgctcatctatggcatgtaaatcacatgagctgtcaaagatttcaacacagtaaaattcacaaccaaaatttgctttcaaatggagagataactgatgataagaaagcatgatgactagcaaactgcacagagtgaaaacatctctttataacctctgtcatatatggaaatttcatcagtatgaattaacagtgacagaatttagacagatagcacatgagaccattgaaaagcctcgtgacctgttatttggtaccaaggcagtagactaatgccgatcagactatgagtacagcttagcagatcttcagagtaaaacatacttcaatttgttggatactgcttaactgttccctattagatatttttccccttttaaaaaaaatcccccatctctctccagctgtagctggacacactgctcccaagctagaaattatgtttcccagtctcctgtgcttcttggggtgaacacgtgcctgagttcaagccaaagagaggtaagcagaaatggtttgtgcaatatccaggaaatccccagcctaaagacaagacactgcctattgtgcactcttcccctggccagaaacggtgaagccttgggctcagagacagtcctacatgctaaggatagctaaagtgatagttcttagagcacctatctactgaccctagtctttctacctccctttggcctaaataagatagaaataaattcctatcttaattaaaacactgtattttgggctttctttgttactgtacacctagcctatgctacaagtaatataaatattggtcaattcttttcaaagttaacatggcaaactgtgaaatacgaagcagcagtcatctctatattactttattgattgatgttgtttgtagatgttatagttttccaaagcactttgacatccattcacatttaagcctcacaacatctttgagtcatggtcaccatttcaatttagaaaactaatgctcagattatggttaagtaatttgcttagggtcagacaataacagactttaaaagtctgtttttgctcagttcagcacattttttcactgccctaaagaatgcccttcccacagctaactgccctcagagtggattttatgttggttagatggaaactagctacagaatgaccccctccaccgcagccctctccaccaatttgtagtgtgtgctggggggaatctggctagatgcaaagccataaaacaaaaatcaagaaatgagttttcaaattctaccaattgggcatctgtgtaagtttggctttggttccactttgatttccctgccctagtgcaatgagggtgagggcagaagttaagttgtattctcccattcagtattctattctattaataataatgaaataaatctacacaaaagttaaacaatttttagttatatttgacaaagatgctattactaatacttagatattcttttttaggtaaaaagagttatacttatttttcagcaaaatagtaactattgtatttctcagcagcctgtactattttcttaaatattgtttctatagcagcttgggagataaacatatattggtcaaatgaaggaattcatttaggtggaaaaaataagttcacttattttgtttttgttttttttttctgaggtagaaataaaaactaattcaactgtcctcaagttctgcaagtcagtaacatgtcatttgtcagcatggcagtaattgtgtatgtttttaaaaagtcaccataaaaatacaaatgacataattagaagagtcctcatttcaacctctatttttcatttgatggagaaacactggtagagccttatatgagtgaaaagtcttaggaccccagctactctacatgaaagaatttggccatggaaagttcaaagactaatttaaatcccagcattacatccacacacagcaggaattgaccaatgatccattgcatcagtacactgtactttcagacatttccttctacccaaatactggatcacggactgccatttcattcactacagtatatcaggaccgcctgagcctatgattatcaatatcattcaaaatctggccaggtatgttctaattttctctcccattactccccaaagctatcctgggagtccagtgaagccaggctccttgctttttctgaacaggccaagttataagttctttgcagtctcagcacctagcacaagacctgcaaataatagatggcaaggcatttctagaaaccagggtttctagaaactggaattgggttacggcatcaagtagggaaaacacatttgtttgctgctacttatggctcccatctgttcatctgagtcacctggtgggctagttaaaacacagattactgggtcctgaccccagagtttgattcagtgggcatgcaatggagcctgatattttgcatctctgagaagctcccaggtgtttctaatgctgctggtctggggaccactctgtaaatcactggcttatggtaaccaggattagtttactgattaccccgattaccacccactgtcctcctaaagagattaataaggccagtgtaaataatgccagatgcaattattctgcaaatattttcaagggttaattatgttcaggcactcttcaaggtctgggcaatacagccatgtacagtgcaggcaagtctctgcctgcatgaaggtaacatttttgtgagggagacagacaaaataagtggaggtaagtggaaaaacaaaatagagaagaggaaaggaggggctgaagtagaggggtggcatcaacatagactggtggaggaagaccacactgaagacatttgagcaaacacctaaaggaagtgacggaactaaccgaggtggctactttgggaggctcattctaggcagacaaaaccagcgtaaaggactctaggggcaggaatgtgtgccggcatgctgcaggaacagcacagaggccagtgtggctggagtgcagagatggggtgaggggaggagggtgatcatcacagctgcataagcccttgtagggactttgcattttgttctcagtgacatagggaacaattgcagtgggatttgatttgaggagtcaaatggtatcacttaagtcttgaatggatccttctggctgctgttgactgaaggaatagggggcaggggcaggagcagctgaggccactggaaggagatcaacatcactttcactagggaggtcaccaggagaatcatgctaagttgttggattcaggatctgtttcgaagatggaggtaacagaacttcatgatggattcaatgtgggatatgaaataaaataaaaatcgaagataatatttgatttggggcctgagcagttggataatgtgctattttggggtaaatttgtgcaaggggtgttgaataaattgttctcctttggcagtgaagtttgtgacgtcattacatatgaaagagtagatgtcaaccaggtcgttagtgctcaagaattttggattccagtgtgtatggatataaacatggagccgtgacatcgaatgggattacctgaggaaggaaccacagtaaagaaaaaaggacctagtacttggaggttgagaggagaaaaaaaaaaaagtaaatgaaggagaggccagtgagggaggaacaggagaaggtgttctaagaagaaagtagtgttaaatacaatcagtggtcaagtaagacaggcccccaaattggccaccaaattggccaatatagtggccattagcggcccgacaaaaacagtttcagtggaggagcctttccaaatacctcacttggggtagaggttggggaaaggtgaagaataaagacaaaattttatgccaagggtagggagaacaagtaagaacaaagctttttcagaaaatatcataaatatcatgtgattcttgaaaatcagtctccaagagaccatggggctacggaggcccttgggaaaagggtgcattccaggtcctatcccagagattcaggttcagtaagtctaggaataagatgggacccagagatgtaattttaacaagaacttgtaggaggatgttgccagttctccttgggacacttttggagaatggtctcccaaacagaatttctggttatttccgatgacttaacacaacaaaacaaaccaactgccacaaccaccatgcaaccaacacactgaacctttccttgaaacacctccaatacctattctaccaaagtgaatcagggccttggattctcttgacattcaaatgagattggggacaaggtgataaacatgaagactttttagaaacagagcagatggtgcttctcatgttggatctaggaactcttttaggaaaacctagactgcctatcccaggaagactccttttgctacacaagaggaccgtcaaactatttaaaaattttgtttcgtttttatatttatctttaagagacttccctcaagaaagaggttacttcctgcagtgtgaggagattatacatttatgcactaacacataaaccttgcttggattttattttctaagccagaaagcatttgtggatgtgcagatttcagtgtgttgcctgttaaactgcatttcttacttatgggcactgaacataaatcacccaagaggagcgaacattcctcctggagtgaggtatttcaaagactgcctctactgccgctgggtgggaatgggtggtgcccaggatctgatcacatttatgtctctattttcatggtaaaaatgtgaagacaaaagtaatggaccagatctgagttctcctggctgtcatgggctgcaggctgttgtttgtattaagcagctgaacactgtttgacttgtcttggtgaaaagaaacactagctctatcttgttgcttctcctccaacaaaaaggcagcagaacaagtgaatcaccatgactgaccagcatgttttcttcttacccctaaatctcttctccatattaagagatatactaaggagaccataggcatttatttccctgccactggcctcaggaaataaaggatggagcgcctgaagagaccttctcagacctagtattttgcacatgccctcacaaaaaataaacgtgtatcaccaatagagaacatgaaagcaaaccaaaagtcataaagcattctggaagtcagaaagaagtttccatttgattgacaaaagctgcaaaaccagaacccaaaacacatccaggataaaatcaccatgaagatgaggactgaactgggaaaaactgcaagctcagattgaacataagagcaggagggacctcttgggcaatcgtctgtgtgatatttaagtatggtattccatggccacccccctccttccagcaagtggtaggagagattgaactcaagataaagaactgttctctactgaggattagtttccatctaaggaggtagagccatgaggctgggtggggttttggggttgggttctgtgcaggtgtggaggcgtcaccagggctgaattcatgggcacctccccgcagacactgtaggcctattcaatagaacctgctctccagtcaaggctgccaactcagagggcttctaatgttatgtggagagccctgcatccttcgccagctgtagccgacttagtgctgaaaacacttgaacttgcccaacatcctccacaaagaggccaactctatagaaagacacttagcttcctaaggactggttaattggtatttcaatgtgatgccctatgccaacaccaggactggtataatgggtataggtgcaaagcaggacccatctggctggcaatcctcatttcagatctttacatctgaccatgaaaaggccaagctggaaacaaaagggtggcagagtaagaatgagggcctctgcctcctggaaacagaggaatcccttcagggggctgtgtatattttcactgtgcagctcctctttctcgtttgctatcttagcaagccctgtcaaggaagaatgtggaaaagggaaacagtgggaaaacaggaactcctgatactacagaacccttttctccttcaactttacctccagagactgagcctatgtcatagttgattctctaataccagcataaacagctttcaggagaatcatgcctcagtcaattgccaatcatacagggaagattttaggatggtttaagaagatggagagaaaggatttatgaagtagtagatacccatccctgccccacccaaaataaacaactcagtagcatatacttctcttttttccaataaagagactgtcgttaaatacaatctgtttcttggcttcttctgctctcaactctagcttgtaatatgtgaagtaatttgagattatcctcagaagttccacagatatcttgtggtacaaaatgattaccaatactgtgattaaaaagtgcttttataggtggtaacctggagggctgatacaacctgatgtaaacagcactgctgccttgtttgaaaggtaattagaaagccattttgttctgacagtggagaatccgattcaggagaaaagtttcttctctcctgaggggccaaaccaaatatgtgatggaatatagctgtggcactctttgaaccttctcattggaaaatctggagagaaatgggacatacggcaacttttaagttgaaagcccttgtgcccagggcccctgtctctgtgccagtccatccctggaagagcaatggtgcaatgcaataactcagcgctgcccttcacatgatggtggctggtatgctcccctgggttctacctgggatgaccaaatggtacccttagcctccactgaacacccacttcacaaagacacattatcctgacaattaagatctaatgcaacggttctcccactatggacacagaccagcattgttaacatcacctgcaaatttcattagaaatgcaacttctctggcctttccccaggcccactgaactctgggggtggaggggcccaacaatgtatggttttaggagccctccaggtgattctgatccactaaaccttaagaacgactcttcaatagtcaaattaacccatcattacaatcattcattccaggtgtgtgagccacccctccccccccgcccccttccaccccctgcattttcaagataaatcatttgacgctatagtgaatttgaattactatcagcattgatgaacaattcaaggtttcttttcaaaatatctcatttttgagggtagagggctgggaaatcagaccttgcatcaggtgaaacactgaagtttaattaaaataatgcaaaaccagcaacagctgccctgctgtgaagcctatgtttgtacttaatgatttaggtgctgtttttcaggacgagagaagtacccatgataaatatgatgcaggtgcacccgggatgttacctttttttttaagtatctcctctcaaagcgttatgcagctaaaaccattcaatcagtggactatgcactatttgggatttgaagagacacctggaccatgtaagaattttgtattgggacggtcacctaagacagaaattcctttttaaaatatacatatttgggatagcaacgcagacagttcacttaccagtggatagtaatttaactattctaatgcttatttttcatgaaaatcagccactcttagacaaggcagatgtgttaaatcaatttaggaaggcaatttactatgatgaggttgttaaagagtcaaacggaacatcaggaaacttatgcaaatatttttgggaatttgttctgagtatgcaaatgctatataattagttatcatgcttttcatgcaaaattaaatttgctataataacgaatcacactcaagaataaggctagttaacatgaaaagaaccctcatttttatgactgaaagactgcaaattgagggtaaactgcaggtgaatctaattccagcctttaggattattattcattccggtcaaacgaaaccaactgcaacaagggatgggagggctctctgactctggacagcacatgtatggatgcaaaaatcacaaggagtagaagcaatggagtgttgtgctttttggactaaggctgtctcagctatcattagccagatactcttttaccctctaattattttggaaggactcagtgctatcatttaatatttatcagactagcaaagccaaacttctattttggaatatctctaaagtctaattactgctcagtcccttcctgccccagactgacaatttggagataatttggacttccagcatgttggctcttcctgcctcactctgtaaatgtccccacttgtcacggggctctctagacctcctctcgctgtcaaagtcctatgtctgctatatttgccaggctatgtaataattaggcccttggctgggtgcggtggctcacgcctgtaatcccagcactttgggaggccaaggtgggcagatcacgaggtcaggagatcgagaccatcctggctaacatggtgaaaccccgtctctactaaaaatacagaaaattagccaggcgtggtggtgggcacccgtagtcccagctactcgggaggctgaggcaggggaatggtgtgaacccggaaggcggagcttgcagtgagccgagatcacaccactgcactccagcgagactctgtctcaaataaacaacaaaacaaacaaacaaaaaaaaagaaaagaaaaaggccctttatgcctcctggccacttgtagaccactcccatttggccaggaatgagacatgttccatagcatgaaactttctgtgatgacgctggagaagtcctgagcaaaccaggtgagttggtcactctaccacaatcacacgtttccccatgactcccaggctgtttgcccattcctgtgggtgtcagttttcctaactatgcttcaaattcctcactggagtaggcttagccataacttctagtgctgcagactagccctaaccccaggagtcgtgtatgctcatctgctatccactaaagaagtggaggctccatccagtgagcctgatcactgacccatgtcttgccttatcccaggtggactgctcaggaataaaggggtttccagctgcctgaggactgacaaagggttccttctgtcacctccccagatcggagcctcaaagataccagtttgcatcacagccacccccatcccaccctcacccaatctgtgattagactcagtgcccttcagtgggactagcactttacctaggttaggctcagttatattcttgctttatacctactccacaccggatcattgtggaggtcccaggttttacctaaaaataccttgcaacctactattaaaagtgaagactgcacctgaacattcatgttgtctttacacataggatcacaagatactgttgatacagaatctagagttgtcaagtactttgtcatattaagcttacaatgacaaaactaggttttagtagcatgattttaggacaaaaaggaacccaaagccatacatttgaagactacatctatcccttagactgaaaagtcagacatggtagaaatgttttataaaagaagagaaaagcgggaaatgaatgccttgctgcccatagagacgtccagttttctgttgaggctggctgttaaaagtacctgactccattggtttcaataaatagctcaatcaccttgttcttgctaaagctcaagctcaataacccaatattccctagccacatacaatgcatttaacccttttcctcattatcccacttaagctaaaaaacaagacaaaacacaaacaggatagccagatgaactcttaattccaaaacaatatcaattgaattcactccatttgctagtactgccttctcaaccatgccttgtcttagctcaatattaattaggtaaaacttaatagtcatgcaacctggcccacatcaaaaattatatacctataaaaatgtgcatttttctagtttttatacatttcatacttcgtctcataagtcattctgtaaagtgagtgtcattccctcatttgtcacttttgtaaagcccatcttataaaggtttatttagcagaaaggctaatagattttattaataggcatagtctttccaacctgtaaaaacaccaatacttaagtcaaatatttttgtacccactatgcaaatagtactttgctaaaaacatcaccgttagcctaggagaatgagacaaagcatagatgcaagaaagttctatgcagtaagtgatacagacattttacagcaaaaaggtatcatctgtgattgagatccagaggcaggtagaaatgaaagcttagagagtgagcttgtggaaagataattgataaactacattttacatgatactttattttcaacactccattacaaagtttgcttaattatcttttacaacataccagtaaaacagtgtgtctgtctctgtattactgatgagaaacctgggctcatagagttcaagtaacaatatctgagtgggtagttgaaaacaaaatgttacactaaatcattaaaagtaaaagttgaaaaattatctttctagtaattttcaccacccatccaggatattcttctaacaattgcatttgagaatctatcctgggggatgagaccctaggacacatagaagctatgtggaccttgagtactttgggtctatttccttatttataaaatgaagagatggggccagatcagtggttagcaaacctcagccagcactagtaccacctggagagcttgctaaaacagactgcagggtcccacccccaagaatttctgattcagcacatctggggtgagacctgaaaatttgcatttctaacaaattatcaggtgaggtggatgttgatgctgcttgtccagggaccactttgagaactactagactggtctttagggcctctaggattttgagtatggaaagacagacaatattcttaacttctagaccagctgcaagtaagagttccctcatttatccttccacctattcattcaacaaatggacacttgttggtttgtgaacaagtgtgttttcaaatagttccaagtttgcctaaaagtagggaaaaatctcaattatttaattgatatcatttatggatatttggcaattttctttaactctatttcgtgatcatgtaaaatcaggaaaaaatcaattaaatcaggaaatgcatgcaaaaattattaacagtgtctgacatagagatctcagcaaacattagttctatggatcagggaaacaatttacatatcatattgcacttttgcctctcatatttttattccagctgctagcatctatcctatttcagcatctcagggttttcctcctcatcctttgttggagaagctgatgaagttagcaaggcttgggtcacggtaatactgagggagggataggctgggttaaagaggagagaatgattatatgcgaactatatgactggttcctaacaaaagttaatggattaaatacaaaatccctgcccttcagtgtgttccagctctcattagtgccaactgcatctcaaggcacacctttctcctgtgccacctatgtccttggcatacagttggagcaggagatgggggcgctactggcagccaaagaaatggacagaaccagtgtgattgtctggggaatctgacagagaggtaaattgaacttaatcactgtcccagccaaatcacatttgtaaaggctgaggctctgtggacacctgttataaataaagcaattcctaatgtttttctacaagacctgagcctttggttgatctcagtttctcagtataagaaccatttttctcacccagggcctggcatcagcaatttggtgttatgtcccaagaaattccccaaaactcctgggatggcacaaagttgtcctagctatgtgagttagactctgagctccagacagaaatactcatttccaggttcagcttctaaaaatacctgccttcacgtatgtcctttggctccgggaggtttccaaactacaaccaaagtctgagatgaaaacttaaagaaggctagactgcatgaaatttacctcacctatcccggcacaagccagaactggatgaggcgtaaaccaggcctgctgtgcaaacagatgcattctacctctggggatggctcaagggaatcataaacaccccacattgagagggcaggaggcctgagtggcatttaggtttctctgaggcttattttgtgaaagcaaaactgactcactgagaaaacattttaaaaatatttacttggaattacataaaaaatattttaaatgatttttgttttttcagaggtaggaaagtctgttttatagctggctgctgagtcagacagaatagccggaaagactttgggaaacctcagcctctctttggcctctgcagttgtgaggccgggagatgtggttctgaaacccaggcaagttgctgaagcacacagaggaattcccagaatttcctctaaagttttcacttagatgtcacaaagaaggcctgatttcagcgaaataaaagtttgttgcagagtcacacatgagcaccagttgtaactaagaaaatatatatatacattctaaagcacatactgtattccaagtgcttttttttttcttttcttttttgagacggagcctggctctgtcgcccaggctggagtgcagtggcacgatctcggctcactgcaaccttcaccgcctgggttcaagtgattcttttgcctcagcctcccaagtatctgggattacaggcacccagataatttttgtatttgtagtagagacggagtttcaccatgttgaccaggctggtctcgaagtcctgacctcaggtgatccacatgccttgacctcctaaagtgctgggattgcaggcaagagccaccacgcccagcctgccaagtacttttaaaatgtattcatttgattattcactcgaattcttctgagcacctgttatgtgtagtgctaggagccgttggatataactgtgaaaaaaatggacgatgtctccttccatcactgccgtattcaatctacctgggagggaggaaggcactggaatgcagaaccatagctttaccatgttaagccactttcccaactgtacacagggaaagagccagagaaatttgaacaggattttgcgtctccaaagtgtgtactctggcctttggggaaggatggatccaaacataaaggaagaagaaaactagatgactccagcttatgaagatagcatttatgtattcccctaagtgcctacataaacctgagaataaggtactcttctaacagaaattggcattcctttttagtacagggactttgtgatgtttcctgagggatttccatgtactgcaactcattttaattatttcaaccctagccttccctaagctcttgcatctctagtttctacagccaaccatatactggttttaggggtgttgaattgctcagttattgttgggtgcaggcactggacatttgttattttggagtacatcaagcccccttccttgtggggatcactcccccgcagctctgtgcactctatctgctcccagggtagagtttgtgacctgaatgaaagctagttaacacaccacatttgcctggagatgtcaactggttcaatgatgggcactggacctaatcagaaccaatgagactaacatgagaatggcatctctgctagccttggcctcccaacttcagcatttgagtactcactgacacctggacccatcatacattgtgtttggatatgacccccctcttaaaaatgcttgcaatgtttatttttgccggatgtcatcaaaaagaagttgttgatggtgtgtgctggagttggtaaagctgaaactacccaaatggctgtcactagagggccaataatgatgctgtctttcagcacttcttgttaatacgtaactagaatcatgcagctctcttctttaatttgttctggacagtgggccactttagggatgaactgctcagcatttctggcagaggaacagcaaccccttaggatatccttgattgaaaaactataaggccgggcacagtggctcaggcctgtaatcccagcactttgggaggccgaggcaggcggatcacgagctcaggagattgaggccatcctggccaacacggtgaaaccctgtctctactgaaaatacaaaaattagctgggcatggtggcacatgcttgtaatcccagctacttgggaggctgaggcaggagaatcacatgaaccagggagttggaggttgcagtgagccgagttcacaccactactgcactccagcctggtgacagagcaagactcagtctcaacaaaaaaaaaaaaaaaaaaaaaagagaaaaagaaagacaacaaagctggtcacagagctggtaaactggggacagccacagcaagagtcctgtaacagcagagaacagtcctccattccctcggagacattttccagctctttatttgaaatgctttgcagaaacctggaattctggacattatggttattaatataaagactcctatcattccatagctcccatctccactgacctctaccccatctctaatgacctgttacagctttgacgtcactctcagagcaggatttaatgatgactcatctttgatacctcttcctgcgtaaattcaacagcatcctggctgctcacagtagagtgcatttaccagaaacagcagcatttcctgggtgcttgctggaaatgcagcatctcagattccacttcagaccaactgaatcagaatctgttcaagaatcggcttctaacatactcgcaactgctgctgctgctgctgccgccagcctgggaaccacattctgagtagcaggaatgtagacctcagtgtttcctaaccgtactgatcataagttctgttggggagcttcttcaaaatacctgtttctgggcacaacttcaaaccctttgaatcagaatcttcagaaaagggactttggtatttacagccagcccaggtggttcttctggatgggcaaacagaggaaacactgggaatctaatttagagttctaggccgagctctcagctgcctgctcttctcctgcctgaatttgttgcttaacagatggaagcacaatacagcttccactagggctgtttctttttcccttttgttcctccaaagacttgctaccaaatgctgtgtcttcagcatctggaattgtttttttaccttctctctatgcagttaggtaagaaaggaccttggaaggattcaaatcccaattctaggcaaagatatgttaatagtcacatcccagtggcaatgctgtttaatgttagtgttttgaagacaaaatgcagattcctggccctggttgttctgcaggttgtagccttaataaactggttggtctgagtacataagttttcttgaggactgacaaaatgcaagaacagtgttagtaatggaagaaaggaataaaaatgataaccctgtccatctaggatgtaggaaaacagtatttgttaaggttttctacatctttgaaaaactggtaaataatatagttgcctaaaattcttaggatctttgttaattgcttcaatatttttccttccttagccttggattttttataagacagtagcgacattaatacctgcagggctcctcatgtgaagactaaaagtgaatgcatagaccagtgcttctcagtgggggatgacttcatatcccaggagacactgttgtctgtcatacctgggagagaggggctggtactggctgttagtgggtaggagccagggatgctgctaagcatcctacaatgcccaggatagcccccaccgcagagattattgagccccaagtagtgcccaggttgatctagaccaaatactctccacatcttcagagcttaatgatcatcaccctgttgtctctctaccaacgttgggccccaagttacccgattggtagaaccaagatttgaaaaaatgttcctctgcctccagagctgtattcttttcatcccaacgtgctgactcccactggtagcagactatggtaattttttcgtgttgatttataggagtgctgcaaattgcaaatcctgttctcagtcccccaaattcgctgcgtatctgctctcattatgtcattttcagatggagaatagagggttgaggcttggagcaacagaggaagcagaatatagagagagttgacatagactgggatttttatctattttgttttaaacagagtaactgagctcttataagaatcaagagatttaaaacttaatacattttaggggggaaagccgaagactcaactacagaggcagaaggagaagtaggctggaagtaactaacaatttctgacttgtggtgccaccaggtagagctcctggagtctccactgcctgggcagtccttgacatcctttgagagccaaagtgttaaatatgtaagagcactggataatgaacacgtaattggagcatgggaaaaatcagacactgtgaactcgattatgatatgttggtaacaaggagtgaaagcacctaacctattcagtgagattactgatgaaaaatatatataatgaaaaaaatatataaatattattcaaagggtagactagctgcagtgcctcatgtttaatttaaaatacacttgcatttcaacctcagatgagcagttctgaaatgtcatgaaatgctgggaactttcatggaaagaaaaacttgcggcaatcataatattagaatttgtttgccctagggtgtccataatcttagaacaaaaaatactctttatgtggaaataccttgtagttactaggagccttttattataaagaaaaagaaaggcaataaaaaggaattcattctaaggaggtgtttagagtttcctttaactgtttcctttacccacatagcttgccgttaatacttctctattaagctttcagaaagaggaattgcattttccacctcgctgaagaggcatgagagtggtacacttgggctatactgagatggaggcttcgctgacagcagccatccagatctgggtctgctttcctttttcaccttattagctattcccacctcatagtccacaggcctgtggagggggcaggggacaaccaggggacagccacgtggacagggagcaagggaggaggggctggggaaagcacctaaaagaagagggagtaccaagcatgccttaaatatctcacaggtttccagttggcctagcaaaaaaagagatgatatagagatgtacacaggggagcgccaggtagaatctacctaccaaggacaccactggtcttcataaagaatagccaagtgttatggaagagaaaaggagaataaatctgacaaaagtggggggtattgaaagatgggcaaggtgtttggaaagaaacagaaagggaggatgggcttagcaaatgagcagactatataagcccactggaattgtcaaaattaaggttacacacaagggagaacatctgtatcatgacacattgaaataataagtatattaatttacttatcacatccaatgctaagacagattatgtaccttttgtaactcctgaattctccagaatttaaaaaatgctaaagaagacacacactgtaccccaaaggtgagaaaaaggagtggttgcccaagacccctcttctgttcaacttcatgaattcacctgtggaatcttttaaaatagggattctgagagattcttctggtttgtgaggaatctgagttttttaaaggctctccagatatacccctgaacaaccttttaccggaggggccagcgtctaagacactatgaaagataaagagtataatactgagcattattttccagattttggagggaatgtggccaagaaagcaagacctttttttttttttttttttttttttttttctgagacagggtctcactctgtcaccaaggctggagagcagtggtgcaatcatggctcaatgcagcctctacatcccaggctcaagtgatccttccagctcagcctcctgaatatgggtttacaggcatgcaccaccacacccagctactttattttttgtatttttttttttttttttttttgtagagatggggtttcaccatgtgtcacaggctggtctcaatcccctgggctcaagtgatctgcctgcctcagcctcccagagtgctgggtttacagacatgatacaccatgcctggcttacattgtttttgttttttttttttcttattaaatgtatcaataatttttttatttaaaaaaaggacacgttttgtgttgccttttaaaaatacatgttgtagcaagcatataatatctattaacaaaaagaaaaaatagtttgcaaaactcttaattataactttatttgatatgtaactttctgcatcatatggtattagtagcagctaaaaaatattgagggccaggcacagtggctcatgcctatcacccaaggctttgggaggttgaatcaggaggatcacttgaagccaggagttcaagatcagcctgggcaacatagcaagaccctgtctgtacaaaaaactaaaattaaaaaaattagccagttgtggtcgtgtgcacctgtactctcagcctacttgggaggctgaggaaggaggattgcttcagccccgggatttaagtttgcagtgagctatgattatgccactgtactctagtctgggctacagagggagaccctgtattaaaaaaaagaagaaagtattaagcatatactatgttctaagcacatattaactcatttaatacatacacagacatacatgcacacacactcccactgtaccatgtgctattattattcttatttcacagatcaaaaaatgagcaaatatgtgtgcaaaagtatgtgtgtgtgtatgtgagtgtatgtgtagttttaggtaaaagaataaaagatatcctaattgtcgttgactgatacagaattttttaggctataattagtattcttgtgctgtgctgattaagacttttatcagttcttgggctaaatataaatatttatactccttttttgttggcaggttttaatagttaaagatagattcgtggagagggtagaagatgaatagcaaacaattgatggagtcttctaaagtttaacattaatgattaaacaacatgatctgatgacttactcagcaactcaaagacaataaaacataataaatctgtcaattagcattttcatcttctctcccaacagagcttaatggcacctgcaaaatgcaattttcaacccagagctctttgacattttctgtttcctcccatgtccctctcccgttgttcccgttatgactgagagcagcaacgtgttctgctccatggtggcaaatgagtcacctgccattgaaaggaaagcaattattgtgtcctctctaaatctcagggatgacttgggtactacttttccacttaagggcataaacagccaacccaggaccggttttaagtggctgaaccttagcaacagcagctgggctacaggttgatgtcacctgaggtgcccattaaaggtgtggaaagctgccagacaagaatgacttccagtaactacgacttctccctggagggagcacaacgcactgccacacacaaagtgacaaataatgactgcaaagatagcatcttgcctttatcttcctggtccttcggtttgaggacagtgacccaggcatggaggttaggctgtttcttggatgggtttccagctggtgggagtagatgctatttacacaagtgtcaggaattacaattcttcctcttccaggcagctatgtttagctcacatgtgtgtcacacgtgtgtagaccccaacaccaccatctctgaactgtcaagtaaggagattctgggtgatgagaaaaagtgtgccctcagggagacttcagatagtaccttggagctttacatctaatgaggacatctcaattgtttttctaagcttcagagtcaagtgccttgacaaaatgggcccaatataacatttccccttgagtcatttttaaatgcacctttttcttcagtgagctaaagaaaactgccttataaacaccatcaatgtaccaaatgaaagattccattctaaataaatacggcaagcctccattaaccagaatccaacactccaatgcacccagttaaccagaattaggttcactacctcatttttagaatcaaaaaccaatacttaagagcatataataatttcagccaaaaaaaccccacaaaattttcaggtctttttatgcaaccaattatctcaggggtgcattttctatctacctgtttacacagaaaatgagtttttagaataatgattctgaggcaataatcatatagtcaatatatataattattggtatacttgtgcttaagacttgaaagttttagaaaaaatgtccactgtatttgaaaagaaaatttttaaggattctgagattaatgataaagtaaacaaatttatattcacccttacaccttgggcttctagtattccagaaaaaaaaataataataagtgtttcttttaccctgctatttgctctgcttctaggggaggtctggaagctttccttcacctcacagatgggtgacccaaggtgggaggtcaaatgacttgctcagagtgagacagcatgtcaatacccaatgcagggttagacaccagagctgtggactaagcccttcacgggcaaatccatcactgtagaggtatactgcttgaaaccatttttccaaaaggttctctctggagggaaaattctggtctcaagaaatgaaactttgattacccagcaatgggactccttgccagctcttttttgaaataattatgaatctaaaacgtgcccttgtttgctctgaattttcctttaatgtttactggcaggatgaatacaaagcctccacaaattaagtcttcccagaattagttcagaagtgcactttctattactctgactagcagctcctagagtttcataggagattggaagttaattcttttcagagttgctccaggcaaaaaagcaggggatgataatgtttaggtacttttctccctcttttttagataaatcccaggtcctgaagtctgaagaggtcattagtcagcagagggtatgatacatcggaagaggaaaggctacggagtcactgggggctgggtttgaagcctggcttggggcctttaatgcattagcaatgaatgttaatgctctctgctttcttccacgacgaggaaaagccatggccttgacgagctcaacaaatagagtgtggaagtgaagtcacacagaaagactcaacggtcctacctttctacagctactatccacattagccacactctgtcaccttgtcagccaccactgaattactagtagaattgagagtggtgacaatctagcatcttcctacttactttcaacattttccataatcatatataagtccttagagccaatcagactgcattgctgaacaccatgcaagagaaaacttctcaaatctcctttgccaacatttttatatcatattgattttgctcccctacacagtgagggactgcactgggtgttgtgtggaaatgaaagtgattaacacacaaggaaggtgcttgtttcaacagtacaaactggaatgctacagagaagattcggatggccctgtgcaaggatgacacccaagtttgtgaagcactccatatagaagggaaaaaaattaaagacacaagggaggactttgcaacctcctatgtgcatacgcagattgagtagaaggcgctgtgataagggctataggagggactcaatttgctatcagaagaaaaggcaagagaagaaggccgttagtgatccgttgagagatggtttatttcaatggttatgtgtgtggacactggagccatcttgcttggattcaaagcctggctctgtgacttaatggtcgtttgacctagaccaagtctctcagtcactttgtgtctcaggtttctcacctgtaaaatggggataataatgattcctgtttcatagggcttttcagaggatcacgtgaatgaatacatataaagctggcactgtcgtattagacatttcttttgaaagctgaattggaagtgctcacggtggtggtaaagtatctgtcatggagggcatgccatgcgacagatgctagctcgggcacttttatgttcatcatcttatttaattgaaacttcccagcaaatagatattatcacccagattttaaaagctattgatcacgagagttgaatatgttgtctgacatttcataggtggccattggcaaagtggagattcaagaccacgactgtccagctcccaagttcatgctccttctgtccctcagcactacctttgaccatttctccgtatatgcatataaaaagaatttccttttattgagtatatgtagattgggcttggttatcaagctgttctccagtgataactacccccttgaaggaggctgctgcccgttttaacggtggaatcgcagtaatgaagcatgtggagcagcagatgccttgccagaaaataattagcaaaattcctgaattagggtgcccctcacactgctgcagtgcagaaaacagtgaactgattgatgttagatttttttatcttggtaagaaggatcaggtttgctcctttacagcatgtggctgagctgggtctctactgtgaatcaaaaagaatagaaagccaaactcaggtccatttacttgaggtcattcactacctcctataataatgacacacatttgctgagtactaattgtgtgatattcattgtgctaagtgttttgcataaaatgtcttaagtttcacacggcccagtggtgcaagcttgttgtcattcccattgtttaagtgcccaaatctagacacggagcagtaaaataacctgcccaacccttcctggtatccatggaatgtctcagtggtattgggatacaaatgaaggcaatctactttctgagccataatcactgcgttatagtctcttacccctctcactcttaatcaaagcaaaaaaattggcttcaaacaagcaaattgctacacttgacaacagaaatataagccaaatctgaattattagattgctagtaattcttatttgactattaattgggtgctttagctgggctgggtgtaccttttgctttcctttagttggataattgcaagcgaaaattttggatattaccattcatgtacagagagaggtagaagtcagcaattacactaatccccttaatcctttatgtactttacctgcactgtaaaattccttgattttaaatccgccacttgttctataaaaaatgtatagactaaagaaccacaaaaaagttaaataaaaatttttgcctgatgatatattgattgtacatacatatctttacttttgcatattctatgttgccattaaaagatccattaaaagctgagttcaaataattattcactgctcacattactatgataatcaattgcctgttatgaaaattattgccatctttaagaattgctttgctaagtgaagtaattagaactgatattttattttctagttcagttccaaaaattgattttatatgctaatcagagtgtgaaaattgggacataaattttataaacaaaatgaatggctagtcaggcttcctatttgacactttatatagtatttgttgtttctcaaggcatcttgctcttgagaacacactgctgattactgtatctgtcagaactaggtaggataagtttttcattttacagagtctcaagtatctgaagttccaagaattaagaggtgtgggccttcaatcaggacagagggtggaaaatcacaccttctgtccaccgaaatagccattatttcttgcagccccaacagaaaagcagaggaaagacaggtaccatttaccaactgtcttgagtgtgcctggtgttaaactcctgacatatatgttttttctgttccttatggttatctggctaggtaattactattattattactcttacatataaggaagcaaacagactaggaatttaatttgtgatcgcacaccaagtaagcggctaagttgggaatcaatcccagtctgcaggttcacaaggccatgcttttcctttcctttaacaggccaagtgcaaacagctgaagtgaatacacttcagcacaaggctcgagcttcatgatgattttgccctttggcacaaatgtcttggtaaatgtttcaaaagaaagttaatgccttcacttggtttttaggtgatcatgaattgtagaggaagatgcaggaaaccacaggttgaagttgcatttagaagcaaaaacaaacaatattttcatatatattactggaattatgaggtgaaatgaaaggaagaaccaaatttggtaaaataaaacaagatggtagtctcaattccagctccgctaataagaaaatgggaaattttgaatacattccctatctgagtctgaaacagctcatttgtaaaatgaagggttatgctctttaggttaagagtttctcttctggctacacgggtggctgataaagttgatttcatctccaaaagtgacagggagcaggcttctgtttggcagaggtatatccctaccgggtctcactgccacaggaacagaaggggcactcgttaaatactgtcaccctgttttgccctcatgatcctaggtgtctcttagagagacataagtgacatttttataataaataccaaacaacaaacattgtcagatcctttaggggcttggtcatagatcaacagacttcctgtggccatagctagaactcaggcctcttttcaatttgttttctgatcccccactcttcattttatcatcataaagaacccaaattattaatatgccagtaggacaattttaatttttcacatagtacatggactcacactcaacatacctgggtttaaatccagctgctgctattgtgtagctgaacttcttgaacttcctctaaacttttctggccttggagtcctcgttagcttgagatttctcatgtcctttatgctccagattcaggacaacttgagatgcaggcttaaagaagaagtaagtaccaagcttgtgtgctgcattaatgctctgctaaatgtctgtgctatagggatgagttctaatcagactgacatagaaagaatttccctcattattatggggtaaagttcatacattacccccagtactttagaatgggcttatatttggagataggatctttaaagaggtaattatgttcaaatagggtggttagggtgggccctaatccaatatgactggtatccttgtagaagaaaagattaggacattaccagagagagacaagtggatgcacagaaagatgactgtgtgaacacacagcaagaaggtggccatctgaagctaaggagaggggttgcagaggaagccaatcctgcctacatgttgatctcaaccttctatctttcagaattgtaagaaaatgaatttctattctttaagccactcagtctgtggtattttattatggcagccctagcaaacaaatatgctcattataccaataatcaacttccttggatagaatggaccattcttatgatgaatttcatgctgtagcacgggatgcatatgtttaaacaattttgcccctaaagttaataaacactatataatatgggctatactcagatatctaaacattttattccttcaagtacaaacatttgaatcaaacattcaaaaactctagattttaatattagcaaataatagattcttggaatatttaaagagcatgattgaaggataagctgaattatatgggtctattgcattttttttttgttgaaatcaaatatttgaatttcataatttggttaagaaaaaatatagcaagtaccatcacagacatttggtttttaatgctgtgaagcagtggagtgaaattctatctatagagtaatagcaacatgctattctctaaggctcccaacaaatgttcaaagatgtagagttcctatataaacataccaattctaaatgtacacgaatgattctgtcattgcattctaattcttagtaacagaatgtagtaagtaagcattcagagcctaaggtctttactcacatactaggaacctgaatcatgcacccccatcttatagtgcagctttcattctgaaagattaaatcctattgcaccatcattaatcaattcttctcatagcattccagcaaaaataatacaatgagtatcaggttcttttttggtacataagaagacaggcatagctgatttgctaaggcaggaggcctgttatatggtgttatcaagactaaaactaccaagtgttttctgttttagtccgaaaagatttattttctctttccaagagaatgtgctatgacatatatgctttctttaaaatacaaggccatggccaggcatggtggctgacgcctgtaatcctagcactttgggaggtcgaggcaggcagatcacttgaggtcagaagtttgagaccagcctgggcaacatggtgaaaccctatctctccaaaaaaaacaaaaacaaaaacaaaaattatctgggcgtggtggtggtcacctgtaatcccagatactcgggaggctgaggcaggagaattgcttgaacctgggaggttgaggctgcagtgagccaagatcttgccactgcactgcagcctatgtgacagagtgagactccatctcaaaaaacataaaaataaaaataaaatacaaggtcactttcccatttctatgatcctgccttataatcagttatgtgcagggaaaaatcaaagaaatttcaacagaattaatataatctaaattattgagaatttatcaattttccttgtttctcctttcttatgtctcttagcaatagagagaaatgagaagttgtgtaccttttaaaaaataaatgtgtcagaagaaagaatctcctagaaataatgagaagtttatggaactttttctcttttgatctttaaaaagaacacaaggccaagtcactggggaaaaaaaaaaattctatgaaacaggtcccctgggctgtgaatccatggccccaggctatttgtaataaagcatataaagtgtataggttgctctggtctttgaaggtctttcaaagatgaaataattccatgacttttgacatttgagaatctttatgggtgtgaaagggacctaattgaacaagtgggctaagctgccaggaacagagatggagtagccatattttaaccaagcattgtaatatggtcaatggcagccattaatttatttctgccaagacagatggccttctccttgataccaatggggaaaaaataattaagaaaatctagagccagaatggaaaagatagctgtcttttgacaaggtgattcttcagtttgcaattaacaactgataaaatgctatgcatgttaactttggggaagaatagctagtcatttgaaatactaatctcactttcttttcaaactaccttttactggtatctgccctttctgtcccatcctgtaagtaggccatacattttatggaaaacaatttaaaagaacatcagtagatatcagctataattctagaaacctttgtgcggtctttggttttacatatatggtttcagaagcaaatccaatgggcattgttaagagtcacatggtttagcttccgggtgttagaaagcaaacttccactcttgtgccctacagacactctcttcactggagttctcaaaatatatgatccctggccagcaaattattatgtttttaaaattatactagctgccatacatatcaaggatggcttttcatggggcaaaacggaatcatttaagaattacatcagatcacagcagtagcaagttattcacaactaccttgagctgactagcaatttttttgtagcttggaggtaaatgactttttgttgaaattgaggataataaattctagctctcattttagtaatgaaaagcagctcttcgtctcctcatcttcaagaatgtgcagagaactaatctcccctcaaaggtcctttcctctggccagactaagttttaccaaaagaacacatggtatttcaaacattggaagacttagccttcttttcttcctcctctctttccattccacaaatatttattaagacttcattttgccttaagttggatcctctgtaattgccataatattctattattttgacttacaacagtggctctggataccccctgacaatgcataagaaagaggagacgagtaagatacacaatctgtctgtaaagatcttataaacaagttgacaagccaagaatgaggtaatgaatgccctataacaataatccttgatgcacctaacttgggtggcattaaataataaaggtaataagagttcagagatggcaaaaatccctagtacaagagtaagcagtgatttctttttgaatgaagagatgaatataaatcttaaaagtacatttggaaaacaagacattgtatcactgaagcattctgtttcttatgcttattgcacctgtgttttcttcctcatctcagcagccagctcacatcctcagaagttatattgtttccacacttctcatgcaacactgcaaaaatggttttacttaggtactattctagtcacctgcttcatacaagccactctagctgttcatacatcttttcaatcagattataatatttacctatgacattttttaaccattgtcaattccattaattctatttacctgtgaatgaaatcactaagaccattagatcaaatggattccttgttatctcctacaaccacattcttttaccccatggaaaaaaaaacacttattaaagtatatatacagctataaatatgtcagaatatagcaacataaaaatgaccaactgggtcagacacagcacctatctttgacttgtcattctggaagtgagcagatttttttttttttttgtacccacacacctgaagatcatgactaattcccctcattaacaagaactccttcaggcaatgtttctaagggggataaggtggagtgggctctcttgcttagaggaatataggatgctccactgggaagagaaatacataattcaaagaagaccttcaggtaattttgatattttattcactccatcttcaggtccacaccacagaaaattattactctactgtacatatttcttcttgatatcaagctcagtgagtaccaaaatatgttctcttatcaatctgttatctgagaatgtatctatataatttaaggttatccatatttcataatactggtgttcaaatgtcctcccaaatttgccagctgttaagtaaagtagcacagcacccatgacacttaaccatgctagattatccatctttgtacccgtatctctccacccacattgtcaactcctatctttcctgtctttacatttccagcacctgggacagagcctggactttaaagttatatagaaccacattaaattgccattttttgccacttaactgtggttgcatagtagcaatttcataaggttcaacctaataattgtaagccatgactaatgaatagaattttaaaaaggatctaaacattcttttttttttgagacggagtctcactctgttacccaggctggagtgcagcggtgcgatctcgacttactgcaagctcagcctcccgggttcacgccattctcctgcttcagcctccagagtagctgggactacaggtgcccgccaccatgcccagctaatttttttgtatttttagtagagatggggtttcaccatgttagccaggatggtctcgatctcctgacctcgtgatccgcccgcctcggcctcccaaagtgggatctaaacattctttagggcttcagggaaaggaaatgggggaggggagggaactaagatttactgagattttgatgcagtaggtctgggatgggacccaggaagcagcattttaactagtattgcagatgatcttatgcagatgacccacggaccatgttgtgacaaatgatgcctttagggacacaaagggataggataagcttctggtcagttagaaggcagcaggagacaaggctactcccaactcctccttttcatgcaaatcatcttcatcccatccagagtaggctgtgtgagccagagtcagagaggcctgggcagtttgcatggctgtccttagcaggtcttatactagtatgctttttttccagaggtattttgttctttggaaagtccctagcatctttgtgcctaccaattaacaataccccctccagccaccatctgcactgtgtatatgcaaggtggagtcattcagctcttgcattcccaagtaatcctcttttaggaaaagggttctctaatgtgctcagagacaaaagcacccagaggtcactgtgttctttgttcaagtggctgcaatgtctgaaaacacaagggacttcttgacagatttcacagtgttgtgattaattagtgcccacacttgacaggctaggaggacaccagaatgatccctgcaggatggtgcaacatctctccatgtcacagcagtgagggacaggtgaatgatgatttctacaactagatgggaggtagtgtagagtgggctgcaggctcgtcagatctcaacttgcttgatcccaccttctaaggtatactaaaggtgaaggcttattcattgaaaatcagagacacaaatcctccaaggcaatgcatcacagattgtgtggtacactgatggacatgctgtgttaatgactgcatttgttacagtttgcacagtgcatcctgctaggcagtgctcataagggacagcacattaaacttatcatgttatgtcactgaacatatcatgcaatgtgatgtagtatcagcatactattcattgcatatgtttcccagggtttccagattaatagctatcttgaagaatataaaaaaaattcataggtttaatatacacatatacatgaaggtaagaaacatgttagtagcaaaaaatgacaaatagattacctacaaaaagaaacacatgtatctgcacatgtttaaaaaaaaaaagaataaaacctgtgctcagagcagaggattatcacagaggccagtagtataaggcaaatataaaagggcaaaaattaaaaaaaaattctactcttcaaaaaattttattttttatgtctaaaactgagatgggactatcaaaatctgaatttcatccatccatgcatccatccatccattcaaccatccatttaccacccaatacatattgattgaatgcaaactatgtccagatactgccatagacaggatgtaatcatatgtaaaggacatcccaagttccctgtactcacggaggttaaattctactgtgggagtcagacccaaacatacaagtttaaatctgaattcacgtcgccataagcagtggtataaatgttgaacaagcttgggagtcggaaggatgtgatttgtagcttttgccatagtgtaagtgcacccatcctggacaatttcagtctaacaatgtgatgtcaccggatgaggagttggaaagagatgtgtacagttaactctctggagcagtatgagccagccccagctcacccttgaatgtgatgtgaagaagcaaagttgggtaaggggccagagactgcggggaatggtggatcttttaggcaggtgtcagtcattctttgattagtgacatttgaacagagacctgaataaagagaaaagaagtaataaaaatatggccagtcacagcggctcatgcctgtaatcccagcactttgggaggccaaggtgggtggaatgcttgaggtcaggcattcgagaccagcctgaccaacatggtgaaacccctgtctctactaaaaatacaaaaattagctaggcagtagtagcgtgcctgtaattccagctacccagaaggctgaggcgggagaattttttgaacctgggaggcagaagttgtagtgagctgagattgcaccactgcactccagcctgggcgacaaagtgaaactttgtctcaaaaaaaaaaaaaaaagggtaataaaaacgcgaggcagggagttgaagatagtgggggagaagagtgagcacaaaggcagcaccgagcacagaggaagcactgcactgcagcaaaggtactctctgcaaaagggaaaacaggatgaccagtcaggagtggtttgtattcatctaggcaagaagtgcaaatcgctggacgcagagtggtagaagtagaagtgatgtgaaatgcttagatttgggatacatttgtgaggtagacttacttgaagtcaccaatggattggatgtgaagagggtaactgaggagtcaaaggcaatctcgagaaagactcttagttagcttttgctgataatatataccaccattagatgcaatggggaagaccaaggcaaaagtttgtgtagaggaaaaatcaaaagctctgtttgggtcattttaggttagaattattgacagacatgtggagatgtcaagcaggtagcgggatatgcaaaagtctaaaggtcagaggaagtcagggatgaagatatatgaagatatgaatttggaagtcatccaaatatcgatttcagtgactatgccctcagtgcgtcatttgagaaccaatgccttagagaataatgacagagattcagcctttaaggggcccctggggaggaggcaaccttttatagaaagaggtgtgaatcattgccccaaaatatctcctgttaagctctccctatttctgaaggtacagcctttaaaagataacccattttcaccacccgggaaatgaggagcacctctgcccagccgccccattgtctgggaagtgaggagcgcctttgcccagctgctgtgcaaccctccaagtgtgaagtgacagccttgtgtgtgatctttctgccctccccaagtttgcgtttttgacattaaagtttacttttaaattaaaaaaaaaagatactccattttcatcatagtcctgttaaaatccatgttaatacttactaacaaactaatagagatttcccacctgtcaacttgactagagaactgggtatttgatgttcagaatatggagcaatggttcttaaccctcggtacacattataatcaccaagtagagttgaaatatgctgacacctgaggcccatcccaatgattctagtttaattgttgtgcagtggtgaaaagtatggatttcttttaaggtgtaaactggacaagggacaggaaaggtggtgatggaaccaaagagctgaaggtctcaataatgttgaggatacttgccaaatcctctagtaagagaggagttgtgatctgcttgtggggtgatttcattgtgactttgtaggtggttcaagatgtaatatgggagtggagatggagtaacgcaaaagatcactggggataaaggaagtgcagttactgaaggccagggtgttgggaaattcctaggaggtttggggtatgaggtatgatagcaggcacagagatggaagatgactgagccaaagaaccaggagtcaaagtcttcaatgactgaggagactagaagaacaattatttgaggacagcaagaagcagcagcaggaagtgtttattcaggactgaacctgaaagtttcatatccaatcaatgagagacttctggtaggtttccctatcaattatattctaaatctgacaatttctcatcacttccaccactccaccccactctaagcaacgtttgcctcttacctaaccatggagaaggaataaaatgacccaaatatggtagtagaaagcagggacaatacaaccctcaaatccaagccatgaatttgcaggaatccaaagaagtgagcaaaaacacatctatttgaaagggctgcagggatgcaaaatcctcagaatggggtctatatgcagggaaggctattaagtggtatattccaagaagaggagagattgatgatgacagactgtgaatttgaaaggattttcagaggatgagaggggatgagaaattgggccacatacgagtttgctgagacgtgtgagattaagagatttgggtactaatggatttccagcgctgcttaaatttctggtgttagctaagggaaaacatgttagaaaagatgtgattagtctcatagcctcttagagaacagtcctagggtgatggtctgaaatattctaattagccatatggcagcttccagggctgcgggcccctcacagagcatgtgttcgcaaagtggcccacgcaaggagcactgggtgatatggtcatcggactgggccatggccctcacgaaatacaaggatgagaacttgtgaataaatgtgtgcaaccaagcttcatccatggatggcgatgcaacaggagggccacttgccagtagagtgggaatcaccctggtatgcattactgagtaacacatccagttaatgacactcagcaacagcttgctcagcagaagacttgagtcattttaacaaatagaaggctgggtgaatttctgtgagctctgacaagtacaaactgttttcttagactcgttgaggactgagtgttgtagttgcctcatcactgtggtgggccctgccctgaaaatgaacatgcttactgcaccaaaggttgacagccacctgtgaaatataaaacaaccttactccctgatttgtgaaattatttatgttaaaagttctacaaagctatgtacatagagataaggctggaaggaaatactcctaaacgtagtaatgttacggataatgtatttttttctctttattctttttggtgcttttctcaactttctactataaggtcataaaactttcaaaattgtgtggggggagttaattataaagtataaatattcagccgggcacggtggctcacacctgtaatcccagcactttgggaggccaaggcgggcagatcacctgaggttggaagttcgagatcagcctgacccacatggagaaaccccatctctactaaaagtacaaaattagccaggcatggtggcacattcctttaatcccagctactcaggaggctgaggcaggaaaattgcttgaacccaggaggcggaggctgtggtgagccaagattatgccattgcattctagcctgggcaacaggagtgaaactccatctcaaaaaaataaaataaattaaaataattaatataatataatataatataataaagtataaatattctacaatggcattgaaaaggaaatctgggctgtcctaagccatccatgttgtctggctgctgtcctctccctccctgtccccctttcattctggcctcccctctgacctgtatgtgtattgggcccctctgggagaattcaccaattcttagcaagtgcctttccctgaaaattgctttctgacctacaaggctgggcccacagcatgcacatgtcatggcatagctctgccttctgaccaaatcagctaaaccagaagatagagtccttctttggtaattttaatttatcacagagattataattgggtttaaaatatgttcttgaaccaaagtgacaaaccttgagctctgtggcagctaccttctgcgatggggcaggagacacagaaaactggcttgcagaagggacaggatgaaatttagcaggcagagagaaaagggatgtggcacagggatagcattctacctatgaggatccctgtttttagacttctcagagatctgccattaccgcaatatgcttacaccacttgctgagtgtctgccgctcaagttagctcctctcactttaaactagaaagttcctgtctctcatcccttctctccctccttccattgctgaattaaaaatttaaaaattctttaatgaagtaaaaactcattcaagtttcaaacaagtgatcttcagaatataaccacttaataagcagggagcaattcaatacgtctgtgtgtgtagttttatttggggagtagagtttagaaatcattccaatattatacatcactatgcatttgttttactcatgtatctactgtgacaaaaacacaaaaactgcatttttggggtgggagtagtttttggaaactatgaagaataaagttacagccctactatagccaacatcaccatgttttcacatccccaaaggccctactacccacactgtggcccccattagcccacacgtcatactacaatttatatgctattgatcatgagaaatgcaggcccaaaaactaccttgaagcaaaaaaaataaaaataaaaaatctttttctcttgactccccccttctccatgctataaaatatattgcagacaacattttcctgctgatggttaataagtgaaggacaattcaatatccagtaaaggtgatttattttatcaagactgtgacctgctgcccagctgggaaggatttacaagaaataagaagacacatgacaaagaaaagctgaagtttagaaaattcccaaagacataaagcaaataaggaaaataagtaaataccaaaatatttcttcttagaggtcttccaatactggtgtgttctctcttatgctgagtaatgtaaaatatgtccttccaaatataactctcaagcactttttttcccaaaagcagcttactttgagcacacaaccctctctatcttacactccttaacaatctaaaaatgctgtgtcaaatcttttcactgttttttctctgcccacaaaaagaggatattttgatcatttttaggcagtaaattcaaggcctatattcccccattctgtagcatttggcttaggggaatcactatcttgtttccctagaagacagaacataaggtgagtgaatttgccttttccagccactaccctggctgccctaggaagaagagagtttccagttaacgggaggaaaactgcacattagaaaaggctgccacagtgggcctgacttctgctccgcacagcagcacacacctggttcatactcagcctctccttctcccacttgcctgactgcctgtgttcctggatcaagtggcaagtttgcagtcttccttgaattcccccagcactgtcttcctcgacggcacttgacaaagcggagaaatgaatattctgcttcctaatgagaatacacagttttaaaacatcttctccttccctagcactgtgagttggtgccattagcttgtcatgcttgttttttgtttgttcatttatcatggaaactcatttcttccactttgaaaccattaggttcacatgtttggcattttacagatcctcttggcagaacctcttgggaagcacaaagaaataagtccagagtagcccattagttttatgtcttaaatatctcttcaaacagttcacttccttccaatgcctccatactattgtaccctcaactctagcctggtctatagaactatcctcttctctgaattctgtgtttctggctggcctatctcttatctactttcagcaaccagggtaaacttaattatatttttttaaattttaaaataattttaggctcacaagaagttgtcaaatcatggcagagatttccgtgtacctttcacatagctttccccatgataatattctacataaccacatgcataacattcaggaaatggatattagtccaatcctatcaactaaactcagagtgatcctataaaaatgcaaacctggctgggagtggtggttcatgcaaacctggctgggagtgatggttcatgcctatggttccagaactttgggagcctgaggtgagaggatcacctgagcccaggagtttgagataagtgtgggcaacatagtgagatcccatctctacaaaaaagcttaaaagttagctgggtgtggtgacacacaactgtaatcctagttactcaggaagctgaggtgggaggatcacttggacccaggattttgaggttaaagtaagctatgatggtaccatcacattccagcctgatcaacaaagaaagaccctgtctctaaaaaagaaatgaaaatatataaataaatagatatgaaacctgaccataacacccctcccctactttgctaaaatgtattatagcttcccatcactcttagaataaggaccaaaatccttaatctggtccacaaatagtctgaccagcactttggtttggccaagacagttctgtttcccacccgctgtcccaatgaattatcccattttacatgtcagcaccctcaaaattgtggtagtttagataataaattatggtcatcccacagtgagctctggatggtctggtcctgcctacacagacctgtggcttttgttttacacctgtccccttctcggtctgagcccctgtgacacagacccccttttagtcctcaggatgggaggaggatgcataaaagccacaagacctttgcacatgttgttgtctccgcttggagtgaatactatttcttcccccttcacaccctctccctctctctccttcccccttcacctgtcagctcctacttgtcttagctcagagaaatcttccacagactagatcacatctctctattaaatgccctcaaacaccctgagccacatctttgaattgcttattacagttgtaatttgacatctgtgtctatacatgaagagtgagctaaaagaaggtaaggcggagtatttgtgtttgtagaacatcacatccccggagccagcatgaagctggtggacaattactttatagttatcgactgaatggatgacagcttagttgatgggttcataaacaacaaaagcaaattggttaatagcttcaggaaaaaggaaaaaaaaaataaaaaccactcacagggttttctctgcagactggtacccctatggcccatttaatgatttaaaaaccaagctttggaatgagacgggcccaagtgtgaaacttggtacttgtaaactgaggacatttatgccagtaatataacttctttgagccttaatttttttcatctgtaaatagtagtggtaggagtaatggtaatagtgttaataataaagtcatctactctataaaagtcttatgagggttgaatgagaaaatgtaccgtgcttaacacacacatcattaggtaagtgttagctcttattactatttggctaaaggtgtttcaaagacatcatttcctctgtgtctaagatgatttccttgtttcctaaaagacacacaaggaggaggtaatgctcttcacctggcatggctctctcctcacctgtgcccccaccccaggacttccccatcctcctgtgctatcctccttgcagcaatccaggccaaacctgggcacctgccagaccactctctctcatgccacacattggatctcaggaaagcatgtctgctttctcctcaaaatatattcagtatcccaccactccccaccaccccataatcaccacctccaactgccagcttattgcaacagcttccaagtgggcctctcttctctagcctttgtccttcagaatatcctcaagagggcagccaaaatgatgctgttaaaatgtaagtcacatcatgccattcccttcctcaagcccttccaaggttttccattttctatgaaaaaaaatgcaactggcctctggaggggtgacaggacctgcaacctgcctcctatcttggatcccccatagctcgtcacctctctccttcaggtattccctcaatggagaccctgtcaccatcacccatttaaaacctaaataaccaacaaccttcacactctgtatccccctccctgttttatttctccataactttcattaccttctatacattttcgttatattcttgatagcccaactccctgactagaatggaagccccatgagggcagggatttttgtctgttctgtccttgctgttcctctagcatctgacactgtgcctgacatgcataagttgctcaataaatacatcttgaatgaatacacaaaagaataaattaatgcacaaatgcaggaggcatcattgctctcagggcaagagctgtcctccacatacaatttgggatacgttatgaggcatagagaagaggtctgaaggcctttctagagtgtgttgggtagaggcaggggaagaggagaaagaattagctggggtgggctatctcttagcctcctgaaggctaaacagacttgaccctgacattagacttgctgagtggctgagtgtagtggaggcatggggatgggtggactgagggctgagcaggtacaagagagcatgtgttcacattcagagaatgctctgcccaggtgggcctgccagacagagatttatgtggactgccaaaactcagggaaacatctgctggagaagactctggccagaaatcccactggcctgagggctaacatgaggcacttttagtactagccaagctcatttcccattgtcaatttgaatgaaatttccagaacatgtactggctcaggatacattgtccagatgttggcaaaataaaagccaaaaaggaatatttaaagtcggctgcttctcttgtgactccacagctcttttgccaaacatgcaagcttgtcttgttagaagctgaagcctgagccaaggtcttgggtggacaggacttgaaggaaactttgggccatattcaaacaatcttggactgagtagtggtcactaaattctccattagaatacagctattcacaaactcaagggaagtgaactgcgaagcaaaaactcagagcattagtattgggactttgtaaaatcagcctgcaaatctgaggaaccaaccatgctagtgtcaccaaaaggcatgaaggacatgtgggaggaagtaatgggattatcacctactatctgagacagaaggcatttttggagtctttaagactagaaggtaccttagagaccctctgctcccagttttccatatctatctctaccctggacttctgagctcagtcctctataaaagttggccagagacggtaacatcagggcatttgctgaatattgaagtcacatcaacctgacttctcctcaatttgatatagacaggagacagggaaatgctgggtagaagagggtggttcccagcaaaagccccaccttcaagcatggagacccatggccctaagtgggaacaggcatttgtttttgtacccaaaaagttgccttttggcctgagacacacccctatcctgtcacataaactgcaaaccccaggctccagaagcagatgaggtggtgagaaaagcagaagaacagtggaatgagacagcaaagaaagagagaagaggaacatctcaacaatgagaggctcagctggggatagtcagaaaggagttcagccactggacagtcaaactcctggggaagatcatcttccgactccatccccacttccagctccccatccatcccactaagagctacctccaccactcagtaaaacccctatccatccttcaagacctgcttcttccaggatgctggacaagagctcaggatacacaaagctgtcacactggccctctatccctgcaaaaaggcaaagggtccattgaggtggttaacactcaagccatctgtgaatggcaggctaaaagagcacactgtaacacacagctacttgggctcctgcacctgtctgcatgtttcccctcccctcaggggtttgggcagtgaggtgacagaacaggaaagccacagccctgtcacacatctcccatttcaaattcttctcccctatatgcattatataatacttaactcaatcttcttctttagagacaaacttcctttcctatctctggtagattagttctcttttttttttttcctttttctttcccttttctctctttcctttttttttttgagacagggtctctctatgtcacccaggctggacttgaactcctgggctctagcaaaccttccacctcagcctcccagtagatggggcaacaggcatgcaccaccatgcctggctcagttctctttttgattcttgcctacagggttccctgttgttatcattacatatcatgttgggttaaggaacaaaatccccatcaggcttggcctgggggattcttagcagttggtctgacacatcacccaatagataagaaggttctaaaggagggaattaaattgtctaacatcacccaacttattaacgatagaagcaatttcacagctcaaaccctctgattcttaacagaatacctctaccaaaattatgaggataggtaaaatatatttacttctattttttctagtttgtgcacaggactataaataacttctaatacattaagacattaaagttatacaggaagcatcccaaaatcttagaaaataatgcttggtcaatagagcgccaaatgcacataagacacacaaaaagacattctaaagaggatgctaaaattaccagaatcattaactagatatattctgagtttctatataatgtcatcatcttagctgaaaaataaaacaattccaggtggttaatatggtgtggaataaaatatttacactttttaacatttgtatttaaaatactcatttgaggccttcacatagaatcaaaaatagaaatttaatggttcattgacctttatatttataacttctaaaattctggataagagaatacagatattttatccaaatgaaatcgtaatctttttgtagcttaagttttctctggcttggtttggtaacagcctgttactttacatgagtgattataagcctatcttaaactgtagccattgccctaaagaaaatgtttatggcctgactgggataattgtattctcctattaaatatcactccttcagggctagttactgttgagtataaatgtgccactttatatgcaaataaaatgtcctgagatttgaataaaaagttctgcatatacctactgacaaatcaacttattatgattcatatcagcaaacagaacttctcaagatataagatgctaatattacatacaacaagagacagttctttccttgaattttgttttcaaaatgttcagatacagctggaaatgtctttactcatagatatagcagattttgggtttgcattctgagtttcatttttagtcaaaagatcttacggtattgtgattacttattgccaaccttttttttttctttttgtatattttagtctgaccttgatttgtcttcagtccttttcccatatacccacatacctgggaaaaatcaactttttctcagatactctagcgcaaaggccaactcaaagttcagcttttccaagaagccttcttaaattcgacctaggaaagcatagtttcctcaaaccttgcgtgtggagtataatcacctcacatatttgcattttctttttatttttttaacctatcatctctgaatttgatctttgagcaaaagtaccctcaggaaaactatcattttgctgttcacatttgaaggagcagtgtttttgttttctgtttttttttgagacagggtctccatctgtcgcgcaggctggagtgcagcggcgtgatcatgtctcaccgaaacctcagccataaggcttcagagatcctcttgcttcagcctccggagtagctgggattacaggcatgcaccaccatgcctggctaacttgtggatttttgatagagatggggttttgccatgttgcccaggctagtcaagagctcctggactcaagcaatccaaccatctcagcctcccaaagtgctgggattacaggcatgagccacctcgcccaactagaagcagtgttcttatatctcaaatcccatctcagacctgtgccttgtgtttttaacaacctctcaggggtactgtgcaacaactcttcagaaaagcaaagcaaaacatattatgtgtattggggccctgtctgtgcagagatagtaatatgagataaacatggatgatttaagggagaaactatataaagcatttaatccccattttctccactttccctacagctctgctgtccttgcctggagctgtcagaggaaaatgggagaattcaatggcatgatgttgaaaactgaactctgattttctggccaatccatctacttccctagagttaaaggattcataggtgaatgggagctgcaggaccgtaggaaaggacatctttgggttatatcaccaaatcaacacaatattgcatgtttgggaagttcattgcttttgttgaaactttgagaaagcccaatacccaacaagaagaaagtcattcactcaggagttaaagctaaatacttacactttttgagaaatacctaaaattttatgattggggtctattgtacttcttaattagaatttagggctaacaagagatattataacatcaatacttgcattatatagaggaggcctttaaactactgtctagggaattcagagagccatgttcctttacaacattccttctcgtgcaattcaaagacaattgatagctagaaaatgtcaaggaaccaagattcttgaccaacttgaaaagcaagacttggataaatggcattatgagatatatttgcactaattgtttcaatttgactgaagtatgtcatctctgctagattgtaatttccacaagggtgaggctcatgtctgcatatcaccccttatttatactcagaagggtccctattacctagtgggccctcaaaaatatttgatggatcatggaataataaattaatgcatgcttgcccgaccctaaatattgttctatttcttgtagattcttccaaaattatagtcactcaatacttattcctattagttgggtcacacacatacacagacacacacacacacacacacacacacacacacacacacacatacacagaggctaatgtgaatatagggtctttccttatagcctttaaaatagaataaattcttatgtgcatttaataacttagattttctgcttgaaagcaaataaatggagtaaatcagtcccaaaaattagaataatttctgtaatacaaaattaaaccaatttaattaacattttaatgttaacaggacacagctaagatcacccttagaataatgaatctatgtaaagatcttcatggatagaaaaggtacaaatgggtttgcatgaagcttgtacctacctctgatatttgggacaaaagagatgggtcactagaaaggtttctgctttagaaatgacctccttatcaatctccttgtttttaatcttgccctataaattccattcttcaaaatgaagtcagagtatctgttattatctcaaatgtagcttccttgcttaaaacacttcagtacttcagtagtcctattgtcttagagcaaatttttggggtcatttcactggcataaaaggcctgacctaaactgtgttcctttctacagatagaatttcatttcatatcactcattgccttgagctatgtgctgtggtaataccaaagaactggtgattaccttgctgaatacgttgcattaattcaagcctctgtacttgtgctcacactatttccttttcctggggtgttgtcctcacctgtcttccccttgtgactccttctcccattaagacttatcaagtctcctctaggaggtatttaaaatggccttctgctatggtccaatataagtctgcatacattttattatttgctgcattacattgaaattaaccagttacgtatctgtttcttactctagactctaagtattcccattacacctctttatggttatctttatggttctagctcccattttgaaatcagttattatcccaataaaatcaataagtgttgaaccaggctgagtgcagtggctcacacccgtaatctcagtgggagtttgggaggccaaggcaagacaatcgcttgagggcaggagtttgagaacagcctggccaacatagtgagaccacatctctaacaacaataacaacaaaaagccagggtatggtggtacatgcctatagtcctagctactcagtgctgatatgggagatcacttgagctcaggacttcaaaactgcagtgagctataatcacgccctgtgccccagcctggacaacagagcaagaccctgtctcttgaaaaaatgtgttgaaccgcactgagtatataacattatcttgttcttttgcccatctccatcatttcaatgttctgttgtggcctgggagtttccagaaagtaacattctcttttcttatgtgaattgctgaactaaactactaatattcttcagaattatagagtagtaacactataaatggctgttaacaaaagccatatggctaacactgacctgttactaaataagagtatattgaggactcaggtgggaaaaatattcaagaattagttagcttcatgtgctaatatttataagaaataattacattgcaagaaacgtgttaaagcatctcagttatgtttagtagtaactaaacttgacactatttgcatatttggagtacttctactgttttttcaacttaagagctcaagcaagttttatacattcataaaaaattataaaatcatttctttatttcaattttcaaggccaacgtattgtgtagactttcttataattgttacaaactcagaaaaagaaagatttatgaaagaaacattgacattcctttaacaatggtagttttagcaggcaccttggtattatcagatattgcggctcccagtctccagtttccagataatgcagtgacttaatcagtcctctctgaagtgcaaagcaggcaatcttctttgtcctttgtgcatttctcacgtcttacaactgccccacttcaatattcctgtgtgtcacctaccccacatccgtcttaccctatatcactattctttgtaatttattctgggcttagttttgttactacactgaaatcttatgcataattatgtgaggttgctatggagattttgtgtgatttgtcatgaggaaaacctattgtgtttgagatgattctccatactaatgatcaagaatccatttttttgcccatattttctctgggattataaccaactgcatatatttgaatatctataagcaaaagttattctataaataacataagcagaaaaaagttattgaattcaccattaaagtgaagcactttagtgcaaccagttcaatttctcatgatttagaaagaacttctaatgtaactctttttgaataccagctgaactcttgcctgaatccttttagaagagaccctgaagaagttattctataatcacatctcttaaaattctgtcactaatactatatatttggctatacaataacttgaaaatgtaattttggagaatctgtgaaactattgtgcaaaattaagagaagatatagccaccttattcgaaaatgtttattcataattcttcaattatacagactttttggaggtggaaactgagggcgaaattgattatttggcattagtcaaaggcaattcagactaaagactgtgattgaacaacagaaggtaaatatcacaccatataacaaagtcatgattttatacctctcttgtctgaccgccccaccaccagcctaggatgaggaaaagcatgaaatatcatgagacaatgcacatgaatctctcctttagcccccaggtcagcaaagctaatttcaggatcatgattgatttttagagagaaacattcccaattcaagtaggtagaagtttcccaagcaggcagaagagaattgtgatgaattcggcagcttgtcatcaggaaagtggcatccagaggataaatttagaagttaagaagtgaaatctcaaatcaaaggcagactaattatagaaatgttttctaggcaactatttgtctgaaaacacaactaaattaccaatcatttctggaaagagtgtgtggttttcactcatgataatttgttgccatgggtacccagtgtagaaatctaacaggaacagagatagcaagtaaggagaaggagagagaggggctcagtgagatgctctggaagaggaagatcatagtcagtgtttgcgtgacaaaggactccaattcagtcgactatctggtaagtctggacagcaaaggagtcctttcattgtcttcatgggagccaatgaagtaccctcctcccagaagccgagaatagtctatactggacatgcaagtcagtgtctgaaaagtgtcagagcaggtgatagatcttaagggattattctctatactacaattgattcaaagggagaggagcttctggaaacaatgaatgatcatttagggaggaaaataggagaacacttttgtaagaatataaaaggaaaataatacctgccttaaaaggctggtgagtagaagatcatggctaatcaaattagagtggagaaggaatttagcttcagcaactggaaccaatacatggtttgaaagtcttcccattaaaaaaaaaaaaaagtactagcatatagggaagactcacatgataggtgcaagaaatcaatgggcagacccaagcaggagacaaggacctatgctggtgactggagaatcttactgaggtctttagaggaagtcatgggctcctaccacagggttaaccaaaggttgtggcttttctaagagaatgcatcagagatgagaggaggagcttcaccagcccacaaccaatgtaccctacttctaattcagagaaacttgtagtgagatctccagtggctttggaattctgcatagaaagctagagaatgtgagcgcctaagtagccatgtccagttgaagaacaggtaaaagggaaaggagggcaatttggagaggaagaagatgtcaaagtattaggttgtcttgatcaatattccttaagcagagctgcaaagatagatcctcagggatttcctcaagacccaaagtcctattttcatggtttcacaaagtctcaataaatatctttaaactcttaatctcatttcagtggcattaaaataaatactaagcatattctaaatgtattagtgaacaacttttgactgaatactgccatgtggtccagtgttctttgcacttttatttatgatgctcttgttaaaagtgaagaaaacggacgtgagcttaatggacaaatggaatattcctgccacaagaaaaggccaaaatgatataatcccatgttaaactaacagtttgtagcttgatgggttgaacattggaaagacaattgggttgtcatccattacaagagtctacaggacagccaaactcagaagaacctgctcctagtggaaaagaccattaacaaatatgcaaattgcaaataagtctagcaaatgtcttagcaaaatagcaccatctgttatattaaatccagttcatatatttgatttctattggttttatagttttgaatttataaatttattttgattctgcacttaagaaagaactataagcataaagagtgtatggtaagaagaaaaataatcaaggaattgagagaagcataaatctgtttaaaaaatgaaaaaaaaaacagtgtaaaaaagtctagagtatgctgtggcttacaaatactgatgacatctatagggagtgttaggttaaggctgtgtttcgagccatatgagaacaaggatgggattgtcttattgcttgaagccgatgatgtaatgctaatagaagccagagagaaagcagaaccattcaacttctatattgcttccacctttgctatcaagacaaacgatcaccgtgttgaaaagaagaggaaaacatgaagcccaagacaagtgaggagatcccaagggagatcagcaaactgctttgcataaatccaagtctcagcaataaatgacaccctggggtaatgaaaggacttcagctgagactgtggaagtttgctggcaaactctggggaatcatgatgagtcagaggggccccatattaagaacagaaaaatgtgtttgtttgtttttagaacatgtcaggagtttttaatttttaaaatcaaaagaaaaagctgcatttagaagttacaagtcagtttttagtctggttatcatgttccctcaaaaatatttctagaatgcaatgttttaaaagagagtgtatgaccatctagaaaagaaatcaatggtcactaggagttacaggggcttcctaagataaactcccattcatatctttttggataaaggtaacaagactgagaggcaaagtgaatctggattgcagccagatatgtaatcatgtatttctttgttgttgttgttgttgttgttgagacagaatcttgctctgtcgcccaggctggagtgcagtggcgtgatctcagctcactgcaagctctgtctcccgggttcacaccattctcctgcctcagcctcccgagtagctgggactataggtgcccgccaccatgccaggctagttttttcgttttttgtttttttttttcggtagagatggggtttcaccgtgtcagccaggatggtctcgatctcctgaccctgtgatccgcccgcctcggcctcccaagatgctgggattacaggcgtgagccaccgtgcccagccataatcacgtatttcttgataaccaagaagcaggctatagaagtggggactagatgatcattttgtgaggtaaaattgaggaggtacaaggtggttgttctctgcctaacaactgtgctgaaatagtatatcatgaaaagcctgggcttcaagtcagaaatctgagtaactctttaccactgactagttcggtggtcccacaaatctaacccactgcccatttttgtaaataaatgttggaatacagccacacacaatttttttttttacctattgtctgtggctgcatttgtcattcagtggcaaagttaagtaagtagttgcaaaagagatcatgtggcacacaaagctaagatatttactatcagcctatttacaaaaagagtttgtcaattccctgactagttacataaacaactaggatgtttcataactttacttatactcattttcatcatcgacattaatctacattaacagaaattgattactatagcatagtgcttcaaaggcatctaatgaaataatgtatgggaaagctccttatggattgtagtgtgttgtacagagataaggcatgtcttatgatcactctggctactgaaagattaatagcaatattttcatgttaaagacatgccaatctccggtacaaagaagactctcaaaaatactagatggacttttggatgaatggatagatgggtggatggatgaatgaatgaatgacagtagtaattatacctcgcttatcactggctatgtaacagggacacatactgttttacatgtattaccttgtttaactgttgtaacagacttgtaacattatttacattttgcttctgagtaaaagagatttaaacaatggcaacatcatcagaagcaataacaaatatttatacaggacttatgacatttagccactgtgataactacttaccaaatattatttcatttaatccctcaattacctcatgaagtaggtgttggtatcatcatcatcatcatcatcatcgtcatcatctaatcatcattattattccatctttattgatgagaaaatagaggttcaggaaaactaacagacttcccaaaatcaggcatctggtaagtggcagagctggaattcaaaaccttgtctgcttgactctgagcttttaaccatcagacactgagacaatggatttgcattgacatgactcaattttctaaagataaatgtaatgtcttattgaaataattaaatattcttgactctgaagtgctctgaccttacaacaaaccatgaaaactagtttttaaaggactttttatgctgaactagttttagacttcaagaaaatttgcaaacatagtacagaattctctttatatctcccatccagcttcccataatattaatatattaaataaaaatgacacaatggtgagaaccatttagttgtcatttctccttagtttccttcattcgctaacagttccttagtccttccctgggtttcatgttctcgacactttggaagaatattgattagttactttgtacagtgactctcaatttgggattctctgattttctgtttttcagaatttgactgaggctgtgcagttttggcaagaatatcacagaaatgatgctgtgtgctcagtagatcacagtggagctcgtgaggtcattgtgtcttttttttttctttttttttgagacagagtctcaatactgtcacccaggctggagtgctgtagcgccatcttggctcactgctgcctctgcctcccaggctcaagcaatgcacctcagcctcctgagtagctgggactgcaggtacatgccaccatgctcggctaatttttaaactttttgtagagatggggtgtcactatattgcccagactgctcttgaactcttagactcaagcaatccttctgcctctgcctcccaaagtgctgggattacaggtgtgagccaccatgcctggcctttataatttgttttaacagactgaagtctcaataaactgacaggtaccctagctagaaacacacacacacacacaaacacatacacaaaacctcatgagagttttgactgtgttaagaaattcctgagaaccacaagcaaaagtaacatcaattctgcctttttctccaatgacatggttactgaaataagcactggttagcagaggctgagggcatctggagtttacttcctatttcttattgtttccctactagctggcgaagcacattgtctgatagaaatgaacttttggtgtatgtgtatctctgagccccatatgacaaagccagcttgaatcatgctccaaatactcattcatttccttgtatatgccaggctagactctggttgcctgtcctacctatgagccaggatcattggatgataagcactaggaaggtttttctagaattctgccattatacttagcctacacacacacacacacacacgtatatatacataaaacatattgattctatattaagattgaaagacataagtcccatgaaaataagggttgttaattttctcacatcttgctctgctcagctatagtcaatttaaaattgcagttgaatacaaagagagtttgctgtgaatacattgaaggccattgctttattcaggtgggcataattacagagaccataaggagactcccttttatttattgatctgacttctataagtttcctggatttcaacattttttcttgtttagagatatactgtctgaaaactattcaatttgaaatgtgtccactgtacaattcagtccttggaaaaaaagcctttagtaattaaagcagccatggtgtacctgctggcactaaaatatccctgtaagatgttagccatcaatatttctatagaaaatgccttattcaacaatatgctcttattatttcagttacagacacttttgtaaaagcacacatttaaaatgcacattaaaagaataggggaaaaattgatggtttgtcttaaaaaggaaaaacctgcagaattgggaaaaatagttttgtgagcacattttttgatagttgtattttttttaattttggacaaccattttgagtaacaatgactattctgagagcctatctctgtaaatctcttatcaatagtaagtaaagaagataaagtcagatgttgattagatcatatttttaaatattggtgatttaaatcttaaataaatatttgggattttgttgttgttgttaagacagagtcttgctctgttgcccaggctgcagtgcagtggtgcaatcttggctcactgtaacctctgcatcctgggttcaagggcttcttctgcctcaacctcccgagtagctgggattacaggcacgtgccaccatgcccagctaaattttgtatttttagtagagatggggcttcaccatattgccaggctggtcttgaactcttgacctcaagtgatccaccagcctcagccccccaaagtgctgggattacaggcgtgagttactgcacctggccttaaaaaaatatttgaatcaaatattggcaactaaataaatatgtttgggtaaaacctattccaatgcttaaaacattataatgtgccagaaaaattatacacagttcataagagaatatttgttaaatagttatttttgatttaatgtgactcaaaatcagaacttaaagagactttaaaagtcatatggggagtaaattggtagaagtgtctggaggataatctgaagttgcaaaaattttaaagtatatgtgtgacacttctgcttgcccaatttatcataaggaaatagtaaaacaaagttacaataatgcccatgaaattacgttcaccacagttttacttatcacgtaaagacactgaaaatgacaccaatggcccaaacagcgattggctgataaactttaagacaagtagtctcaagtcccacaccttcaaccttgaaataaacctggacttccacagattctttttaaatgctaaatgtgagctcttgttcatctgaccagaaaagaaaaccagaacaaaacaacagcagaaacatcaacaacaaaacccttcccagccgaggagcggtggctttccctgcctgaccagcagcctgggttacagacctgacctccttggtatcatggaacctaagaaattattggctattttctgcagctgttttcacaaagccacagcggaggtgaccttggggtggggtgaggcaggacccagcagacgggagctctgggcttcccctccagtgagagtgacttgaatttcatctcagccacaactggttttctaggtaagattttatttgaatatgctttctaaagccaaaaaagaaaatataagtttaaaaaccactactgtaccacccaacaattagttgttgttattgttgttgttgttttttcaaattagctcaaaccaggaaaacaaagtgctgattttagttacaaggattatagatcacataagtctggaacaggactgccatctcttattcaaacccctttgtaccagatgaattccaaatactttgtatttgttagatagttaatatagaacctatatattatgaaacacccctagcaaacatggaggcagcaactcacactcaaatacattaatagttctgaagtgagtcatataaaaattcacactagatgaattaaataaaaatttaagttacctcatatcaattcatatcagactttttaccaactgagttgggccaaatccttaagaaaattaaagaaacaaacaaacaaaaaaattggctttcagagctttttggatgttaggattgtggctcaggggctgtgcacctgtgtgatgcagacaaagctggagttcatgaggagctgcaggtggagaccccagcccagccagatgccccccagaactgaagtcagacacgtggatgctcacttgggaaggcaaagagtaaaattcaaagctccatacagaaggtagaaagagctcatcagagaaaacaaattagaggtcacatgcccttttcagcagtcaatatatatttctattctttaaaacacattttccaagaaaaggactatgtatactttaatattcatacaatgccataataatctggtaaagtgaaaatatgtccaccttatatgggtaagtgggaaatgttgccaaaaactatttttttctattagatagatcccttacccaagtgtgcacatgaattttaaaaagatgctatgtaaatggataaataaccaaaatgttaacagtgcttaatttcagggagtgtaaatttgctgatttttatttttattttatttttccttttctaagtgtttctgtattttttgaataatgagaaagtatgatttttaaaaaagaaaaacagaactctttactcttggtgaaaaatacaattattagcggttcacatgtaatttagtccctcagggaccaagtgattcacctaaagtcacattgttaatttggagaaaaactatgcttggactcaaggcctttgactccaagccttgcatcctctccatttctccaggctgcattttgaaatgaagcatgaaggatggcccctgccttcaaagtgctaatgattaagttgaggagataagaaatataactaggaagcaattaacaaacattacaagatgctatctatttaagtaactgctgcaaatccttttggaagtgggaggggtcatctaaatctcaaataagagaatacagtataacattgcatgacacgtattgcaaattcctatgaattcagaggagtagaagataaaacttagtagtcccagagaaggctctactggtaaaagacagatacgctttgaaaaggttaaggtcaggaaggatatttgtttccacaaggacatatccagacaacaagaccactgattgatggtagaaatagttctctgcatatgctagagagtaggagaacaggactggacaggtggagtaggcacagtttacagaaggctttgaaactgaaaaataagaggatgatttagaaatgatgtggaaagaaataggagccatggacagctttcatcgagggaatcacgggtgggacaaaggcacttaaactgcatgaatgttccagaagtggcatgtagggtggataggcaggtgaggatgatgtcgtggaagtcaggtgcagaactatcgaagcaatgtctgatgttgggcagcagaaattcacaaggaatcaggatcagacatggaagcagaaggctgagtcacaaagatgccaaggtttggaatggatgtctctgaaaacagtgatgacctgacagagatagatgatttaagatggggttcactatttcagaaggcagagcaaagagtaaagaaaacatgaagtgctcttgttcgttaaagttataactgtttagccatgtaggtttgagcactaaggccaaggggctaggttcaaactttcaatttgcaatgtggcttgattctgttctgatgcatcagccatgctcctcttatttcatgcaactatagcaaacacagggggattaaaaatagggaagacagacaagtcaataccaattataggaaaatgatttcataaacaagcaaaattcatccaaatatgatcaagtaagaacatgattttatatggcttaaatagcatctaaatgttttctttcgatttatttgtgcgagaaaaaagagaggttataaatatagaaaatggatgaaaatacaagtagttacatcttccctgtgtctgcttaggcattctatattttgcttgaagtgttttttaagaaatgatttatcttcattccatctgccctgtcagagacaccttggttgggtcagaatgactggtttagctgggaccccattgcctctgaacctttaaacagacagcgctttgaatttcatttcagagatcaggtgacatccaaatccacttaatgtgtaactggtatggtttttgatgtcactggagaccctgatgaaattacaatcctattagtcatgacgggggaagacaggagaccttaggtggctaatgttccattcataacaagaaagagccatttagcatttgtaaagggcattgatttctgatagttccctaaagaacaaggctcaagtgaagaaatatgaccagaaagagcttgggaaagaaatgatagaaaaggcaagattgcatttatccaaacagctttactctgtgtactttttacaacttcacttgaatccaaagaattgagtcttcatgtaaaagtggatatgaggaaggacaggaaggacatgctcagctacacagagattctgttactgagaaatctggggaattataccgtgcccttgattgataccaatgaggtgcctctaaatataaagggtaagtagaggttatgtggaaaaagggttttaatctgggtgataaattgccagattccattatgcttaatgagtctcatcagtgcatagctagactcaagaaaataagacccctttcaaagcctagtataagcaaattagaagaattaataataaaaatcctattaatgtgtatgcaatttcaagcagttaatgaagtcaatttaaaaagtttggctaacgtattttttttttttttgcattttttaaaataaaaatacctgatcatcaaaatagatttgttcttcaggattttttttctttttttcccccaaatatatcctatgtaagacttaaaggattagatttcctttggtttactcttctccagggagggccctacttagaagttatgggatatgacaaagggagtgttgcaggtcttcaaatgtataaaatgcttattgacctgaaagttacaaatgagattcattcaagcaaatttgccaagcttcataatatccctcctaagcaaatggcgactacctgaagaaaaaggttctcagtcacctgcctggtaaaacataaatctttgcttctcaacataaggtctcaggtaggaaataagaagcagggtctacaaacatctatgtgtggctcaaaacagcagtagttgttgtctctgaccagctaagaccttcagtcccaaataacagagaatctgctggatttgcaccaacaaatttttgtgcaataaaccatcagtcatgggttaaaaatcagactctcacttcttgccaattggattcttttaagccatcatttagaaaagaatctccatactcaagcatataatcaaagcatgtgggagatgagaaaaaaggtagcccctgttttgtagttaaatccctaggcaagaagcacaatcagacatctgtgcgtatttagatttccatgaaaaggaatgccatgtgctccttaatgccatgtgaaataacataactcatggttttcggatggcacccaggggcatggagagtgtaatgatgtccgcttcagaagttaggaacacacttgtgtgcaatgttacctagataatagtcacagtgtctggcacagagtaagcaccctataaatatttcttcaactctgaatggaagagtgagttctttcatacacaatctgctatgtaaagtttgtacatcctctgttttgttacaaaaataatatatgttctcactagcttgtggtttaacctctgaatcaatgaagaatgggagccactccctcctcaatttttttccttcctgggctgctaatgtgctgcccctacctggttctacctccatacctcagtgcttccttactgggcttcctcttcaaattacttgtcgccatcccaaccctgtttattttcttttacattttctaatcaaggattcattgagttgtatgacttcaacaaatgcctttatgcaaccgtgccctgaaatatttacaagcttatcattatactagattctgtaagggataatatagtttagtaagaagtgcactcatatacttgaagataaatgacaattttatggccaaatgattgaaaagatgcagaactatcattagaaaagaaaaagagccctgttgtttctggcaaaggatgtgagatttgagtggtccttgaaggatggatgagagtcatacatggagagctcgagaaggagaggctatcaggaggtcaactgttatgggcaaagacggtggtgatggaaaactatgtggctggtttggggtcaatgaggagactgctgggtctgccttgaaggtttcattatagaataatgggcagtgttgtggaaagacaggtggacccactctggaagccctcaaatgcttgattaaggaatggattttatcccatgggaaaaatagaactatgtgggattttaagcctgtaagggacttaataaaatgattcctactgactagaaggttctttctcaacatctcctcactgcaagtccattccaaatcccatgtttctttttcctttgtccactggcttaattatttctgtcagtgttaacagcatttttcttggactcaaaggctgttatccttgggaatatctttgaggtttgtctccaacttcaaaactatttgagggttcactgaccaaaagcaccttggtaatgctttaaataaatacatattcctagaccctgttcgagaccaactgtatagtggtagattttaggacccagatttctacctcttacagaatgagtaaatctttgctaatggttacttttcctttcaaatatctgtcaaccttcccatttcttttcaaacctactgcagtcactgtaactcagaacttccttatccttgactagttactatgacaggcaccttctgggttacatccttcactctaatatcagcatcttctttacagaactcatttggactccaggagaatagcaacataatcgtaattcagatcagtggtactcagatgtttcagtggaggtgattctaatgcaaacttttcttcaggagggaaataaaatatttaggtatacatttggcaaaaatatatgtatctttttttggatgggggatgacagagtctcattctgttgcccaggctggggtgcaatggcatgatctcagctcactacaacttctgcctaccgggttcaagcaagccttgtgcctcagccccccgagtagctggaactacaggtgtggccaccatgcctggctaatttttgtatttttattagagacagggtttcaccatgttggtcaggctggtcttgaactccaggcctcaagtgatccacccacctcggcctcccaaagtgctgggattataggagtgagccaccacgcctggccaatatatatatgtactatctacagggaaaactacaactctgatgaaaaaaatcaaagagctaaataaacagagagatattccatgtttatggatagaaagactgagtattgtcaaaatatcagttctttcaaacctgattcacagattcaatgcaatcccaatcacaatcccagcaagttattttgtgcataatgacaaactaactctaaaggttatatggagaagccaaagaccctgaatagtgaaaaatatcgaaggagatgaataaaagttgaagaactgagaccgtctgacttcaaaatgcactacatggagactcaaatcaggaccttgtggtactggcgaaagaatagacaaatcgattaatgggacagaatagaaagcacagaaacagcacagaaacagacccatataaatatagttaacttgtctttgacaaagaagcaaaggaaatacaacggagaaaagatagtctttccagtaaatggtgctggaacaaatggacgttcacatgccaaaaagtgaatctagacacagacctcacaacatttacaaaaactaattcaaactgaatcacagatttaaatgtaaaacacagaatggtaaaaccctatatgtaggatagtaatggtgcaatcacatgcctgggtatttacccaaaggaattgaaaacttatgtccataccaaaacctccacacagatgtttacagcagctttattcataattgccaaaacttggaagcaaacaaaatgtttctccataggtgaacggataaactgtggtacatcccagacaatggaatattattcagcactacaaataaatgggctatcaagccatgaaaggacatagaggaaccttaaatgcatagtactacatgaaataagccaatctgaaaagtactgtatgattctgactttatgacactctagaaaaggaaaagctatagagaagatgaaaattcagtgttttccaggggataaggggaagggactgggcacagaggatttttagagcagtgaaactactgtatattgtagtactgaatatatgtcattatacatttgtccaactcatagaatgtacactaagaatggaccctaatgtaactgtgaccttgggcgaccatgatgtgtcaatgttggttcaactgaaacaaatgcaccactctagtgggagatgtcggtgatggggtgaagtgcgtgtgtagggcagtgggtgggggatgttggtgatggggagaagtgcatgtctagggcagtgggtgggggatattggtgatggggagaagtgcgtgtgtagggcagggggcatgtgggacatctctgtaccttctgctcaattttgctgtgaacttaaaactgctctcaaaaatgtctactaaaaacaaacagaaaacaagcaaaaaccctacttttctctgtgctgttggtcttcagagaaaggagcggcatcttcaaagtatagtaaaagcctcacaactggagaagtaatcagcatcaggaaagcactcactaaactttctgcccaaggccaaattaactgtcttttctgcgctccgaaatactcagaagactcttgaaattccactgagtatagaacccaaagccaactggatttcaaacaattccaagttcacaaactcagtcagtctgtccctgcgcttttcttacaatggggaagcactgccaagccctgcagaagatggtgggaagcagtgcttatctggtaacggaacacctccttaaaatgaactctttccaggttgaaaattcccctgttccaacttctactatcatttgaagtgatgaacacaaaaagaaacacacttctccccacaatcttgtcctgtctttggcattttagagcttatccaccatagtttcttatgttccaagaaaattacattcttttggtattcttctagggtgttagtaatgtcttgaggaaacaatgtgggttagagatgatcagaacactgtgacatgagccgtatgaaataaacctggactatatttaaatgtctgaaaaaccggataataacccaaactggataacaagccaatatttttttaaacttttattttaagttcatgggtacatgtgaaggatgtataggtttgttaaataggtaaatgtgtgtcatgagggtttgctgtacaggttatttcatcacacaggtattaagcatagtatccattagttatttttcctgatcctctctctcctcccaccctctgccctctggtaggcaccagtgtgcattgttctcatccccatgtccacatgttctcatcctttagctcccacttataagtgagaacatgaggtatgtggctttttgttcctgagttagtttgctaaggataatggtctccagctccatccatgtccctacaaaggaaattatctcattgcattttaatggctgcatagtattccacggtatatatgtaccacattttctttatccagtctatcactgatgaacattgatgaagccaacatttttaagaataggtgtataaatgaatacagaaagtcaaaaatgggaaatgggtccaatgtctgaaagataagcacatggaggaaagagagggcttcagagtgggcccaataaattcatgtcaaggaagtcagctcctgcaggaccaaatgcctggctaggtgtacaggaaacaaaagtgtggtggcatcaccaagagggtctgggcaacaaaatcaggcacaggtacaataaatattcagtagacatctattgaaagaaagaatgaatttatgaagatttaggtatcagaaaggaagaactgattccaatacatgatggctgtcatctcaaattgagaatattcaaacctaacaaaattaatacacttatgaagaccatgttatcagaaattggaaataaattccagtaaatgttgactaacaccagaaactcagtatgttcaaacccaactaaaaccatgtcagtgtggcatcaccattcagcccctcacacaaacaaggaatctgggaatcatcctcgactcctccttctcccccgtttgcccgagtcctcatgccaccaagtttttttgcttctacattctacatactcttgaaatattgccccttgtttccatcctcatagccactgtgattcaactgtctttatcaactttcactgagaccgtggcagtgacttcttcgtcactgtgcccagcttgggtctcatccctactaccaccactacccaaactgtgggctgggtaatctttctaaaacacagactctattacagcatacctttgcttaaacccttctggtgaccttcccctgtctacaaaataaaatggagagcatttgggccctatgtgcctttccaatctcatctcttgtcatttcccatcttgatcacactgggactagaaatatgaaaggcagaataacacaattgttaggagctgagccacagcagtgctagacattgccagtggtacctgtgtgacataaaggggacactgtcgctggtatatcccattcctataggaaacttggattcctttttagatgagtacatataaccttacagctctgtagagaggcccaaaagaaattgtaagtagtgtattcatttgtgggtaggaaaaaatgtctgaggtatcagaagtaatgtttttggagttccctgcataaaaggtattaggggaaactaacatacaaaaaaagaaaattcttacagatgagtgtcttgtctggtttttctgagtcatcacatttttttcctatacactggactctctcattcatttgtagccatccaccagacacccatatacagctattatttcttattttaggttaatattgccaagaagttacataatcaaaacagaaaatctgccaaaaatcccaaactgtataactattcatttcaaagccaaatataaattatttgagattagccaaagtttcaaattattatgtgtatcagtggattctgaaaagcatacaggctggaataagcatagtaaaaatgacagagcaagcttcttgaattcttggtgaatgctgcagcaaataattttgccaacaaccacacttcctaaacctcattaagcaagtaggaaagaataaactattccattaccattcctcaaactggagaaaaaaatctaggaggaaaagccaggggaaagcacccaacaaaagcatttcacctcaaaagctctaaggtagagcaatttgaagttagaaaaatgggtttaagtagctactttggttgatttctgcctagttaggcttccagtgaccccctaatttgcctggaaataatgcagagaccacctaccgtgtgcaaagcagtgtgacatttagaacaaaggtggcagaatctcaatgttcaaaagaacacataccacatgaggtaggggactcagaagaaggaagtaagaactgggctcacttccatttacttaccaggctagggatggagccatctgagggctaagccccaaactggccttggattcatgagaccaggaaaacccctgatccacacagggagcagtctaattggctgggggcagggctgctctcataacccaccccaaacagtggcagtcacaagcgaggacaaacttggaaggaggcagggcttcccaggtgtgttatatgaaccaccggctttttggaagattagacaatccccataaaaagataccttaatagctatatgctgatgtctgtatatattagaagaatataaaaaataaaactaacctattaacctcgtgatttctatgctaagttttaaaaagttgacaaagaaaaatggtaagtaaatgatagtacagatcttactaggatatggacacatcattaagattatatccaaatgagtgaagtttagaaaagcctggactagaccaaagagataagataaagcaagtccatggaatgaaaaaaaacttctaaggctaactctgaaaaaaacgtatatatgatactctcacaaatttttttcctgccttttagataaattacagacactaaacatctgaattatagtgtagactatcaaattttgtcaggacaaccagtttggaaaacctgcatcccacttctcagcttctatctgccaagttttgcatccaattgccccttccactgcatgcaaacctcaggtggggtgtgggagtgaagagtaacaggtgtaattaacctgcccacacttccttcccaagtctagctgttgcagcagtctgggagcatcccacagccagggaaagggtattgaagggaaagcagtatctgccacctaggaaattaattgaaaagaaggaaaccttcctccgttctgtctcaccccaattcagaacatgttaattgcagagaggctaagttcattaagtgctgcttaactgttgtctgaagattatcacatattaaatgtaaaacctaacagtcttcactcttctgataaaagtttgtaagagtatttttccagaagcccaatctggaatgattgtggagcggtgacttgttaaggagcttaccctgccaatgtgtatgtgggcactttgtttctaattatttcaataaacgagctttataagaaatcctagtaataaagtaacttatgccacagaagaataaatcctggtgctctcaatatccagataacataaccatgctattaagcactgcctcgtcaataatggtagtctttgtataatgatagaactctatttacataatacaccaacagtgcctaatgcaaaacagggtttacatataacattagttgaatttacagcatgaattcacattccacctttgcattggtcagaaaacattatttcacacttcactgctctaacaaataaattaataaagctcacctcatctccagtaaatcccgacgtgcatacctcgtgattcaaaataataataacctccagtcttgtccttgcatgtcctttgaatcattctcggagagacaatcattttctggactaccccaccctgcatctgaactccagatgtgttcaaactggattctggccaaagctagagaagtctcagggatagtgacgatctcatcattttatgtcaagtgaagggaggaaagttaccaggattttcttgttttccttaaaaattcacaaaataccaagtctcatctttctagggtaagaattcagtaaaacactccatgcctgtatctttacttgaattgtcagctccatgtggacaggaaccatggccttctcatttattcacttttctgtcccttagttcctggtacagacaggtgctcaatgcctgacacatagtaggttttcagtaaacacttgtggaatcaatgaaaaaccttactaatattgcatctcagattggagaaaatgatccaaggtaatgtcagcgcacttcaaagtgcagtaaaatgcagctgtcatttatgtatcagagactttatacccatccctgtgtaagatattctgtgagaagtaaataataaaaattgggatttatagtcagatgaagggaaacagcccagtgcaaccgaaataccagcaagtgaatagatgtatgtacataattggaaagatgttcatactattacaatatataactgtcaaaaagcaaattgcagaaatatgagagagggaaaaaaattatttttggcccctttgaatctcatcctgtggaacctaaaagcaaatttctccttttagaaagaaataaaaagatatttatttattccttctatgatatttatttgtatatttatgtgcagacagacagatgaataagatttatcctagtataagaaaaagtctaaaagggcacacaccaacccattcaaactgtttataacagtgctattaaatctaaaaggtagagtttgggagaagattttttttcactttctatttaatgcatttctgcattgtctacatttttttacagtgagcaattttttttagtaaaacaaaacaattagaatttttttaatgttataaataactaactacatttgtggtatatattgagtgttttaggagctcaataaaactttaattgtctggaatataattaaccaaagacctcaatcaaccagtatttttcctctacattctactcttagaaaaaaagaagcaaatcagataaaaataaattcatatcaagaatttatggagcagttgtatttttccaaggtaagtagctttagggtcttgtctaacttccaaacattcagctctaatgtatccatctccatgttgtctgtacaatgatgagtgttgttcagacctttgctattctatctgtgctgccaggcaagcaccttgtcaggatctcaggcccaatcagacttactgaaccagaatacctggaagtaaagtccaggaacctgggttttaacaagatccctaggtaatatgtttgcacattaacttggagaagcaccagtttagaagactaacccctgagttcctgcatgatcctcaacctataaaggaagacttattttcatcagattgtccatttaaaaatagaaaagtagacattttacatatactgcaggaagtgctaaacaatgttacccactgaacaaaattaactagacatatattgaaccccctcttatcccacaaaattgttggaaatgacattagagcacaacacagtaaaagatagatagtcaaaaatttcagctccagaacaagtctgggaaagtagaatcctgcaattacttgttttaaccatcagatagtgcttacacattggcagggaaaacagaaggccatatctcaggacgaggatgacaaggcatggcacttaggctgctgccagtccccattccataccaatgacagacatcgtcagtcatggtgctttctcatcccacccaagatgctgcaccagaatccttctcaatggatatcacaggtactcatgtctcatgaatcaaagttagcacttaagaagaaacatttctaacgtccctatttgaaaactgctggacatgataaataacctgattaagagatgataaatgaaacatgagtgatttaagtcctcatcgggtgggcaaaccaaatatgagagattcaaaatagccaagaactgctccctctatccagaaatgtatttatttaccattcctcaaactgtttgtttagtgtaggcaaagattagaaattagaataaatgaacattagagccaggagaactcttatagactatctagttcaactgcttctcttacacaggaggaaatactgatctaaagaaatcacagtggccaaatcccatagctaattctggcagaacccaagtgggaatcaatgcttatctaaccaggatttctcccattgcaccaaatggcccctaaagccatagcagccactggcaccataaactggatacaaatacacatgtggattcagaaacagagaatcacatcacccctagctctggggataaaccaaactcatgtagtggcggaccatgctccttggtaagaggctatagccagccaccagggagctctgcgctgaagtttgggtaagcccacaaaggggaaagctcctccagaggccctgcacagttacttctgagagacttgtgttcttagatctccccaaggtattccaatttaacacatgcaaaatcaaactcatgatttgcacgacacatccatgccagaacaacaaacctactcctcctcgtctgatagttgtctttgagtaaaaccactcttcacacagttatgcagggctgaaagctaagagtcatccttgtctcccgcctcttcctcaatctcaaattcaacgaacatcatcatcaattatattcttagatgtcttggggatcatcctcttctctatacctaccccattactatggtagtgttaaatactctcacctgttggcttagtcttctgcaatagcttgttaactgatctcacacgtgtattatgcccctccctcgaatctgttcaccacacagtacctagagtgactttttgcaaatcagaatggtatgccactcaccttcacttaaaccattcaataccttctcattggttttaacatgacactcaagtccctacaggatctgaccgctgtctacgtctcctgcctcaccccttaactctctgcacaccacactggtcccctctcacttcccctgctcctcataattcctttgactgcagggcctttatacatgctacctcctctttctggagccatctgcatccttcacatcccagttccagatgtaaggcctccaagaagccttttcaggttccactgaatatgttacttctcacaggtaagcatttactctctcatgaataagcatttgttttcttaggagactttcatctgttaataattagacattcattggggcattatatgatcaatgtctgtctccttactcaccaccccattctctgtagtctggagagttcaggacagcaggagagatgctagaatctttgtcctctttagttcatcattttgtcctcagtgtcttaccaaaggcaacacacagtagacatctaataaacactgaattgaatgaatgaaaaaatgaacaaataaaagccttgtatttaagcataagccactgattatgcttaaattattattcacagcttccaggcacatgtaaaagtgatgcattctaggattgctttttttaaaaaaaatttttttattatactttaagttctagggtacatgtgcacagtgtgcaggtttgttacatatgtatacatatgccatattggtgtgctgtacccattaacttatcatttacattaggtatatctcctaatgctatccctccccactcccttcaccccacaacaggccctggtgtgtgatgttccccttcctgtatccaagtgttctcattgttcaattcccacctatgagtgacaacatgcggtgtttggttttttgttcttgcgatcgtatgctgagaatgatggtttccagcttcatccatgtccctacaaaggacatgaactcatcctttttatgactgcatagtattccatggtgtatatgtgccacattttcttaatccagtctatcattgttggacatttgggttggttccaagtctttgctattgtgagtagtgctgcaataaacatacgtgtgcatgtgtctttctagcagcatgatttatattcctttggttatatacccagtaatgggatggctgggtcaaatggtatttctagttctagaaccctgaggaattgccacactgtcttccacaatggttgaactagtttacagtcccaccaacagtgtaaaagtgttcctatttctccacatcctctccagcacctgttatttcctgactttttaatgcttgtcattctaactggtgtgagatggtatctcattgtggttttgatttgcatttctctgatggccagtgatgacaagcattttttcatgtgtctgttggctgcataaatgtcttcttttgagaagtgtctgttcatatccttcgcccactttttgatggggttgtttttttcttgtaaatttgagttctttgtagattctggatattagccctttgtcagatgaatagattgcaaaaattttccccattctgtaggttgcctgttcactctgatggtagtttcttttgctgtgcagaagctctttagtttaattagatcccatttgtcaattttgacttttgttgccattgcttttggtgttttagacatgaagtccttgcccatgcctatgtcctgaatggtattgcctaagttttcttctagggtttttatggtttcaggtctaacatgtaagtctttaatccatctttaattaatttttgtataaagtgtaaggaagggatccagtttcagctttctacatatggctagccagttttcccagcaccatttattaaatagggaatcctttccccatttcttgtttttgtcaggttcgtcaaagatcagatagctatagatgtgtggtattatttctgaggtctctgttctgttccattggtctatatctctgttttggtaccagtgccatgctgtttggttactgtagccttgtagtatagtttgaagtcaggtagcgtgatgcctccagctttgttcttctggcttaggactgacttggcaatgcgggctcttttttggttccatgtgaattttaaagtagttttttccaattctgtgaagaaaggcattggtagcttgatggggatggcattgaatctataaattaccttgggcaatatggccattttcacaatattgattcttcctacccatgagcatggaatgttcttccatttgtttgtgtcctcttttatttcattgagcaatggtttctccttgaagaggtccttcacatcccttgtaagttggattcctaggtattttattctctttgaagcaattgtgaatgggaattcactcatgatttggctgtttgtctgttattggtgtataataatgcttgtgatttttgtacattgattttgtatgctgagactttgctgaagttgcctatcagcttaaggagattttgggctaagtcgatggggttttccagatatacaatcacgtcatctgcaaacagggacaatttgacttcctgttttcctaattgaataggctttatttctttctcctgcctgattgccctggccagaacttccaacactatgttgaataggagtggtgagagagggcatccctgtcttgtgccagttttcaaagggaatccttccagtttttgcccattcagtatgatattgcctgtgggtctgtcataaatagctcttattattttgagatacatcccatcaacacctaatttattgagagtttttagcatgaagggttgttgaattttgtcaaaggccttttctgcatctactgagataatcatgtggtttttgtctttggttctgtttatatgttggattatgttttttgatttgcatatgttgaaccagccttgcatcccagggatgaagcccacttgatcatggtggataagctgtcggatgtgctgctggattcggtttgccagtattttattgaggatttttgcattgatgttcatcagggatattggtctaaaattctctttttttgttgtgtctctgccaggcctgggtatcaggatgatgctggcctcataaaatgagttagggaggattccctctttttctattgattggaatagtttcagaaggaatggtaccagcccctccttgtacctctggtagaattcggctgtgaatccatctggtcctggactttttttggttggtaagctattaattattgcctcaatttcagagcctgttattggtctattcagagattcaacttcttcctggtttagtcttgggagggtgtatgtgtcgaggaatttatccatttcttctagattttctagtttatttgcatagaggtgtttatagtattctctgatggtagtttgtatttctgtgggattggtggtgatatcccctttatcatttttattgcatctatttgattcttctctcttttcttctttattagtcttgttagcggtcaatcaattttgttgatcttttcaaaaaaccagctcctggattcattgatttttttgaagggttctttgtgtctctatttccttcagttctgctctgatcttagttatttcttgccttctgctagcttttgaatgtgtttgctcttgcttctctagttattttaattgcaatgttagggtgacaattttagatctttccggctttctcttgtgggcatttagtgctataaatttccctctacacactgctttaaatgtgtcccagagattctggtatgttgtgtcttcattctggttggtttcaaagaacatttttatttctgccttcatttcattacgtacccagtaattattcaggagcaggttgttcagtttccatgtagttgagcagttttgattgagtttcttaatcctgagttctagtttgattgcactgtggtctgagagacagtttgttataatttctcttcttttccatttgctgaggagtgctttacttccaactatgtggacaattttggaataggtgtggtgtggtgctgagaagaatgtacattctgttgatttggggtggagagttccgtagatgtctgttaggtctgcttggtgcagagctgagttcaattcttggatatccttattaactttctgtctcattgatctgtctaatgttgacagtgcggtgttaaagtctcccattattatcgtgtgggagtctaagtctctttgtaggtctctaaggacttctttatgaatctgggtgctcctgtattgggtgcatatgtatttaggatagttagctcttcttgttgaattgatccctttaccattatgtaatggccttgtttgtctcttttgatctttgttggtttagtctgttttatcagagactaggattgcaacccctgccttttttttgttttccttttgcttggtagatcatcctccatccctttattttgagcctgtatgtgtctctgcacatgagatgggtttcctgaaggcagcacactgatgggtcttgactcttatccaatttgccagtctgtgtcttttaattggagcatttagcccatttacatttaaggttaatatagttatgtgtgaatttgatcctgtcattatgatgttagctggttattttgctcgttagttgatgcggtttcctcctaaacttgatggtctttacaatttggcatgtttttgcagtggctggtactggttgttcctttccatgtttagtgcttccttcaggagctcttgtagggcaggcctggtggtgacaaaatctctcagcagttgcttgtctgtaaaggattttatttctccttcacttatgaagcttagtttggctggatatgaaattctgggttgaaaattcttttctttaagaatgttgaatattggcccccactctcttctggctcatagagtttctgccgagagatcagctgttagtctgatgggcttccctttgtgggtaacccgacctttctgtctggctgcccttaacattttttccttcctttcaactttgatgaatctgacaattatgtgtcttggagttgctcttctcgaggagtatctttgtagcattctctgtatttcctgaatttgaatgttggcctgccttgctaagttggggaagttcgggataatatcctgaagagtgttttccagcttggtttcattctccctgtcactttcaggtataccagtcagacgtagatttggtcttttcaaatggtcccatatttcttggaggctttgttcatttctttttattcttttttctcgaaatttctcttcttgcttcatttcattcatttgatcttcagtcactgatatcctttcttccagttgatcaaatcggctactgaagattgtgcattcatcacatagttcttgtgccatggttttcagctccatcagctcctttaaggacttctctgcattggttattctagttagccattcatccaatcttttttcaaggtttttaacttctttgcgatgggttcgatcttcctcctttagctcagaaaagtttgatcatctgaagccttcttctctcaactcatcaacgtaattctccatccagctttgttccattgctggtgaggagctgtgttcctttggaggaagagaggtgctctgatttttagaattttcagattttctgttatttttttccccatttttgtggttttatctacctttggtctttgatgatggtgacgtacagatggggctttggtgtggatgtcctttctgtttgttagttttccttttaacagtcaggaccctcagctgcaggtctgttggggtttgctggaagtccactccagactgtttgcctgggtatcagtagcggaggatgcagaacagcaaatattgctgaacagcaaatgttgctgtctgatcattcctctggaggtttcgtctcagaggggtacccggccgtgtgaggtgtcagtctacccctactgggggatgcctcccagataggctactcgggggtcagggacccacttgaggcagtctgtccgttctcagatctcaacctccatgctgggagaaccactactctcttcaaagctgtcagacagggacatttaagtctgcaggatttgtgctgccttttgttcagctatgccctgcccccacaggtggagtctacagaggcaggcaggcctccttgaactgtggtgggatccacccagtccaagcttcccggccactttgtttacctactcaagtctcagcaatggtgggcgcccctcccccagcctcgctgccaccttgcagtttgatctcagactgctgtgctagcaatgagcaaggctgcgtgggcgtgggaccctccgagccaggtgtgggatataatctcctggtgtgctgtttgctaagaccattggaaacacgcagtattagggtgggagtgacctgattttccatgtgcaatctgtcacagctttgcctggctatgaaagggaattccctgaccctttgcgcttcccaggtgaggtgatgcctcgccctgctttggctcactcttggtgcactgcacccactgtcctgcacccactgtccgacaagccccagtgagatgaacccggtacctcagttggaaatgcagaaatcacccgtcttctgcgtcactcatgctgggagctgtacactggagctgctcctgttcggccatcttggaactgccccccacattctaggatttctgagggaaagttgcttgttggctatttcagtcattcaaaaagtccacctgcatacacttgcaaaatggcgtcttcttgaaagatgtatatatcctcagatgcaggccaagccactcctctgtgttcagacatcctgctgtgatctcttgtgtcttgttatctcagactgattatccctcccaaatgtcacacctcataatttgaggcagagatgccaactacataggtacctgagttagtcccaggtaagggataatgagtagcctgagaactgttagcaacagaacaaaccagggaaaagttcctaacgttttggtatgtattagagactcgacatggaagagcagaaaacaaagtgttctcttgctctatatcatagtcttgaagcaatttctgacatccaaagctgataattaactgtactaaacgatacacctatttctaacttgggccacagccaagtggatcacagtgttttcatggtagttaaaataattacgaagtataatcttggcttgtgcacacattcgtgtgggtgcaggcccgtgagctcaccctctctcttcccctccctctcctttgccagaagactccaatgttgagcaatgaactcaattcttttcacacagttacttggctttttcagagtggccgtctagtggcttgctccttcagtcatagaatcctgaaactgaaatgaaccttcagaatacattgtgccaagagcagagcttccaggccacctaagtaatatcttgattagaacagccatctctttggagaagtgaagcatcccgattgactcctcagtactgaagcagcctccaaccccagttccaaaatatacccacaactaaggatggcaggtaacattcatgtgataacactcacctatgcaaacaaacaggaaaataaattaccctgtgtcccatgggccattcctggcacaccagctgtgaccccaaccctccaggcccactgtggtccatgcctgtgtatatgtcgcaggacaagtccatgcttggtacccttcaggccctaagacaagaaagactccttccagtgtcttctattttacaaccggaaactattttagcctctgggagtcttctgggtaccagccagtgatgactagctccttgactctcctgttgaatgtggctattatgtgcataccagggaggacataaagcttcccacacacgacccgataccctggaggaacacaggcctatttccacactagttcctccttttaatccagctcctcagatctaatgctttcctaggctaagatctttgcctggtttcttacagaaaatgctctttctaatcttaattttcctctttttctaaaactataacacttttcagttttctcttggctccttcctcatctccccagccaggactgccatctcaccaacttttcatcagcctctaatttcccctagagtagtggttcttaaccctcactgcaaattaaaatcactttgggaattaaaaatagacgcctatgtagaagtgtgtgtgtgcctgtgtacaccgttacctgtgtctaggctccatcccagaaaaactaaggcagatctctgggagtgggacttggtcacggataatttataaaggatcttcagtgattccagtgtgtattcaggggcaagaaccactgccttagaacttgtttacttaactataccttttagttttcattcacacatgcagagtgtatttattggtaatatactcatttttatgtattaagaatttcgtatgcaccaagcattgtgttgggcactggaatgcctcaccatgtagatggagccttctttgatgttgatgttctgaacatttctatcctcagccctcctattctttccacctacactttcctgagagctctctgccacgtcattgtgccaactaccatctactttctgaggaaccctgaggctcaatcttgggagcttgtttggaggttctagcagggaagcatggccactcagatatcctgaatgaaagaacagtcctcctgtattggggaagactgtccccttcaatccacagtgcagcttcaggagggttgcacatggagcggtgagggaggaaggagacacctgcctaggcagccagatcagccgaatcaaccctggcagtcaatgggggacagatatcacagccagatcaccctcacatcccgaagtctaagtcttgagtccagacagctaccctgttacttagactatagactatctgactacatgtaagacatgctggctttagtgacccatggacaaatcagacccatatgtcaaaatggaatgttttaacttcccactgagtcttccttctctatcttcttggtggccccacagtccatctggtcacccaagtttgaaatctgggaaatcttgctccccagccctcttccccgcactcatcctctaaatctaatgttgtgtccaaaacattgtgtccctaatccaggccctcaccatttctctgtaaggtggctgatggatctcctgcctctagtgttgctagctatagtctaatcttcaccagaattaccagggtaaactgtctcaagggaaaatggaatcatgtcacagttttccattactcacaagtgaaatttaaggtccttacctggcacacaatgccatccaagatctggcccctcccaattctccagcccccgctagaatgaattgggagaccaagattgctatcacagcaacacagcaggggttacaacgtccctttgccagttaggctttcttatgcccacccccatggtttttatcatgctgtcttctctgtctgtaaaactcaccaactcaccccatcccacatacacacactgattagttgtattgccattagtctcagttacatctcaaattacatctacagttatgggctgcatatggacacttggatcaatgacagaccacatattcaatggtagtcccataagattataaaaccatacatgtactgtatgtttttatgtttaaatatgttttgatacataaatacttaccattgtgttgcagttgcctacagaatgtagaacataacatgctgtaaattaaggtttatagcctgggagaaataggctacaccatatagcctaggtgtataggaagctatatcatccaggctatgtaagtacactctgtgatgtctgcataatgacaaaatagccctaatgatgcatttctcagaatacattctcattattaagtgacatatgactgtagtatacgactttaaaaacagtataattatgtgtctttgtttctgtattccccatagatggtgaactccttaaaggcagtgactataactgtattgttacagtttttgttgtttttgtctttatatatttcacaacctagaacaatggctacaacatctcaagtactcagatgcttatggaataaataaatggagacataggttcctccccttaataagcttaaaattgaataaatttatttttgtttctatatccatttatccaagtccatagtttccttttccccaaactcttatatatactcagaaaggcccattacagtcaaatacaaacaaggcaatttaattcagcattgggagtatctagctaactgtaatattccaagaatgtagagggatcatgtgtattactgaatcataatactgatgtacgatgatttataaggcaacagcgtcgaaaactgacccctagcttcctataatttgattgcctttcagaaaaagttctcagcagagaactgagtctagagtcctctcagtacagaagccaggatacgcaacccatcaaataagactggtttgctgaatcaagagccactgaccgatttgacagctccatattcaaactaaacagctctttttggaaactagacttttggatgttataccagagatgtgactgagtagaacagagctttccaggggctgaataatccattatgcttattttatcagagattcaagttgaaaccattgggccattgagtaataaactcagtttgaccttgtcaaaatcctacacctagcagtattttgagaacttgtttgttctgccacttcgttccaagttgtttgaactttagttgagcccatgaaagctttacagttatcaagtgtgcttatatatgcacattatttcacattgatccacacctgcctggtagccatcactagaggccctggaaatattcagagaatcactgaagtgtgagcaacagttaataaaaaattcttgcagttttaattacaaacaaaaagcaagcatgtttcaactctataaaattcaactggaatatccagggaactattgctgtttataaccaccataaattatattcatctttcatactgagttagtgcagcttacagattgatatataaagcaacaagttctaatatttatgaaagtgtgagttctaccacctgtttcaggagttctaacctaacctccagaacaaataaaaatgaataaacaactatcttcgcccttcctgccatgggagtccttttgttctctaagtcatgtttctatctatgaagcaaaatgaaggactactaacaaccttggtgccatatgtattaggaaggaaaattgctgtgctttgtccaaaggcaattagtgttaggaaggaatcaagaagcaagccaatattggagctgctctttcttctgagctgtgactgctagaaaccatgacaaaaaataatgtgagagattctcatcagggatcttgggccccatttgcatattctttcattcaccacttactttgtaaccagccctatactggcattcaacacacaaagacaaattagacagactcctgccttctttacagagaagcttcctgcacaatgggtggttcacataagcaataaaatgatttggtaaatgtgagaatggagacatgcattattcattcactctttcaacacatatgctagcttgactttttaaagtcagatgctgtattaggtgctagcgaactaaaaatagtccttgcccttgaagtgtttgtgggatgtgtctatatggtaaatacccaattacaaagtaatgagattgggagtatggtaggccaaatgcatggaagcatctagcgagtcccctgtctcagatgtggaagtgaaggaaatctctcagagaagatggactatccaagacaagagctaagaatggaggcacatcagtcattgaaagaggcaggtgtggggttggaagctactgcaggctacaagacctagaaccagcaagaacgtggtgcactgtaaggttttctggattaaagtctaggttgtagtgttcatcctaagaagtttcttatagcaaagctttagatattataaccctttagtataagctttggaaattatccaaatcttgcaaatgaatgaatgaatcaatacatagtgacgtttctttacagtaaccccaggaaccattttgttggatgaacttcaaaaaacacagaacaccaaattcgaacacatgaaaggaaaggaaaccaaatttatcaaataagtcaccaggaaagaagacaaaagtaaaatgtccttggccttaaagacagttgcaggaagatataatcaaaactttaaatcatgcatgaaaatgcaaaacccatggtcttgcaggcctcagtggatggaaatatttaaaaagcagatttgttcacctggtctcaaaataataaaattgtgcattttcaccattcttcttaacatattaagtgaggtaaagaaaatgtttagcagaatgcctgccagtagtaaatatcccctaaatgttagctattatcatcatttatgagacaccagttaataatttatgtaacacattagtttttctaggaaaagcatttcttatttaagaaacaaacagttcagactaaaacatgaaagttttctaaaaggttagtgaggggacctgggcttgggtatgtgagaagcagcctcccagcttctgtgctcagggcacactccacctgagagagatggattggcaggaaggcttatgtaattaactcaatgtcatccagaaagtcctattcacggaaacacccttcaatgatatgagggcaactcttctcagaaataatggccagtgctgaagatttccttgaaaacaaagtatccaaggcttatttgggtcagaacaggtaagaccagacatacctttcccattcaatggtactggttaccactcggccttaacatggttaacgtgcaggagagacctccttctagtcatgatttaagttgtgtatttaaatattttgagtgaattcttggaattatcagaacattatacagtagtttctagaaaaagtatcctatgttcatctaaataccttttattttcctcaagccccaactgtcacatacatagcaaagatacattatcctgctgtgtttttttagagacagggtttctctccgttgcccaggctggagtgcaatggtgtgatcatagcttactgcagccttgaactcctgggctcaagcgattctcctgcctcagcctcctgagtagttgaggctataggtgtcccaccacactcggctattttttaaattttttttgtagagatgggttccctctatgttgcccaggcttgtcttgaactcctggcttcaagcaattctcttgccttgacctcctaaagcactgggattacaggtgtgagccactgcaccaggcctattcctctactcaacgtaccattttagcaagtttctttctctcaccatctccttcacattttctttctctttcaactttaccatccattgcctttgagaataacacagagaaactcaatcaccaacacatgtaaaatccaatggatatggatagcaaagttggcaagctgaggaatgccataaaaattctgcttggagtttaatcaaggtaaagttcaatgaacgttgtccattcaaatgaaaggtacaaacaaaattgggaagcataaagtaaatttgaaaaagcataaagcaatattggtaagcataagcataaatctcaatgaacaaagtggttgcaagggctttttaaatttgcagggactccatttacctggcctcagctctcccagccaagctgaactcagctcgttttcaccaaacaagaatgacttatcctacactcactaattctttcccttctcaaaacctgtagtggcccctaaatgcttctcatatcacattaaaacacccaacatagaattcaagggtatttatccttggcttttgaagatactagttaagacatatagtgtattagtttgctagggctgctgtaacaaagcatcccttggcttgtagaagtatcattctgatatctgcctttatctttacatggtgttctccctgtgtgtccaagttcccccctttttataaggacatcagtcatattggatgaggacccacactaatgacacctcatttcaacttggttacctctataaagaccctatctccaaacaacatcatattctgaggtttaggggttaggattttaacacataaatttttggaggccacaattcaacccataacatacagtactatattgtcattattattatttggtggcatctgtggaactgtaagtataatgggaaggacacatgcttgtcgtcagacagacttcaattgaaattcagctctgccatttactctgagcttcctgactgcgtgagatagagataaaatccctataatgcagaatggtgtgaagactaaatggggaagcaacttctgtaaatatgtaaggacagacctttgcacattacacccaactggaatgacccatatcaggtttgaactttcttctaataaaccaaagcataacacaacataatcaaacttgtttgcctattccaaaaaggaaaacctgtaagataattcataaaaatctctcaaatctctctgtttaagactctgaacactctctcttcccataacgaaatgcgtttcttgttcattcatttatggctgttcacccaactctatagaaaccaatctaaatcaatctttcttatggcctcttttcatgtttgaattcatctggccatttgatcgcaagctcttggaatggaagaacaatgtattcaatgatataattaagtatttgaaatattttgatataatatgtgaaaatattttctgaagacagccttcatgttaagcaccttctctatgtaattcattgataattagggaactttgaagcatatctttgtttcccagactgttctttctcattgacctggtgtccactgtctactaccatatgcttgttgcctctgttatctttattctcaaaacctccttgcagaaaagacacagatgtgttttgcggattaagcaataaagtgctctggggctgctgggtactattaagcaggttgtagagtgcacagggtgtccccaaaacacaggagattttcatatttatcataattctttagcagatggttgtaggtctgttttaatataagtctgaatgttacaacaattttctactctgtataaggagtgttttatctaatttgcatagggcactgcatgggctggccttggccttgcagctgataaatctgatatgtaattccccccaagagattctcaggcaaggagatctaagccagaggaagggaactctgtgcattttctgacttcagcaatgtgagagattggtttggggagaatcttttgacaagtcctgtattaaggagtggcctcccctctcagtgttggagaaaactgtagtcaagcaggctctggggtgggtagtgaatctgccagcattgcacgctactcacaagagagatggaggagcaaagccatggaaaacgtactgccctggtgctactagataagatcagagacctgatcctcagggaattgacaacagtgtcttcttcactcatatcacagctgaatcatctagaagatcaactcaaactcatcaaaaggaaaccctcaataggagaaacaagagatatgtaatattttgcagacatctgtcacactgctatgtgataaatagcttggagtacctaatgcatgcagggcttaaaacctagatgatgggctgataggtacagcaaaccaccatggcacatgtatccctattaaacaaacctgcacgttctgctcatgtctcttaaaacttaaagtaacataaaaataaaccttagagtggtgcattttaatacttcaaaaggagagtttgttttttaatcatctaaatcatgtcaatacaaaatattaatagcaatctgaccaatgatgatggccaatgacatcagtatgaaccatatttttaaaaatgtaattagcataagaattagaggaaaatatgtctgtttttaacaaatgcatattctggttggagagcataaaaaatagcaaacaataaaacttcctaggtggcaaaattatgtgatatatcaacattgacatctttgcagaaagacttaaggggtgattgggagcatagccaagcagatggagactgtgtgaaagcagaaccaagtgggaaggcagctcaagctcaacaactcctgaagcatgggagggcacagcacccttcactgagaggcccgacagggtttaaacacttgacttaaacttagccaatcacaggcaccaggaaacagccagggtgagaatgctaggggaagtttataaagtggagctgggctgggaattggcatcacagataatggtggaaagcaatggagatgaaaaaagaaacacaaaatatttaagaaaggaggaaccttgtagaaataaagaaacagacacctatcacagagaccgaggccgctgctcggcagatgcatttccttttagagcacgccctggagccttgagacaacatgctctcgctcttcattttaggcagccctgatgaggttctgcttcttacaatcacagctatgtaacaaaagctataggaataccaggaagaggaagaggcaggccaagggaacagcgaagggcctgggacaggaagaggggtggaattttttgtggaaaagcgggggaatcaagctatggaggactatggcaggtagagtaggtccagggtcttcattgcacagattaagaatgactcattgaccctaagattaaaaaaaaaaaacaaaacataaaacagctgtcattataaagttggaggaaggccgggaggcagttgaaggcagggagaaaagagttctaagattctgtacatatagataggcaagaattcaaattgccaaagccaacttgagcattttgtggggggcattttatatgaggttttaaattttgttttcttctaatgtttagactgaagagaaattcccttcaataagaacaactttaacagattattaaaagggacagtgtgaaaccttcaataatatttagaaatatgtgtaggagagctaatttgattcattcatcacattttcaagtaactggtgcgggctccataacacagtacagactacataacacagtacaggcttttgtgtattaaaattaatgaaaaagtagggggtacttatgggtctcagtagttctcccaatttaaatacacttaaataactgtgaaaactggtcagtttacacataaaatcatgccaatttcaaacagaaaagttccattgatattgaccacatttttggctcctattaaattgctacataaatatataaagcaggtctgtaatactatatgtctgcaaaaagatatttttggcaaataaaactcattttattttctaatttcaatcttccttacccagtattcttaaatatataaaaattatgtttggttctaaatatccaaatacccccactcccacacacttttttccacattgcttttatccatccttttacagatttatgcataaaatagtttcagttaatgaggatcacaatttttaatctcccaaaatccagcttcccattgtcacccagagcaacatctgaagtttaaatgtaaaggatcagtgattatcatgagctgaatggtacccgctgcccccctaaaaaaaaagatatgcccatgactttacccctggagcctgagaatgggaccttatttggaagaaaggtcattgaggatgtaattgtgttaaggatctccagatgagatcatcctggattactggtgggccccaaatccaaagataagtgtcctttttagaggcagcaagagaacagatctggagagaagaggagaagtgagaaggagaagatgaccatgtggggatggaggcagcgactggagttagacagcctcaagtcaaggaatgtatgagccaccagaaggaagctgaaattggcaaggaaggattcttccctagatccttcagagggagcccagcctcattgcaggcagctggcctccagtgcagtgagaaaaatttctgtggtcttaaactaccaagtttgtggtaatttgttagagcagctctgggaaactaatacaatgattaaatggtatcgatttatttttaaatttgcatttcattaagtttgtggcccatataaaaatgctgattttttttcttgtgatattgtgatttaataagaaatatttatttgttctgtatccctgctccctggcacagagcttctgaagcttctgaacccttggaatttcctgagtgatacgaatgagggcagcagcttttgttattcacaataaacccctttctaactatacctgagttactctgatgaggtgactctttgtgggaccctagatagtttccggatgggacctggttgctagaggaaccaaccatgaaattagagggttgggaggtgaaaggggctagagattcaactgatcatcaatgaacaacgatttaatcaatcacgtctatgtaacagaacgtccacaaaaaatcctaaacgaaaacagggtttggaaagcttctgggatagtgaacgcattgaggttctggcaggttggtgctccggagagagcatagaaactccattcccctgctcctcacatcttgcctagaatcttttccatttggctgtttcaaacttgtatcatttatagtaaactaataatagtaagttaacacttttccctgagttctgtgagctgttctagcacattatccaaactgaggagcaggtcatgggcactctcagtttgtagcctgtcagtcctatgtgtgggaggcccagaacttgtggttggcacttgaaatgggggcagtctagtgagagtttgatgctaactcaaggtagttactgtcagaattgagtggaatcattggacatccacttggtgtctagagagttggagaactggtcatgggtgtgtgaaaaacccacacatttggtgtcaggagtgttctgtaggtagaaaccaatcatcatagttggtatcagaggtattatggagtaaaagtagcacaggttccttaacttaatttctaccataattaaaaaaaggatattgggttatctcaccctggtttcccagtcagggctccaacctgggctctcataataacttcctcctttcctttttgacttttgttagcttccattgcccatggagtcaagtttattaagctccctagaatggcaatgaagtcctcacttactttccaaacttatctttttctaaaccttctcttggacctactgtactactctaatctgcttgtggctgccaagcttgcctgtcatgatctctcgagattcagctcaagggatgagaccataaaatctcttctgcccttccagggggatgtcaccctgtcagcgtcatcaaggaagctttaaaattttgtgtcttcctaaattaataatctctgagtggttttagttaggatttaatccagagggttggattattggtggaaaagagggaaactgaaagtgcttaaaatgcctcagtgctaaagaagaaggactcggtgtatagttttagtgaagacaagcactgtgcactcacgcctactgatggtaccaaacacagatccagaaaaaccctaaaataggaccctgaggcctggtcttccagggatgaggaggagaagacaaagaggatggataacaagtggagaaagacaggatttggtaactgataaagaaaacttactttcctttagattgtagggaggggagagttacagataagagatagaggtcacaggtaataatttagtaacaaagtaaactgtaaggcaaagctctttggtagctgatagggtttggatgttctgttccctccaaacctcatgttgaaatgtgacctccaatgttggaggtgggcctagtgggaggtgttcgtgggcctggatccctcatcaatggcttggtgctgtcctcacgataatgagtgagttctcattctgagttcatatgggatccggttgtttaaaagagcctggcacttcctccttctctctcttgctttctctctcaccaagtgacatgcctgctcccccttcactttccatcttgattgtcaacctcctgaggccctcaccagaagcagatgccagcaccatgcttcctgtacagcccgcagaactgtaagccaaaataaacctcttttatttataaaatacccagcttcaggtattctttcacagcgatgcaaatggactaatacagtgacaatgcatcctgacttacttacctggccacatttttctgttaagaatttctagtgacttttgaggaacagaaacatttttttaaattgtggaagtaattagccagagttaacttttatgtcccaatgaagaaagattcccaagctccaggtggcacaccacttatctttgaatagctttgagaaaaagaaatcatgccacaaaaacaatgtgattcattgattgtacttcagacagcaaagaaagttctagggtatgatttagaaagtgagcctgcaaaaactctttttcaagacaaataatgtaaaactaggttcactaggattgaggcattcattttacaaagaagtaattatgagtaattaaaatgtcatgcaccaatgatgattagtgacaattggcattgccacagtattaaaaaatacagaaattaattgaattaaatttactttagccagcacctcataagagtaaagtaaatggcctgtggcagatatgcatggccacagggtgtagcaagtaatttcttataggttttactaaatgtatttagtctagtcaatgatgttttattgagttttgaaaattttggatgtctagtgtttaacacaagactcatggttcaagatgactatatttcatatccatgtgaaacgtactagattttcaggaaagtccatgtattgtaattctaagaactcaaggctggcaccagctttaacggcggatggtgcaaactgctttagttactgtggcccttcctgtcaccacctttgcaaagtgctgccatggagaatgtccccactttgggcacgtttcctgtgatgctccaagtcccatctcattccaccagtcccaaattcccttctgagtaaaaggtagtatagagggttagcatcatttaagtctatccttatgccatgaaacacattttactgatgtgtttaatcagtggggttcccataagctggtctgcagtcaggtggatgtgtgtgtgtgtgtgtgtgtgtgtgtgtaggtgagttttcaccagtcatacctgagccccttgactgccatgtgatgagccttggcccttgcccctcagctgggcagcccaggctctgtggctcctggtcttgcctacacacctgggtagcccacaccctactttctccaggcctacaaaccccagctatagtgtctcagcttccctacctcctcttagaatattctgaattgaatgaattaagagactggcttccaattttgctaacatacttacctgaaactacattttgatcatgactgggtagaaaatgaacatttgggctccctgtcctgttgaactgttgaaatacaggcctaaattgagcaacattaatcaagatcacaattatatgcaaaacaatattatgaaataaaactttgttatagtagtcccccttatctgcaggggatatattccaaaaccactagtggatgcctgaaacttcagacagtaccgagccctatatacattactgttttttcctatacatagatacatatatagctatgataaagcttaatttatgaagtaggcatagtaaaagattaacgataactaataattaaatagaacaattataacaatctatgcactataataaaagttatatgaatgtggtctctcatttatttctgaggtttttcatttaatatttttgaacctcagttgaccataggtaactgaaacagtgaaaagtgaaactaggtaagcgaggactactgttttctttaattgtaaaagcagaaaaatgatatctttttatacttgtgttatatcagggaaaatttgtccattgtctttcttgcaaataactatgctttcctcttgacttttgggatattcaggtcttttctttcactaagtgatgttactagcagatggccctgctgtcttccgctctttagccatcatttttacccctagattacagaatgaacttccaacttttcctccgtctatcagttctcgaccagcattaaatgaatagttagatgtgtgatgagattagtgtttcactcccttgcctctcttccaatctcaggcttcccactaaacttagaactagacctaaactctctagtgtagccaataaggccaaatacaacctggcccctcctatagggttacatctcattattcacagtagttatgtttcataatgtcattgccaacattgaattagcaaatcctgaaccattgctccttggaaaaatactgagttacgtttctctgagcctagggtcacaacatttttgtcaactgatcaatacataaccttgttttgtgtgtgtttctgtttaaagacactttatttagcatagaaagttcatttattaactttggactcctggtcaacagcactataacttatacttgaacaaagcttatctaatacacatactttctacataaggcacatcacagccttcgtgcacttatgaacaccagacagcacttcggcactactcttcggggccattttaaacagtgacatcaaccaaaagcacaaaaatgtgaaaaatgcagtactaagcagacctcaaaaaggacacttgtgtatagtaagcaagtgaaaccagaaggcggggcattgtcttgttcaatctcaactggggacatgtgcatggggagacttcaaattttttgccagtctaagtctgcaagtgatagtgaaagcactgtgatgattgattttggggttataagtgaatttcagtgagtagcaaattcataaataaagagtaaagtttttctgactttatcttctacaaatatcctttgtgtttgctacactccagctatactggcctctatgcttctagtccatgtccagctcacttctgcctcagaggctttgcacttgctgttccccttgcctgggttataccctgcacaaaccccaatctaatccccagcatctatgacagagccagatgccgtaggcactcaatacatagttggtgaatgaatggcaattgttttcttaagatgtcatttcttgacaaaatagaaaacacaggcaactcttcgacagtactcaaaattcaggggaataatttacaggtctgtataatccccgaattgaagatccattgcttgtaaaaagcactctctacaaagctgcagcccatcatcttttcccatcatgttgggattttatttagtcacacagcctaacatgtcatcaataagtcaacagcagtgtctcacattggaagcatccctggaacagttagaagaagagaggctttaggcagttttacctgagtattgatacagattgctatcctcttaactacccgaataaagacactttcctttcatttaactaagttgatttgtactaacagaaagaatcattttgatgagttttggggagtgcttttggagaaagataaatgtaagaaaagttatgcagaagtaggctgcagggggctgctctggagaactggaattcagcctgagtctctgaactgcagtaggtgagaagagacgtgaaatataacacaggagaatagagagggcaaagggaagggcttcagaaaaagaatcctccccctttttacagttttgcccaaggctggacctgcctcattcattcttgatgtggcatcaatttgttaaaaacaaaccaacaaaaaacttccaggaaggaaggaagggagggagggagggagggagggagggaaaataacaactgaaaaacagttaggaaaaagagtttaataatttatcagataaataaaagatcaaagttgggaatctgtctggggtaggaatgcaggtatagctttctgctgagtaaattcagttctctcacagactcagccagacactgtctatactgtcccattcccagaaaacactgactttggccacagtttagctccccttacagcaaagcagcaaagtctatattcaagccccaccttgcccttccttccaggggacctgcattattcctatcaaacccaaactgttctctctgtggctggggacagccttcactggttagcacagtttttaatatgaatccaaccttctcacttctcttttgagctttcttgtgtctcagctctagcatggagagcacttacagaatatccccctaaatgggaacatctggtttgccaaagaggtgacctcatacatgagcctcttgaaagcccatgagcctgagtcttgtaatggggaatgtttatccgccaggtatgaaagatgaaatgagggctccaggaatttcgtcttaacttgcaagggaggaggatcttttgttcaggtgctgaacagtgaagattttcaagttttcttaggaacacaaaagtgtttgctgtcaggagaactatgttgttttccttgagggcttctctgtacacaatggaagcagagaaaccaaactaatcctggtccctcctgttggcttctttcaaaattttgagttgtttccagtccaaaccagactggcccaggcttccgtttaaaaataatccacttaccacagcattcaaagcaatttggcaagcctaggaagaagtgtgacaggaggacgggtgggttggttgcgggaggcaaggcaaggaatccatttttgtgtaccctctccacgtggtgcaggcgctgtgccggccacttaacacgctgagcccagggcctattgagaagagtccagtgctgtgaatgagcatccctcaggctcccaagctggctggtttgaaatctgtgtctcccttgactatcatgagcaaagataccaagtaagtgccatctctgacagggcaaagctgagaaaacattacaacaaaaacacgatcattccttaaacttcaaatcatagaaaaaaatgaagagaaattctggtgttcagctatcagtaaacaaacatcttgtaaatatttacgagtgggcttgatattataagttgttgtttaggaaggaggtcgataaaggggaccaaggttagccagcagtagaacagataggaaagtctcacgatcctaggtgccctttgacttagggtgcctacactaaaaggaacacaaagacaggccatatgcccatcttttccccatcctagactttgtgatctggtccacagccctcatttcacaactgaaaaatcagagggtcctgagaacttcagtggtttccctggaatagtgcagtccattggggagccaggacctgggtctggtcttctaatgtatttttctttctccttcccactgctgatttgggggcaaaccatctgattgaaggcatgatgatgatgaggagaggcacagaagccttgagctctcctctgtcctcaaggcgtgtggcacagcttgtgctaaaatggaacagtggacctaatactactgcttgtataatggatttttgcatggcataacttttgcattcactttgtgtgcagcatatatgttttttcaactctctccgaatgttgttccatagtatacttatatggtccctgagaccgaaataattgctcctctccaagactataaaatcctcaaggccaagacctaccccctctacattgctgactcacccccatcccaaaaatgtaaagcaatccgcaaatatttagttaatgcttgaagaactgactgcagttggcatcatgctggtgacttggggacacagaaaggccctgttatttaatttagagggtgaaagatgatattatttgttcacaattctcctttccctcctactcctgctggtgggaaaagtctataccacctcccagctatgctgactgtagggtttgccatgggactgtcactgaacacagaaacatgagcagaagtaatggtgtgccagccactggcagagcctttctgctgcccctcttgtggccctgcctccaccttgagaacctcgtgcccctgaacagtagtggggctgccactggagtctgggcactgggacaagaagatcagagaagcagaccccagcccatcctgaagcctggagtcaagcccagccacacacagcagggacccagtggagccacagctgacacacaggactatgaatgaggaataaatgttgaatactgtaagccacttaattttttcctgggttgttaccacagtaaaagctaatatatggaatctctcttaaaagcacatttgccatagagctgaagtgctgtgaaccaatttggtcacacaaaatatttagattctttttggcagatactgaagcagtttgaccttgctactgagttataatgaaagcaatcctcagaccagatttccctacacatatgtgaacatttattaaataaatatgtgttaatgcaggcataaaaatggaccttactacctgctgtcccagctcaggaaagtcccagctctctgtccctttagtgtctcacccaccatctttactgaaaggtttcctagaagcagacgctaaacatctcagaggcaggattgtaccctttttgtaggcattgggcaattaaaactctttgtagcaatgcctggacaacagacttataggaatcaagattcaggtgacatccctaaaggagtaagccacgggtcttgctggattcttaagccctgttcaggaaaccatggtgaatatctctagcatgtagacagcagagatacaagttgagaccagttacagaccttgtcatggagaagtttacagagttgagcaggggcttttggagccaaggttagggttcgtcatgggctttagttgtctgagaacaccctaaaaatcaagggatgtgtgtgcatgtgtatgcaatgttgtaggaaaaggtctacattgttcatcagatttctaaaggagcccatgacttaaaaagggcaaagaaatgctttcccatgggatctgtaagagatgactctataacaaatgcatttactcagactttgctatgaaggatcaaactattgactatataagaatagacttctagccaaatgaccaaaaaaggttcttacacataataactatggtagttaagaggttattttaaaaatgtcctaacagaactaatgactaataaaaatggtactagacatgttccaatgaaggaaactccatgctgcaccattataaaagtcaatcatagactcagcaaagcaaaggctcaaggttgctttgatatgcaacaatgcccacagggtaatagtagcaactcccaagtctcattttaatcacgatttgcctctccgtgccaagtatgaagtagaatgggaagaatttacagccatgatttaaccatctactacacattgctggttccgttacttagaatagacatcacacgtaagataataaacatacaggtagcagggacatttccccctcaaactgtccaagactgttcaacaaagagcatagctgatgtcaatgaaattcatggcccaagaagtcatgtgttattcatcacgcggttttcatagcccctgctacatccctacacatcccagtttaagaagcacaggcttcacttctctgaggtttagtttcctccatatactaaatgggaataatcatacttacatcaaagggttcttaggaaaattaattgtcatgtattggttcaatcctataacatagctatgctgcctagtacctagcaggtactcaacaaatattaaaacctacctccattcccacttgctatgcagctctgtgcttctcagagtggtctccagagctgcagcatcgcagggagcttcttagaaatgcaaattctcaggcccaccctagacttacagcttcagaaattcagggggtgaagtccaatgaagtatgttttaataagtcttctgcgtgattctgatacatcctaaatttaaaaccactgatgtagataaatcattcttaaccatggctgtacattaaaatcatgttagatgcttttaaaaactactgatacttaaactctctaaccaccccaagactacaacagaatctctatggggtgagggactgggagcattggtcattatcaacagttccccagggatttaaataattgaatttaaagggccaagggaagtccacttctctcctcttggcagtctgcactggatgcttgaaatccaatcaatattgagtctcttctgaactcagacctgccacaccagtaactagctgtggggccttggaaaagtttcctatacttctgttagccttgttttgtcacttataaaatgaggatcataatgatccatcttgcatcttcttattttccaatgggaacgctgaattccaaagtttttgttccttgcccatgtcacatatagcagtagtagcagaccagggcccagcctttgccatgtcctcttctgcagagagtcatgtgtatgggtgtgggacagagaaacatctggagccctggtgtgggcgttggtaaactttataatatttttggcataagtatcggaagggagggcttccagctaatgactggagaatgtgccactaagaaaggtgagtgaaggacttgcaggactcagtggaagctgtgtgggatgaggagaaggatctgcagcaggacaaggaatcaccgatgagcgtacacaaggataaatacaccattcattttccactggggctggtggaggggcaggcagctttggttaggatacgtggagactttgagatttcagagtaaaattgggaacagggcttggaaaagctagcagcagcatgaaactgaacggaaaacagggagggtgcggatatctttgtgtactctgctctgattgggagggagaaaggggagacccagggatgatttagccatttctcttgcttgggaagggtggcataagcccaacaattcacaagcccaacagtgtggaaatgcagaaaggaagtatttagctctagcaaaattcgactttgggtttattgaatctattatctttatttttcttctccttcccatgatccctccccatgatgtacacacacttaagaatcaccatgtctgctaggtgagaatgattactgtcatctgagaagaggcttcaaactaagcttcactgttcctccctctaactcctgttcatctgcatatcagggataaaatgaaggggaggaggcagctagctctgccctgcagccccctgatggtcacagtagtcactgctttggagtgaatgcctacgtactccccggattttatatgttgaaattctagcccccatggtgatgttattgggaggtggggcctttgggaggtgattagctcgcgaggatagagccctcatgaatgggtttagtgtccttatagaaagggaccgcagagagccctctctttttctgccatgcggggataatgaaagcagccatctgcaacctcgaagaggtccttaccagaacctgaccgtgctggccctgatcttggacttccagactccaaaactgtgagaaataagtttgcatttttataagctacccagtgtatggtactttattacagcagcccagaataagacagtcaccatgtgcagtgtgggtgcgaggctctgccccacattttctttcctgattctgaatttcttattctgaccttggccttcagactcacaaggctcaggtctctcattaatgtgctgagatgactcttcccaccttctgccattcactattgaccaggaatgacctctactgtggtgactttgaaggcaacaagacaaaatcaattaactggacaaaagtgaagaccttaactttttcctgtaattattataaaccagaaggaactctagaagtatgatttttatcccaagcattctaaaactttattggcaacttttaaatcagtatcacagaggctttaaagccatttacactagaaaactggcttttatgtcaaatatttatttaaaaaacctctgtagttgtaatcctcaaactatgactcactttatctaaagaaacatttgagatttcaaaattctggcacaaacaaataaatatcttgggtacctaccaccttgaagtgtactacaatggtttaccttctgcagggagggaggaaggagagggagctgagaaaaaatttgaagaaagcaaatatgagagtcctgtgagcccagaaggcatatcatgggccaaagcctgcaggtctggcctgcctggagcaaacatgcagagcccaccaagttcaagtagaagctgagctcagcatgtgggtggggaggcacagtgggaagagacagtgcaagtgtcagagcacaggcccaagccaggcacacagctataggcacatggggactagtatgcaaactggaagactggaaaaggatccaggaaggaagtattaggagaggtcaatcttctagcaacattgtaaatggcttctttagcttcagctgttaggacccagaggcatgggctggtcccctaaatctagccagattgtaatgcacacagattgcaaacagaagtagtgagctaggctaatgctagccctcaaatgtgttgtgattggcctgtacagagtttaaaaggaatgaactgataagatcagtgtatcatatcagtgtcaatgtcctagtggtgatatactatagttatatgtgatgttatcattaggggaaggagggaagggtgcctggcatctttctgtattatttctcacaactgcatgcaaatctacaatgatctcaaaaccaggtaaaaaaaaaaaatttaatgagctaaactttataaatcagaagatgtcacattttttaaaaaacctcattttccagcttctcttgagaagttggaagatccggcaacaccaggcccaccctgtgttcccacaataacatgttctcccgtaacaatcagaagaagcagagaagcatctgatgccttcagacaggcattacaatcttcattttgcccccttctccatccagcctgcttcactatttatgttatttgtctggtcccaatggacattagatttttctgtttttctatatagagggacggagttaaagacttggccgtccaagaggtcatctgagttcacacaatttgtctggagttgaacactacatcatgaataagaacacaaggacatctcactatcctggtgcccttggggccttgcacataataggtatcattatagtattctcctacagtagaagaaccacttaggatgggttccaagaaaaatcaatgacatactaaatgtcacgccacagcaatttctgtcataactcaggagccacataaaatacagtgagttcttaaagtcataaatactctgaaattatttatgaaacaggtattaggtaaggtccaatataccaaaattggaaatacctagacacaaggtttaactggaactctccatatatgtgtgctctatgattccaagacaaggtgccattccaaatggagtctgtcttttcgttttctgaggttaaaacattttccacattagaaacctgtcccctttggtttccacatggtaaattactctagtggaatcatttaccctaaaggcaatgcagtgttcccattatcactaagcagcaaagggcaaaatagccaatgggacggagacagggaggataaattcaggtcattcttgttgcaccaaaaaaaagcaactcacattactcaaaaaaaagcattatattgactcacagatttagatacatctctgtagttatgaaatgatactttttacaacctttagtctgctcaatatatggtccaacctccttacaccacctctcactatgcacattcttacacatcatactcaggagttggcatttttcctggttaggccattctaatagtggtgctttctctgaattttactatgaaaattagattttcctcccaaggagtctatgaagggtggaatattatagcacacaaactaataatacggagaaagcatggtatttttacgtattccttaacacatgagttaacttatcaggagagttaaattacatttaaaattcaggggcagatgtaggtcctggctaatggtcccttcagtggcctgagataaggattcactgacagggttctctcaatcccgccctagtgttgaactttgacctgcaatatgctcactctatgcttagctgttttacaaattggtaaatacacaggccaagcggctgctgtccattatgtctcagattgattcagtttggttactcaggttagctcaaccccattgcccccgctgatgctgcctcagttcacactggccgaaatggacttattcatgttgccatttgtaccatgtcatggccaaagaaattatatcctggaaattccttgcaaaatgcctgcagtctgagatttggctgttgccagtggccactaatctgaccacagtcatgcatctggaaaattaaattattaatgtgagatacttactctactgtattgaaagtaatggctgtgacatccaagccaaatcatttcatatgaaacacggaactggtttgctctgtgtggggcatcagctggactctgctataaggcatctggtgacgccatgagtcctctccaagttttctgctgcaagcctgtgatagccagctggcagagcagctgcaggcccaggtcactttgggagccagctgaccatactcccttagataatacatgtataggtcaaaggaggctctggctctcactttgaacaagtgtgtttggtcaccaggggttccactgaccactgggctgcagaacgtgcaaataatttgcagcttccttaattaagctaaactccaatccccaacatagagcttgacctcaaagtgctatttttatttcttattcaaatgcactgttgcaaccacacatcccctatctgtatcaaagtctctctttgtgaggcttttgaaaacaactattttctctttccattttttgaaatgatacatttattttgaatagctgtagagttacagatatatggacagagatcaaatgcggttttgattcccagagatgagtttatctgagcaaaagtaaaacacattgtgagtggtagatcataaacaacttgtttggattttggtgaaataagtgtgttagaccagtagtcacatggaataaaatatttctgatgttcatttagtgatgtttctctttgttactgagatatgtcaagtttctgtttggctctgataaacgtcaggtctctcctacctcttcatagtttggcagcttattatacattaaacaaatatctagaaaacacctcctctatgccaggcgctctgtggagctctgggtgtaatcagcactaagatagatgaagacctttccttcagagaataaaactagtggaaattccactctagtcatcctttcctagcaaaaacatgtgtcccgttttccagattccaagagatgggaaatttcccacatgggcttaatagagataccctttggatttgttttttagaaatcatttatcaatgtatagggatgaaaatgacatttttctggaacaactttttcacattcagaaaactaccttcatgatttctgagaacctgacagccataaaagagaaaaaatgctgtttctctgtgctctttgtaaaaaggatcacagcaaatggaaacttcaggcttcttggaaaggctctagttctgaaagattagggtttacactctactgttaaactagactttcagagatgagggctaatgctcaacttggcattggaaataatctgctttggcattatgcaaaaaaaaaaaaaagttaggttcacattgtactgaaatagccaccacctgtggaatttttagaggctgtttttgtttttatcatgtcaaagcatttctactcagctcagactcaccattccgagcttaggatgagaggcagctcatgcccctggaccaaatgagtttatcctggagaaaactctagttccaaagcaacatgcaacttcctcgaggtttggaaaaagaggcttccaagtgtagcatctttttattttataaaactcctttccctgccaaacatttggtcttgcacgcatctgagggtggggcaatgcttagaatgagagtgagaaacacaagatttagtaaaagcgttgccagatactctgcttttgaaatgttgcttaaaataaaaaaacacttttctccttactctttgatatgaataatgaaaatatctttcttttttgccctggaaagtatgttaaaaaaaaaaaaaaaaggcagtgttttgtttgtttctttcttttaaggaccacaggcaactcttccatttgactcatttggctatttttgattattggcccccgacacgtggaacattgttcagatcagtcctagagggcccagaatggccagctctctcagtatctcatttttggcaattcaaagcgcaatttcccattaaccccgattgcctccttcacacccctggaagacatgcacttctctcctactaggtgagcccacagcactcctaaagactgcgcagcctggaatcgaccccaggcccactttcccaggtttattttgcgagcacagtgggtcagtctggcaagtgaccgtgaactgccagagcagtggcaggtgtccttcccagcagagagctgtcgaggtgcacaatgtgggaaatatgctaatccaaggggttgggatgggagccccaggctttgttacctctcagttgagaggcctcagtgagcttttgacaagatggagctattgtcctcctgggcctccaacaggatgattcagaggagaaccacagtgtagatcaaaggatggaacaacaggacctgggagcaaaggctaaatagccctggtattattttgcctggagaagagaaggctggaggtggggtgggtcaagtaggccataatggtgaaaaagctattatgtcgtgaatgtgaccagctgtccgacattttgagtgagaagaaaaggcgtaggagaaaatgaatgtaaactgcaatgtgagaaatttggttgacataaggaaaacatttcaaacagggagcgttgttagacgctaaagttagtgacagagggaatacgtttcttagatgaactttaaagctgtgatttttcagtcaagaggtttgaaggcaaacttgctcggatgtagggagtcaataggaaaaaatgttgagacccacttcacttaaatatgtgcaacatatgatttaagcctttgcaaactgctctttacaacggatattttctcagaggctagcatcagaagctgctacacaggacttctttgaccttgctttaatgatttacttagctgagacaggaattgtctttgtggctaagtgattgacaagtaccttgggtgatgggcattctgattccagttctgcagctaaacaactctgagacttccaacaagcacagaacctcaatttccttaactgtcaaacagagacaatagctctgttctacctcataggatggcttggaggaacaaattataaaaggaataaaaagcacactgtacccaagtatgtagtaattagactgttcagacctcagggctactcccaaatacaaaagtgcttggctctcttagcattgttttaaaaagttactccccaaccagactaggagtgagaaaagagaaggatcaggggacaaacggaggattcaagaacagagttcaagatggtatgggggctgttattttattcttgcctctcccaggtctacagcccaacatcaagcaaaactgggtggtatataccagtgcaaggcaaacacccagttctttgattaaactgtgacctctgcagtttgggtcatttcaattggaaacgtttctccatgaaatcttcaaataacagaactagaaaactccattgccgttagtgtttctaataggtcagtcttaaagaacttttgaaataaacaaataaataaacctcagtgtttcaacacagtgataaagtgatggaattttttacccttagtgtgggttcagaccgagggcatattgagtcacaatgaaagaaaaaaagccttctacagagaaaattcttttaaaaatgaaggcaaactcaaaagaccttttcagataaaggctgagaggttgtgtcccaagcagatttgcactacaagacatgtaaaggaggctgtttagagcacgcctgcttcttaaggttgtagtcagttggaactctgttcttctgtccctaatgcttctgtgctgctgcaatcagagacggaaccctcaactgtggcagtcatgccactctagaatgttcaaggtaaaaaggaccatgtgagcacattttaccaaattcctttattttccaaataagaaatagatggtccaagaaatagaaacaaagagtaatggaattagtagggagacaatattggaatttgtccccaaatcttgtggttgcccagtgatatgatttatcccactggaaaggccacagactgatctctaatggggtaaatatggttcacaggcatatttcatttggcccacaaagtggattttttaaaataattttaaatttgttatcttgaaaaactagaagacatggttaggtgagccatgtacctacatggaacataattataagtacatgagcctacagctggagttccaatgtttccttccctttttagatgaaaagtactcttttgtttgccacattcattaccactccctaacgtctccctgatgatgaagccataggtgatttagaacgtatctccatactcacacagatgctctcttaaccatccatttcactcatttgtatgattttcctgggctatttacacatttaattttgcaaacccttccctaccacatgctgcttctattttcctactcagcaaaatcattcacaattattcctgcaaagaacaaagaaacaaaaaaacataatgaccacatgcatatatgacatacctctgatcctgtagtgataatgtgtatagccctggagacatacacgcattcacaaagcagttcaagagactggtttattttactcacttttgcataagactctaaacattgctgaagacccacttttgtattccagtattctgaaggaaagtgatgaccatgttgacatttctgtccatttctgctgagtaaaagggggcctcccctcatactctctactgtgttttctaatatcttttagggaagatggggtaagagaatctattagttttaagacactattaaaaagatagacacatttgtccacccaaaaatgtgtacatgaattttatagtagcattatttataatagccaaaatgtagaaacctagatttccatcaatgataaaagaagtattctatacttgtacaatggggtattatttggcaattaaaaaatgaagcactgatgtatactacagcatggagaaatcctgaaaatattatggtaagtgaaagaaacgagttgcaagccactacatattgtacaatccatttatacgaaatgtccagaataggcaaattccaaacagccagattattgccagctaggctagggctgggacattgggaggacatgagaaataactgatactggttatgaggtttcttttttcagtgatgaaaacaacctaaactggattgtggtgatgggtgcacaactctgagaatagtacactttaatgggtggaaagtatgtatgtaaattatatctcaataaaaatgttacttcaaaaagataaaataggataaggcttttgaaatcaggaaaagggaaataatatttttgggtgagctgctacgggccaggtagagtctgatgtgtttttttatatattttattcaagcctcacagcaaaccgccaggaggttttattctgtccatttcacagatgaagaaataaaggctcacagagattaggctgccttacctcgtcacttgcgaagctgagttctgaaccagatttgactctcaaacagcctgcctcgccccactgctgctcagcagtcacgcagcgttttctccttctctaaagacaaggaactaatagagacttgcctccactggttcttattgcctcatgtgactatttaatgatgagcaggataccaactcttctttcctaaagagctaccctgagccatgccagctgactaaacagtctttctaaagtcaaatggggcctttttttctcaaggtgacatgagtgcttttctaaatgcagagctagactcgcctaaaacaattctctgtctgctgtctgttggcattttctcatttacccaatatcctccttgaactcacctctgcttgctccctcattccacattacagctaaaaacattgtctaatgcagttttccctccctaccccacccctgcctatataaagcagcatccaggtagcagtgaacatgtttacgcctcctaattcttttgttacacatgtctctaatcattaacatcgaatagtgcttacaaattaattcatatgtacaaattcctcacctgagcattcaaaatgcatgaatcagcatccagccccaatcactttaagaggttacattaaagcacagatcattagggagcatggataaggtgaggagaagggagagagattcaaatagaattcatgttccttgccttaaatgaggatcagtctgagctatatacaagtgggcagccagcagagagcgtctgggatacaagccatctccaagccacaggcacagcctgcgtttactcacatcacaatccattatcttcccagccaggatccaaatcttacctctactgaagcaagagccaaccagtgacctcagctgggtcatcaggaccactgtagccacttccagcctcagctctctgatctgacagcctcagtcagcccttactttcctctttctgaacagggccagtgtgcttcctcctgtctgtcaatatttaactacgctgtcaagtcacattacatcacctgcactaaatcccacccagtgatagctagagggtgtgcctgctctattcaattcaactcagctaacctttatctagtgccttccactcattcatttctttccacatgtactcagcacctactgcatttggcattggggatagagaactgaaagatccactccccagattctagtggaggaaacagacaaaataatgtggtatgtgctattgtgctagagcacagagtgcaggggacactcccattccaggctggctggggaggtatggagcaaacaaagccagagaattcccaaagatggcaacacttagagtgacatctctaatggaccaggctatatcaggaagacaaaaggatgatgcatacatggcctctgtcctcaaggagcttactcccagcacaggttgctctatgttcctacagatgaacaggattgcttacataaatgccacggcaaagtgcagaatattaaatcaaagagggcagccctttcttgttgttgttgtttttttgttttttggtaagttgtgtcctgaacaaagatgtctcaacagtgaaagctggctgtatcctatagatcccttggtgctacaaatcgagggggattcttccaagagccgagagagcagataaacccagtgaataaaggaagtgtctgtgacccattttcaggaccaagaaaagaagaattcaggtcacagagtaacatttttctctggtcaaaggaattaatctggtacaaacaggcttggccaaaggtaaacagggatctctcacatgccctcctaatctctctatgacttttctaaggcaacatttcctgacacttaatgaagtgttgatggctcttttaaataatagagatagatatgcagaaccacttggcatcactaaaactgcagcctttaacttcgtctgtgatcagaagcctcaaaagctattcactttgggattttttttaaggttgaatttaccaccaaagcatggctctcaaatgtacccatgcaatcccttttctaccaaaacttactgcagtttcatgcaccagagaacaaagacccccatttatgtgtgaacattcaaaggaccccaccaccgggaagcctaagaggctgccacggaaagtcccggtatatttgaattgcaaaacacagcctggggatctcaatacatctaatttgggacatgttccaagctcaggagcctctctgcatggaagcagctttattagtcactttctcagacaattttctagttccacatgcacacttccccaagtgtttccaagacgaacatttacagtctgttgcaatattttactacaaggtatttagggttttgacaaatactaactgacattgccaccattccagtgaaaactgatgacccatagctaatgcctgcttcttggttgtggctcaagaccgttttgagccagtcagtgattgtaagcagaatgacactccagacctctccttcacatcctggaagcacagtttgatttcagcccattaatacattcgcattgaatgttgaatcgtcatgaaactgaagtgaagtgaagctgcacctcagtcaagcctgttctttttttttaaaccaagacttattcagaaccctttttgcttactaacatataacacacttggcattaggaatattatatgttattaattggggaattgttactactaattgccaaatgcccagggacttctggatccaattagaatggatgtttgacatttatcttgcaatcccactagaaggacaaggtgctatgtgacctttagttggtttttaaaggcagttttagtaaattttagcccacatgaagtaaatttttcaaataatattatgcatgtcgtgactggtgagataactatcagctcatggaaaataactagcaaatacaactaacatttccagaagtaaaccataagaaacttcaactttcaaaagagaatatttaaaatgaattctatttatctcttgtgtactcagctttacaaaatacaagaaagggaaggtttttgtttgtttgcattttgttttcaataagaagtcttaaagagaagttctaaagcaagactaatttctccaaatccaattgaataatattcatccaagttagaaagcaactggtattgtgcactcatcatggcagaaaagtatagatagagaacttgaagccacagttaatttaatgtgaccctgggcaagtcaatcccataattagggtctaaacctgctctactgaaactaaagtgatggattgtttaaggtacacaccaaaactcataggtgtcagggagtactgtgccttttaaacccatagttatagggttaagaccctataacttgtccagggtcacaaaagagtccttctcaggctgctgttaatgctctcaattttctcaggcctcagaggtttcccaatcagtgtgactgtcagtgccaacaccagaaaagtccctggccgaccaagatggccacccaacttgctactactcagataatgtcggaacaccatcttggaagtgatttcatattatatgataaataattacgcatcttgtctgagccagcaagttctgattctttaaaattcagttgactttttgaaatagctatcatttgtagccaggcttaatagatgagttttcaaggtgagtaaaaattgtgatgtgaaaaataaaatgttttcattaagtatagagatttgactttttgtgtggggttcagaaactaaacccaaaacaaaaatgtaaaaacctagaaggattttacttgctactttgccttgctactcatggtgtggtctgtagggctagcaatgtagcctcattaggaacgtgttagaagtagacgaacctggttgccctaaatctcctgaatcagaatctgcatttctacaaaatccctagtggttctgaggcacgtgacagtttgaggagtcctgttttagaatttgtttaagcctaggggaagggcaaaccagcctccataaaaacacttgatacagtcataaataaaaaacagtcttgcaattcaaagcattttgacaaaaaaaatgaaaggcattgttgtaattgatgttttctgggccttgtgaattttaacttcagagctgagaaggccataaaatatagttaaactctaaatgaggccaatgattaaatggttttcctacaagggagccttgttggatgccagggcccacttcaaagagtggagcagtcagtctgcgggaattcccctctatgcacagttagtcaccaacctctgttccaaacatctccctggttaggggatcaaacccagggtgttgcctaggttttaatggtttacatctgaaacattatcgcacaggtgaagaatggggatagagggaatttctaacatacagattgagaggactattttgactgtgagatttgagaagtctaataaacacctatgtggagaagaaactggtatttgaacataggagtctgaggcagagccagtcagaaaacagtatgtacgtgaaacatccttggaaagtaatcaggggggtagtcagcttatggattatatcagaaaatgagggaataaaagattacaattatagggagagcatttcaggcctagataacactggaaacagatgccctgtggcaaaagggaaaaagagggcagagcaaaagaaagataaaaagaagtgacaagcaaaaattactagatgataaagtgaaatcaaaatgaatgacaataacatatagagaactgcaatagtatgaaggttaaaaagttttccttcctaaaacagaagatgcatattattgtgggaaatacaaaaagagtctgaaaccaaattctaaatatttcaaatggggagtcagaagaggactgagcacagagtttgtatttgcatgtaaatggatatttggtatgctaaacagaaaatgcacagtcttcttttatgcttatgggataaaaattcacagaaaataattatgcatgtggccacaaagaaaacactgaaaattccctgaagtgaacgaggaaaaggcaaaaaacacaaaaactctcaagtgcctttaaattaaaaaacagtcttctaaccaaaccaaggatagaaaatgcaggccaggcacggtggctcatgcctgtaatcccagcactttgggaggccaaggcgggaggatcacgaggtcaggagttcaagaccagcctggccaacatggtgaaaccccatctccactaaaaatacaaaaattagctggacgtggtggtgcgtgcctgtaatcccagctacttgggaggctgaggcaggagaatagcttgaacccaggaggcggaggttgtggtgaggcgaagtcacaccattacactccagcctgggcaacggagccaaacttcatctcaaaaaaaaaagttcaagttatttagacataaatacaacaatggagaacacctcatatcaaaactgtgatgcagtaaaatccagaggaaaatatatagccttaaatgcttttatttaaaaaaaaaagatagaaaataaatgcattacacattcagccttcttaaagtcttccaaaaaaaaaaaaaaaaagacatagaggggctatttccaaatttattttaagaagccagcatcatctaataccaaaatcagatacagacactataagaaaactgcaggctaatatctctgatgaacatggatgtaataatcctcaacaaagtattagccaaataattcaacaacacatcaaaaagattataccttgtgaccaagcaggatttatcccagggatgcaaaaatggttctaacgatcataccttattcaagtatggaaattcaaataaagtatgatctttagttaataagagtgtatcattaattgtgaccagtgtaccatactaatgtaagatgttaataataggagaaactagatgagaggtatatgggaactctgtactatctttccattttttttctgtaaatctcaagctgttctaaaaccacacaaaagtctattttaaatttttaaaataagtagataatttctgatggtgatatacagaacataaagtagtgtaatgcagtacaatgttctgggattgggagggtagccaggaaaggcggtcagcaaattttccctgcagcatttgagctgagagtttttcataatgcagtagggagagccatgcaaaaatctcagggaagatattctagcacaggcacaacatcaaaacacaaaagcaacaaagaatcaattaaactgaaagctggttatttgaaaagacaaataaaacaggtaactctctgtcattctgattaaggagcaaacataaaagcatacaacataaagactaagataacagacataaatgagtaggaagacaatttgaaaaatgataagactatgtgagtgacactgcatttgaaaatgggtattttttaagcaaaacattaatgactgaaattaatacaagaagtatgagacagaagtacacaaaagaaggtaaggtaataaaactgtcactaaaatgttatagttttaaaataggcaaatatagcatgacagtctgattttatttaaattttaagaaatagataattcccatataatttaatttgtcccagaaaagagcaaaatataaacattttcataattaactttactgagccagcagatccttagcacagataaagaaactctgataaaactagcacagaaaaagaaattctaatttcagttgtaaaattaaatagaaacattttaaatagaatgttagcaaattgtattcagccttgtaagaaaatcacaatgcaatgtgagaaaatcacatatgatatgaccgagcacagtttattttagtgatataaaaatatgttagcattaaaaaatctatcaattaaatttcttatattaatacatcaagatcactggaaataagatacatataaaaggttatcatgcttatttatactatatagtaacagaaaagaaaattaaaagcaaaatcctgaaattctgatgcatctaggaataaattttacccagatagttcaaagaagacctatatgaggaaaatgtttaaaacttgcatatgaattaacagtagaaataaatgtatatttggatacaggtattatcataaaagtgatgattgttcccaaagtaatacataagtgatataattctaataagaattacaacaggattatttttgaaagaacgggcactaggcaaaagtcactctacagttcatgtggaagaataactattcaagaatattcacaaacctttaaggaagctttgtcctacaagatattaaaacacactttgaaatactatcaccaaaacagtagctaattgctactagtgcagggaaaataaatcactggcacagaataagaagtctagaaccatgtccagaaacagtgccagaaacttaattatgataatattaataaaattttgataaaactaatatttcagatgagtaagaaaatcatgttaatcagtaagttacattattcggtaaattatatgagggtatttgctttgtaggtggaagaacatttcattagaaccctattttacacaatgtgcaaaacccattcttgagggatttaagttagaagtgcaaaacaaaaccctgaaaagcaagagcattgtgaaacaatatattaaattacttttataaactcggagtaaaagagataagatattcaactcagaagccataaagggaaaaatagacataatttacataactcatcacgtgtttacacaaagatactatgaaccaagctaaaacacccaaaatatttccaatttgcactagaaacagactccggtagaaaaatgggcaaagaatacaaacacacaatttataaaagactgcaactggacaatacgtatttgaaaatataggctactatagtcagtcaactacaaattgaacaatattttacctattagattgaccaaaattataaatactaatagtatctaaatgttattaaaagtgttgggaactaggcagttgaatacactgttggagaaagaatgaagttcctataatttttttagaaattaatttggcaatattaatttaaaatgtacatatgattggaccagcagtcacttttaggaatctctcctgtgaaaataaatgcaagaccacataggatttatgccctctgcgggacggttataacagcacaacactggaaagattctgaataaccaccagtgggtggacagttgcagaaattatgccatgtggaatattatacaggagttacaaagggtaaggccattctaaatacagtgcctcagaagaaggttcatgataagatgttatgttaaaaaagcaagtaaaaacaacagtattagatgattttgctttgctttgttttaatttggagctacttttttttaatttccatttttattttggattcatgcagtacatgtgcaggtttgtcacaagggtatattgtgtggtgctgaggtttgagattctaatgatcctatcaccccaatagtgaatatagtaaccaataaaaagttttacagtccttccccctcttcatccctccatttttagtccttgcctccctccctccttcaaggtctactgttcccagctgtatgtctgtgtgccccccagatttagcttcaacttataaatgaaaatatgcactatttgttttctttttctgtgttagttcacttaggataatggactccagttgcatccatgttgctacaagggacataattttattttttatggctgcatagtattccacggtgtttatgtaccacattttatttacccaatccaccgttgatgggcacctaggttgattccatgtcttagctactgtgaatagtgctatgatgaacacatggcaatacagtgcatgtatctttttggtagaacgatttcttttcctttaggtatatacccaataatgggattgctgggtcaaatggcaattgtatttttagttctttcagaactctccaaactgctttccacaggggctgaactaatttgcattcccactaacagtgtataagtgttccctttttctccacaacctcaccaatatctgttattttttaactttttaataatagctattttgactgatgtgagatggtatctcattgtggttttgatttccatctctctgactagtgatgttgagtattgtttcatatgtttgtcggctgcttctatgtcttgttttgagaaataactgttcatgtcctttgctcttcttgattttttaatttttgtgggtacatagtaggtatatacaattatctttgcccactttttaataaatttgttttttcttgttgactcatttaagtttcttgtagattctgaatattagtcctttcttggatgcatagtttgcaaatattttctcccaatgtgtagtttgtctgtttactctgttgagagtttcttttgctgtacagaagctctttagtttaattaagtctcatttgtctcctttggttttgttgcttttgtttttggagtcttcatcataaattctttgcctaagccaatgacgtgaagagtatttcctaggttttcttctggcatttttataatttgcggtcatacgtttcagtctttaatccatcttgagttaatttttacatatgatgagaggtaggggtccagtttcattcttctgcatatacttagccagtttttccagcaccatttattgaatagggagtcctttccccattgcttattattgttgactgttgaagatgagttagtcatgagtgtagagctttatttcagtgttctctattctgttccattggtctatatgtctatttttgtaccagcaccaactgtgtatgtgcatggttgttgatacatgaataaaaaatctcccaaatgggtataatctgagagttatcactgggtccttaaggtggattaaatagtgggggtgggggtggagagggagaaggaaggaggagtgagggaagcctattcttcctttctacaggtctgaaattgttaaattgatatcatcaggaagccaaaattttgaccttataaatcatatactaggagaaagggggaaaaagaaagagaaagaaaaagaaagacagagagagagacagagagttttctagctacacaatgttttcatttttcatggaaataaagcttcatttcatttctagggtcatttttccaaagttcaaggaaatataacatgaattcaggtttccagttccagaccatgtgctgatgagacagataggaaactagcactgcatttaaaaatacttcagaatattgaataataattcccctgaaagcaaatacccacagaatgctgctttcctgccaggttggtcagtcatactctccatgttttatatatttaaactggccatttcaagttgtcttcagatgtgtaacctacttcctgtacagaattaattactgtatgttgatacaacattttaatcaccacccactctggacttttagaggtagaagaggagagaggtgtagacaaccgtttccaaggtatacagcttggaggccctgaaggctttttctttgatgtgaactttctgtttcactgactcattcttggagaaaacattccgaagttgtcgaagagggcagctgggatctctgcagctgtaagcatgaatatgtagctttacgatgcttgcacagatactgaggcacaaagaaccaggataatctgcttgaggagtggcctttttgatggcagaacaaggtttttgtttatttgtaggaggcatattttatttgtagcaatcatacctatacttcagaagcaaatccttcttcataataccatcatcaaagatgggcaaagcaatgatgctgataaagaagtaaggaaaaacacaacttcttttatcactaaaataagaaacaaacaataagttttacttggattgaggaaaggaatcaaatccatttacatgagtataaaggttcaagaactgaagggtggttactgatttataactttgtaaaattgcccatggaagagagggtcccatttagaagaaataaatttgtttctctctgaaatagacacattcaccaaacacatggatccgataaataccaaatcatggaattgatcattatatcattccttaacctttgcttcaacagccacaaatcaggtcaataatcacctagcctagtgttgtcctttgtcacagcaagagcacattaaactttgaagaggaaacatcatagagtttacaatagaactgcaggactcatactaccaaattatctgtatcatgcaaccaacttagcatcattatagtttcatgagataaaataaaaattgctcattcattattaataatctgtttccagcacacagaattaaaaaacaaatacctgagaaaagcagaaatgctgataccctaaacatttatttaagtcaaaaagactcagttgagtttaaaatattgcatttcccgtctcctggtagcacggatcactgaagtgctttgagaaccccttccttcctccatgccacccaaatgctcccagtgcctgttgttgctattaagccagagataaactcaacatcagggttatctatcctgagcactgatggactcggctccaaatacaagcctgtcaagtagcttgtttacagcaagtcttttaaataatgaaactgttccctctaaatacctggccgtcagggtagcatgctcatttcactactctaatactcctgcaagactatgagctccatgggctccacaggaaatgataatgattttgctcatcaatatagtcttagaacccgacacagtgcctggcatatagaagacaatcataactattcatggtgaatggattatatgttaagaatttctccactttatgcatctgcacaatatcctatgaaatggggatattattgttcttttatttctacatttctggggattcaagttgcttcttttgtagtattttaaacactgctgtgatgaatatctttatttttgtgatctctccatatgttagattcccaaaaggagaattaatgggtcaaagaatcagaacatttttatagctcttgacatataatgcaaaatgacttctggaaaggatggaaaacagcatagcaccagcaaaacacagaaaacagttttgaccactttcccaggcataccagctattagctttttaaaagagatgataactaaagggaacaatgaaatattacctaaatatctgttataaatttgtatgactttaatgtggtaaattggacattttctctgtttatttaactagttagattttctgttttgcatatcaaccaaggaatgatttgatgtggcttctgctgtgtgaatgggaaacctttcatagatacttggagaaactttgacactacaacttctctgccaatttgataccttttactttgaatattcctcaagagaatgacaggaactttgaaaactggagtttaggtgatacttccactgttccagggatctctttattctatgtatgaattccaagagaccaggagcctcttagatagattacttacatgtgtgttgataaatatcttcagaggttttcacatgggaagaattagtgagttattttgcagagttgggccagttttacaggccaataaataatgagctaaataaatcacagtcagggaccagcctacacagagaaattgtatacctacaaaagttttagcagtaatgaaattgaaagctgtcaccaaatcctgttatctgtctggatagaaaagtgctcaacaaaaacactgatagcgtaggagatagagaattgaattaaggccaaagaaacctttcagtgaatggcagattgaagacaataactgagtaatagaataaaactttctcaggaacccaagtcttaataaattgctctgtaagtactttgggactacagatctatctaacttctttaagttcccagggctcaaggacgtttggttttgggaggaggcacctttaggatgtacaggaaacctgggcaactcataatagggcccaaggtggaatccagttcgtgtagtccagttaagtttggtattattgtgtaaatacttatacatgatttccagaacaaagcattctctcattgttccagacactcattgcttaaatacttggaatcaaaaaaaaattctaagaatgcttataaaaatattctagaataagtatttaaaaattctcaaggataatccaagatatgtttagtgagcccagtgtttacctcttccttcctttctattttgccaggtgatgcttgatagcaacataaaggttacttatctttaaaaacgctccttttcaagaaggattagtatagagagagctaaatgttaactacaggtaaacaaataactgcattctataaataatttcaaggaaagttttcttttcatgtctccctggagatcgtacttgagtcagggagaaaaagtaaagcagtaaagtcaagaacataggctgaagccagagggcctggtcaaatcccagttctatctttactcgttatataatttgggatgaaccattaaactctatattcctcagtttcctcatctgcagaatggggtttatagtgacaatatctatctcatagtgttgttgtaaaaatgaagtgagttaaatatgtgaaaacactttacaatagtgccaggcacatggcaaagtgtattttccattctgatattatgaacatcttaagagtagtttataaaactgtactgcccagtacccaacatcattccagcacatagtaggtgattagtgaacaattgctgaatgaatggttgactataaaggattttccaccaatattttttttaaaggaccacatttctttgtatcttcaaagcatgacttaattcaatacaggactgacaggtaactttcagaaacaattccagggttcagagtatgcacacctgtacgtatcagcagaatgaataatgagagagcaatgaacaatattagataaaagctaggagaactatagaagacaagtaagagtcttaacccaaatccaaaagactttgaattaatgcaagtattatttccttggcaaagccctggcctgcccttctaatcttcactgataaggccatgactattacaccatctgggataggtcaagattaagtgaagattctgatctcatcactaactactcttatattcaagtgggggttggagagtgggtgggaatgtttcagggagagatcttctaatgacagattcactcatgtaatgctcaggaggtgatttaggcctacttaatctccaggacatctgaaacaacacaatttctggaacaacttcttatcctggaaaatcccagacgagtttaattatttttttaatccctgtgtttagtagtcatatcactcaccactgaaatgcagttcttgttgctggagtaaaagagagcaatgtttttaataggtaccaaagataataggatgactaggcacacagctcacgtcactgaaaacggagacagactggctctaccaggttggaacgaagccagtctctccagggctcactgtactctaggtatggcatcatcagctcccctaccggacagtgatgaggtgagagagtaggcaagagaaagagggagagagtgagtgattaaatgaacaaatacagcaaagttagagaaggtgctggcctacaaaggttttagttaaaaaaagcagggaattttgcattaatgaaatccactgaataatcggtttaatttgagatatccacatgtggctagtggctggcatattggacagggaaggctgggtgagttcacttgatatctctgttctttttctatctccttcatggtgttctcttctctcacctgccacttccatgtcggggttcctttttggttccctgcttttgtgactctgctcactttccatggctgaccttgagtcacctcacattctacgcgatcaaaactgaatttttcgtcttcctttataaaatagttactcttcatgaatttgttagttcagtttgaggcattatcattcacccagaccctcaagcagggaactatccttgacagctcatgcccctccatcccatacatgcaattaattttcaattcttgctatatttaccatccccccactccccaaatctatccatgtagcccaactacaagtatcttctccaaactgtcatcctctcttgcctgcattccacctaacattcttctagtgcaaggattctcagttctggctgcctgttagaatcaggtaacggggagtttaaaatatggccagaacctggatccacctccagagatgcggttttattcgggatggaatagagaccaggcatcaccattttttaaagctctccagatgactttttcagagtcagactgggactcacacatctagctcatcttcctggctctagtttttttgcacctatggccacaccataaagaagcaccacagggctctttacagaacattcacttgtccactctgcctaaaccctttcaatgacggaccacaatctagaaaatgaaatccaaattctttgacattccctggcctttctagtcatgtactgacattctcggcctcacagctagttccccacctgcaggtgccttttcctacctgtgcttgtgacctcttctttgctcagatccccactcttcacctggggaacctctactcatcctgagagactcggcttcggcgtcgcccttctaggaaatctgttctcacttgcttatgagaacagattctctgtacattgaacatcctgtgcataattatatgtatgatacatcacgtgtatgttaacatgggtgcctacacctggatgccccgttgcctatgagcccgttttctcagagcatgtatggtttatacctgctgtctcctttaattattaatggtgctcccttgagtctcaagggtatctgtgctaccatagatgataaattgcagattaccctccttgtaagattgttgaggtcagtaacattgtcgtatttttcattgggatctcagtgcctaacacttcttctaaaacttggtgttaatttatgtgctcaaaaaaattaatgaaggtgctgggcacggtgactcactcccgtaatcccagcactttgggacgtcgaggcgggcggatcacgagatcagaagatcaagagcatcctggctaacatggtgaaaccccgtctctactagaaatacaaaaaattagccaggcgtggtggcaggcgcctgtaatcccaactactcaggaggctgaggcaggagaatcgcttgaacccgagaggcagaggttgcagtgagccgagatcgtgccattgcactccagcctgggtgacagtgcgagactctgtctcaaaaaaaaaaaaagaaggaaagaatgaagtatttacctgggaaactatccttttacctccagaagcacatggtaactgttagaaaggctggcgtaaaaaactgaacaaagaaacaaatggacacatagccacttgtaaaaaaacgtgattttagagagtaaactaaagccttctttctcagctgaatattactttttgtacttttgtgtttttcccgaggccctactgatgttggggaagttccacatagtcatcaggtaggtatagatgattcctaaagcagccccagccagcgtcagttctcagaagggcagctctgctttttatggccaaggatttagaatctgatgtcagacttcttgcatgtgaattttgctcctccactgggaggacatttgacttcagttaagttatttaaactctccaagcctgctttataaataaggatgttaaaagtgcctaccacatacagttcttttgagaattaaataaggaaatctatgcagagagtttagcatggtgcctgtcatagagaaagctctgaatagagtagcccttattattttatctattttacttgttgaacttacaaatatttcatttgaagaagggatttgcctgcatttaaaaatactttgaaaaatcactgttccagaatattgggattgtagagattccaacccagttcccccttgggatttttgtaacttgagttgctaatggagccagtgttatttctttcctctgcaattcagcaacctaagtccataccttgcctgttcactagtacccattagtggaaaagaaaataccaacccaggactcatatttcagtgtgagccacaggtgttgttgggtgccagcttctggcagcatggcatacaaacaaatgaatgctcttgccaatgttgggaatattactgcagtatgcctattacaaatatttacttttttagctggaatatcaggggacactagggtttctgtttgaacagtgctttgaggcagaactcattgaaacaacatggaaagctttgcataaataaattcttttatgattatacttgtaacacatcgtatcatcagactgcaaaataaaacttgagaggataaataatcccagttatttgcacataatgctagttactaatacagagctgtagataacttcgcataaagtataataagagatatttcatttttggtaaaaggctcctatcaactagcattgaaaaagcaatataatttgtgagttacaggctgggggttatagacaatgcctttggagtcaaagacacataggtttgagaaaataatgcacttaagagtgtctggcacctaaaacaaatgcaacaaattgtaactcagagtaagaatattaataataactagtattaatatattattctctagggatatttgatatagttctaccaaacagaaatgattagattatattttgttctatcctatgttattttttactgctgcttttgtctgtaattttaaatcaaccccaaaatattcacataaacttaaaacctgacttcaataatttcaattttctctgagaagttggtggatcaacacagaagtgtggaaatgaaattgaggtgtctgcattttcatgaccagcaggcatgataacttgtcctaaaactgtttgatcttgttacaatttctgctgaatactttgagtcatgcaagaatatagaatgccttttattcaaaagcttccaaaagagagatagcatccacagaaattcagagtgagctgctgaaaggcaatattaatcctgatctcgggatattacgctaaatatttgacaggaatccaaattttcctgtagccttccactaagaagataatctttcataattttaactgtgaaaggggaggatttgatcctttgaaatggaaagggtgagcctaattgaatttccttctttggtttcttattaaagatgggaccagattgaatcatattcaattaatgattgtacttggatatattgctcttttcagaagctgaaataagattaacaaagcttgaaaaagatgtcgggggcaacagtgccaattcaacacttaaagggctaggcatacaaaagagcaaagccctatttcaatgccgtttatttacatgatccttgagcaggctgggccattgttcttgaccaattcaaggactgagtagaaggttgtgtgaccttgaacatcagctatggaggcaaagtaaacatacaaatgtacatatgaatatacatacatggaaataataattaagacataccattctgacctgccctctcttctgactacacaccaaatacaccatgatccttgtcaatgatgagtcagtatacccctataatgtctcatctaggcctacccaaccacttttctgtctgccttcattgctcaggttaaagaatgtcttcttctctaaggttttatgcaagtctagtaaccatggaaccatgttttatggactaataattgtgatacaaaatataacaagtaaattagcacaattactctgaagattttaatactgggactgtccaggagcacaatgcctacataattagtctccataaaattctcccttttgtaagcgttcctcgggtatgttgtttctatgttaaacattaggatttaccacaatagacctcacattatttgctaactgtctcatgtttctgtttgtatgatatactgcttcactggtgactgtgtaaattgactagccctttatttcttcagtgtctgcatagcacaaaacacatagtaggagcttgattggtacttctccaaatgcagttggtgtgtgtgtttgggaggtgatacaagtttggaagataaatctgaaattagtatcctagctctgacccttgacatctgtgggagcctgagtacgtttccacatttgtagtataggcataaaaatacaaatagtacatgcactgtgatgatattgtaggacatttgtgcagggactggtatgcagtaggagctccatccacagtcattctgttgttgaatgaaaacactggcttaagaatgattttagaaggccaggcccagtggctcacacctgtaatcccagcactttgggaggccgaggagggtggatcacagggtcaggagatcgagaccatcctggctaacacggtgaaactccatctttactaaaaatacaaaaaattagccaggcgtgatggcgggcacctgaactcccagctactctggaggctgaggcaggggaatggtgtgaacccaggaggcggagcttgcagtgagcagagatggcgccactgcactccagcctgggcgacagagtgagactctgtctcaaaaaaaaaaaaaaaaaaaaaaaaaaggaaagattttagaatatgagaggcaatggagtatggtgctcattggcttggggatcctccatcagactgcctacatttaaaccccaattctaagccttccagttgcaagggttaaatgactgaatacatataaatcccctttgagcgcctgacacagacaaagatttagcttcagtattattaaggatgaaactacttgagacacacaaatgaacttggtcaattttcaaggtcttttaaaactcttaatctatattcctgtgaagaaataatacatgttcttgcctttaaagctccacatattagaaaacacaggattattctgagacagctctcacaccctacagacacacacactcacacacacacacacacacacacacacagagcagcagcagcattgtctaggtctaattttttccttcctctgtcaccctcatatgtgtgctaattgtagtaactgtgagtccaatcaatatatgttctgtcataaggagagaagaagctggactaggaagatggagttgacgctatacctgacattcagtttgaaacactgaatattagaatgttagtcttttccagagggtctgaataaatgacttgtctaaaatagattcctgaggaaaagatctagactcagaatcatgcattgaaccagaattatcaaagaaaagcctaattctaataaaattaaggctcttccagcagatggactaggtcagcaaaaggtgctctatttaactaactggaagtctttgcagcgttaggatacaaaacatttaccaagaaagtctaggtacaaattgcccatgtaatcacacatctgtgaatttgcagagttttcaaaatcatttagagattccaaggaaggggtagtgtgaactcagcaacaaaatgaaaaataaactaagataataaacttactttgtgatctactcagtatttaaattctttgaaatagacctcctctagcaaccaccattccacattgctttcattcttctggcctggttgcctcctcttccctttcctttaaatgaggtcttcataggatatctcagtttctttaggcatttcctaagcgaactctcagggaattaataccatatctaagacttttatttaaatatagactcttctctgtatcagtttcgctctttcagtctctgtcataaaaactctaccaggtatcattcttttttttcattcccaaatacaatataattgcatttcaagttacagaaactgaaaaggctgctttctgaatggaacaaaatgtcacaacaaaaaagacccactggagaaacacggacagagtgcaatgtcataggaaaatccagaatgtggagaacagcaagttgccagagggttccctgcagctacccccggaacttaaaggatgttctgaaagggcatcacacgtgagctctgttcagtggttataagagtcaggtactggaatcaagacaggaaggaagaaagagaggcagggaggaaatatagagtggtagtaattgggctgaattaatgactctagacagagctatgcacataggaggcagtggttctgacaaagacgaccctcctctggagggacttgccccactcctccaccatcaaaaccttccccatctgtgagtcattgctgagacccagccttccctgtagctgttgaagctgcctaacagctcccctctgacatctgatgaacttattgtccgcaccaggggttctcaactagggaagaattttgctgcagtcatcacatccatcataaaaccatccaagcccccaaccccactgcttcccttctagggtgtaggtctcctaatggactgcctcctaattgatggttcccaggctattgccccagggctgagggccagctccctggtgctgtcaccacctttagccattagttccccagcacctagcagagtgtgggctgccaatggtgtttgttgaactatcgaaagggaggacttgtgacctcctgagatgaagaaaaaccatgtttaaaggggctaatatccagccatgacagcaccagtgccagacagcctcatgtcaggctgtgtcaggcagctgctcagatggcaaggcctgctgccctgaaggcttacctgcctgggagaaagaggcagccacagagtgctcctccagaacacccctactcttcaactgcatgtgaatttctgagtactgatttctagtaagataaacagcatttaaggttgcctcttggtgctagtttttaagatgatatgaattgcatagtccacaaaacatatttgccaagatgtagcatttctttttatacttattctgcctgatggcaaaatacaaaaacgaaacctaaaactagtccaggattgagagattcgcttttctcaagcccatttcctcaggggttcaggtttatgggactatggcattgggcactgaaatgttgtctctcgctgtctccttgccctgcctggctggggtcagtgtgaacttcacaagtcctaccagcaatctagggaagagctagtcctgcctggttccactttctgttggttttagatgcctttgctccggatagttctcttcttatcaggacattagtgaaacaaaacaactgtgctcctccagtaatggccactggctggtctgaaggaccccaaaacctcccacttggatgatctggtcatggcaatgcactgaggttcagctgcattttctacctcagccctggtaggaaacttcctgtttcactgagatgctcctccatgggaagggccctcctttcttgcacactccctctccttcggctaacttttggaccctgcttctggaaatttcctgagacctttgagctgcccgcagccgtctccagcatggatcaccactcttctccctgagcccaagcttgaagcatgcagacttccatcaactgcagctccagctcacccctgagtctcctccttccacttcaaacctgctctttcttcttcctaccctagagctgttttctctactggaagaggggaggaaaggatgagtagagggacctcttgagtctgtttgcgttctcctggtgatcttttcttttaccttcacaagtgacttttgaacctagaagtcaagattatggcaggcttctttactggtatgttttagataatttcatatactcctgcccagggcaactggctgctcctaattgcataaaacagtgttaatcaatgtataataaaaacaagtgtatgcttttgtgacaatccaattcatgttaagtgcacaaatattgttttttaaaaagtccttttatttttttttcagtttgctgtattgtctaaaatgttctcattctcttgactgacctaggtgaagcttttaaatgaagctggaaggtgtctggggctccagtggtatgtcccattcttcaggtgagaaaagagaaagcccaaaagaaggaaggactgatgtcctcaagttttggtaccatggtctagggaaagactcacagcgtcttagggctatctcagcgctgtttaagcacaatggaacagctaacatagggggcccagaaactttgccaaatggcaaatagcttttaaagacaaaaacaaagatagatagatagatagatagatagatagatagatagatagatagatagatagatatagatatagatgtagatatttaaaaagatgtatacatcttctggtattgctttaaaattgctcttaatctttgagagggaagttgagacttggcttgtccctctctctgtttgcagtcaaacaagaggttagtgaaccctgccctccttatcccagcacggtgttaaaaggatcaagtgagataacaaatgtgagacacccatctaaaatcaggaaactcttagaggtctctgtgtgagtgttatctgcagggatttgccagagttctgtgttcttcttccttgcactctgatctttgcttttctactttatgaactcagcagaacaggagtcagccctctccatgaacttgatggccagctcctctgaactccaggcctgaccctctgactagcgctggccttgctgctcctttgaatccatcgcaacatttcctccacagctgacttcctggatcttcactcattgtgattctcctgtggactgtcgcctccatgtgaagaattattttaactaattacttgcattttaagatctgaagaggccagaatagataccatgtgataataaaaaataagcttttaggtaattttgttaatttcacctgaggacactaaacattttcttgtgattgagtgatttacttgggaaaggaaataatttattaaaaggtcattctctttatactaaaaaggggcaagttgcaaaaatatcaggcaatttaactttctcatgttttactgtcatgaaacagttctcaaatctaggtacatctgaattaatacaagaaatgagcttttttttttgtaggttgaatcttatagatttattcacaaataatgattcaataccaattttaaaaagaaaccctgatgctaggtattgtggagtttataaagatgttaaaaataaaatccaaagcaactactttttgggcaaaattggtttttaaaaaattagtttcaaaagacttcccatatatatttgacttaattctcataaaaatcttgtgacacagttattattgctatcactgttttatatttaagaaatccaaggctcacttttgtagaccttggatcaaaaatcccagaacccctgacttcaaactctaaatccttccctttacagagcatgtagacgtttggtttgcaggaaataagtatctctaagaggctccaatgcaaattgttatttggtccttctagggaggagctacttttcattggagtgattggagagggtataattaaattgcgattccacctggtcccagagaaagggagagactttttggcagcacagggagagtaaggaagggggagttcaggttgagggaggggataggtgaacagaggcacagaggggaagggaagctaagaatttttagggaatagcaattggagcagcttgcgataatgtgacacccctgaagaaagcaacaacagcaacaaaaaattagcaataattcaagagatgggttgtataagaccttattgctggaccaagggatttagacatcctccagtgctgagtggaacccactgtgtgtgtgtttgtggcagcgtggtggtggtttcaaatgaagatagaacgattaagcttgtgttccagggcacttggccatgtcttaatgcaagacagacttgcaaagagaggaggtgagaaccaaacaactgcaggagaaaactaggaagctgtcagagtggtccaaggaagaattaatatagcaaccataggaaaggggaagaaaggcaaagatatgagaaacgcaataattagaaaactgaaaagccttgacaatttctagaaggttgaaggtgagaaaagaatggaagtcctacatttcaagcttcagcaagtagaagatttgttcatgttataaatagatatgatattaaagaagaaaagctttctggagcccagaagtgtctaaagataaaggaaaataaaaacaaaaatagctaacacatacttgcatgcttactgcataccaggtgttgctaagcccttttcgtgtaataactcatttaattcttaccccaacttttggagctaggtaatatggcacctactttaaagatggaaacactgaagcaaggaaaatttaaacaagttgtccaaggtcacacagctggtaagtgagggagggagagggagaccaggccgcctggtcccagaagtcgtgtgtatgagcaccatgctctgctgccgctctatcatgagcctcgtcctgagcatgctgcttgattttgccctggaatgaccagatgaagatgcataatgagaaagccaaactcaagatgaaagcttagaagagtaaccaaagctaagcttgcatgtctggagatgacagctgaataatggaggagatgagacaaccatgggagagaggggagaggcaggaagaagaggtgagaagtgaggggaaagggagaaaggatgagaaagaagacagagcacagcttgaagtgcccatatttagtgggtgggaaagaggaggaatcagagaagggaaccaaaagcatgcagtaaacccaggaagacctctgggcaagtttcaagtgcaaccccagtagtctgaaatgaggaagatcgctcaggcaaggagctaaccaagaaagaaccattggtaaagctgaactagtgactctatgcgtggtggaaaacatgccaggaaatgtgcgtaaaaggtatggcttcatgggaggaacacaccacgactttgaactccatctctacccgccatcaattcactgcccttcccgcaaccaagcagtcagtagcaggaaaaacaaattgccatagaccctagaggggctcaatattgatgggaaacattcatgtgcatatcttactgagctacatgcagaattcagaggtaaatgtcaaggtccttgcactcgtgcttttagtaaaatagtcttacgtaaataataaacctgaattgaatcggctcaataactttatttttaaggcctctttctccgtctttttccttccttccttccctttctttttatttccttttttcttctctctctctccttcctttccccttcctttccctgcctttccccttctcttcccttcctttccccttcctttcccttcctttcccttcctttcccccttccctccccttcctttccccctcccttctcttcctttccccttccgttcccttcctttccccttctgttcccttcctttccccttccccttcccccttctcttctcttctcttttcttttctttttgtagagatggggtctccttatgttgcccaggtctcaaactcttgggctcaagtgatcctccaaccttggcctcccaaaatgctgggattacaggtgtaagccactgtgcccagcctctttctttttctaaaagaagggaatttgagacagtgaatcatcttgcatctctacctgtggccttcatcagggttctctaaagattagccagtctatgtccagctggctgagacagggtgccacatgtggtacttccaataattctgtccacatgcatgggccatttcacctctacagctctaagctcactgctgagagtacccatcagactaaagcaaacatgcctattaaacatgtcataaataggctagcaagaagcgccacacacagcagcagaacaaagcagaagtgggctgatcatgtcctaagtccatccacttaaaatttatacttctactttattcctctgaaaatattttgattatgttaccatctgaaatgaaagcaagtataaatcttctgttggatttattctcccctttgtcaaccttctggccaataataggtttgatattgttctgggaaaaaaaaaaaaagagggaggcgggttggtggccacaatttaaaagcttccggaaactcttttccacaaatcaaacctttgaatcattctgtagcatgaggaagctcatgtatttcattgacatgagaggaagagcgagcccgtatttaactaatctatcctgtatagtcacattaagtaataccattgtttaccctgagcagtcaagaggaaagacttactaaatctaaaacaaaagtagcgcatgtatgttcttggtttggttttcttcaagatttccccaaatgctgcaaattgaacttggccttaggagtgcatggttgagcagtatttttttcttaaagcatttttctgctttaaagaaagtctactgacaaaagaggaatcagagtttcttctttattttttttaaaacagggtctcactgttgcccaggccaagtgcagtggcatgatcacagcttactacagccttgaccccccaggctcaggagatcctcctacctcagcttcctgagtagctgggactacaggtgcatgccatcacacttggctaatttttgtatttattctatggacgaggtctcaccatgttgcccaggctggtctcaaactcctgggctccagcgagccacccaccttatatgcttcttaatctctgtagccatctttctcctttctataaaataacatagatagacaagatgctgtgtttacacagacatatgcaccatgtacacatgaataatgagagaggatgttcttattaaccttttttccacatagatttaattatccttgcacttccaagctttttgtatattcccccataatggcacttatcatattgtataaaataatttctcccctacccaactgggagtacaaaatcaagggtagttttagattcactttacattcctgttgcctattgtagagtagttgctcaataagtctttattggctcaaggaatgaataaatgaaagaatgtttccctaaactgctattcattctcatgttatgtatattagaaactgaatttttgcccctagttcttagtcctttttccttcacttttagcaaaacgatttagagctcttgtaccttgggcaaaagcaactgaatggaatatattttatagtcagaatatttcaaggaattttttaacagagtaatagaaaataatcaaaacaggtgaatggcatattatagacaacagggaacacacgttctccctaaaatgggaatactaaaatcagatatctctgaaattcgaaatagttggacttttgggtccttttccaccttgagaattctttgaacaaggaaatatagaggtttaccctaaggcgtgacggttccttttaatgatatgactcttcaactttcaaattctctatcttcaaaatctacaggccaatctgaaatggattctatgtcaaggttgcgatcatagattgtatcatcttgactttaccaccttttctctcttatgtgctgtatcgatttgaactataaaggaaggttaaaatatataattaacattattatgcctcatccaaatctcacagtttccagctttttttttttcaacagagattttaaaacttggatgcataagaactcggttgcatagcacaatttttgtgggttgaagtgccttgacaactacctgccaaatgtctgtgcatctctatgtttgagcatctcaactcccacgggactcaccatctcccaggcagtccatgatcagttgcacaaggccttgttgcaaggcagcaaagatgtacctaccagaaacatttattgatttgcccatatttgtctacttgaggcaatacaggccaagttgaattcctcttctcaacacacacgcacacacacgcgcgtgcgtgcgtgcacacacacaacaatttaaaggtttaaaagaaagcttatttgctcagtctgtgctgcccatctgttctccaggctaatcttccctgttctgttatccatccctcaggtaatgtcaacttgagtcattttattctcccagcaattcttctctgggtatattccaatatgtccatcaagtgcattttcatatgtggtaacctttcctgaacacagttgttttcagcatatgttgaccagtccaatgcagaggaagaggatgacctccatcattccattaatgcggcctatggtaacattacgtttttaaaagccattcatattgagattactattgactattcggatgcatactgttaataagcttatagccctctgatgagttgactgtacagttgattttgaaataatgacagaatttacatttatttcttttaaatcatttaaaaatatatatccaacaactttcattgggtgaaacattttcaatttaaccacacactattctcaaatgggatatacatggttctattctctttattcatactatcaaccaaaaacttgaatagctccaaggccacaaaagaggcacgtactatgccacaaaaaccttctggttgacatcaatcttcctttggggacaataattcaaccaagatctaattcaccacatggtattagtatccagactacagttctccaccttttccaccagggtaaaatgagaaaccttataaaaggttttcatatgctaaagccctaaaagaatattttaccaaaaatcaaggcagagaaaaatatattatttcattcattgctcaagctgtatttgggttagagcccccaaacccccaaaatgtatgccaacctggaagctgtgaatgtgactttatttggaaatagggtctttgtagctgtaatcaagttaggatgaagtcatcctggattagagttggttctaatccaataattgttttgtacatagacacagactcaaagagaagatggcccagtaacatgaaatattgcaatttttagagcctaatcagatacttaagagggacccagaagccattctttactctgatcttacagtcatggatctgaacttctaaatgcaaagcaagttctctgggaaccctctctcaacctcacctttctctgcatttcaccactgcaaataattgatggccaaagtttcagtcaggtgggtcaggaccagttcatgttcacatatcagaaagcatatgccccagtggcacatgagtatccttttcagtaatcaacttcatcagcgaaagtcaagtcattttctgctgaaaagtgagttgtgaaatcttgtctgtcttctaacagatcttttccctggaatgccacacacggccatgcaacaatcactcttatacacagaacttttttatcttttccaccaaggtaacatatcaacttcactaagaacagatgactttcatgtgatttttgagctaaacctccccttcccattgcagggcagagagcatgaccatattagtgtctatcaacaaagtgacttgcattctgggtcctaactgatgccagcaaccccacaatctcagaaagcctggcatgaaagtgaattatgactttgtctctttctgggctaagccatctatatggcttgcaaatgtatacttgatgaatgctactatggaggatgtctcttcaacccgaaggagtgatgggaacttcaaacatttccctgcttaaaaaataattgtgtgttgtcttccctcaagcacaattacacacacacatactgagtaatgggggctatatgtgcactgcacaagaaaatttagaggaggagaaacttcatagggaagaaaggattccatttagcagtcttaaggacaggtgatctagcaaatgagtcccctgaaacagcttaccagctcactccactataataatatttcaattatctgagacctgttagaaaacaatcaactggccaaaaataataatgcttggccccaaataccatgtcaaatgcagcctcctctccttgagagaaatgtttcccatgtctgcaattgcagaacacactgaagggcatccctgctccaaagacaagggagaatttgaaggaccaaagcattaaatgcagccaactaggagaggctccttgcttgggaaagcaagcagcagttgtgcaggcagtgcatatgaatgggattatgggatcaggggaagccctgattaaatggaatatgtgcccaagaaggaaatccactgatggaggataatccacatgctataaatttagacctatggctgataatatgtaatggagaaattgtccccaaatctcactataaaatttcatttgtaactatgcttctaagtggcatagatgtaggaaggaggcagtaggggagaggcaggtgatacattccttgcctgtacacaatctcctcaaacaacacctgtttaaccatttctaaaatgtaagatgttgacatgacagaaaggctctcagaagcagcagtgtgaaatcaatccttaaatccattcagaacaagattgacgcatcaggagttagactgtgaaacacacagaaaaggcaatcaaagcaggacttgtttttacatgccctcccgtgatgtcccagacccaagccttgccttgggaagccatgtgtggcctctttcccctgtacagtcatgccctggtgttagaagttactacttttcaccacacccaaatttagtataattcatttatttatattattagatagtgagcaacttgagggatcctctttccttctttttctctctcctgctattaccattgctacctaaataaattcactgttgaataagtgaatgtatatacaaagtagtaggactctcagttctccaaataaggcaaccagtaatcaatttaaaaatcttcaattttacagaaaacaatagaacttgaagtgttttattgtctttatctcatcatcctaagggaagagtcattagttaaaattaaacaatgtctgataattttgcccagtcatcaggtcacctcaatcaggaagtatgtaactagaaaatcctgaaagcaaaggttatcaaaataaattcgtcatttgtccatttcaagatacttatagaaccactgaataaagaaccctagaatcctccatctccttaatgcaaccaatagttttagacagaactgcaataattccaattgactaaaatctcacccacttaaaataatctgataaaaatattgtgcacagcattgaccaaataacttcaattctaataacaattcctaacacattagtaatagaggtggacaaacccttgtgaacaaagatgttcactgcatttctatttataatggcaaaaaaaaggaaagagaaagaaacacagttggaatttgacaaaataagggttattcattcagtggaacatgatgtagccagtaaaatatatttatgcaaattgtgtaattccattggaaaacactaataaggtagtattcataaaacaggaaaatgaaaggttatatatccaacgtgctctctaatgaatggaaggaagaaacaaaagaaggaaggaaggacaaaatatcaagtaagttttatttctttcaacttttctggatatgtttataatgaacaagtactattatagtaatcagaaacattaatgatagatttgcaaaaaattaagttgaaaacaagaaagaattacaggagaaagagtccagttttgagcccccccaccaccgctgaatcactatcatgtttgtcacttgcatggtacaattcatcatgtatatctaatttactttaataattatctgaaaaacagtaatggttttctgttaggttgcttttatgtcagtttgcaaatcagtaaaagggacagtatatgttcatttttagtacggctaaaaacaaacaaactggttgcctataataagaaatgaagaaattaagcttataagctttaaaatgttcttctaagtagcttttaaacatagaacttggcttttagagggcagcatatgtacaatggataatataatttaaatataaatggctattcagaatgtgattaccatctataaagcactggtgacttactttgaagtaagtatttggtatagaattatacttcaacatactgaggatattgataaatattgtgtttgttatctgaattaggtcatcagggacaagattcagaaaatggagaaacacattagaaagctttaacagtgctctaagtgcctttgagatgggcatctcattaatattcatatcaaatcatgtaatatttattaaacattcatttgtgtcaacatttggtattgacatcatagatcaaacaacagacttgtaaactcaaggtcttctctgcccaagaaagaagtattctcagcatttcctatttcagcttctgtagtctttggagtgcttttgacatggctgagattttaaaaataatcatacctatcatacaaatgaagcacagttaaatataaacattactttcttagatggttcaacatttcaaggctatctggataaacaggttgtacgggcctacatactttcagggattttgtttttctttcgaactcaaaaaaattaggtcaaactatcttacctacaattatgaagctatctgcagaacccaagatattctttagggtcattaagcaacaataaatgaatataattggaatgttacctatcacaggtacaaaacatctggggagccagttatatactttcatccaaagggtctgatttgagaaaatacattggcatgatatactcaactttaatatttaaaaatgtttaaataatattaaaaaatatttcgtgttgacttgtatctgagtctttgttaaaatgctagatgaaacacgattttctaccttttgtagccacaacatgtccatccagcctgatttgtttaaagcaataccaacaagaacaggatattatttacagagatagtcaaagatgaaaggctccacaatttttcttggcatgattataatatctcaaagccttgacatctattttttgtaaagcctaaaatgatacatctcgatgaagtttatgcccatttcatccctttcaaagtttaaggtcagctatttggtatgcctttatgaataataaaattatggctttcctcccttctaggccttattgtagccaagtggctttagtcattttcatgggacagattttccaatgtctttattattactctaccttcgccatctcatatttttaccactgggccctagatatatatatcatccattgttcagcatgctctacccagtggaataatcatatttagaatggtctataagatgatcattctccattgggtccaatttacaatctgtttctcccttttttctttcgtatgtttttctgctcattcaaattatgatcagaagctaaggcattttcatatccaaatgctctccccatcacttctaataccatcaccatatattaaaaatagaagacaatatgaaaggaaagcaataaaagaccctcgctgaaaaagtccttgcactttgaaaaacaaacttatttttttatacaagaaaacagaacttaaaccccctttttatgtttgaaatcctgacaatcaaatagctgtgacattaagacttcacaagcattaagtcttatatcagccgtggttagatgtaaataaatccaccataaaagtcagtctaggcaaaaacgcactgtaacttaattttctaaaccacaggagctgggaagcagctgaacttcactaaatcagacagtaccaaaatggataaacatccgggctctgtatcttttgtgatggtgtgccatatcttgttagattctctgcacatttgttgttttatgagcaatgatattatcactttatgatctcaaggaataacccacaacaagcataaattaaggatgggacctgtagcagacattgggagttccttgctaaattttcattgttgcttttattcttcactaacaaaacccccatattgcagcggtagcaatctacccaactgcaagagaacatgtcccaggcccccatgcagaaaggagtagcaattatgatgtaagtaggaggcactgattgccatcgtgtgggctttcaggaaaattctctaaaggtgcctgatttggcaggtgcccttttgcccttccctctccgccttcttgctagctgcactctgcatcagtcatattgtgacctgaagtgaccttgagagcagaagccatgtgataagaatggcgggacagaagagaaaaggagtgcaggctcctgatgacatcaaggagtcatccatatcacctgtaattcgccttcctctgcagttcatgttccatgggagaaagataaatccttttttgtatgtcatgatattttagatgtcttacttgcaggtgtacacaactcctagttgatgaaataaccttattatgtagtgaatttgaaggaggctgctgaccccaaatcagtaatacattagtctgaaattatttttccattagtaacaattagttggataaagcaaacacaatttctttttaattggcctttcttgtttaacagaagtacttatttcccagatacttggccaaaggaaagtaaactttaccagtctaagtagtgtcaaacccacacatttaaccacctttctctcagcaactacatagctgcttatgaacattatcaggactgtcggacacgtcataggtgtaacaagatctttgtatttccatttctgcactgtccaaccaatgtcttccgttaacacagctatgagcttcatctctaatgtgcagcattcgtagcaaaggggccccaggtaagagtaggtccttaagtcaggacaaggatgcattgtatttcatacaaaaaggggacttgagaggtacatgatgaagacagagattccatctgacaaactgattcccatgtggccggcctggagacaggggaaattggattaaatagtttctgatggctttatccaggctaagatttcaatgatctttataaacctccattaatcatgtaatcatctttccattttggaactgaatttagagcattttaagataatggcttccagtgtctgtagagccaaagctaaaatatgacctcaaagagtcaccccttcccttggtgagatatcaaatcctaccactgagaactctttctcatttgatgtgaagagaaagatgcccacagaaacacacctacaccatttctaagacagaatggcaatgcagccttaatctgcatatttcaaaataggatgcttttaaaagattttacagctggtttaaggatgagtgtaaaatatttaagatgggaagagaaattataaggtaattatttttagacagtctgaaggaacaaaatcttatggaaatggtttcattcagaacaatcagtaatacagatcaaaattaacactcatgggttgccaagtaaggagaggtgcaaggcaactcaaatagcattcgtttgtgtaatttgaaaaaaggaaatctattcttaaagggccagtttttctccctctcccattttttagaattagtgagtaaatctcaattcttttttctagttttttcatgctacacataataattggttatgcaactaaaatggtacaccttacaatttctaacaattctgttaaggacaaaagttaaacacgattttctcctcttgtctctgtttaaattagtgtgtaagtgtgtacgccctttcccaccactttatgtgattcagccttgatgataggtctctgttacattgcagccagtaaatctgttatgagcttggctgccatgtgcaaccatgcctggaggctatgttaaaaattctgagatccatgaacatcagcaaagtttttgttcagtttaagctgaacaaacagagttaaagacaaactttattgagtttggagtgggtccatccattgtcactggactaggtactgacaggctaccagctagagtaacgtttactggattagcgaaaatctactagctgttggaggagagaataaggtgctaatattaatcatgaagagcatgggaaaatgaaactctttcaacaatgaaagcaatgctcctttctaccatgaaagttttcatccctcttcctcatctcaatttcaaaacgccatatcctaagcatcaagtgcaatttaaaaacatgagcaacattatgtgttgggcatctagatggttcatgtgtgcagagccggtgaaaacttgaagggccttgcaacatcctggctgctgtccaaccaaaacgatgaaatatggagtgagacattatttcctatccccacaatgcacacctaccttgcaagtccacaatgtgacactgagtcttttggattctgagtgtcacctttgataaatctaccacaagggaaaagtaagcccccaagaaaggaaaggaaattttgttattgttgttatatacacctccagaaaagttatggatacattttcctggatgttaacaggactgcaagaggaggatctgggtggcaggagggggatgaagaggaggctgataaggactctcggggtttaggaacacaggcacaagccacagtctgtttaaattgttaagttatcaatgttgtcaaattgagatgtcaaaattatgagctggtctagggggaatttcatctgcatgtagacagatctcattagaaaatccttaaaatggttttctacaactgaagcaaatcttgcctaagaaagagttgaatcactacctgccttgtgaaatctaaatatgcatctagtccatctttggctagtgatggaccttcctcggctttacctgaactctctgcagttctgtgttcttttctctctgatgctaagttcatggcaagtagaactaacacaaagccttggtcaatagttgtagcatttggcatctggctaaggaaggattttcttagcattttccttcacaaagccagattccatgtatgttttgtacaattctctcaaattgatagagacggggtctcactttgttgctcaggctggtctggaacgcctggcctcaggtgatcctcctgccttccaaaatgccaagattacaggtgtgaaccaccacatttcgcccaaattgagaggtgagcttcagcaaagcccaagacttcatgggctaacaatttctctttggcttatatgagtgtaaggttcttatagggttcctctggggcctatcagaggaggctcatttagtccaggccttcctttcacccatagtcccaaaggtagacgttcggtgttatctccaagtgaaatcatacctatgtataaagaaatatactataatagttgaaagaataccacatgaaggatttaactttagttattaaatgaaaatgcctaaaatgtgtctggacacattttaatatactgggatcctcaaaaactgcaatggcctggattctgttgacctgataaaggcctattgaggtatactaatcattacagacagctttctatgtgaatcatgaagatgtatttaactcatgatcacacaatgcatgggtaattacaaacacgtaatgagtctgtaacttcctgttcaggcgtgggaagcacacactttcattaggaagcacttttacatgaactattactcaaatgtgtgtaggtccatgtggaatgaaatgttcctactttaaatatcaagttcagtgttatgtctgtttgatatttaaaacattgataagtacattttcaaagacttacgtgcaaaaagaggaaagataaaactcgcatcagttcatttttcctttactagtaattagcagatagaaaaaaggtgctatttgtgactaatgcttagttttatgattttaaattacactctgtctccattggatgcataaataagagccctctaactacattttcctcttgctacccttccaacactaacaaggaaattagctcacacatattcaccaccctatatggttatatactttaacattcagcaaaaaattctaaattgctcacttactgagctgaatcacatagagggctgaaattcatccattaatgaattattgtattgcctgaggtctgcttagagctacctgattttagaattaatggcagaataaatcttaagaagaaggccaatatattttaattttatgcatattacctatttgagcaatatattctaacatgagtttggctgtaaatatcttattactactaagtatcaaaaggagttcagaaatattcactaatatacttcatattgcaactttaaataaaattaaaatttaatctacacttctgagaatagaataattgtcgctcatttactagaataacgcttaggagcagatgcatataatgctcataaaaccatgaaagaatagccattgaacatttaactagaattgtcaggtacaaactataaactgtaacttaaaataattttattttcttcctctaactgcagaaatagcacctaaatcaattagagagagctaagaaatttaatcttgaggaaaaaataagatttttattaaggagagaaaaatcctatattttatttttgtatttagactatttcctttacaaaacagctaaatacaacattatgataaaaatttcataggtaagccaaaatagagaatttataacatttaagctaaatcaaagcattatttatagttttcagagaaaaacaggctatcttttgatataatacaaagaaaaatctattaaaatgatttttctaaatttggtttggaagagaatgggcttaagtaacttttctgttggttgctaggaaatctaaatgatgttcttcctgaacaagcaacacaaagcgctacgttttactgcagccaaagggagatgggatggggcaggtgaatagagaggggcgggaaatgacagcaggtctcaggcaatcttcatgctgtgcccattgggaggaaggacctccaaatagaaacattatttatctttgagaggtgaagtcatggataactttttccattcattttctgttgtattttatgagttatataagttaaatgaagatttttttctagaagttctatttgattctttttcaaatctccttgatcaaaacttcttaatagtttactgggttttgcttccattttcaagtttctttattatttttctaacagctacgcattagggtaaagctagagcttcaataatgagaagcagagattgaatgacctaaggtttatatctctctcacctggtctcagtgtgaatgggctagatcaatgggacagatctcctttctgcgcccactcagagttccaagtcccaaccaagcaattgctccaccatcccctaggacatggtcaacatgtgtgtggttaaagctaggttgatgccctcctgggctccagccgagtgtgaagagacaagagggtgcattgacacatcacttctacttccattctatgtgtgagatcctgatgacacagcctcacctgattgcaaagagaactgagaaatgtggccaagctaggcagtcatccatcctacatactactactaccgtggagtaggttaaaatggactttatgagtagctacccatcacaacatgaaacgtgaagatttcataggatatgcctaatatttccaatatcaaagtctctgcaggtctgactctgctatttcttctgcttttcacttactgtgtcatgtttccctttatgtttgaggatttttgaccatgagttcatgtttatgttctatgggaatatatggttatgttctatgggaaaataattttgcaggaatgttttgaagtctgggttaaagttgcattatttcacatagggaatgtatttgcttttgcctaacaaccctaaataattttaaaaatgtatttgcttaagttctgcttgggccttataggcaagtttccttgttggtatcttccaggcagtacagtcaattccagctctcatcattctgagattgcatcccttttgggtctcaccttcattgggctctgatctttacctgccggtcacatcacatgataaagttgtcagagtggagccataatggatgggcagatgtcttggtgcccactttctttctaaattcctgttgttactaaatcttggcttctacagattccttgtttttgtgccggcttcgcaaggcatttgaaattatgggtttttaaaactgtgtatgtttgttttatatttttaaccagcattttagttttcttattggaaagaatggaatctctggtccaagatagcatcagaaatggaagttccaaatatacttttataagacaatcatgaccatgattttagagagatcatcacaagtagatgagaactagcaacgcaagcctagagttttactactgagtcttgtgtgttatatcatacacagaacttggatttcttgatctgtaaaatggggagaataataaccatattacccatgtcagtaagttatgatgatgacagaataaggaactttgcaaattcttaaacagtattgccagttggaattgagactgagaacctcacaagccacaagcataagagcatgaatatgtcaataggcaacagacatgttaaaatgcaatgatttacaaagtcgttttctgatatcttccaccggccctactcctgctgagccagccctctcattattggtttcacctgtgaaacagttctctgccactgctgacttcaccgaatatcttctttgtacttccatctgcgttttatgtgaactctggagcgattagtcgctaatatcaacattggtgcacagtctaggaacatttattgctcccctgcttggcttaatgtttctgacttggtaccataatattattaatagtcacagggtacaataaaagaaaattaagtgtttattttgtttaggctttagccactttacctacagcctttttccattacatttgcacataaatgagcatacgccacattttttagatacaaatcaggttttaactttgctaatcatatagtttcctttctggtagtcttccaggctggtttcagtgtgactccagatgcatgcatattgtagcaaatgaagaaatggccatgtggtagatgtttgcccttttgtgattcacaaatagtgtttttgaagaaaaactatatttgtaaatccactctgaacattccttttcaattccaggagcacatctttaagttttaggctgaagtccattgttcaattccagattattttctagcaaatagttgggaacaactgccatggaatatgtaatcattgaaggcatgagaactacttgaaataaaagttactagaaccaagttttagcattaaagggcccccatttctcagcatgagaagcccaaagccctgagatacttaagtgggcatccaaggccaatgcagtgagtttattccatgtttcctactttctctaccacctcctaggcaatgttcttccaaatgaagtgtttgctttgccttgaaaagacaaattaatattttacatggcaacaactctttattccttggtgggatatttccaacttgatttatatgatggtgtctaaatgcttaaaagcttttgtaaggcagggtttcaatcgattaaagaatttagttttccttgaggttcttgcatcagatattatctcagaaggcctacttcctaagatttataatccaatctcttcctcatgttaaccatacattttggtgagcatcccattggaccaagcttggggatttcagttcagcatcatcatgtggagtgactgcaaacagcacgggggagcctgcatgccccaactttccatcaacgggctctggctgtacaagacttcagtttgcttgctcactagcaatatatatgagtcctctgggcttctgggaatatctcacaggttcaaaaaacagatgattttgaacagaaagacagaaacacagtattctaagataatctgtacacatgagtccttctttattaaatcaagaacttttaccttttcacttaaaggaagtaccttatggcttctctttgacatatatgaattgccagctccttgaggatagaaatggcacctatcatagtacctaggtacaaaaatgttcagcaaacatttgctaaatgaataaataaaataaatgggctgggagtggtggctcacacctgtaatcccagccctttgggggccaaggcaggtggatcatgaggtcaggagattgagaccatcccggctaacacggtgaaacccagtctctactaaaaatacaaaaaaattagccgggtgtggtggccggtgcctgtagtcccagctactcaggaggctgagacaggagaatggtgtgaacctgggaggcagagctttcagtgagccgagatcccaccactgcactccagcctgggtgagagagtgagactccatcttaaataaataaacaaatgaataaataaatgtggaaataagttaatgaggagtagcctgagatgtgggaagaaggcagtgaggagtagaaaacttggatgccaccttgtcattgccttcagctttgtctggactgagacttcaacttaagaagagaacttgcaagtcagacactcctcatcacttgccaacgtggcatggggctctcggtgaagcttgatgtttccatctgtaacttggggccaattatagactaattgagaagatcacatgatttaagatatgtaaatacacagaatagtatctggcactgcttttgctttttttttttattattatactttaagttttagggtacatgtgcacattgtgcaggttagttacatatgtatacatgtgccatgctggtgtgctgtacccactaactcgtcatctagcattaggtgtatctcccagtgctatccctcccccctccccccaccccacaacagtccccagagtgtgatattccccttcctgtgtccatgtgatctcattgttcaattcccacctatgagtgagaatatgcggtgtttggttttctgttcttgagatagtttactgagaatgatgatttcccattttatccatgtccctacaaaggacatgaactcatcattttttatggctgcatagtattccatggtgtatatgtgccacattttcttaatccagtctatcattgttggacatttgggttggttccaagtctttgctatcgtgaataatgccgcaataaacacacgtgtgcatgtgtctttatagcagcatgatttatagtcctttgggtatatacccagtaatgggatggctgggtcaaatggtatttccagttctagatccctgaggaattgccatactgacttccacaatggttgaactagtttacagtcccaccaacagtgtaaaagtgttcctatttttccacatcctctccagcacctgttgtttcctgactttttaatgattgccattctaactggtgtgagatggtacctcattgtggttttgatttgcatttctctgatggccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagttctttagtttaatgagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagatttctacatatggctagccagttttcccagcaccatttattaaatagggaatcctttccccattgcttgtttttctcaggtttgtcaaagatcagatagttgtagatatgcggcattatttctgagggctctgttctgttccattgatctatatccctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctaaaaattaccttgggcagtatggccattttcacgatattgattcttcctacccatgagcatggaatgttcttccgtttgtttgtatcctcttttatttccttgagcagtggtttgtaattctcctggaagaagtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatgctgagactttgctgaagttgcttatcagcttaaggagattttgggctgagataatgggttttctagatatacaatcatgtcatctgcaaacagggacaatttgacttcctcttttcctaattgaataccctttatttccttctcctgcctgattgccctggccagaacttccaacattatgttgaataggagtggtgagagagggcatccctgtcttgtgccagttttcaaagggaatgcttccagtttttgcccattcagtatgatactggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagacttgcatcccagggatgaagcccacttgatcatggtggataagctttttgatgtgcagctggattcattttgccagtattttattgaggatttttgcatcaatgttcatcagggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctatggatccatctggtcctggactctttttggttggtaagctattgattattgccacaatttcagctcctgttattggtctattcagagattcaacttcttcctggtttagtcttgggagagtgtatgtgtccaggaatgtatccatttcttctagattttctagtttatttgcgtagaggtgtttgtagtattctctgatggtggtttgtatttctgtgggattggtggtgatatcccctttatcattttttattgtgtctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgtcttctgatagcttttgaatgtgtttgctcttgcttttctagttcttttaattgtgatgttagggtgtcaattttggatctttcctgctttctcttgtgggcatttagtgctgtaaatttccctctacatactgctttgaatgcatcccagagattctggtatattgtgtctttgttctagttggtttcaaagaacatttttatttctgccttcatttcgttatgtacccagtagtcattcaggagcaggttgttcagtttctatgtagttgagcggttttgagtgagattcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcggagctgagttcaattcctgggtatccttgttgactttctgtctcgttgatctgtctaatgctgacagtggggtgttaaagtctccattattaatgtgtgggaatctaagtctctttgtaggtcactcaggagttgctttatgaatcttggtgctcctgtattgggtgcatatatatttaggatagtcagctgttcttgttgaattgatccctttaccattatgtaatggccatctttgtctcttttgatctttgttggtttaaagtctgttttatcagagagtaggtttgcaacccctgcctttttttgttttccatttgcttggtagatcttcctccatccttagattttgagcctatgtgtgtctctgaacgtaagatgggtttcctgaatacagcacactgatgggtcttgactcttgatccaatttgccagtctgtgtcttttaattggagcatttagtccatttacatttaaagttaatattgttatgtgtgaatttgatcctgtcattatgatgttagctggtgattttgctcattagttgatgcagtttcttcctagtctcgatggtctttacgttttggcatgattttgcagtggctggtaccggcttttcctttccatatttagcgcttccttcaggagctcttttagggcaggcctggtggtgacaaaatctctcagcatttgcttgtctgtaaagtattttatttctcctttgcttatgaagcttagtttggctggatatgaaattctgggttgaaaattcttttctttaagaatgttgaatattggcccccactctcttctggcttgtagggtttctgccgagagatccgctgttagtcttatgggcttccctttgagggtaacccgacctttctctctggctgcccttaacattttttccttcatttcaactttggtgaatctgaaaattatgtgtcttggagttgctcttctcgaggagtatctttgtggcactctctgtatttcctgaatctgaatgttggcctaccttgctagattggggaagttctcctggataatatcctgcagcgtgttttccaacttgcttccattctccccatcactttcaggtacacccatcagatgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctacattcttcatgtagttctcgagccttggttttcagctccatcagctcctttaagcacttctctgtattggttattctagtcatacattcttctaaatttttttcaaagttttcaacttctttgcctttggtttgaatgtcctcctgtagctcagagtaatttgatcgtctgaagccttcttctctcagctcaacaaagtcattctccatccagctttgttccattgctggtgaggaactgcgttcctttggaggaggagaggtgctctgctttttagagtttccagtttttctgttctgctttttccccatctttgtggttttatctacttttggtctttgatgatggtgatgtacagatgggttttcgatgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgccggttcccagatctccagctgcgtgctgggagaaccactgctctcttcaaagctgtcagacagggacatttaagtctgcagaggttgctgctgtctttttgtttgtctgtgccctgcccccagaggtggagcctacagaggcaggcaggcctccttgagctgtggtgggctccacccagttcgagcttcctggctgctttgtttacctaatcaaggctgggcaatggcgggtgcccctcccccagcctcgctgccgccttgcagtttgatctcagactgctgtgctagtaatcagcgagactccatgggcgtaggaccctccaagccaggtgcaggatataatctcgtggtgcgccgttttttaagcctgtcggaaaagtacagtattcaggtgggagtgacccgattttccaggtgctgtccgtcacccctttctttgactaggaaagggaactccctgaccccttgcgcttcccaagtgaggcaatgcctcaccctgctttggcttgcgcatggtgcgcgcacccactgacctgcgcccactgtctggcactccctagtgagatgaacccagtacgtcagatggaaatgcagaaatcacccgtcttctgcatcgctcacgctgggagctgtagactggagctgttcctattcggccatcttggctcctccccccctgcttttgcttttatgtactgatcatcatcatcatcatcaatcatcagtcattccacaagaaactcgggattacactttttgatcctaaaaacagttcagctcaattgtcagctctttaatttttttttcaaaggttagagtcctctcaggtggcatgcaccatccttgggtgcacacccctcttttgtgggtgtgcttacctgtcatcttggcctcagcacgaacagccactttactcctgctaagtgagcggctcatatgcacttttttagactgtattggattttataaaaccttaaaattggtaatttaagtgccactagcaacttgtctttaacaggtggagagagatctggagcccatcctaggaaaaagcaaatgacatttctctcttgcgacccagtcattgcaaatttggtctgtctttgcaaggaacctagtgctagagccattgctaggttttcatatcagggggaataaaaacctgggaggggaggggggaagcaagcaggcagagggtctcaagctgtgggttggttggggtatatatacttagaaagacactgccttgggtgatctcctgataattgctttccaggaccactgatgctttggatacacagttaacatggcttcctcccaggctttatcatcataggctaaactcctcttgcatgaatctcttacctaaggtaatgttgatcagccactactcctctccccttgtcctgaccaaatgccctctactgtctctcacctcatcagggctaccactgcaatgcccaggagatgatgcaagccatccctacctcacttgaaaaattatcttactcaagtctcaaactttcacgaccatatgttatgctttagtttgacatggtcattgatcataaacttttatttatttttctttttatctcaacttagtgtcctggatgtagaaatttaattgagtaaacttctagaagcaattgttatagactaacataaaagaaaaacctgagggtaaatataaaatcatccacaatcccaccatcttaactctaatacctttaccattttaatgcagcaaatcaccccttttatatgtaattttatgtagctgtaaccagattctccttgagcctttgcctgccctaaaattctgcttgtttccatgatattataaacattattttccatatgtgagaaaaacatgttttctcacagttgtaatacaaggtttataactatcattttaatgtctgcatactgtaactttcctttagatttcttataaattatcttgtatctagtagcataagatatcaagagcatcttatgcttctagacattactgtggctttagatgcttttcatttaattatatgatgaagatcttggtgcaatggagttttggcactttgattattttgtaaggttttattattgcttctcctctcctttttaggctcccctccaccacctatcctttaaaggttggggttctcttgggtttcatgcacaagcctccttccacacgtctcttcggcccttagtaagctcatctactatcaagcaaggccttacctccccaaacattctgcagggtccgagacccatatgtactaaccctgcaaaaatgtaccatgtaatcacattaactcctcaaatattttcccaaacactaaacaataacttctcctagaagctgctctaccttctgagcagatattctcagataatggcacccctatccaccagatctgcttggttagcaacacctctaggaatcttctctctctcttctccgtatccaataggcatcaagtcctctgcagtgctgccttagaaatctctttacatgttggattgcttctcttattggcttccacatggccactgccttgatccaggcctttatcatcttgataaagatgataattgttacctggtttccatgctaaaaatttcttaccactgcaaccagtttgatcttaaacaaagctccctgattaaaaatttagttagggccgggcgcgatggctcacacctgtaatccaagcactttgggaggccaaggcgggtggatcatgaggtcaggagatcgagaccatcctggccaagatggtgaaaccccatctctactaaaaatacaaaaattagccaggcctagtggcctgtgcctgtagtcccagctactcaggaggctgaggtaggagaatcgcttgaacccgggagtcagaggttgcagtgagccgagatcgagccactgcactccagcctgggcgacagagcgagactccgtctcaaaaaaaaaaaaattaattaatttagctttttattggctacagaagtagttgtcaaagtttagcatgcctcagaataacctagaggacttgtgaaatcagagcttgctgggtattatcccccagagtttctgattcagtaggtttcatggggttgtgaggagatggacagcagagaatctgcaattctaatgagtttccaggggatactgatactgctattctgggagccatactttgaaaaccactgttctataagataatagttaagtttctaatcatatacattttgaaatcagggctcagtttatccttccagccttactttgtaaacgttgtctagtgaaaattacttttcagctattctaaaattaccaactatatgtggtttctatctgctttcaaaattacccctcgttgtatatgctgtaacttctgactgaatagcctcatatttaagtttttctttgtcaattggcaaacagtgccaattggcaagccagttactacagagctacaaattcaaacatgtatctagagcagttcaagagcaaaaatgcataaagcaggaggaaggaagaataaagagagttccatttaaagtactgtatgatccagcaaacccacaaatgggtacatatccaaaggaaatgaaattagtatgaaagaaagtgaatcagaggtatctgtgctcccatgtttattgcagcactactcccaacagacaagatagggaatcaacctaagtgtctgtcaacagatgaatggataaagaaaatgtgatatctatctatctatctatctatctatctatctatctatctatacacacacacacacacacacacgtacatacatatacacacacacaatggaatactattcagccataaaaagaaggaaatactgtcatttctacaacatagatggacctggagaacattatactaagtgaaataagccaggcatagaaagacaaataccacatgatttcacttatatgtgaaatcttaaagagttgacctcacagaagcagagagtagaatgatggttatgaggggctggtgaagctgcaaggcaaggattgaggagatattagtcgaaggacatagaatttcacttagactgcaggaataagttcaagagatctattgtgcaacatggtgaatagagttaatagtaatgtatttcatatttgaaaattgataagggaatagattttaagtgttctcatattaaaatatgggaggcaatgcatatgttaattagtttgatctagccattctacaatgttacatatataaaaacatggttatgtacaccattaaaatgtacaatttttgtagatacaaaaaataaacaaataatgaataataaataaaagggcagcctctatctctctcctactaattatcctctgagaatattgctaagtctttggaatttttcaatagaagccagaattctagggttttttttttgttgttgttgttgtttttgagacacagtcttgctctgttgcccaggctagagtgcagtggcacaatctcggctcactgcaacctctgcctcctggggtcaagtgattctcctacttcagcctcctgagtagctggaattacaggtgcgtgccaccaagcccagctaatttttgtatttttggtagagctgtggtttcaccatgcggaccaggctggtctcaaactcctgacctcgtgatccgcccgcctcagcctcccaaagtgctgggattacaggtgtgagccaccatgcccagcctagaattccagatttctaagcaaagtctccacattcttagatagtggtaatggatttcaacaaatgtaaaaccatatgctggctgaattaaacatatctgcaggctgaattcagcccaaggcccataagtttgcaactatagtgctactccttattcaagaccaagtccaataactgttcctccacacagcattcccgatgtctgccaggactcccaatgtgcacacacacatgcacaagcttagtcacactgtcctttctgttcttaaggtactgtgttaaaatttatataaaagcatgtgcttcaattaaaccatctacataaatgacatccccaacccacaactaaaggctcaagagcagaaacttagattaacttctttttttcttattttctaatgtagtatgcctatcaaatatctgttgaaggatggaagaaagatcgaataaacaaataaaggtaaactctattagaaaatagcaggcgatatcttattccatacatcttaacttccctttgtatggatttcctcagtgacatgttagatttttcacaatgaaacagtcaaattttagccatgctttccacagatgtacagaaaaatgttagtccaagctaatataaacactggaaggatttagatcaagcagcattattttaacctgtctttcaagagaaaaatgatggaatgattcatgacagtgactaaaggcatcaatattctcttatcataactccaggtaagctttcacatacatgcaattaatcacagcattataaatgggaaaaggtatgtgtcaacccaagaatcagctgtctcctacctatttaatccaaagaaacccaacaaaaacaaaaagcagaacagcaagaacaaaaaatcagttctgtactgtgccagacaaagaagaagtcaaaccagaagattcttccttatcctccatccatgtctcttttttattcctgaagttgtccagcctcacagttctgcatgtgatttgaaagcagttaaatagaaagttaaaagttttcgaattaattttaacagaggttttgttgagccctgaagggtctttcctaagaagaaaatgttattgtcaatggtgcccttcaatttatactttctgtcttaataaaactggttgcagagtgtgcaatgcaaagtcaggttgcctttcatcttttactaagcattaaagcattgaggaaaggaaaaaacactttaagataattgcaattttcttcaattatataatataacttcataacctgtaagggttttcattaaccaaggttcatcaattctaatcgggctgccctcgcattggagaggcccataccagtgtaattaaagctgccgattctgctgacagcattcttcagtttccagggcccttatcattgatggataagtcatcgagcagcatgtgatggccctacatattgccttcctgccttcacttttcaggagagaagctaatctccatgcttttaatttactcttcatacattcttcccctagagccaatgatattaatcagtgttttaaaagaaagaaattaggcaaaattatgttttaaaatgtttaaatagagccatctgtcttcggttctccttccccctttctcgtggaataggcttcatgctcttatagcacattgatttttatatcatggattaatattttctttaggaaaatacatctgatttcccggatcctctaacataaagtacctaaatcaataaggtagttacagatgatgctgttataattacctcttttctttcagaacagcttctcatcatgagttagatgtgagattggaatgcatgccatggtcccttatttgaaatgacccaggctaccacaacagaaccaagcctgcagaggtctggctctgaacaaccttttctcacacatccgcttttgttggtcagtctcaatactttctccaaaagcactattttaatcatgatactcccttatggagaaacttaaggttggattaaactatcctagtcagcaattaaacactttctccaaagtcattgtgctacgagactctaattttacttccttagaagagcaaaaaggagtgaggaacattgaccttgagcccaggcgttctggcctagtggtctgccttcatcagagctggttgctcctgctgtaggttcaaggtcaatgaactctgactattgctttcagcttgccattggagagctgtatcctccctttgataaaatcttcttggctgacttattttcagcttgaacattctgctctatctgctccaggaagacagatctgcttttggtgccctgcccatgacttacatatcttccacttagttacaagacagcctccttttcctcaggggatctgttccaagaccttcagtggatgcctgaaacctcaagtagaacccaaccctatatacactatgttttttcctacacatacacacccatgatagagtttaatttataaattagataccacaagagattaacagtaactactaataaaatagaacaattataaccatatactgcaataaaagttatgtgaatgtggtctctctcactctcaaaatatcttactgtactgtactcatcatttttttcttcttgtgatgatgtgataacttaggctactaagtgactcatgggtgtgtggcatattcagtgtggacctgctggatgaagggatgatgcacatcctgggcaggatggtgcaggtcagcatgagattttttcaggctactcagaaaggtgtgcaatttaaaacctatgaattatttatttctggattttccctttactattttcagaccatggttgatagtaattgacactgcagaaagcaaaactgaggataagaggggactgctgtgctgagatttatatgacattcatccagcagtattttttataaacactcttattattccattgcacctggatccacatcaagcctttaaaaaacagaggaaaactaaggactccctcatgaagaactaaatcttcaaaatctggtttcaaactcactttctcttttagatattgttctctatcacagtgaatctcacctggttccaatcatgccagcaagtccactgccctttactgacagcagcagtgacttttgcaatattactgatatttctaatacctattcctgacacatttctttgcacttttcctagcaaccccatttgataatgaacttcttaagggcaatgatctttgttttctttgaaacttcttccaacaggtgcaagaggaaccctggatttggagtcagtaactccaacatttactagcactgggatcttgaaccttcctagaaatctctggaagactcagtttattatcattacatggggacaatcatgtctcctgccctgacacctcgataggcagggctgtgggtaaagatcgaatcaattatagtccaccagggcactttgtaaacagccaaggctcatgcagatgctataacacttatgctgaataaattttgctaacagaaaaactagccaagatttatgacgaaacatacaggatagtgatttcactacccttaccctagtcaactgcgatgcatttcaaatgtttcatctcttttctatcaccttgaaaaagccagagtcttaaacccaaatatgtaaggatcagggagtcactagaaatgtgtaaagaatacctcgcacaagataagacactaaagcatgctggggacagtgacaaaatgaaaagtccatgtcttgtctaaagcagaaagctggcactagatccgcccaattgtcaccctgaagaaaggtgagccaactatttcaagggaaactgcaatccatatttttataagtgaaatacctagatgtttaaattgttggcctttaatttggttattaaaataaatgtgtagtgttcaaatatatcattaatggatatgccccatgtgtcacaagggtttgcaactttggctcaagatttttaacatctgagtttgtatgaacaatcagcaagtgttcttcagctccagtaaaaactaactctggaccaagtttttgggggctgttaaaaagaagtataaggcatcatgcctgcatcgaaggagaggaattaataattattatgtgcctaacatttattcagttactttacatacttaatcagtttactttaacataatccttatgaatttataaggtgattactgttacaatcactttgctaacgaagtaaccaaggttgcttgcccaggagcatgtgacataactggtaagtagtggagcaataatgttaactcagttctggttattgtcaaaactgatgtttctccaccatggaagggaacatttcaaagtagccagaaaagagaacttgaaatatttctaatgcacagaaatgataaatgctccaggtgatggatgccctaatataccctgacttgcatatacattctatgcatgtaacaaaatatcacatgtacttcataaatatgtacaaacagtatgtatcaacaaaaatagaacaaaactatcacagatccatttagtggagaccaaatttagtgaaaatcagttgtctttctgctttattgcagtacaagggaataaataaaagatgatgaacccagaacagaatcaaaagaatcaaagacccacagaataatcgaaatttatgctggatggtggtgacactttgataagacattagaaaaagatataaactggtgaggaatatgtcactctgagaaacttagtggaggatatgggcattgggttagggttatttaggatttgttttctttttcctttttttttttttttttgagacagagtcccactctgtcacccaggctggaatacagtggcatgatctctgctcactgctacctccacctcctgggtttaagcaattctcctgcctcagcctcctgagtagctgggattacaggcatgtaccaccatgcccggctaatttttgtatttttagtagagatggggtttcgccgtgttggccatactggtgttgaactcctgacctctagtggtccacccacctcggcctcccaaagtgctgggattacacgtgtgagccaccacacctggcctagggaattagaatttggataaatagaggatggtagggggaacagcataaatgagagactgagtggatatgagtaccttaccaggtagtaatatagttctgctttctcctcccctttcccttctaacaaacacactccagcttctgtgaaggagtatctgttggttttgcttggctccatgttctcccagcttttggtaacagcacccttcctgtttttcctttggggaactgtcctgccatcattctgtcctggggtttctctgatcctgtgcatagagcctcctgtacgaggtcacactcacatattcagaatctggaagtgagaaagtgtttactctacagaagcaacacaggcctaatggtgtctcttcaatcccttgggtagacaattctactcttcagaaggtaccagacagattgaccctcagttgcccacagccatggctgattcaacaatgcacctttgcatgggcttctcctccttctctaattcactcttgctcatctcctactcctactccgtggattcacttcccaaatgaactgcgtgttccaagcttttgaattatgccctgcctgggaaaaactctggttaaggcagttgttcgtgacaagattcccaaactgtcctgccatccagcattcccaaagccggattgctcaagtcaaagcaagatagctttgactctgctattgacctatcctctactattctaaaaatttcaccacttcacttttatcagctggtgtccatttctgtttcttgccaccaaaaaacccgaactgatttatgactctatttcaaatagacctatatcataccattggataatagaagaaaagttctgtacacatactaataaaaaaatctcactaaatgtcagtgtggctattgctttggatggcaagaaattctgaaacatctgacagtattattaaacggctcttgaaaaacaaacattatggatgggctgcacagtcatctggcagtgattcacggtgtttctgccaatgcccacacctggcatgatgaagtgttggaacccagcatttccttcataaccacctgggccttgaaggctaagattatatatgatttttaaatttgtgcaaatctataggatgtgtgataagatttttacatgtatttaatgtggagagatcaagtcagggcatttagggtgtccatctcccaagcacaacacattttttaagacttttaagttcagtatacaggtttgttgcacacataaacttgtgtcatgggggtttgttgtacagactattttgtcacccaggtattaagcctagtacccattagttattttttcctgatcctctccctcctcccatcctccaccctccgataggccccagtgtgtgttgttcccctctttgcgtccatgtgttctcatcatttagctcccacttataagtgagaacatgcggtatctggttttctgttcctgtgttagtttgctaaggataatggtctccagctccatccatgtgcctgcaaaggacatgatctcattcttttttatgcctccatagtatttcatggtgtgtatgtaccacattttctttatccagtctatcaatgatggtcatttaggttgattccgtgtctttgcttataatacatattttaaagtatagtaacactactctgctatcaaacattgaattataccttcaatcttactatatatttgtacactttaacccacttctcttcacccaccctctcctctaactcatgctagccagtctctgatctatctttccactctttacctccttatgttcacgttttttaatcttccacaaacatgctatatttctttatgtatgtgcatggcttatttcactcaagataataactttcagttctcatccatgttgctgcaaatgacatgattttattatttctaatgggtgaatagtattacattgtgtatatatataaaattttcctttttttttctttttctttttctttttttttgagtcatgcactgacactcaggctggagtgcaatggtgtgatctcggctcactgcaacctccacctcttgggatcaagcaattctcctgcctcagcttcccgagtaactgggactacaggcatgtgccacctcacccagctaattttttatattttagtagagatgtggtttcaccatgttgcccaaagtggtctcaaactccttagctcaggcaagctgcctgccttggcctcccagtgtcctaggattacaggtatgagccattcatctggccccaaattttctttattcattaattcactgatggatacttaagtggattccatatttttgctattttgactaattctgcaatgaacatgtgagtgcaattatttctctaatatattgatttctttccctttgggtagatatacagttgtgagattgctggatcaaatcataattctagttctagatttttgagaaatctccatactgtttttcatggtggctttactagtttgtgttcccaccaacagtgtaatagagttcccttttctctgaatccttaccaacatctgttatttttttttctttttaataacttctctattactctaacccaccaactcattgaaatcgttgtctttttttgtctctcatgtaaggaccactcctgtgatacagttttctcttttccaggtgagaaactatagaaccgatgcaaaaattaaacttatatctcatttttccatgacattgtttgcccactaaatcatacagctttccattgccactttaattaaatgggttagattcatactgagttcaagtatttttaacattcctttatctatctatctatctagctattgtccttcttcttatctatcatctgtttttctatcatttatcattctatctactaagtagctccaaatacacaagtatatccctgaaaagtggccatttttctaaaatctgcatcccaaattgcaaatggaaaaatctacattattatggtgcatctggtccttgttaattcttaatctgttgtatcttttactgtcatgatttcaccagatgtgcaagtctatctcacaagttaatattttacataaactactctaaagaattgttgaaacaaagttgagactccttggctcccaacactctctccatacaggagcagtctaagtctagctgaccaaaagccaagaagatcataaaaatccactgacttagaaacttgcaaatgagtccaagattctccccaccctccttgggtgtgtgtgttttaccctctgttgggtttacaaaagaaaagatgctcaggataatccagaattttattaaagattaatacgtttttgagaactttgctaatactctgcaaaaaaaaaggggggggggctttttctctcttaaaatagaattcagaacaacgggctttcttttaaacaatgggttcaaaaatagaacttgccatttggaaaccttcttgagattttctagaacagtggcttcccaaagtagctgatcattagaatcgctcaggggacttttaataaaaatgaagattgcatggtctccccccatatctattgaagcagaatttctggcaagttggaccaaatttcctgggtgatcctgatattcagccaggtttgaaaaccatggctagaatgtggagttggaacattaaatactatctaagcagttaacattttagtgcctgtggttataattttattctattaatttcctttggatttatgttttggaagtgaagcctggatggggaatcatttggctattattttgtccaaatccctcattttgaaaaagctctttgaaaagcttaaaaaggcccttgcatgatggatttgcccaccagtgtctagatcctttattgctgtagtgactgttgctcttctatcagaactgcacctctaagagcatgaagacaggcctgaggggaagatggaaagttatttctatcttggctgaatcctcaggattgagtcagaaaactggagaggaccagcagaaaccatctggtccagtccttgtcttcatgtggttatgatttgcttctaggaatttcaaagcagagagagtccactgctggtgtttcaagatcccgatagtgagtaagttcttccctagagccacctggtgttgctcacaagccggcatgtcctgattcccaatgcaggggaaacgatgccatttcccatccctttctaatttattccctagaactaagaagctacacatagaacaacatgacaagatggattaatcctaatacaagttaaacatccctaatcccaaaatccaaaatccaaaattaaaaagtttttgagcaccaacatgatgccacaagtggaaaattccacacctgacacctttgcttttctaatagttcaatgtacacaaatgttgcttcatgcacaaaattatttaaaatactatataaaattaccttcaggctgtgtgtataaggtgtatgtgaaatataaatgaagttgggtcccatcccaagatatctcatgatgtatatacaaatattctaaaatcaaaaaaaaattgaaatctgaaagacttctgttttccagcattttggataaaggatactcgaccagtatgaccatggtataatgacaaccctagactaagtcaagaaatctagatggtagtcccagcactgacactaacagaatatgcaaaatcaggctaatcattaatatttttgtggcttagtttcctcatctgcaaacgaaagaagtcaaaccctttctggcttgatgtagtatatgcctatcattccatcattcatttacttggccatcaaggcccttcaatgtgccttaatgaggtcagtgctcagtaaaagtagggaatgagacaaatatgtcccgtgaccacaaagatattatatttataaagaaaatggacaaataagaaacaaacattggtatgtaattacgtttatatcttttctgcaaaagaaaaggaaaatgttgagacagtcaccatttaggctagagtctttcctccccccgacagcacgcctggccctctaattccctaaaatgtggaacaacagatggcccatgcattccaagaattctctaaatggactgatttacccattagcatgaaactgatcaatcttattagattttggcagcttctagatgaccatatttatgaggaagtgtccaagtttgctggcagaactatatatcttccaagaaaactaatagggtctccaaactttagagtctaaagagatatggccctagtgtcagtattatcacttggctaggaactagtgacaaggtcaaaatcagaaactgaagtcatcgatcggcacatcagcttcacatagaaaaagtgtttcatggccacaaaatgaactattaactcagcccttcacccaagtgtgtgttggttacaaaggaacccaatattatatggataactcacttaaatatatcactagtgatggaaaacatcttctgtagcattttatttgctgcatactgggggtggggaggagggtgtcagtccagtattaatcaactctactaacaagctgtttctttacactgaggcaacacttgtaactttccagtatgtctttgggtcagttgcatagatgatacatgcaacaacactatgaggcagatgggatgatgtattgtatcacatgcccatctgaaaggataaactatggcctaagaggattgagtgaatccctctccagtcatgtagttaattggaaaatgtgtgcacgcactgcctcccacccatctccccaagtccctgtctataccaaaggactgcttatgtaaacacggatagtgacaaagtccacaaagaatatattacatggaggagaaaacacggaatagatcacacagaagagaacagagcacagttggtctctgctcactctgtataatccattgcattctttctcagaaagccaagttgccagtgactatactaaatgctgaagtaggtagacatcacatgcctttttccgcttatttgtttttaaagaagaaaggtcttaggttagacacttcagttctttgttcaattgcatttgagatatttcactgttgttgttgtttatcagcaacagtggctgcatcgtcattttcactattcctttgggatgaaatctcaaacccccatgcagtgaggctagttgtgtgacagtgatgacaagcacttgttccatcacctgaagtaccttcttggcaatccctcctatacctacctgtgatttaaagtaggaaagcccttaaacatacagtctgaaacagaattggaaattacagatggtttagcattcaacacatgtgaatcacagaaatcagttcagtcagctgaatttacctcattagattatcagaaattttgactctgtgacagcttgagtggtgaacgtctacaaatattttttttctctcagcaattttgcagaaggccaagattttgatgtaactaaatagtgtcaggcattatgaggagctgtttgtttttgttctcataaaaacaattagtaagctattccctagaatcattgatggacaccagttcattcaacgggtcattgtatttcctgtaattcagtcttcccacactttttcataagagctgtcattggctgggaccttctttgagggaaacaagccctgaaagaaacaatgactccagcttgtatgaatcgcaccctggaaaactcagcccagcacactgcaggagtaaaaggcagtgcccagccctgtgtctttgaaagactggctcaaaaatagcccggacattttcctgtttggagaactcagtaacagctgttcatagcccacatttctttcataccctccccagccacaaagaaaatacaaattcacactagctgtaggaatggacgttattcaacattcgtgtgccttcaaaaatagcacaggaagagttatagacacaatggagggaaaaatgaggaaaactcaggaggagtagagagactagggaggagatgcttttaaacaatgagaaacttaaaataagcaggaaggcaaaaaagaaagggcaggatttgaaaagtctacctctgagaaatgatagggtggtgtgaaaagggcactgtagtgggagctgtaaaagtcaagaatgttgttggctctgctgctaattagttgtgttttctagagcataccccttaccgtctccaggccactaccatagaatggtcagggggtggaggcaatagagattaagcggtctctaaaaattcatcctgattctaaaaatgtcacattgtatgaaagtatagaatgtggttattaggcaggggggagttgggagaaacactggatataccctccatgtatttatgtatcagtcccctggagaagggcattcagtggtctgaagatgaggaaaaaagaaacacacccagcttcatggccacttccttcccctatcctagaatagctgcctgagaggatggtgagaaagtggtcttacccaccccaggctacagcagtagcacccagaaagacgtaaagtccagttctcaaagacccacgaccaccaaatttcccctgtctttcatggagtcccctgtaggttcttgccaaggatcacaaattcaagatggcagagtgcatgggctccaacagaagccatttagcatgtaggtaaaaagtcaggtactgagccagacagaactgcattttcactttaacagaactgcattttcactttattgagggtttgatctgtgacctttggtatataccttaatctctccctgaacttaatttttaaaatatttctcaaatggagacagaaatgcagttatgaattttaaatgtagttgtcaaagtgcatagcacagattaagtgcttaatatacatattatctattattattgttaatgttatattcatggaatgctttacttagcttggagaagtgttttttgtttgattttctcaggtcccttgacctcctgaatcaccatatcatctttgatgaaaagcaaacaaaacaaccaaatcagaagacctctagcaagggctggtcaaagggcttccaacaagtgctggtggctgttgatcagacattgactagagctctatcaagcatggaaaaatcagccttaaatccctaatgtagaccaattagtgagtaaatctcaacattttaaactgggattccaattttatagttagagctccctagggcaacaaacgcacatttttccatccagtctaggcatatggagtgtttcccttacccctcccttcagaaaaaggggcaggctgagtacagtggcactttgggaggcaaggcaggaggactgctcgagcccaggagtttgagaccagcctgggcaacatagggagaccccatctctaccaaattaaatttgggaggctaaggtgggcggatcatgaggtcaagagatcaagacggccaacacggtgaaaccccttctctactaaaaatacaaaaattagccgggcatggtggcacgcacctatagtctcagctacttggaaggctgaggcaggagaatcacttgaatccgggatgtggaggttacagtgagctgagattgtgccactgcactccagtgggtgacaaagcaagactccatctcaaaaaataaaaaataaatttaaaataattgctgggcatagtggtgcatgcctgtggtcccagctacttggggagctaaggcaggaggatcatttgagactaggagtttgaggctgcagtgtgccatgatcgtgccactgcactccagcctgagccacagagggagactcaatctcagaaaaagtcggcaggtagttaagggggacatagtacatctccattttggcaatctcataggaagataagatgttttatttggttcttctgcatttgaactgtgctgagaaattagttaacaaaaagaaactataggcatacatacttatctgaaatgaggaacctaacacacaatgtcagccttttctgcagacacaggggttagataatctgaaagggccccatgggacaaatcatcctgagtgagaggagactctgagggactatttgatattcaggcagacagagattcaaaaatgtgtttcataggggatctttcttagcagaagtcggagaatacacagtcatccattcagaaggattcatgtgagtttctgtatggaagcaaggctttgatagaatggtattttaggggcaatttttacttctaacacacattgatgtagtcttcttacagcaaaatagaatcataggatttttaagtggcactaaacttatacaatcttccattgaaccccttcattttatttgtccaggtaactacttgactgtattttaaagtaaaccctgaatgacctaaatcttcgtgcaataaaatcacaatacaatacatgagagttctgtttgtttgtgtgtttgtatttgtttttgtggagcactcagtcaatctggctaaatgcccaaggccctggacattggaccattccatttgaaatggacacggtgacagaaatgtacctaaggaccttccaaggacaacagaacacacaggaacacaaaggttccaactaagtggtagaaactgtgataaccaactctgtaaatctatggatcagatttcacaccaggaactagctgggctctaaaggggagatttccagggcaccaggcaaaggtggttgtggagagggctgaggggaaataggctcaggatgctgacagaacaggggccacaggatctccaagacagaatcccagttctacaaatggtcagggaacaacccttggcatcttttcattttcaacataatttcctgaatatccaaatgaggagtactcatgacagagccctccctctgcccagcatcaacggctataaccctggaattgggtacagcccaagtgttgagcaaccctcactctcatttcctgagtggagtctggtccccagccaggccaagtgtggtccatggagagtagttacggcgatgctagtttttctagatcctttagggaacacccacctattcccaggtgattccaaagctgatccagaaaagcaacacatacaaatcctaccaaccctgtttttagatttcttacttctactgacggagcagttaagacctgccctgtggtaacaatgttatgtggagaaaagtacaagagtatcaccaaggttatgattaaatcccagagcatctctaaacaaatgaagcttaaggaaagacaagaacagaatagggcaaaggcaaaagatcccacctaaaattcaaaacactatctctatttctgcacggtcagcataatggtgaaaaggtcccaagctgagggatgaggatgtgatcagaagcaaagtcaagtgaggacactgggataggaggcacctcatgggcaatcactgagcacacacccatattttcatagtgctggacagaacgaggcagacccaggctgctaggtccaggaaaacagaactgacacaattgactacaagtttttccaaggaagtgttcatttttagccaagttttctttgtggactccagctctggctgtttgctttgtatttgccaagtttataatgtaagttttatgatttctgttaagaggagtaagtttccctcaaggagagatctaaagtaggtaagcctgcttacttttccaaaagaaccagaggaaacttcagggaaatgctaagctgtggaaacaggagaagaaaagaatttggatgtaagagacagagaagatgagaaattctcaaagtgatctcacattcatctatgagttcatactcctatcattcaatagtcatcaattcattcattcatgtgttcaataaatatttcttgggcttttatggtttgccatgttaggcatcagagaatgggcaatacagctgctcttgagcttgccaccttgtgtaagagatggataatacacacgtaaataaataggaatgtaatgtccgggaatgaccattgttctgaatccaactatcacaggaagtggggttcttgatggcccagcatgagctacttctaataaggtggtcagggaaggctgtctgggagggtggtggagcagagaggttaagacctgcctcatggtaacaatgttgtgtgcagagaggtccaacagcgtcaccaaggttatgattaaatccaagatcacctctaagcaaacgtaggctagggaaagacaggaacagcagagggcaatgggaaaagaccctatctaaaattcaaaacaccatctctattcttctgatattctatatgttaacagatagaatattactcctttcccagaatacatcagaatagatctgttcttctccatccctatgaagtgagggagggagttttgacaagacgtgaaggaatagccagcttttctgctaaggagatgggagcatagttgaagggccataagatgaccaaagtgactaaagccacatgggcagagctgagatggaggcaagagacagtagtcacttcccgcagagaccgttaggtcaggagttcagcatattgtttgccacatataggtctgtaatttgtttatttctgttgacagaagcttgtgaaaatatgtatttctttgcaataaatctgtgtataaatgtccttcacgcatttttactactcatatggtaaacagggctttttccatttcttctctatgttaccttctccaggagctcctgcccctgcaagctcttctgtaaggccttcccagccactccaggccagcatgcttgctcccatctctgatgcatctcccatcctgcccccaatccctgctctacctgtatcctatgccatatctagttagtgtgtgtgtgtgtgtgtgtgtgtgttaaggtctatcttgtcaccaaagaagctcccggtgaaaatacgggctttggagtcaagaaagatttgccccacccactaattcagccccaccattcaccacataagtgaaattagtttctcagcctcaattgtaaaatggggatgacaacattggtaccttacagtatagttgtaaagaagatgtagtatatgaagacagtgtttgggaacaggagtgaggccagcaggtctgtgggttcttgcggaaagcgggactgtgcctgtgattttcagttctatttcatagcaccttataacacaacgcttcctgtgcgtggtctctgaagggagcacaacacactccaaaaatcgctggatctggaacgatcagaaatagattcccttctaggttctgtctctaactagttatatgaccaagaaccaaagtaatttaattattccaagcctcagtttcctcatctataaaataggcatgattatgccaatctcacagggatgttagatatataacctgtgagattgtatatggaaagaagaaagcattttctgttctaaaattctgatcctgtgatttttcaactcttgttgatctaatataaaatccaattacatgaatccacaatttatttaacaaggaattcatagactcagtgcttcagtacctttctctgacaactccttcctggactggaagaccagggagtggtgaaagccatcttgctgttgcccagaacagaagtcacaaggggagggccagtgtttaaggtacatgtgactcaacacatggctatcagaaaacaatgtatttctttccaagatgaaggtcattaacaacctctgcactggcaaacctgacaaattactctgtatttatttcagcctcagatcttctacctgaaacagttcaagtgacattaaaaatatctcactaagtggcagtgtaaaattgggtgtagctagggaaggtcactgtgccctaacagactcgctcagcgactttatgcaattctaaatgtactctggccttgacagaatttacattttgctgttacacttcagtgtgttttagagagagccagatgtataacagttgacaggcatgcatgtcaatacaacaggtccataaagcaggaagaagatgggcatagggaaaaggtagctgataaataacaattaccattagccagtgactaaatactaataccttcatactattctttttcaagactatcacgtaaccctcaccatgactttggcaagcatatgaaaactggtaatagtttgggtcctactaaaatattctgtaactcaatctgtaggtaccacgggagtaaagaattttgtttactgatgtgtctcaaacactgagaacagtgtctggcacatagtatgtacttaacaaatattgaaacaaaacccaaaaaggaatgaataaatgagaatcctgttttgagtttccctgcttaattccaggttcattttatatcacagttgcaaagcagtttgtgtttagtcatcgtcatctacacaattaaacatggttcactagttagtttataaagctaatgtttccatttgcttatagtacacagaagagtgatacattagaatgggcaatgccatctcaagaaagaagagtgagcaggctggttaaatgatgtgacaaagatcaggcagaaaaaatagtgacaaaaggagcacctggaaggcccaaggccagctgctccctggctctccatcacccaagggcacttatcactctgtgggaggaaattaggcaaagggagagaggtcaagactttcttgcttgtccaagaaatcattctgacatcaggaaagtttgggtttgtgagaaaaagttggtagccctttaacttgatctatgtggaactcatgctttggcctttttgttcagagacagtgccgttgcactgatgcagcatctggaattgggagtaagaggcccatatgggacccctttccatttctgttttaccatttgcctctgcaatttgagacagacccttcattgtaccttaagtgttcattctcatatagccaaaaaccatacaggcttaccaacaacactgctatcaaggcctaatttctgtcttatacaaaaccttgggcttagggctttacctttacctttgttcaccaagatatctcagtttttttctctcctaatgaccttctcctctgcatttccatgtcattgcctcagctccaccttttcttgagtcttccctaaacaaacagaagtacttcccagccagtttcaatgtctcaagtcctgcatcccttcaatccattttccatacttctgtctgtacaccaaaaataaatttctaagcctcctaaccaagtgaatgagccccctcttagccaagagcattccaaagtaaacctgaaactcgacttcaggccatgatgagaaggtgcggtcagacatgcctcattataccctcctctctatggaaatcgggtacaactaaccagccttaacattaaagcagggatgttaagactgataaaatagactttttatagcaataagacacccagttccagcctagctctggtatagccatacatgtcagagagcaggcaccaaaagaaattattttaccccaaaatatatttttgacatactttgaaatggccctgcaaagtagaggaaaatctacattttgtcgagaatccccttccctttccaggtcttttccctgatccaagagagaactgactaagagtctggcatcttttaaggtatgataagagctctgaagcctgctacctggaagcttcatctgcacaacaaaaccttggtctccacaaccccttatcttaacccagaaattcctttctattggttccaggtctttagataataactttttcaaccaactgccaatcagaaaatctttgaatccacctatgatctaaaagcctccagtttgagttgtcctgcctttctggactgaaccaacatacatcttacatgtattgattgatgtcttatatctccataaaatgtataaaaccaagctgtagcctgaccatttgggcccatgttctcaggatctcctgggactatgtcacagtccatttctcactcatttttggctcagaataaacctctgtaaatattttacagagtttgacctgttgcctcgagacttccaccctacacgcgattccaaaaggcaatcttgattgcataggaaaaccagttgcttagcacagaaacacactgacgcttagtgcagtaggcacagggactgtgtacagatctacacatgcagaataaactggaaaccagccattacctccctcaaaccattgttagactcatccaagatttgtgaagtccagcgacagagcagctccttcagttactgcaactactgtttcatgacagccagtttttgaaggactgtagtcactcaggcacacaaaaagctccgaactactgaataacaggatgatatagaaggattcagtccagagacatgtctgtggagggggaaggtggaagattaactagtcatacctaggaataaacctgctaactcatctgggtagtgtaaatagtagatctgggtagaattaccagctgaaaattacattttaaatatactaatagtaaaatatttccttgctggttactctcaggcaaaattttatgcctgcctcatatagtgtcaggatgtctcaaaatctaaattaaattaaacaacacacttgctttgacagatcatgtgtttattcagaagtttattcaagccaggagcatgcacaaaatctgacagtattcaaggttataaatttttttaaaccactgtttcagtcaaatgtatctaattaaatgcttttggagatgatgatgttagtaaaccaggtcaactttttgacattatttacagacatgcagacgttacttgcttaacaaatcagcccttgaatcttcttgagtccctgattgattacgaagggattacaaagaaaataaaatcttgcagaaaaagggaaaccctcctcacctaagaaactgttaaccctgtaggtgatacatgggcacctctgggacaaaatcctgagctacttgttcatttcttactgaaaattacctttctgaaagttccatttctcattatcctttatggtcagttccagtccaacatctttttcaaagtctgctgagtccttcagctcatgttcatctcccttcccttggccatttataggacgaattttttattcctcttgattttgcatgtaacttatatattatcaagacagaaaatgcatctcataaaacttaggactgtaccaaccacatagcaactactacaaaaatgcttttggagctttgtggcaacttcacattgactagaactgtgattcttaaggtgtgagctctagcccaccagcatgggtatcagcaacttgttagaaatgcgaattcatggcctcactcagatctgctgaatcagaaactctggggttagagccagtaatctgtgttttaatgagtctttcaggtgattctgatgtatttatatgctcaagctggagaactactgtactgggaaaattggcatctattcggaaaaacttgaccacctatgagagccactgaggctcttataatagattcagagttgttttattaaaaaaaacttcccaagtatatttgcaaagaagtgtttcttgcaaaaagtaggcaccataagattagacatctgaggaaaacaataacaacaaaacaggaaaatgtttctctaacaaagcaacacagatgatatttccagttatcaggagaattacttagcacttactgtcagcacaaccacagcctcctgaattaattcatattctgggctgaatgaacgtgcaaagcttattcccatggaaactgagcactatacagattgatagggttatagagcatataactgagctaaagcaattgccaattttaaaagattagcattgacaatttaatgcaacacatttatttcccaaatatcaggagtgtctcatctacattcaaggataaaggactgtcaaaatttgatttaagaaaaaataaaaagccctactacaacacagcttatcatcttttgagcttgggccaaaatgaggcagaagctctgttttcttaatactcccttaattacaaggagactgtttttaacattggtattaaatgggttgctatggcttcctgcctgagagttcagcatgccaagtttcagtcaggagcaagctatgaatgggctgaataagatcctcacaaataggtttcacagcccaaattcctaccacagagcatcccattaggaagattcctgggaggtaacagggagctgacaatggtgctgcctcccttcactttccaagacattccttctatggcttctcactaatcgccttgtcctataggatccttgtcctgtgtaacagaaagctgcttcaaacagaagcggatctgctgcctgctgcttccaagcacagaaaccatgtggcagtttgtttagtcctccaataggtttgtttgttccttgggcaatttcagcgttctcaaattttatatatgactgtgaccagaagggaagaaggcaaacaagaagttcaaagcagagttaaccatgcttagatacaggcccctgtctttggtaaacaatgcagaaaaaactactggggattttatctctgtgttctcaaagatagaaagaaccccaggtaacacaacccgcaatggtgaaaatgagcaaatgcagtccccagagccatgcgtatgtctaatatctattcagatatccaacaagccttctggcttcaaaattctccactcctctgatcttgtagcttctcatagggaccaagcctttgaaatttcatgctaggttttagtgatttcggtttttgtgaggaaaaaaagatatccataaggaacatatgcccgacatttgtggctgtttttgtaaaagcttagcctttgagagctgtggctactgtgttgaagagcaagctctggtcgtttccagagcttcatcattcagaagttagggtcagagcaaactgctgcaaaaggctggggaggggacccagacatgttcctggattcctttcaggatatttacatttacatgcagttaggcaggatgtgtatgagggagaaatagagggagcagagtaaaagtgggaaagaaagaaaggatgaaaagggaggaggaagggaaagaatgagaaaaacggaaggaaggaaggaaggaaggaaggaaggaaggaaggaaggaaggaaggcaggcaggcaggcaggcaggcaggcaggcagccaagaagaaaagggcggcagggaggaagggagggagggagggaaggagaaaagaggaatggtagggagacagggagaagggaaaaatgggaaaaaagaaaagataaatatgtacaacttttatgcatccataaaaataaagaaagaaaaaaaaagaaaagagagacgcggagggagagagggagagaaagaagagtaaacacagcaaagacatactgtaaaagaaggaagtgattttcaccatgtctttcattcagctgtgctgacctgcaggtgtagagaaggtgaaggagtttgtactctttctccaagaagtgatcaactcacacctggcagtttgacacaattacctcacaagctttaatactcattatcttggcttccacagatacaattgttttatggctccaagaataatgcactcctttcggaaatccagcagtcatgcctgggttggcgacctcctgaatcaaggaactgctaactggcaatactgagttctaatacaggtggccaacccaagacaatttactttgcatggggagtaggtggctatgtaatactgtgaagttaccagtaacatttcaattctggactgcggctgccagatataaatggctttatcattttgtttgtgattttgcagatgtggttaaagtcacacaaaggctcataccaaaggaatatgagctgttttttggtttgagacccagtaccaaattggtaaaatgagccagctttcagtaagaagtttttattatgtggacatgagataaatatttaacttgcaaagcttacttgcacgttaaacgtctatcacagaaaagggaaatacccaagtctttctgtctcagtcatctgtgggttctaaaaatgcacaaactagatggaacatcataaacacattttcaaaaggccatgcaaaaaaaccaacaccaggtggacacatcttcttgccacctcatcagcgggcataccacataaaccagaccagactcaatgctgaagaaaagtgacataaaagtctaagtgttcttttttgttttttgttttttgtttttttgagatggagtctagctctgtcgcccaggttggagtgcagcagcacaatcttggctcactgcaacctcagcctcccgggttcaagtgattctcctgcatcagcctcccgagtaggtgggattacaggcacccatgaccacgcacagctaatttttgtatttttagtagagacggggtttcaccatgtaggccagactagtctcgaactcctgacctcatgatccgcccacctcggcctcccaaagtgctgggattacaggcgtgagccaccgcgcctggccccagtgttctcattttgcaaattctttgatttttcagaaatgaatggatcccaacttgtttctgacacaacaccatttttcaaatagtttctctgattattcacaaggatttagaagagcaagcactgtaaacacttccaagtctgggcttgattacctagaaatgtatctagaatgcattctatcatttaatctaaaatctgagtcatcttgaggggaaaacacagaatcttataaaaaggataaactgcttttaagaacgtggatgtctgattttggatttgcaaagcaatgccaattacaagtgatctatttgtttggaaaaacacactgaggataaattctattagtaattaattcaacaataatatgaatttgaaaagatgcatgctccgctctctaaaaaagaaatcagtcagaaagtctacctcaaatctgccaaatcaatgaggttttatccctctgaagttcacagaattgtaacttttgacaaactttaccttctaacttacaactcaagcgtgctcatcacaccagagacactgctccaataacacgtgtctttctgctgcagcattttggaaaactgaagacttctgagggacaaagcacatgggaggtctgctaaccagacatggcaataattaatctcaaataccaaaattacaactgtaatgaccacgtcctaaagaggcaacagtggcctcagcaaaacagcacccctaaattgattgtaaagttaacagagcagctttgggcaaagtggggagttcaaacattaaagtaggattacaaattaattttttaaatttatcttgacacacttgaaagaaatttaagcaaatatctcatttttagacagcagtataaacaatctatattgaattttcttcaggatcatctttatacgtaagtttattgggatagtgatgtacttgtgacagatttctttccctataaaatatctctcttcactaataactgatgcctgcaattccatcatagacatttccattattccttacttaaatacaacacagggaaggggtccctatgcttgattaatccttgtaacaccatctctacagctgtactgggaacactttgatggctggaaccttgtgttttccttcttcgttagtattccctgcaggacctcatcctgtgctaggcgcttgataccacagaatcattcagctccaaggaactggacagatcgctgggctccgtcctttgattacaaagacaagaaggtacagctgaaactcagaagaaaactgagacttctctggagtgactcagccaattagtgacaaacctgggaccagacgtgtggagcccatagacagaaaaatttacccgtcaagcatttactgagctctgctgtgcactgggcattgtactataagctgaggacatggaatgataactacaaatacattgtcctgcagaagcttgtgatctaaatgagttggctagactcatacaccaatgatcacagcaaatctacctaagtgccattataaaattgagtccttaattagccctgttgattcaatctagggaagcttagcaattgagacatagaaatgatttcttttggaagatttcacctaaaaaaaagtactggaacttagattccacagacaggtctttagctgagattccagcaatttcgagttaactttactaatcagaatattttatttgcatttatagatgtgaatgaagagctcatacattttagtcatatactcaaaattaaagtcgtgttcattcatttttcagtcaatgtgttagttaggtgtgtatacaaagaatgcagacagaaatcctgatttgattcgttcttctgttcggatctaactagttaatattaacaagagctaagctattaacttttctaaaggattaatttgtacattctcttggatgatggtgaatctcattcaagtgagaaaccttactctattcaatttttcatgaattctctcaaataattggtttcaagaaatagcactacacaacatcttatcattttctagtcctcctgggaattcctaaatcatgtgacaaggacactaatcacaaaattcaacagggaagtggtagtaacatgaaatactcaacatgtagtctttgctttataggagcctccaggctccgtagatccttgagtgtccgttcgcctcgcttgctgtgataatttcccgtgactgctactttggtgatccttatataagcccagaagaaagtcttgggtttccccagtatctcaagactccacctctgtccctgtctggctagtttgctcatatctgcatctggtttatatgtgcctctactcaaatcttctagatttatctagtttcagagatagggaagaaatgccatgcttggcttgtgatctgacatgacagtgaccctttgctacctcttctccatgcagacgttatgggccatgggttcttttttactctgtacctccacacgaatggtggctgatttccaaggggctgaaagagtggagagaacattggatcaaaggcagccctctagtgtgtgtggtggtggtgtttgatgacttttctccttcctttggccaaatacaatagatagatagatatggatatagaaatatagatatctcactgcttgtcctgagattcatcccagtcttaaaatctattcagtcttctaccctctttcctctgtatgccatatgtctacatcatatccttgatattcataaaaggtcaaagcagataaagactcaggacccagccctccctcatgccgtgagcctctgtgccttccaccccggtgactcccacaggggcacacaccacagctatgacagaagcactgcagacttttcaagaaaaacgcattttaaagaatagtaatagtttcaagattttaatagaagcacagtacttcggaaatgaggcgttcaatgaacgtgtgatgaatgaaagaatgaatgaatgaatgagtggcaagcttccaagtgtgcctggggagtgaggtggctccctgcagaggagggacttggatggaagttggcccctttcccttgctctatgttgcgatggtaggcatctgaaacgatcctaggtcacatccagttgggtgagcctacttctggcatctgagagtggacagaaacaatttcagctctcaggggtgagccagtttaggtgagccagttaggttaatcaagagtgtgtatggtttatccacagcacttactggaatagagctttacttggtagtaaacccagtcccaccagcaacaacccttggtttttatcttattatagtgactgttattcatttcttcctttactcagtcattcatggaacaccttggaatgctcctttctgctcaactgtactgggggtataactgtgaacgagtcaaagctcctgttcccatttaagttctcaaatgatcacagttcttactgttctggagtatgacttttaactttctcaaacaattgcttttggctcttgcctcatctgatccttatataagcccagaagaaaacagaggctcagaagaggttaaagattttgagggtagcacatggctaattagtagcagagctgggtctttttttatgacatggagagctatacatagtttctattagccagtttcattttcctttcaacagaagccctgcagcaacacacttatcaacatgggcagtgatctttggttggaccttctctgggcaaaggactttggacaccaaatatgctttctgtaacaaccactacacccaattttccaatttttcatggggatccggtaaccatataggaaaaaggaggaaccatcttcctgctcctattatactaagactcatcctacttaattcctcatttaaaacaagaacttttgttatttccaaacaatattcaattaccaaagagtttctctggattaattgcaggacgtcactctcctttaggatagagcacattgtccatcagccccaccaaatcagtcaagagtgaagaaggaagatattgccagggaggaaccaaggcctaggagccctagctgtcactctcctcctcctcctctgaatagaaactccctctgggcacaagaacgggctctccaagaccttcagggctcctgggaaaagtgcttaaatccacaataccctctgtgatctgttttccatttgcagagggaaaaaaaaagtctaatgttggaggtttagctccatgggaaactacaactgcaaattgaatttttgaaaattaaatccaatttaaaatgcattaaaaactatttaaagcaatcttctggtgagtccttggttatatgaggaatctttctgggaagaagaaaaggcaatccctggtgtatctgttgtataaatctgggtttacaccaatagaatcttcttaaaacaaggtttgggggcctgaactgcaaaggggtgaaggctgacttggacaaactgattccatttatgtccagccttccaggtgacatactatagctcagtttagcacttaaaaattaactttaattctagaatttctgtaccattcagcacatgcatttaaggtagcaatgtaccagagctgaggattaggcccaaattagaagcaggctgaaaatactataagagaaccctgatgtttctgcctgattcaagttacactgacttccaatcatgcattttatcttttggcatgcttatgtaggtggccaataaatgttacctttggtgataataaaacaaaagccaaactttcataagctagaatatccaaaagaccattgtctgcattcttggcagcagccagatagccagttttcccaagtcagcagcctctgaggaggctggcgaggggccagttcccagggttggtgcattcctggggcctggcaagaggccactgggaccctgtttcctctttccttctctctatgtagtggaaaaatgttcccattttgacccctctgagtcttttttccccctatcggagcaaaggcagtcagatgggaaatgttccccagttcccccccaaaactcatctcccactgctctaagctggcagagcttaaagcaattgaaggcataagacaaacaaaggagggttcctcaggccagtcatccagcctgattctatcaggagcatggtgcctggagcaaggagaaccagcgggaccttgtgcacagggagtcattgtacctgtgcttggaagactatgggcacttctggaagcttttggaataaaattacctgttataaatagacactggctgggtttcagggttgagagcaagaggccaagatttccagaaaaatagaatgctccatataagagggtctggtgtacagctcattaataggggactgctgagcaattgaactaagaagaaaggaatttgaggttggtcagacatgacctgtagtaaacacctgggtaaacatttctggcagataacatcatggatatgctattccacttttaaacatcatatatatatatatgtaaaccaaacattaataaaaatcttttctgaatgcttccttccatgtacagacaaagaaagctgccatctggaacggccacatcagctggtccacatgtttccagggtagagaagtctgcatgccaggcatggtactgcatgccctatttgtgttgtgagtcctttccctaaattcactcaacaaccctttgaataagagacgatcacctctactaatagatgagaacacggaggctcagagaaggcaggtgacatggccaaactcacacaggcagtaggaggcaggttgggattcaaatccagttcagcctcattctccagccaactcatgctctctccactgcattacagggcatctatttccactgtgccctttaaaattagtgctttgcacacagcaagttcttaatacagctttcttcctgaggctgccactgctacttctatatttgatagaaattttggagtttagcagataggagctgcaccgctctcgtcataacaatgtatttcctttgcatagggtgccacagcctccaaaacaattccttgttctttatttcacttaatgacaacatccctcatcatagtgtcccaccattgaagacacagatattcagagagtttaagaaatgtgctaaaggccacacatctaccaaacatttcaactccagctctagtctaaggacttacgcagttctaatgcagtgatcgatccactagaccaccctccctgcacctcagcatcacacaacttttatcaggactgttgaagagaacaccatgtcactggttacatggaacttgtgttctgaaggtgccacatcaaattgtctggtgaaaccaaattgacaagtccaagggaatagactggaaaacaacacacaaaaatctatttcaaataaaatattaaaaatgggctagtgttttctcagcccagaaatgtgagaagagatggtggcagagtatattattttatagagtcaatgtgctggatacactcgtttggcctctccaaatctacccttcacccttccctgccctggtctgggcccagagcactctatgggccccattccctctggcttccaattgggttcagccagtggaggcaccaacaggggacaagacagtgtgaggagaatgaagtgggagtgttcacgtcccgatccccttgctgcagggccagcacggttggccatatccctccacctaagtggcatttcccgccaaatggttcactccttatagccacatggttctatagccactttctaggcctagtggcaatgactccccactgtttctagctgcaggaggctccattattatcttgttgcactttctatatcctgccaccccttttaaagaggccctttattaaactctcctccagtacctggcatgagtgtgcaatgtgtctccttcccagactttgatgcagtaaacaataaaacaatattactgattttgtctttgtagacaaatgatgggaagttactcaaatcctctaagaggatgagaaaggctaactactttagaccaggctctctctttcagtcacttccttctcaccacacctcaccaaacagaaattaggtcagatatcctgcctcagggacctaccaaactgggcccaggagatctccacatagctacctaccacacccacagtctagcccggagtctactccgggaggaaggcaggacaccactggcctcatcccagtctgtctagttggtgccttcacagatttcactctcagcgttcaccaacccaagctggatcactgccagcctcatggccactccatctccaaaaacggcaggcctctgcaaacagctcctcctcacagaaagggcaacagcccttgagcctacttatctgccggctctgacagatggaccccagaattcaccaaaccaaatgattttatttccctctacacatctatgtgcatgagagcagtcaacgaattaattgcattaggaaacctaccaagctgaaaacaactgcttaaaaccaagaaccaaaaaggtgcggaaagacagaaggcaagcaaacctcaggggcatattcggaaatggacaattatgatccattaagcctggttaagaaactgaaatttatgaggaagaaacatctggaactgcctggcatgtaaagaaaccaggaggaaccactttttgggcttagagggagcaggccagacaaataggattccatgttaggagagaattgcaaaattagtgtataaaaggacagaatggaggcagtgcctctggtgttaactgaagcgtttgaatatgatggctcctggatttccttttgaaatattaattgaaattgggctggagatgagggctgcatgaaaactggcagaaagatcataaatactggttaaagtgagccagaggaatggaacatggcaatgcaacacgaagtaatgagaaatactgctccattcatggccatgaaccctatggatgtctaataaatattaattgataaaaatgaactatactgctgagtggtaaattagtgtaagaaacctaggctgctgaaatacagctaatatatatacagtttgtacagcatacaccgatcaatgaatgagaagaaaagatatgaaaatgatttagctatgtgatgcattttgccttgcaccaggaattaggggtaagagaatgttaatagaggagtcaggaggggtggtcagagggggcaagaggaaagttaggacaataattcaagattatagtagaccttgcttagggtcttggcaatttctcatgtataagccaggcaccctggagtcacaccccattcttttagacactgtggctttctcaataaatttctgcttcagggaactcaaggacaccatagattaaatttggaccaatttattggaggaagatatgacagccctcctccttggggaagccctcgctgatcaatgtagccagaagaacaacttcctctttgtaaccccatcagccttgttgtttgcaccactgtatacctcctggtattctgaatagtgtatatgtgacaagattttttttaaagctttgcaaagcagaaatcatagtttacatttcttagcactcatttcactgtgtttcagaccaagtaggtactccattcctgtgctgatcaatgagaaactcgaaaaagaagagcaggctcttatcagagagaacacccagatgcctgttaggtttgggaccagcttctaaggggatcgatgaaagctctacctcctgttatggacaaagcactagagagtctgccatgggaacgatcctaggctgccagagaatgatgcggaaaactcagttgccatggaaacttgtatgatctgatgattcccattgttgaaagatggtgagacaacaggagaatgacaaacagatcttggagccctaagaacacatggaacatgccaagcaaacatctctactcatttgtacttatttctgctatagaagcagtctcatttcatcatctgtcaataacatagcatttataaaaggctttcaaaatgtgtccagttcctgtttttatgtagtgatctcagcgacaacaaggatgcacagaactacctctgatgctggcagacaacacttatcacagcagctgaatacagctgaatgaaacaggtgtcacccgagctcctgctccatgactccagcaagggaagccatccatgggcagatgctatggtcagcactaatggcacgtgaagctacctaacaatttttgcatcacagattcctgtgagaatctaattatacctacagactcactccccagaaaaatgtacaaatgcatataacataaaatatatcaaagaattcaaagccctggaagtcttttcataaatctcccctatcaagcaccttgggactcaagagaatccaggacaccatattaataatctctgatgtaaaacaaacaaacaaaaaactttacacacacacactagaatcatccttgggcaaacctgaagagcagcatgccatttcctctctccaaccttcccaaacagcaccctgggcctgctgcatgtgggccccctttatcccatattcagcacccccatgactgtgtatttggttcataagcagctgctcactgctaagttcactcactcattcattcattttactgagctttttctatgtgtcagactttaggaatacaatgtgaatatgacatggcccatgccctcaggaaacctacagtcaggggtgatttttcttctcagggaacataatggccatgtctggagacagttttcattgtcacaatgagggaggggtgctcctggcatccaatgggtagaagccaggtatcccaataaacgtcctacaatacacaggacagcgcccatgacaaagaatgatcaggtccaaactgtcgatagtgtcgaggctgggaaaccctgttctagagcacactggcctgtgggaatgtgaaaaggccagaagtaggtattatgccagctcaggaaggggcgtgttcataagaactccggaacatgtggcttcgatgacagcctgccttcttttcagagatgaaaggaaggagagaaggaagcaaaggagccattcagagtgagtaacaaccacaatgaaggtggatcctccttcaggcagtgtcagaggaggcaggaccaattgcaagtgctgggcagacaaatggcatttcttccagaatctcctcaggggaaatgctgctgaccctctactcacctccatcagtcagtggcccagcagagggaatgtgcagccatttgataggaccatcactcaagtcataaaccccactgcatgctgggggacggctagatgctggaggtgccccatcgctcaccaggttctccctactcttctcccattctagtcaataactccaccttgtacatgaacacgccataatcagttctcatatgaataaaaacacaaaattgtatatatatgggtatgtgtgtacacacacacatgcacgtacacacacacactattataaatcgcaatctcttctaaagttggttccaaggtctggttcatcagaaaatcacaagatcagaaaatagacctagacctacattctacattccttataagtctccccttcccacctccattcctttgtcaattgttttgctgaaaccaagtctggcttccctctgatctagactgttctaaactgcaggctcctcagtgggcacagatacagcagacgtgctaatgcacatggtctagtcctgttgaggtagctgatgctctttcacattgtgaagcaccgtgaaggagctcccagtcactggcataaagcaattttctgcttcagagctgttagctgtgcagatgcattgtagtctggggatagccccagacctaaagtgaaatcccaactctacctcttaccagttccattgccttgaggaagttgatgaacttgttaagcttcagatttctcatttgtaaaataggggtaattagagttcctaccttaaagggttgttgttaaatattaaatggtagtttccatataaagtattgagcagcatgcctagcctatattaagcctccataaatttcagctactattactaagggaaggaagccatcctggttgagacttaatgcatgattcactaagtgaacatgctgagctgtctgctaaagtggctttgatgttcgattctgccatcctcattgctgacatgctctatgtccactgcttggacctagtctacttccgtcctccattcagactgtccccagcaccagtgttgctgcagatctccaatggccctccaagacttttcgtgttaggatctgatctcttcccactcttttggggctccctcaagacttgcagcaagtagcacctgtgggtggtgccctcctggcccagcctcccctgcctcctcctagctcatctgctcccagctccatccatgggacccggagatctgcactgttggagaacaggtgggcagggcacctctcctgcatttctgtacctgcagtgatgggctgagctcggctggtggacagattcactgggtagatacttgtctaagggtctgacacgtctctaactccacctccacccactctcaagagggcacagtcaatatttcagcgtgacattttggaaaggttgctaaaccaggccaaagctagtctattccccaccagttacttttctcctaaaaatggccttcactagatcctcagatgtcacgccatcttctgatacctggctcaggccatggtctctattctaagtacatgtaagagacacagaaataatagacaagttaggggaaatgaggcagttggaggaaaagaaaaactccctcttgttctttggccctccctgacttgatgctcatttgggaaatctcaaaaccatcttgatatcagagaacaaagatcaggcttcccagaggacaacttggcaggttcccagtggccaggggcacagggcaaacggtactttatgtactcttccatcagtagacatggtcaaagggactgagattagactagctggaaaccttctataggaagctggtgttttgggctctgtgcagtatccctatggtaagaggaggtctaacaagagaaccatgagagtcaagaaagatccagtcatatctgaagcagtacagaataaagacttttgttttcttagtattcataacccactagctgtaggctgtactgagcaacaccagcaatacctctattttgcatttagaaaaagtatccgcaaggctgaacatactctatgtcaatattttctaaatatttagaaaaatgccttctaaatatttttctactattcttcctactggggtatatgtacctttgataacagcctaaacctgttcctctgcctgcccgcatatcacatatactgagggtaaatacaaatcactacttagaaaatcagcacccaggaaacgtaaaacaggactttcaaaattcccattgctctaatgcatgcggatagccattacaatccagcctagtgcctgtctttgtaattaaagtgtttttgtaaataaaatagctacatttgatcatgtgtcttcagaggcagctctcttcctacaacaaaggtgagcagttgtaactactcacgtggcctgcagagcctgaaatatttactatctggaactttatagaaagagtttgctgattcctgcttcagaattacatctagtcactaaatagaggggaaataactgaagataaacagcagagatttaaattcaatatgaggaagaagtttccctgggagaaaaaattcagtaatgacatgaattggcaccaaaggatgcaggaccaatatccttgggttgcctcttttttctctactctcagtctgcagttaccaaattccctctgacgcttcaaactacagctcccccatggcccctccatgtagttgcacagctccaactaccgcttccccatggcccctcctcacatcttcccagagtgacctcagcatctactactgtcagtgccacacagttcatttccatgtgatgatatttttcctgcttattaggacagcttccctagataaactagaagcacttgaggaagcctatccccctgtatcagccagggagaccttccaggaaagagatggcacactcaaagcatctaactgaggagagtttggtaaagggactgtttactgaattgtggacagagctaagtcaaaccaacaaaagatgggctaacaacaaccaagaaccattactatgaagaatcgttaaggtatgggaaaagaaaaggtgccagaacatagatagagcagtggttctaactatagctggagttctggggagagggttgtccaacaaaagctgcaactttaggcaaaggtgcccagttcctgtggtccatgaccaagcagggtgagagtgggagaacaaacacctcgacctctgatctcctgctaggagacaagtaggacctctttctcccattggctaaacccaaccagatgccaaaaggcaagtccatgtggtgcatcctccagggatgattggccaggtagagaaggaaaaagagtggatctggagggaaaatggaaaccatccagcacatccccatagctggttttcaatagtgcttgttgactgattgtgttatgaatgttgtggaagtcttgattactataacgatttggatacaaacagtcaagaggctgaaggttgaattcagggatgtgtgcacgtcctttttttcctctacaagcttataaaactatactgctgtcggaactgaggatttagtgtggcagtgtggcaaacgttttttcttccttttgtgggggagaagaaaagagggtaccaggaagaaattcatactgttactctcatctgtgcttaaaagctaaatgtatttcccaaaaattaaaaagagaatgtttgttacttaaatgtgagctggtaagaaagataactcatgctccagcatgctcatcagctaaatactaccacagctacaagtgtcaaacagctacatgggcagcccgggaatgagtcttgcaaataaaagagcacagtgtgaaatgatgactttttctgatcaaaaagcaccctgggaagggctgaacagttttgggtcaagaagaggactcgatttctggggtgatttttatcgttatcagagagtagactgtacttgccgtgaacgtatatacggctactccgcacactcctactggtggaggcaaacttgtagtcacttgtctttctctctgggcctttaacccccacaatgaaacatatttttcatttcagtttcacttacgtatcactttctcctttaaaagggtgaataataaagtaaaaaaatcaccatcaatgaatatttcagtgtgttaccagggcacacacacatggacatgtatatgtgtgcacacacatacactcaaaccctcccccatgccacgtgactaaggaccacaaacttgttttccccaattggagcttttttcagtttttggactgtgagtttctttattctgtgattcctccagtctaaaaatgtaaaagccattgtaagggagctataatttctactcaacacttcaatgatttgattatataaaataaaaagtgtaatgaagttaatagcaccttattcttgcaatacattatgagaatattttcctgtaaaatctgaaagtggaaattacctctgggccccctaactctcaaaaatatgtgtcatgacgattattgcaatggaattttaagacttaagaacgtaatatgtttctctttcctctattcagtttcccacaaggacatcttctgttcctgggatagtatataatgaaagataaagaacttaagtgacaggttgttctacttttggtgtaatcctagcgtgtgagctcaggaagagcagataacctctctgggccttaagcagtctgcaaagtgaggagacgagataaccgattttcactttagcattctagattcaaaaaataaaataaaaagcatgcattgggaatgaaaactgtactgtaatgccaggtttgttgttcttgttgttttcttgtatttcacagcagcccttatctagaatcttccctacctgcttcttgcctagtaatttgtgtggcttcagcataaagctgaagaagagggcaacatcttgagttcagatccctcacaggccaggcatctttgatctcatccctggtctagctttctttctgatacttggaattcattcaaggtgctttcaatggttcccattcccaaagaatcaactcaaaaagaatactctagctgctattctcccagaagtagcatcttatttgaagaagagaacataatactataaccgggggcaaaattgtagtaacttggcctaagtgctataatgttgaaaagcatttaagcacccccctacacactgtgataggaaaggacatcctttttcagaattttcccaatctgggcatgcagatgtaacacagtctgcctctaggaaacaaggaaaagatttcactagtgtaaaagctctcctaagcatgacacagggagacttaacaggattaagtctctcaggtggtgccaaacaagttctcattttcacagcgttcttctatgccagcaagtcaagaaacatatttgcagccctcaacaagtttcagggtacagccatatgccagaaagaatgcaagctcaatttagggttttcagctagactggtaatgtgacaggattttacttatgcccattttcaagctatctttaggcaaaatttaaatatgagcattgacactgtttccctttttccgatctgcaagtacctacgatccccattgggggttactcacgtccccctgccctgtcttgtcctgccctatccctgccttcgcagctatctgggctctgccttcttctattttaccaattcccacaacaaaattctgctcatcggtttgacatttggcagtgatccaaggccatttattaatgagtgctactatgaattattgaaagacaatagcttattatgtttaactttatagggtatttgcataaaacttgagatctgaggcagaaatctatggctttggggaccaaccaataccgatgatatttctgggttaagagaatctttcttgagctgctcacatcataccctacggctgtctctgtccttagcctaggcctaagacagaccctattggcatgctgatatgtaaaaagtgtttttcttctgcaaaggagaggctgagaaattatctctttatcccaggtttccccagaagttgaaaagggaatacacatacatatacacacagagacacacacacagacacccagacacactcacacaccaatgtcaccacgttcaacctggagttagcaagacgtaggaggtgagatggggtcagatctacggagaggagaacctgaaatacaccaaagttggcctctaaaggtatgctggtcaatgcacagaccaaatagacacagacattgattctgactaaggagagaagaacttgacataaatgcttaacacaatcctcttctcaagtcccagaaactcacatctatgaataatttgtgaggcagagcctcagccgctaagaggtaaataactaatctgtccgtgacagagcaagacctacagctgcaaagtttgaaaggtataacggataaatcaaaccaacaaatagttcattgaacccccactctgctagactccaggacaggtgctgagcatatacaagtgaataaagcacatccctataaaatgtgcacaaggaaccaagctaaatctctatttcagaaagtttgctttctatttcaagtttgcttgatttgattccttgctctgttcacacgcattgcgtaacagaaaaggtgacccacacatgttggcccagagactgcagaagaatagccaaccatcagacttagtctaaagtgaattagtctgtttcactggactaagcagattttcacaccggatagcaaacccaaccaggttgttaagaataatattcatcagcattaaaactctcagaaagttagtttacagacaactgaactaatgcacatacctaagaaggtctccaagacttcctctgctcttcaatatttgaacctgtattgaattcttgttcaacttacccccaaggttaagataaatgggggatggaacaactatacgtaggcttagcatttggcatcagctatacagtagtgtttttgtataggctgaagtctacatcagttgtaattaatgtaattatatataatgttgacagattatgacatttgcctattaagacactatacaaacattccaataatttgctggcttttgagtttgtaaaaaataaatgaaacaaaatctcaagggatgttgctaatggtgtaactggaagagaggtttcaaaagcacagcgttcaggaaataacagtcaaagaataatgcattcaaagccaaaacatatagagtggtaaatgaatatttagtacttaccacaagactgctgtctagagacagcctttttccaaagtcccttttctcaagctgtctctttccctccatggatgaagttatttattttcttttgtgacttataagaatcccccgtctgtttccagggtcactgaaaagagtgaacatgtgttttactatccaagtacacagtgtttagacctttgtttttaactctctaaccagaaacaagcattgaagtcaaaaaatacccagtcccaaataataagtatagaactaggctctctctactcaaaagaccactccgtgttacaaatgtcagagttgtctttatggcggcccctgtgtttttataggttttgctaatggagttggggaatgggtttgcaggttgaatcagcagactgtagaaaaaagcaaacagtccgtttcatgccacacttgctccacacccgtcctctctctatcagccagaataattctgttactgtgcacatagatgctgtctgcaaattccatgagatcaaaccgacaaaaccacgctctataaccaagagttattgagctcaaggcccaatgaagggaaactgaaacatgaacattgtttaatttaaaaaatatgtaatttaaaaatatttgaggaacattgtaagatacattcctttggggatagattgattcaaaatgaatggtgggtgatgtcattactgtcaatgagtatttatagaacccactgtatttttaccatattagatatagttcatccctgaactccactgagattgctttttctagaatgattaagtattctggttaataaggattcatcatatatgttaagtgccagcttccaattttcacaaagatgtaaaaggcttgaaataaaagaaatgggttacagtaaaggattttttttttttttttttttttttttttgggatggaatctcgctctgtcacccaggctggagtacagtggcacgatctcagctcactgcaagctccgcctccctggttcacgccattctcctgcctcagcctcccgagtagctgggactacaggcgcctgccaccatgccaggctgattttttgtatttttagtagagacagggtttcaccgtgttagccaggatggtctcgatctcctgagctcatgatctgcctgcctcggcctcccaaagtactgggattacaggcatgagccaccgcgcctggcccagtccaggatttcttatccactagccaagtgaccttggacaagtcatttaacctctcagaaactcatttttctcaactacaaaacatgatgatagcaatcaaatgatgtatgggaatatgatttggatgccataaattacaactcatatgtaagttataattacccacagattacatttaaaaacagttaacctgaaatatgagtcaatataattcaatatatccttgatgattcagaaggtgctttgagatatagaaattgctcataatccttgtaaataaacatagacattgtactgctgatgcagaagagatgaaatacaatgctataccaattaactttttaatataattggaaagaaatatgttccacaactctcaattgctccaagcctgacatggatcaaacaggcaggatttcatggcccacaggatgtgggctgtctctcttggttttcctcatcaagagggttgagacagtggtgcctgagatggggaatgcccaaactatagtcaatcatgagaaactgatgggctcatattccagcttaggcttcctcctccatcttagtcattttatctcttactttcaagaacactaatttttaatacatcactggtccactcagaaactcttaagagttcaatcagaatttaggataaaatccaaagttttcaatatcattttctaaaattctaggcagtatttttcagaaaagaagttagttctgtatactgctataggcatgaccactagtcaactgaaatttgtttgggaggctgccttttctactttcagctgttcctgcctactttgtagcattctccctctcccccagtctcagtgactgtaaacactggtagttcagaacaccctctgcagtgatgaaccagctagagactactctgaccctcatatttccctctccaccaaaaacacaccctcctaagtcttgatcccaaagagcatgggagtttgatagctcataatagattgtgctttggcctttagcacatatgcattgagtgcctactgtacagaagacagtaggaataccctaggaatactgtatggaaaacaatccttacatgttagtgacacagtcatgtacaagaaaaacaaagtccccgcctttgtggaactcatattttagtgaggcatatagaaaacaagcaaacaaacagctctaaactgtggtaggtacagtatgaaggaaataacctccagcaggtggtgccaaagtgccaagcggccgggcacggtggctcacacctgtcatcccagcactttgggagactgaggcaggcggatcacgaagtcaaaagatcgagaccatcctggccaacatggtgaaaccccatctctactaaaaataaaaaaaaaaaattagctgggcatggtggtgagcacctgtagtcccagctactcaggaggctgaggcaggagaattgcttgaacctaggaggcggaggttgcggtgagccaagatcgcgccactgcactccagcctggctggctacagagcgagactccatctcaaaatataaaaataaaaataaaaagagagagaggacccatttcttaggaagaaaatagccaggaagagaatgcgtgaaaaaagtcctgagttacaggcaaaaactacagaggcttgtaagctaatgtatctctctcagctcttatgctaaacacaaaggttaatcttaggttttaaattccctaccttactccctactagcaggtaacattcaacaaattatttaacctatttaagcttccactgcttactctatatgacagcattgataataggaccttcttcatagtagggttttctgatgattaatgagacaagccattgaaatagttaggctggggacagatacaggtaggtaagacttaaatattagatatattgatcatcccttctggcaaatatgattaaactcattaaaagcaactctagctactgaactttatgctccttcacaggcagatgaggctgtcattttgggaaatggggatccttttgatagttctcaaatagtccaatctgcctatgtggaaagctgatttaacagctttccaaatggatttggtccatttcttttcatattaatggtaccaataatataggcagatataatattcaaatgatttagcaacaatatggcataagggttggccaatcataaacgtacagtccaatcagggctgacaatggcaacaagcggtacagttagagcagtgtatcctagccaattcccagcctaactacatgtactggccccactccaagaaggtgaaaatttgtgagttagaccataaaacaatcatggaaaggttcagagtaaatttatccaagtggatcaaaggaagactatctaaaagaaacaaaatggcaaccaggatgcagcaatatgaaaaggaacctgattaacaatgaaaatatcagaaaggctgaaacattccattgatcgcactattgggaaaagactacatacatacagcagagactgcagatccaggggggaaatgagtatatcatatcctaaagatgcctgggattacctgggccatttgtaccatccatctaactcaactaattcagagactagtgtcatcaagtaaccttccaattttatttaattcctatgcagtatcacttatagaagaagaatgtgctgaccagcaaatatcagtagacaatcttttgaaaaactacatttctagtgcaaactaaaaatgacagtttgacatcttactctttatatttattatttacctatttggttagcatattagtcagcttgagctgtcataacagaataacacagactgagcggattacacaacagacgtttattttctcatagttctggaggctacaagtccaagatcaagtgctagcagagttagtttctggtgaggcctctctccttgtcttgcagatggacatcttctcactgtgtcctcacatggcctttgctttgtgtgtgcacatccccatgtctcttcctctaaggacaccagttgtagcacgttagagccccacacttatgacctaatttaaccttaattacctccttaaatgccctatctccaaatacagtcacattgggagttaggggttcaacatatgaaatttgcaggagacatggttcagtccataacagttattttcagtcaggtttcaaatcacatctgagtgttctattaatcaaattcctaagtctaaaaaactaagggaaacctccgagtagtggggcttatggtggctacctccagactccacacctctctgcttgttatgtgactgttggatcttactgccccctttccacctcaccttgccctgctgtactcttctctgtattgtgcatgtacagatgcaaacatgatcaagacttcttggtcagtgtgttaatgttgaattctgctaatgggaggcagtgagaggagattagaaggcaatgggaaagaagaagccattctgcttccagctctagcagaacagcatcaacagcaggtgactgcaggctccagcaacttctgtgattcctccaatagatcagctaagaaagggcaccagcaatgccccagtctgtgggtaccgccaccttatccctctggctcctccagccctttcaacaccatcataaaaattccttgcattaaatccctctttgcttgaaacatctacagtaatttcctttttctaggcttgacaatgtttgatgtgcaccccatggagatgcctttggaaaggcagcaagccttccttgggaaatacctggatttgttattgtcagtcttctgaaataatagtctggaattattttctaataaatactaagcctctagaggacagagagagcattttatgttctgtgttcccctaggtagtataacacctaatgcatagcacatgaagaacatttgttgcttgcataaataaatgaatgaatgttcacagctgtctttgtgaacatataaagagcagggcaaaaatacaattttgtttagcaaagtaatactagacacatttacaagagtgaggttgctttttagccaagcatattcggatacacccaagcctcaaagaaaacattttgtcatgattttgaaatgtcatcaacctaaaatctatttacctgcacctacaaagagccataaccgagtagtgttaatgtcttttctatgtcttccaacatctctggttataaaagaatacatatattcctcagagcaatgggttggaggcctctccttccctccgtggggaagaaaacggtcatggagttgaaagaagacaggaaattaagcatccttttattgactgatagttattgatactaatcttcccttccccctcacatacacccatctctagctagtgaaactacttctactcagtatctgtagaaatctaagttggccttaataactcttttttttttttcaattttttctcacagttagtaatggccttttcatgctagacagatttttaacctttctaaagatgtcagtaaattctattttctgatatacttcgttaacaggctgtataattttcaagagagtaacaaaaccgcaccattgaataaaatctcaaaggcatatcccctcacatacacacagtcacacacacacacacacacacacacatactcactcactcagacacacacacctgatctagacaccactttctccatctcaatttctgcctttctgattctgccacttcccatccctgctttcatatattaatggtattgccagaagaaatgcagaaaaacagtaatgccaaaagggctctcttgcttaggcattagaagatttggttcctagctttctttgccatgtaaatttgagtagattcctaacttctctgagtttacattttttatgcttttctcaccaggtcattgtgaggtttcaatgagataatgccccagcaagcttttccacatctaaattcaagatgttttccggtcagcttcgttaagcaacaaacaatgcaaaatataattttttgcagcctcataaacatcccgagaacagagactgtgtcaaattcattgttatattccctgcagcatccaacgcaccagctcccacacggtaggcatgcaaagaataactgcagagtagagcacatcaaggacaaataacaaacacagtaagtttcctgtcgttgacaaggcagctccatgggttttcaccctggttgtaccttagaataacctggggaactgttaaaaaacatatcaatgcctaggtcccaccagatcacttgaatctctggggtataggctgcagggatcagagtaaaaacagccagggttggcaaccatcagttaagagcagtggctgtcaagctttgccgcatgttagatggagtcacctggggagtcattaaggcccatccctagatggaataaatcaagatctctgggggtgggaaccaaacattattattttaagattcttcaatatttccaaggtgcagtcaatggaacaccagtttaggaaggtgaagatgtcagtcttttcttgatctccgtcctcttctcaaaggctgagggacacatgattgttggtagcagcaactacctttccttagccaccatacccaacaatttttaatctgcaaaccctgaccccaaagaaaagaaatgttagatacaaacaatttggataaatacctttatccgtatctccactctcaggctcatcattcaaaattaagctgcttaagctgatccttcttttcattaagaaaacattgttgactaaaggtagaaatattaaatctagattccaagttaatgtacgtatatcataaaacctcagagtgaggtcttcacgtagagtttcagggaaagaacttcaaatggcaagcccaatgttgcagaaaaccatgactcagatgcccccaaacccacgacctcctttcttcccactgctctccatgtgcacctagctctcttttcaaagtgctaccaaatagaatgtttgaaactccagtcctctttgtattgaaatctttttattctgatttattaagtccatagaaaggaaagcactggctttctgtatgctttaaacacgtacctacagcagtctcattttggaagatatatcagctcaataactttctcctattgatacagctatttgtggtataaatgggtaagggtgtgtttgtgcatgcttatgtgtatgtgtgtatgtgttgagtctgcatctgtgcatgtgtgttcatgtgtgtatgagcatgtgtgtacatgcgcatgagtatatgagtgtatgtgtgcatgtgtgtgtgtattcacatgcactctgacaacaaaaccacccccacacagaaaagtgttgtgtccattttgaatatgagtataaaaacatgccaaatgatgtaattttcaaccataaaaattttttaaaatcctaccagccccctgaaactgatttagaagaagattaaatgctaacaaatttcccaaatgtggtattcatccttgccagataaattagtggctggaaatagtctcagagagacatgacaacaacccttttctttcaagtggaggaaaattctgcatgatgttgaaaactggttttaaaaaattgtttcctacattcatgctcactaaacgtctcactaataatattcagtagcttccggttgatggtttcaatgccagacaggcccctaagaatcactttcccatgggcccctcctcagataaatggctatggccaacacagagaactcagggagctgcacaaagtctgggtctggaaatcttgtctatttttcaacatgcagctcagtgaactggagcagtaaaaaaattgctatgaatctgaactaagtttcttaggaagagaggtcagagaagagaggtcagagaaaacttccaatattcagtaatttctctcactattaaaacaaattattgagatataattcgtatatcatataatccacccttttaagtatacaattcagcgtcaacccttctaataccaatatttattcatttgctgcagaaactggggattatgtctcactctcagtggggacacaaagaagtttcctcatcacttcttgaggcctcatcaagccagctgtcccatgtcaccatcatcttgggtagcagcatcctggacaggcctgagttcacattctccaactgccacttacaagttctgtgaccttgagcaacttatttcacatttctttgctctagtttcctcactgataaaattaagataataataaaaatccccttaacaacgtaactctggggattaaaatgattcctgttttaaaataccggagtagatactctgttggtataatcactcaaaagagttccattcattcaaaattaagtaatatatattctatacctattttgtcccaggccctgtgttaggccctgaagattgaaagaaaaacaaaagaagaagggaggaacagagaaagggaatgaggaaggaaggaaggaaggaaggaaggaaggaaggaaggaaggaaggaaggaaggaaggaagaaaggaaaggagggagggaaggagggagggagggaaggagggagggagggaaggagggagggagggaaggagggagggagggaaggagggagggagggaaggagggagggagggaatacatgtcctcaaatttcaaggagacctaaaatgtaagagagggagatttatatattgattagtaaaatgcaagataaaataaacatgtgaatgaacaaatgaacgagcacatgatttgagcaaggaggattcactttttattgagctaaccctggaggacttgcctttattgtcattcctggtgttgccagctgatttccagacacaaactattgctacatcttcaatgtatgaactaagaatgaagaaacagaattgcatgggcttagaccagggtaagcgttttagctctggctgctcttctcaaaccatctgttccttctctcccactcttcctttgtaaagatctccccctgcaccaccactctttctttctttcctctgactcttctccatttattgccttaaggaagatttataatacattacataaaacgtctacatgttgcctgtgaactcctaaagggaaggtcggtatagaaacaaaacagataaatacattttataaataaataaataaaatgtacacataaccccagtggattggaagaatatttagataagtggctagggaaaagaattttcacactgtgtcatctgctaacattaatgagtgaattaaattagaaaaattccactgccaaaagcaaaaacatccaaatatgtgggatgctgggggaattatagaccatgctactaaatgcattctgttcaagcttactttttttttttctttgagcaggctgtggagagctacacttaaaaagccatccaatttcaagacagtattttccatctggggccagttgggtagaatatgctctaaactctgcaaagcctgctgagagacaacacaacttgttaagaaaactgtttatgaaaagggatgttttttgaaaatccagcaaaaggtttaactatgatgtccccacacattgcagaattcattattctccattgaatgtctttgtgcacaagtgaaacaccaaaatgactcaggaaatgagtgcagtacaataaattggaagccagtacatttttgctaaggccctagctggtaattagaatatttccaattacctaggagcttttttttccactttaagaggttattcattcttcatgtatagtaatctccctccacccacccaccccccaaaataatcccgatgtgaaatgctaaaagccaaatcaagattaagagattaaactttaaaaccaattaacatactgaaaacaataggaagaatttttagtgaaccagaaaatatagaatgacattaaagatgtcctaagtaataatggctgccaaaatgaaatgtatgagaaaaatctctaagatgtttatctttttctactcaatgatttaattaaattgagactgatattcatttgttgagagggcagcgggctaaactccctcaaaaaggtaaaacaaggccaggttcggtggttcatacctgtaattccagcactttgggaggtcaaggtgggaggatcacttgagctcagaagttcaagaccagtttgggcaacatagtgagacccctgtctgtaggaaaaataaaaaactagccagatgtggtggcacgtgcttgtagtctcagctacttgaaaggctgaggcaggaggactgcttaagcctgagaggttgaggctacaatgagttgtaataatgccagtgcactccagcctgggtgacagtaagtccctgtctcaaaaaacaaaacaaacaaacaaacaaaagacagtaaactagtcaatgaccacccactaaaatggatagctagaaagtagagttaggttttacacacacatatatgtgtgtatacagacatatatatatatttatactatgcatacatatacacataaatacatacatgtgtatatacacacacatatagtcatttcttttcttctgcttagaatttccacctagttttgagcaataaaaatcaaaacttcaattactgggcctttttttttttcccatgtgtaggttgtttctttttattcaggctttgaaggctcaggaataaaaggagttctatggatatttggacagaccagtgcttctcaaatgcatgcatgggaatcactggcagatctcgttaaaatacagattctgatataataaggctacagaggagcctgagagtctgcatttctaacaagctgatgcttctggcctgtgggttgtacttcaatagcaaaggatctgaaacttaaaacagagaacttatctatgtacatgtaatagcggaattccaagcattttctcataaagctatgcacagccagccagttcttatgatgacttagttctttgcagaatccaagacaactatggcttaggttttgccccatgattctcgtgttacccttcactcaggacatttggaatcctagaatcttaggtttaaatgatgccttcccggccccctcttcacctacccatcagtacggttactgcttctaagacaggcctcactagggcttgcccatctcttcttgccgcttccagtgacaaatgggtcacattgtctttcggaagagcccctttcacatttggctgtctcgaatgcctagaaagtttcaatttgtctcttggattttcacctactagccatagctctgttccctagagcaaatataatttttctcttactcaaggaaaaaaatcccaagtttcttccacattttctcttgtgagaaagtttccacagcccataccctcctagttacagcctttgaaatgttgtagaacttggccaatctatgagataatttttttttattttgtaaaaaacataccatattaaatgcatttattttctttgtaaaagatataagctataacaaatgtatatagagtataatatgaaaattgtatacttttactctccctctttctactcttctccgcagagatgcttttaacagtttttctatttgtttacctatatacatatatattgatttttctctttctatataagtggcattgacatctattgttccgtgactgcatttgttcacctgatatattcaacacctgggcctagttcagtttttacagcttcatagtactataaaacagattatcaataaattgcttattaacttatgggtagaaatttagatagttgtttgtgttttctgattctagaccatcccaccatgagcaagtctatgtatctgttgtgcctgtgtgagtttctctataaagcatagatctcaaaagatggaattatagtgtaaaattttaaatttggttagaaattgactaattgccttccaaaaatatttaagaatatgtaagactacctgttttccatagagttatcatagctgaacagaaccaatcataaagcttttacaaatttgttggtaaaataagtgacttcattgtctgaatttataatccatgattattggtgaagctgggcatctttgttttatgtgtggttatctgaactatttttctctggattgcctacttaaattatttgctcattctcctattgcctcttcctttttgagctctgaatacattttgaatattaactccttattaagagacattgcaaatattttccccccagtctacctcttgtctcttcactttgttatggtatagaatgttataattaatttgcagtcaaatgcatcaatcctttatgcgttctaaattaaaagaccattttccatatgtcttcctaatatttttatggtaccatctgaagataattttgtcttgtaaacctacgtaaagcataggtttaactttatttttaaaagaatataaattcattgattctgtgattaaagtattcctcccacggatttgaaatgcccccaatcataacaaaagtcaacatatgcacaatccttttccttgaccctcaagtaaaaaaaaaaataagctaatctatgcacctgtccttgtgccaatatcacactgctttaattatgagcttttagtaaattttgatgtcatataggccagacttcccatgttgtctgtttggaatttttcttggccatttgtgttcatttttgtcttccatatcaacttgagaatcagctcatcaggtccaacaaaaagtaccatataggtttttattaaattggattgaatttaaatttacagattatttaggagagaatttacatcattatattcttgagtctttccattcagcgacatgaaatgggtagtagattgtttaatggcaacaaattcctcccttcctatgatgcccaactctcttttgaaatgtgtcttttatgctcttctagcttaaggatggtgctcatttctccaccccttgaatctggtagggcttatgaaccttttgaccaatagaatgtggcaaaagggaaactgagttctagcactaggctttaagaggtcttgaagcttccattccctctctatgaaccctcaggctatcatactgagaagaagcccagtctagcccacaagagggtgacagccactggaggagaggtgacagccacaccaactgccagatacctggtcaaggccactgtgaacccaccagctatagtcaaatactgagataaacagaggctgatgagtgattctaggtgagaacaacaaaagaaatacacaggtggtcatcccatggaatcaggaggaaaatcagtcattgttttaagtaaccaacttattggggtggtattttgggcagcaacagataattaatttgggtcactgtgttgttcacatccttcagtaaaggatgtgaagactgaaagaaaaaaaaggaagaagggaggaatggtgaaagggaatgaggaaggaaggaaggaaagaaggaaagaatgtaaacagcacaatgacccaaattaataaatattttattaataacttatttattaatagttattgcattaataaattacttcaatcattaatttattgaattaataagctaattcaatagcctttgggcataatttctttagatactaagtatgttttattactcttgagaattatttacatttttttctacttactttttctaattggttataggcagtgccagaaataagcctattgattaataaactttaaacttctgcttaggtaactttctgagcactctttctggttctaaatgtgcttatttttttctactggatttttttacatagaaaattgcaacgtttttggcttttcctgtccgatacttacaagtcttgtttcattttctggtcatacagcattgaccagggaagcaagtttttagcagaaacttttgctcctgacttcagtagaattagtagtaatgtttttatccataagaatgggattgatttctttgtagctaccaattaccagattgaggaatttttttatacattcttgaatctctatagtgctttaaaatgtttcatttttaaaaagttaaacatactgaaaagtacataaagcaacagagattcatgtacctactaccctgtatttaacacagattaatcttgtgccatatttgctttaatctttcctctcttttaagtaataaaagcactgtagatgtagttgtagccccattcccctattctatcctaccttctctccagcaatagccactcccctgtagtaggaaagcattcttgctgtgcataaattatatttctactgtgtatgcataaacctagaacgatatacagcactgttttatgtgtgttttagtttatgtacatatgatagtctactttctatattcagttgtaattgtttttcacttaatgttatagcagcaagatttatccatgctgataagagaattctagtttatttttaaatactttaggaatcctattgaatggacttaaaacggtttaccccaattccaaaagaatgggtattagttgtcttacattttttaccattttcacattgcaaacagtaatgttgtgaacattcttgttctggcatccttggatcagaggcagaagattctttctcatatggggaaatccttgggtcacaggttgtgcacatgtttgagtgagaaggcagtgccaaattgctccccaaaaatgactgtactgtagcaatttatacttatatcacccatgttaaaagttcttgtttttctcttttattgaaaataaatgctcggttatttgggtagttggatcagatgggctctggcagtgctagatgaaagccagtgcccccaccctgactggattactgtttcctttacacatttattcagggttcctcctataagaaggagctacatttgacaggaaaatatcaggccaggcattagtctttctgagttcttcctttatttcagtatatatgtaatttttattgcctgcctgccacccagaattctttaatttttccccctaatttcacccccttcactatgaaattttaataccacagatttaccgaatatctgtttatgtacagatatgtgtggcttctgaaaggccatggactattatgatattttagtatttttcattgtcccaagaaccaatgctcaccttcattgagaatgtttctaagatccaaaatacttgcaggttcataatttttcagaggctagagggaggtggagcacaattcaacttgattctcttacataatcagcagggcttgtggctcttttgatcaaagaatgtggtaatagtgacaatgagttctgaattatttcactaggggcacactcatttaaagaagtaccttatggggaaaataaagagctgagtaattgggctaagtcagagattgcaaacccaaatgactaatatgttgggaaggtaacgtaaatgcgtgaagccgcccctgggagctgtgcccatctgggcaggacccatgcaaaaagggcagctggcatccaattgcagctaaaaaccaccatgcagaaaggaaggttcactttaccaaactcttcagtttttcgagagtcagaaatccagatcatctatgtaaaatctctcaatgtttgaagattagttcggtttttaaaaagtagttcacaaaccaatatctctgagaagtgtgcaacctatagactacactttgattacatgagttcttataaaccttcctctttctctaaagtttgatagttatttttaaagtttgaattaatgtaaaaccccaagaagaagagaagattgaagtctcaaatatgaacacaaaaaaactaggtacaggaaaggggaaggcagcctaatttaatttcccatcacctgcctgtgcaaatggaagaaactctaactttctattcaaagatgatttactctccttttacatgaagtcaaaatgtggaagcaattatcataagttatagaaataagttctgaaagcacaaaggttttttcttcttacattaaaattaaaattaaaatattacttgggttactgaataatttttagatattcatatatgacattgcagcccagaaatttgaaagtctctccttcaaagacaattttatttatttctttaatttaatagattacctaaggtatgtaagtacatgcctctgtaatctttcagttgtctatatgtctttctttcttgttagttttattatttgtctcctacacacacacaaaaaataaaattcaggtcacatatggatattttgacctggattggatatttgaccaattatctgaattatgaccacatctatacgtcacattttgctgtgtagatggtttcagtggaggttagaaaaatgttgatccattttggaaattaaaatataaggtgtgtatttttggttccataactacctgtataccttctgacaaattaatttctctagtcctcaatttcttaacctcacatatagagaaaaatgaagtaagcaatctctaagatccctttggccttaaaatattttgatcaatatcacaattttaaaagaatttaatgcctttaaattcattgcatctaatttacagctttattgaggtataactcatataccataatattgatccatttaaagtgtacactttattggtttttagtgaattcagagttgtaccactagtaccataatctatttttagaacatttttaacactccaaaaagaaaccccatacgcatcagcagtgcttctccatcccctaccccttacccagcccccggcaaccattcatctacattctgtctccatggatttgtctactctggacacttcccacacatagaatcatgataagtaatctttgtgactaacttcttccacttcgcatcatgttttcaggaatcatccatgttgcagcacgtggcaatgcttcattcctttttgtaattgactaatattctattatatgggtataccatattttatttatacatttatgtatatatttaccagtattggacaactgggctgtttccacatttttgttaaaacactcctgtacaactttttatatggacatatgttttctttactcttgggtatatacttaggagagaaattgccggatcaaatggaaactctgtttatcagtttgaggaaatgccaaactgttttccaaagtggctgcatcattttacattctcaccagcagtgtgtgaggattccaacttctccacatcttttcaacagttgttgctgcccaccttctttttttaactatagccacttataagtgggtatgaagaggtatctcattgtggatttgattcccatttcccgaatgactaataatgttcagcatcttttcatgtgtttattggctacttgtatattgttttaaagggttatgtaaaactagattcaggagatacatatgcaagttttgtttcatgcatatattgcataatgatgagatttgagtgttaagtgtacccatcactcaaacagtgaacaatgtacctaataatttttcaaccctcaccttccacctcccatcctccctccctttggagttctcggtgtctattatttccctctatatgtccgtgcatacccattgtttaactcctgcttttaagtgagaacatacgatatttgattttctatttttgagttatttcacttagggtaatgtcctccatttccatccttattgctgcaaaagacagtatttcattctatttcatgactgcatagtattccatggtgttgtgtgtgtgtacatatgtgaatatatagaatattttctttattaaatgattcattgatggacacttaggttgattccatatctttgctactgtgaatagtgccaaaataaatatgatataatgacttattttcctttgagcagatacccagtagtgggatttctgggttgaatggtagttctagttttaattctttgacaaatctccatactgttttccatagaggttgtactaattttcattcccaccaacagtgtaaaatagtttccttttctccacatttttgtcagcatcttttgattttaaactttttagtaatagccattctgactggtgtgagacattatctcattgtggtttggatttacatttctctgataattagagatgttgagcattttttcaaatgtttgttggtcacttgtacgtcttcttttgaaaaatgtctgttcacctcctttggccactttctaatgcagttgttttcttcttgctgagttgtttgagttccttgtagactctggatattagtcctttgtcagatgcatagcttgcaaatattttctctcattctgtaggttgtctgtttattctattgtttatttcttttgctgtgcagaagctttttagtttaattaagtcctatttgtctatttttgttttgttgcattggcttttgaggtcttagtcataaattctttgcctaggcctatgtccagaagagtatttccaaggttttcttctaggatttttatagtttcaggtcttacacttaaatctttaatccatcttgagttaatttttatatatggtgagaggtaggggtccagtttcattcttctacatatggctttctagttttcccagcaccacttatatattagggtgtcatttccccattgtatatttttgacaactgtgtcaaaattcagttgattgtaggtatgtgcctttatttctgggttctgtattttcttccattaatctatgtgtctgtttttgtaccagtaccatgctgttttggccagtatagccttgtagtataatttgaagtcatgtaatgtgatacctccagctttgcatgtctttttaagagaaatatctgtattccaaatatcaattcagatttttgtccattttaattgggtgatttggtttttattattgagttctaagagttttttttatatattctggttagaagttccttgtcacatataatatttgcaaatattttctcctatttcatggggctttttttctttcctgctaatatcctttgaggcacatttttttttaaattttactgatgtccaagctatctgtttttttattgttgcttatggttttgatgtcagatctgaaactattgcttaatccaaggcagtgaagatttacttctattatggaagttttataattttagctcttacatttaggtctataattcattttaagggtttttttggtaggtttgagataggaatccgaatttcctcttttatacatgaatctccaattatcctaacattatttgttgagaagattattctttttctcacagaactgttttggctcccttgtcaaaagtctattgactataagtgagagaattcatttctgcactcttaattctctacctgtgatgtatatgtctagccttatgtcagcacagtactatcttgattactatagatttatagtaggtttgaaattggaggtgtgaatcttccaacttcattctttattttcaagatgatttggctgtttttgatatcttgcatttccatatggaaattcatatgaattttgagatcaacttataaatgtctgcaaaaaaatccaactgggagattgcattgagtttgtagatcaatctggggagtagtgccatcttaacaatgctcagtcttctggtccatgaaaatttgatgtctttccatttattcaagtcttaatttctttcaacaatgttttataagttttagtgtacaactcttgtacttcattttctaaatttattcctagatgttttattctttttgttctatcataagtgggagtactttcttaattacagtttggattgtttattgcattgtatctccttttagcttcaaattgaaaaactagttcgtatttccttcattcattctaacttttttgttctttgctttaaaagatgcatttttattttagctgtaatatattttctagttttatttttaaatctttttattaagtcatgaaaagactcatagggttgtatacagtatatctgaattaaacaaattgagatgcttagcctcctcaattaaatcacttagaataaattataagacttccatcatctttcaccagcactcattaaacacttcctaaatgtacaaaactaacaatatcttagctgcccacatttgctgacaatgcatgcaactccatcaacaagcaaactgcatttaactcctataacctcagaaaaacacagttattaagagaccaaaacataaataccctcatcatttcaagcttgttgcttaatatttgcatttcattccattaaaggaataatttccattgactgccaaaacgaacaaaccattgcaccataaagccacattttaattttactttaaggggactccatgcaaacccttttgaaggcactactctactattgccttttaaaattatgctaacattgttgaaggtataaaatataattatttgtctcagaagagaaataaaagaaattgtggttactttgtcttttccttagaaatataatatgaattcaaactaaagaagtcaaattaggtgagtggctcttaaaaactttgagaatcaggggaaattaaaatacatttaatttgcagagatttttttagcctaatttgaaggattcttgattattctaaagccaagccatggaagaaatggacctcaaagtaaaaatcttccataaaataatagttgagttagatatgcaacttttgtaggtaaattccctggcatatatgaacaaataaacatttctgtgaacaaaaaaaaaactgagctcagagaaggaaaaggacaccgaagtcttggacctactgacttctgtgtccagagggacacaaaaatgggaaagagtttgacatcaagtatacatcaggcaccaaaagctttccataaatgttgggagacaaaggccagccagcttacttcatgaaaacatagtctgggaaaagggtccctcaatcttgaagaaggattgtgaaaactaattactgcctggggtcacagcttacataggatgttgatctgcatagtagaaggaaagacagtctgaaagataggtcttgaaccaagtcacttgatagctcagcttcatctgagatgtacctagtttttttttggtttttttttgtggtttttttgggtttttttttttttttttttttttttttgagacggagtctcactctgtcgcccaggctggagtgcagtggcgcgatctcgactcactgcaagctccgcctcccgggttcacgccattctcctgcctcagcctcccaagtagctgggactacaggcgccagccaccacgcccggctaattttttgtatttttagtagagacggggtttcaccttgttagctaggatggtctcggtctcctgacctcatgatccacctgcctcggcctcccaaagtgctggaattacaggcgtgagcctccatgcctggccccccagttttatattatagaatagatgcctcaagtaactcataaaacctagttctagttggggtgtctggtaagcttcccagaggcatccataaatcctctaggtgaggagaagtgtgcacagagatgagaggaagctccaattcaagatgaaattgacagtttaaagcacacaaaactaagaagacaagcaaaataaaaaatacagataattcaacatcaaacaaacgaaaacaatgaaaagctaaaactgacagtaaaaagaaataaaaaccaaaacataaaatagaataccaatcataaaaaggatgagaaatatgatacaagaacaggcaaataagaaacaaaaacaaatgtataggaagaagatctactataaatctacagaaaaaaactacggtctaaaatgaaatgccaataagacaaaatctagaaaagacaatcaaagggataattaatgaattaaaaacttatgctgatgaatccacctagaataaagcacagagagaaaagttgaagagaaaaaatatccattcaaagtctccaaaatgtatccaaggaattctgaaaagagaaaatagaataacatagaacaaatatcctaagagataagggctgagaaattttcaaaacagaagaacatgtgaaaaatactatacaggctgggcgcggtggctcacgcctgtaatcccagcactttggaaggccgaggcaggcagatcatgaggtcaggagatcgagaccatcctggctaacacagtgaaaccccatctctactaaaaatacataaagttagctgggcgtggtagcacgtccctgacagtcccagctactcaggaggctgcggtaggggaattgcttgaacccgggaggcagagcttgcagtgagccgagatcacaccactgcactccagcctgggtgacagagtgaaactccatctaaaaagaaaaaagaaaaagaaaaatgctatgcatatcaacatgtatactattaaaaccataaaaacctcaagtgaaagacaaaatcctaacacatatgagagatgttttttaaatgacataaaatgaaatcctattagagagctagactgccaggatatttctagttagcaaaaattaatgaatgaacacaagacaatgatgtaatcaaagtgtttacagcaaataactgtgaacttagaatttcaaattgagctaaaacataatccaagaatgagggaaaaataaaaactttttagacttactaaaaacacacgtttttaccttccccagacactcactaaaataatgaaggatatactttagcaaaaaatgagagagaaggagtagaatataggagattgcagtaagcaaagacatggatcaaacatgtttataaatctaattatctattgccattaaaaatagcaattgaaggccaggcacagtggctcatacctataatgccagcactttgggaggctgaggcaggtggatcacctgaggttgtgagttcaagtccagcctagccaacatggtgaaaccccatcactgctaaaaacacaaaaattagccaggcgtggtggcatgcacctgtaattccagctactcgggaggctgaggcatgaaaatctcttaaacccaggaggtggaggtgcagcaagccgagattggctactgcactccagcctgggtgacagcacaagactctgtctcaaaaaaaaaaaaaaaaaagaaagaaaaaaaatcacagtgggtttcaatgggtaagggaaacacgataaggtcttagtgttatttttaaagggtataaagatactaaataaatcttattctttgttataaatatataagtattttatatatatagacattaaaattaatatgcatgtcacaaattataaggtaaccactaaacaaataacaaaattatcaaatcaaatccaagcagaggggtagaaataaaaaacataaaaaattaaatccttttgaaggtaacttcatgaatttttgtctcattgtctttcctactttgttaaaacttttaattgaaaaatataatatgataaatttaaaatcacaatattttaaatggaaaagagaaaagtaaaaggattcaactaaagttgggaactacataaatgagaacaaaacatgagagcaacattcacagagaaaatagcctaatttagtaataaaattaaatcaaagatggctacaataatttaaatacattttatgcaatatatggtaattacatcacgatccttcaaactcattatatgctcatacagcctttagaaaaatcattgccaagattatttaaagaaacattcctgactgtatacataatatgtggactggaggcaaagaaagcatcataagcatctttgctcctttaggacttggctgagttctcagcaatggtagacagttaataattttttgttgaataaatgtttgccaaaaaaaaaataagaaaaagagtaaaacaaaaaaattagtgttaacattgggctgtaactacatgatattgactaagaagtttataaaggagatttttttttttaagtgtcagatctttcacaaaatagagagggctgggagctaggctgaggactaagtcgccataaacaatgccccaaaccactttgcaaaactaggctgaggaggaagctgctactgctgctgcctccaaaacagtttctcccatgaactccctcaataaaatgtccccacctgttcaataaaatggaagggtttgcacgggattgtttgcacacttgactcacttcaggactgaattctctcacatggtacatctggttggtggagctgagatcatatgcctgcatcccagttgtgaggctgaaaatttgagttctggtttcaatgttggggaggagatggttatatcatggggatgtccctaaacatagaaaagctgttcatgagatcacaagcagtcacgaacatgacgaatgtctatgacaatacagttacaaaaatgggaatgcatactccataattctccacctacagctacgtactaagtataatttaatgtcattaagtattcttccacagtaccatatttgaggactgcccagtatctcattaattggatgtcctataatcctataatgtgttttagctactccttattggacatgtaggtggtttccaaattatagtagcttaactttgggaaaatccacgatcatttgcttcaggtaaacggggagagattgctaatgtcctccaccactaccctgtcatcccacgctatccagttttaaaccttccttagccttcaagtagcaaacctcagaacatgccgccatatttcacagtgccagtgaaatcgcagttctcctttcctccctgctcacataaccagcagtggctccagtgtttgcacagactaccttgacatcttttacactgtgatcttcatcccatcaccatttgaggggtccatctgaatagctatgtattacgttcttgtcatctcctggaaattcttaaactctgcagactatacttctgatactcccttcacgataaaatctgaaggtcttctacttctggtgcagtattggcatatggataaaatcaggagttttaaggtggtgatataaaatcacttaagttagcttctctggtctctacttttcttatttataaaatggaaataacaacactatgtataccataggtaggatcataatactatttaccttgtagattgttataagtattaaatgagatcatttatatgaagtatgatatggtttaaatgttttgtcccctccaaatctcatgttgaaatgtgacctccaatgttggaggggggacctagtgggaggtatttgggtcaaaagtgtggatcactcataaatggcttggtactgtccttgcagtaatgtgtgagttctgattctatgagttaacatgagatctggttgtttaaaagacctggggcctcctccctctctctcttgttcactctctcgccatgtgatataccggctccccctttgtcttccaccatgattgtaagctcctgaggtctcaccagaagccaagcagatgctggcaccatgcttgtacaaccagcagaactgtgacccaattaaacttcttctctttataaattacccagcctctggtattcctttatagcaatgcaaaatggactaatacaaggtactcagcacagtaccaagtaagtgtacgagaaatgttagctattcaaagtaaccagataaaattgtctctttttgtaggtcactggaagcttcacatccaatagtattatttcagtctgatattatcactcctaagtttcaaaaatgaaattttcatcagcaccaaaacctctagtctattgactagcattgtggccccaggcctttggctttctccatctttatttcccctgtgggaaatgaaggtctaccaaaagacctacaaaatctaccaaatttggggtctagaaaatcagcctcacatgctccttatgaaaactgtatctttatttccctaaaaacaatcaatacttatttcttcctttgtgtgtctacaacttgttccccttctggggtacttcattcagtcttggagtattacagtgtggactcacaagcaagtggtaggtgtttgcttgtctgtctttcccactagattggttcccctcaagaacagaagccacagctcatttatctggttatctctatcccagtactgaatatctagaacaagcttatcttgtttgaaatgaagttaaactactgagcaatggatttctttgcaaataacttatgctgcttcatgactacttagaaatagctgatgatttgtatcttaacagcgttgatttgtatcttgaattaaaattgccatgtctggaaactgatgcacccagagaaaaactgagatttcattcctcttttatattacctttggttacctcaggttacttatttggaaaaaaataaatctctttttcattattccatgaaacattccttcagaatattctattattaaaatatatacaaatatacacgtgtatacacaaacacacacaatatatcattctttttaaaaagtaatcatgaatatcttcttaaagtaaaaagttaaaattatgtagaaacctacatggaaaatacatgtacttatttaatatgtaagctttttaataaacataaatgataccctattatacatatttcttgacaatttgattttttccccacttaataatatgtcacagaggtctttccatgtcaagataccaatagctcttcttcaattctttaatgatgactcgggctccatcgtgtgaatggagtattatttgtttgattttttccttccctgttgatgggcacttcactgacaaataacttatcactattacagatgctactgcagtgtgcattcttgtgcatgtctcttcacacaaatggatgaactgttttctaggataaatagctaaaggtgccctttcctttcaaatacaaccaaatttctattaatctaaatcactgtctccttcctgttctatcccaatgattacttatactttcagttcagaaaggcagagaatgatgcccacaacttcccagaaatgtaactatcagccttcagaatcaaattcacatctcaaagtctctcctgcctatagaataattcatttgcaagccactctgatcaatatcattaacccagaactcccatgaccccatattattcacagcctcatcttaagggtagttctccatagttttgaaagtctgtttaaggcaggcaggaagacagaactcccctgggtccctacaaaacgagggcttatacaaagtcctgatcaggcactgggagggacactcaaaaggaaagagatgtagaaccaaataacagaggcagctagtgtggacaatctcaagctacaatcagttttttcttcatctatttttcttcattatctcttttagaatattaaactttttgctcatgctattcttggcaagattgcctgcctagttctgcttgaagtcagtgtggcaggagatgcagaaacagccaagttgggtgaccaaattcacaaggtgcacctagctagcggaagctggctgacgcgtttggtcctctacttccctctgccaatagtttgcgcagatttaggaagctgctgtccaaggcagagagtgaaggagatgacggaaactgaaagacaggtatgacctctaaaaatatgcatatttgtttccattgatcagcatcatgatacagagtttgataggctgcctatctgcctgtgggctctgccatcccacaagggcaggctccaagtcgaatctacctcagtggttaccgcacctagcacccactactagatctaacaatctaccttgttataatgctttcattggcactcactaactatgtatctacctggcctaagaaacaaaattgaaacattttgaagttatgtgtgagaatttcgtaccttacaagaagatagcatagaagggaggaggggagaggcaggattcgacagtccaaacgcttatcttttacaatgataaaagatacataatggcttaagcataatcccaatgacattggagaaaatgatacacaaacctcttcatcaggaaaatactgttgtttttgtagaagattgataccgtttgctaaaaatgccctgaaattattttggtttgttatggtactagattcgattagtttaatttggaaatctgagccggaacaaaataatagtctggttttgtctaactgaaagggcaaaaccagaaatgctgaaacacaaatgcattgctcatatgcacacacacaccccccacacccccgccttgcatgtgtacgcacacacaaacacacagactcagaacacatcttaaccatgcccaactggctgagctcagatcttcagatacagtgaagtacatccaagaggaagccaaaggtgaaaaagtgcccccactgaggagtatctgagtgaacagatttgcagaaaggacaggagaaagagaaagagtcaggaaactcattattgcccaagagattatgtattttcaaaacggtagaaagggcttaaaaggagtatttagaagagtacaatttatcagattttccacaatgactgcctctgtggaacttccctggagcattcttcagctctgtgtgataaacctgccgtcctgctcatgtatactccacttaccagatatacaagctgcgctatagagtttcaagggatatcacgcgatgtgtgctttgacataagggcacggttatcctgaatgtggctcattcagtggggctttggaagagcagagggcagtgctcaatgattgagggatgcccccaccctgtgcctagaatatgcctgttcccagcaccagcaggcaaaaacaaaacaaaacaaaacaaaaaaacaaaacaacaacaaaaaaaacacttggtgtaaaaccatttcaggcatatgaaaactctgagagacataatgagccctcccattaattctacaaccctatctaggcattctgctaacctggaatgcttgggtctaggaaaaagagcaattctttgtccaatgcttcaaaagattgagaaaggggaggagccaagatggccgaataggaacagctacggtctacagctcccagcgtgagcaacacagaagacgggtgatttctgcatttccatctgaggtaccgggtttatctcactagggagtgccagacagtgggcgcaggccagtgggtgcgcgcaccgtgcgcgagctgaagcagggcgaggcattgcctcacttgggaagtgcaaggggtcacggagttccctttccaaggcaaagaaaggggtgacggacgcacctggaaaattgggtcactcccacccgaatattgcgctattcggaccggcttaaaaaacggcgcgccacgagattatatcacacacctggctcggagggtcctacgcccacggagtctcgctgactgctagcacagcagtctgagatcaaactgcaaggcggcagagaggctgggggaggggcacccgccattgcccagccttgattaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcatgcagctggagatctgagaaccggcagactgcctcctcaagtgggtccctgacccctgacccccgagcagcctaactgggaggcaccccccagcaggggcacactgacacctcacacggcagggtattccaacagacctacagctgaggttcctgtctgttagaaggaaaactaacaaacagaaaggacatccacatcgaaaacccatctgtacatcaccatcatcaaagaccaaaagtagataaaaccacaaagatggggaaaaagcagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtatgactagaataaccaatacagagaagtgcttaaaggagctgatggaggtgaaaaccaaggcttgagaactacgtgaagaatgcagaagcctcaggagccaatgcgatcaactggaagaaagggtatcagcaatggaagatgaaatgaatgaaatgaagcgagaagggaaggttagagaaaaaagaataaaaagaaatgagcaaaacctccaagaaatatgggactatgtgaaaagaccaaatctacatctgattggtgtacctgaaagtgatggggagaatggaaccaagttggaaaacactctgcaggatattatccagcagaacttccccaatctagcaaggcaggccaatgttcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaacagagtgggggccaatattcaacattcttaaagacaagaattttcaacccagaatttcatatccagccaaactaagcttcataagtgaaggagaaataaaatacttcacagacaagcaaatgctgagagattttgtcaccactaggcctgccctaaaagagctcctgaaggaagcgctaaacatggaaaggaaaaaccggtaccagccgctgcaaaatcatgccaaaacgtaaagaccatcgagactaggaagaaactacatcaactaacgagcaaaatcaccagctaacatcataatgacaggatcaaattcacacataacaatattaactttaaatgtaaatggactaaatgctccaattaaaagacacagacgggcaaattggatcaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccaggttcataaagcaagtcctgagtgacctacaaagagacttagactcccacacattaataatggcagactatacattttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataatgaaatgaaggcagaaataaagatgttctttgaaaccaatgagaacaaagacacaacataccagaatctccgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaaacccttcaaaaaatcaatgaatccaggagctggttttttgaaaggatcaacaaaattgatagaccactagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcaacacatacattctcccaagactaaaccaggaagaagttgaatctctgaatagaccaataacaggagctgaaattgtggcaataatcaatagtttaccaaccaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaaaacgaatccagcagcacatcaaaaagcttatccaacatgatcaagtgggcttcaaccctgggatgcaagtctggttcaatatatgcaaatcaataaatgtaatccagcatataaacagagccaaagacaaaaaccacaggattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagccaaatcatgagtgaattcccattcacaattgcttcaaagataataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaatggccatactgcccaaggtaatttatagattcaatgccatccccatcaagctaccaatgactttcttcacagaattggaaaaaactactttaaagttcatatggaaccaaaaaagagcccgcatcaccaagtcactcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactcaaagaaatttacaagaaaaaaacaaacaaccccatcaaaaagtgggcgaaggacatgaacagacacttctcaaaagaagacatttatgcagccaaaaaacacatgaaaaaatgctcatcatcactggccatcagggaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcgtgtcctttgtagcgacatggatgaaattggaaatcatcattctcagtaaactatcgcaagaacaaaaaaccaaacaccgcatattctcactcataggtgggaattgaacaatgagatcacatggacacaggaaggggaatatcacactctgcggactgtggtggggtggggggaggggggatggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaaagaaaaagaaaaaaaaaagattgagaagcgggtggggcaagccatgagggggaaagaaagcagatgaacgaacactctttttacagaacaaatccctttcttatcagttcaaccatcaatctttagttttctgaacactgttgctatatgctcaaattgtccaaggtatgatgagggcatgaagcaagtagaagtcagagcccaagttttaaaaagttttactgttgtcagggaaacaagattcatgcacattaaaatattagagtacattctttttctgtttatgtacttatttccaacctcattcccccaaaggatttgtgattacttacaaaaatacacacaaaaaccaaatgataaaataaataaaaagtaaacgggcaggatataagtgggaaaataataaaactatggtcaagataaatacaggaatatacagtatgctgtccagactagaggtggactataagttttgaaatccttaagcacaggcagtaaatcgcactgggcgctctatgcagagccaactggtatgaatatggcagagcaatgagttgccaaacctagctgtccagaagtgtcacttattaaaggcttccaaaaactccataatgaacctgaattcctggggcaggcaggcagggaaggaatgctgggaatctgcatttttaatgtcgtcagcccaaacttgggaaccacaactgcagggatttggaaataggggttgaaaaagaactcaaaaaatcagattccaggaattacggtggttgtggatctgaagcagggcctctaaggttagatggagtttaaataggtggagatgatgatagaagacattcccagtagaagtgtgggctagagccaaatcacagaagcaggaaggagcctgaggccatgaaggagacagcatcatccctagtcaccctggagcagtagtaaggggacttaggacactaatttattgctcaacccgctcaattttgatcaaatcccaaaaataattaaagaggctatatacataataaatgagttatatacagaaatagagatggtaagaatgtatatatttgttatctattgctgtgtaacaagttaccacaaatttagtggcttagaataatacacatttattatctcacagtgtctatgaaccaggaatctgagcagagcttagctggaacctctactcagttctcacaaggctaaaatcaatgtgtcaagtgtcagacctcaggtgtctgggatctcatctgaggctctgggtcctctcccaagctcatgtggtttgaggaagaatttatttccttgcttgtggctgtaaagctcatgatgacttgcttcttcgaggccagcagcagaatctctgaggcttctagtttctgacctgtagataatcttttaaggagcttgcctgatgaggtcaggcccacccaagaaaatctcctgtttttattcactcaaagtcaactgattagggaccttaattatacctacaaaagtccttccacaattgccatataatgcagtctaatcacaaaagtgttatctgttatattctcaggttctgtcctcacttggggagggaatcgtacaatggggacctggatcttagtttccatcttaaaattctgctttgccacaaagtacaaagtaaagatgagagaaaaatgttgcaaaggtaaggtatatgaaccaacagaacattggtaattacacatgtcaatttggctctgagcttcccagcagttgaagtacaaaggagttatgacccagtgatttcttagtactctgatcagttcctagtactgacttatacaatatatttctcatgtctattagaaatcatgaaatacagcatcaaaataaagtgaaagatacaaaatgaagtcagatggaatttgatccaaaataactctttgccaagtatgggatatgttgaccctaccgatacaatgggaaattggcaatgacaagaaccaagttcattggggtgcttggtcaatatcaggtaccatgggctggtgattggggtccctataaaagaaatcagctgtgaagacataccaggagttgttccaaggcaaggggggaaactgaagtcacacatgaactgaagttacaagtcagaggtatctaggtgtggaggagatgagagcagaagttgaagcactgcatagctaccaaagaatcttgcagaaaggttaccctttctgcaaccttggaagtgttcttgttgtcttggtgttatttggccacctccctgtggaacaacttttccccgggacatcttaagggcatcacttgatctctgtcagagctgatcaaacatctctgctttgctttacaattctcataattagttctaagcattcggtagcatgaactgcttcaccctgtgttccattgggactctataatgaacctgcttttgcatgcaaaatgctgttctttcttccaccgactaacatattatctctttttatgacctcactcaattccaccactgtctcccttccttgaatggctctcgtctactcacagagtcagcactgtctgtgtaattgctctggcttaagtctggtcttctacaatctgactatctggtccaccacaatgtcctcttcattttctttcgtgttcaaatttccctggagctcactatattgcatatacaaggcttatagatcaaaaaagccttggaatcctccagctcacctgcctttgcaatgaagcccattccagcattgtctgaggacttccagggaaaagaatctttttcataagttctcaccttgtttctaaatgaacaaaagttcttcctaatattagaccacagtaacttctctttaacttccattcttagtcatagtgctgctttcttgagtaaattaaaataccacacttcctttcatatattgttcctgggagtataaattggtataatccccttgaaagactgttgggcattagatctgagatactctattattgctatgtgtagcaattacacaagcactcttaacatatatgtgtatatttgtttaccaagagacatgagagacatgtgccagcatattcataatagaactatgtgtcatggtccaaaattggaaaatatccaaatgcccatccatagtaggaagactatatggtggcagagtcacacaatggaatattatacaacaatgtgcataaagttataattaaacacagcaatacagatgaatcacacaaacataatttgaaggaaagaagccagacacaaaattacacaaaccgtatgattccaattagataaagtacacaaaaggccaaattaatctaagccactggaagtcagtatggtggttaccttagagaatgtgactgaaagggaatttgaggaaggcttctagggtgctggcaatatttcttgttttgaggattagtgatatgggtatattcagtttataaaaatttatcaagctttatacttaggtgcaattatctgtatgtattttatacttcaataaaaaaggttaaacattttcctcttccaaatgtcccaaataaatctaatttatttagccatttctaatatgatatggactgtagaatgttcacgatcctagccacctacttataaaaacttttcatttgtcaaacctctgatcattcatttggaacttaatcctactgattggtgtgtagtattctttaaacgccccacgtgggattaactccttctccccactatgttatgaaacccataaagataaatgttttcccctttgattttccagtagcatgtgtattcagtgtagattgtacactaagaaaatactcatcttcccttctcttccttagcaagtgcagatgaaagtggagattgaatttacataggacctatttgataaaccaattcaagaatctttcttttttatttcaatgaaagtttaatgctaatgtattcagtgaagccaagttttattttgcttattttgctctctgccctcaggctgattgaggagtgacctttgccttgatttatgacagacgtttgggtatggagagatggagactactattaagcagatccctctaaaagatctgagtaagtatttcttatttccattcctctcatcttcattattcataaattcttccaatgtctgaaacccttccttataattttctcttctcaagaaggaacatactcatttggacaatgagacaatgagaaagaagtcttcttattcctgtagttagtggtatcatccttcctgataagctcaatagagggtaaaataaatgagcaacagaatacaaaccacatgcctagcaatggagagaattctaggttctaaataatgaaatgaaaataatatttttggtgctgataatgctcctggccgatagcttgtctttccaaaacaaatatcataagagaaatctgcagacattcacatcatgaatgcggtttttctctctgcacacacactcatttgcacgcttggcacctggaatgcttggttggtacacagtttgctgaaatttcctttcccatttggcacaacttttcctagataacattcatgagcatcagtcacctccacaaatagcaaagagagaggccagcttcttggccacattcatattcctgccaccaggacacctttataaccatacttcagactacacaagcacagccctcgcctgcccaggttttctatgtataaaaagacatatgaacgaaagagagagagagataatgaaattatgagtctgcagattcttaccaagcctgttgaggaactatctctacaaaattgaagacatgtcagtcccttataagatcatacaaaacatagagggaaaatctaagaaagctactcatgcagaaactatttaatcaaaggagaaagacaattataacatctgttaatcttctgtagaggttataattagatgctttggagaaacaccctttcaagggtgatcctttaacatctgttgtgaggacacacagcattgtgcagtgacgaatcacctcggcactttgggaaaacaggggactactgggatcacagacactgccagggtccccaggctgcccttgcatgcagcccagccctgagcccactgccctgaggtgggggctttcctccttggtgctttgataattgcctgtgttgtgaatcaggctgcaatcattgtgtgactatgaataacaggatcacagcactggaaacggccttgagaccatctcatcttctcccccttcactttgcagatgggaacacttgatcctatgtcctttagctggctcatggcaggattttacaaatagaattgttcaatctctctgttcagattactctccactctaccatgctgcttgctccttttggtctccctttcgtttggcctgtaatgtggatgtgttctttgtttaatgagatgagcattataataaagtcctagggcatttgaagattatggagaggtggtctttttctctggtctctggttcattaagagacactgaccatggtcccttctttgctctggagaggaggaggaggacgagcagtagagataaatgaagatgaggagggagaataagagcaaaagggaggagaaaataggagaggtgagatgcaaatggtgtagagggaagaacgaagacagaagattgagaaataaggtggcatagacagagagatgtgaaagaggaagggagcagccagggaagatggtccaggactacagaaaaagggtattgaatgaagaccctatagaaggagtcacatcctccctacacccttctgactccgttacctgcttctactctacttcaaattagcagttctacacacacagaagaccacaggatttgacaattttgccaaacgaaatgcagagatgataaagccaggggcatcacataaacagatgcaatgtgctgagcaaaaaaaaaaaaaaaaaaaaaagcccatatggcaggaacataataaaagcactcatgacccagaagcggattgggggtgcacattgttctctgtagttgttttggagtggcaaatactcatttgtgccaaaatactgagtaaagggaactgttgacatttgacattaggattaaacaacttcctaaacctgggacacacagtgctgtcctcacctctctcattgccctaagacagtcactgaagtacaagggcctacgtcgtcctcaatgataagagccaataatgagaacagtattattaatatgtattaatagtattattaataacgtattaatactacttacatgtattgtgagtctattttggtacaggcacttgaggtagcttatctcatttattcttcacgatgaacctgtaagaaggtaatataatctaaatatgtggctcaaataattactgtgtaatctggaacatattaacctcttggtaccttggtttttgcatctaaaaatgggattaataataacgtctatctcagtggtctgttttaaggattatatgagacaatatgaatagaaagcacaatggggtcagacacatcatacacatttaataaatactgggcaaaatcgctgctgattttttaagaatctcacagcctagagtgcagtggtgcaatcagggcttactgcaacctggaactcttgggttcaagttatcctccaatctcagcttcctgagtagctgagactacaggtgcacatcaccatgcccaggtaagtttttaaaattgtttttttagagatggggtcttgttatgttggccaggctggtcttgaactcctggcctcaagtgatcctcccacatcagcctgagtcactgagattataagcgtgagcccctcacccagctactgttgaaattactacattttatggatggggaaatcatgcctgacaaggttaaataacttgcccaaagtcagtagagttcagaacagagatcagaacccagggatatccaaggataaatgccacatgggtaagagctgtagttataagccttccattatactgtctgcattaattgactccaaagatcaaatcctggtctaacgtaccatgatgtctcaggaaaagaatgtttcacagcatacagggctctagaaaatctctagcccaaagtaggaaacaaaaaggcacattactaagctcaagacatctatctgttcccactcctcttgtcttcatcaataagaagataaaagaaatccttgcccattttcttattcatttgctctcatacctatagagcccccattggacaaatgccatgaatactgattcttgtactatggggaataaagaggtactcacacacttattgaaagttaggtataaaacccaatgccaagctttgtgccccgagtccacaggcattttgactgcatgagatttgaatgccatcagatgaggtataaacatgaatattttcgtaagtataaaaatggagaagagaaagtactaatttaaaaatcagaaaacttgtgtatattcatctattcaccaaatatttgatggacgcctactgtgggccagccactgttctaggtcctaaggttacaatttcaaacaaaacagacacaggctctgcttttgtgaaacataacagcctagatggggagatgttcttaatcaaatagttgatgatatatttaattatacgggtgataagtgctatgaaaaacagagagatggagctacaagagtacatcacaagtaaagaaagccttcctcaggaagtgttctttaggctgagaagaagttgtacccaggaggatagagtggggagaagagaaccttccccagaaggagagatttgggtgaataagaggagctggaaacaagccagcaggtaggaagagaacagctctggactaccctgctcctccccaccactgtttccttgactggaaagtgggtgtgatggagaacatgacacgctctcagctctcggagtctagcttctctttgctgtgtccaaagtgagggcttactatagagtgagaagattcttgtccagctgcatagaatagaaaacccacttttgttgagagtaaggctcactgaaatgtaggcagcaagtataacttgtgcctaggtcaagagagccatcatctctctcagccatgttcaacagtcaatactgggttccccaaaggctcagatcccagggccccaactccaaaataaatgtcctagagagattttatgactaggcctccacagccctggtttggttgatggcttattaatgatctattctaattctccaatttcctcttaagaaaacaatgaaaatgaaaagttaagatatctaatttttccttatagaaataaataagatgcactttaaaataccattttcacagttttactgctatttatcaggaatcctaaaaacaagagcttctttaacagggtggctgtaactgttggcaattggcctgtatgtgaaattttacttagtttaacaaggccctctactggcaatctgcatgaacaccgtctccaaaggcaaagtttcacattattttaagtgaactgttttaactactctcaataacaaagtatctcacattcctgattctataattcaaggctcaaagaataagtggggagaaaatcaggaaggaaagaaataaatgtcattttgagcattcatttagtggttcataaaataacattacatgaggtatcatttgctttcctctgatgaagctatactacatgtcaaaggtactcagaaaggaaggatatttcttacactgaaatgtattgagtattcatgagactataaaaccaagttatgattgctatttaccaactacaataaaccagatcgtttctatttacccaaatatgagtaactggctgtaatgagaataaaagaaacattggaggcaggcatttaaaattgttgctgatatggcacaactaattattaacttatcctccttggcaactgacaaaaaaagaacatggtgacttgagaatataactactcacagaagatgaatgttttaaaaggagattatatttgacatatatgtcaacgggctgttggagcaactgggaaacttcagctatagggtcttagaaaactaagtaaatattaaaaatgaggcaataactttaggaaaaaatgttaacataaagatgtgatcatagtgatttgactcaacgtaaacaatatttgtaatcaaaacaaaaataagcactatgcatgtaattaaaactgcgatataattatattgaagaatagggatgctctgggaggtacaaaaagatatattataatctaccataataataaagaagtagtactttgacatacacacagaaacatatgatttaggaatattacataaaaacagctgaagaaaaaaaaaactcagaaatggggtagagagggtggcccaagagactgtaagattttatataaatatacacacacatatatatatacacatatagagaaacacatactcaatgtttatatatatgagcatgttagagctattgtttagtactaatattcatatatatacatagatatataaacaatttactattgttggattttctgatttatgagcatgtattactttgactttttaagttgctacaaaaccagttagcactgacaatggaaaccatttgagaaatgccttttgggctggcctggatcagttctatgtttctagattcaatttgccaaatgaagcaagttgcctttatggagcggtttgtcagacatgcgtctcgacagtaacacttgttcccacatttcagaactaacagctcttctttcaacaccgtaatatttatctgccatgttattattcccagtgtatgctccaaaatgggcttgggactctcctctttcctcttgaactcagtccactgggcttctacaatgcatccaaattctcctcaaaggaatcactaatccggtaaagttgatttctaaaaggagagatctggtttcttgccctgaaaataccaagattaatttatgtaactacggggaagtaccctgtgtaattgaggcttccaaactgacacgatacacttcattaggcaagtatgtattggggcattgtaaatgtgtgggtaatgttctatgtatctgagagatttattatttcatctataaaggaaggacaattgggaatccaaaattccaaaggcattaaaccctgtagagttagagaactggagaaaaagaaggctataaggtactttgtgcttaactgggtccatgacttgccagagtgttcagactaaacccttctggctatttaaatccactttcacaaaatgctaccatttccttaggttaccattttcagggaccaaccaaatggccaaacattatttccaattttttctttgtatctaatccctggattacactcttgaccaaactttactaggcctaccaaaacccacaccaagaatgtaaataatcttgatgtttaaccataaacttgggctactctacaaaaagattcaggtctggccgggcgcagtggctcacgcctgtaaccccagcactttgggtgaccgaagtgggcagatcacgaggtcaggctattgagaccatcctggccaacatggtgaaaccctgtctctactaaaaatacaaaaattagctgggtgtggtggcacatgcctgtaatcccagctacttgggaggctgaggcaggagaatagcttgaaccagggagtcagaggttgcagtgagtcgagatcatgccactgcactccagcctggtgacagagaaagactccataaaaaaaaaaaaaaaaaaaaaaaaaaaaaagattcagatctctgagattaaaggaaaaataaaaatagtaaaggactgcgcataggcgttagacactttggaaagactagaaaatgtgaattgccagtttgaatgggtggaagtattaatctgctatactgctctgccagtgcagtcaatcggggcagatgtgaatgaccaaaacgtcattgtgggtgaatgtgaggctcatgaagcctccatatccagaaagcggtaaaatgaaaggttaagagtatgcactgtggggttgagtgcagtgtctcatacctgtaatcccagcactttgggaggctgaggcagatggatcatttgaggtcaggagtttgagaccagcccggctaacatggtgaaaccctatctctactaaaaatacaaaaattatctgggtgtggtggcaggcacctgtaatcacagctaaccaggaggctgaagcaggagaatcacttgaacctgagaggcggaggttgcagtgagtggagatcgtgccattgcactccagcctaggcaacaagagtgaaactccatttcaaaaaaaaaaaaagtacgtgctgtgggttcaaatcctgcctctgcctcttatccacccatgtgacttgtgcacattacttaacctttctgagcatcagtatttttgcttggacaatgaatacaatgatcataataagatagcatgagcacagagcttgaaagtgtgcctggtatacagtaaccactcaatagtgattgatgttggaagaaaacattttaaatctgtttttattgtgcccatcaaccatgtatccatacatttttttcatttattgagaactcattgtgtgccaggtgctgagtttacaaactacacttaagattacaaatttgacaactcaaatttggcaacgactctatctcaaattcactagaatctagtggcagcagcggaaggtaaagaaatacttttaaaatggggctatgcagtgtaagcatcccaacagagtttagatagaataccatggggtgtgactgtttcttcatctgagagaagtaagaggggagacagagcagggaacgttgtcagatgaagccaaggaacgtggaaggatttcagaatgcaggaccgcagtcttctctcttaagtagggagggagacaccacctgagggaggagcacaggcaaagctgggactcaagagtgaagcaaggctcacaggtgccaccgtgggaaaggggtaggcacagggcaggagtcaagtggaaatgaaggcattcagtgagcagtattcatccgtctactcaacaagtaattccctaagggcagtgtcatgcatggtgctaagtttggggagtcagttggcaggtgtgccctcgtgagacacagaggctgaagaggggaacagaagcacagtgaaccaatgcggacggagttccatggtgcacagggacacctacctgcggtgactgggatgtgaaaagctgctcacaggacaggaggtgcatgcaagatatggaggataaactgagtgtgtggagaggtgctgcaggagtacaaaggtgcagatgtgctgaagaacatacaagcccagcatatttcagtaatagagagcagctcctggtagctaggccagtaattcccatcgaaatcatctgaggaactttttaaccatggctggatctgaatcccaccttagaggtcatgattcagtaagtctggggtgggacgtgggcatcagcaagataaataataactgtagctaatactcattagcacttaatgtatgcctagcattgtgcctattgttttagctacattaagatatctaatccttctccatcttcccatgaaggaggcactctcattatccacattttaaagaagagaaattgaaatagaaaagttaagtgaattaaccaggatcataaagccggcaagtggcagaagcaggacttgagcctgggcaggccagttccagagtccaagttttcagtcactgtgctgtgctgcatagtgaagaccctgattagccatcaggcccagaatccccaagacagctctaagtccacactgtggagtagagtgaaatgagccaggaaagacagccaggcatcacatcaagaatatccccgtcttcatggtcagaagtctggcatcaagggccttcaaccacagtgaagaagaatttaaagccaatcagcacagtaatgtggtaattttgccaaccaagtcctgaggcttgggtgtttgcaacaggaaaatggatatttaattcattcatttatttagcataatacattgaataactactctgtgcttagtgctgtagctataagaagtattatatagcaagcagcccttgctttcgacggaaagaggtatttaacaacatggcaaagagctccagatcccagggcaaaaaatggcacaagataccatgacagtcgaaacaagtgaatcaccacttggaccaggagagtccaggaaggccccccgcccctaggtaggaatgtcagggacaaggaaggctccagagagaagggtaatggacgggtgtatgcgatctagctgaatactggaaactgaggtccaggcttcagtgagagaatgaagtgggaaggaggaatcaatgaaaaagtgaagagaaggttccactggagagaggggcccaaaagaggaaaagcaaagcaagctgtggccataagaagaagtctgagacttggaagtaaagcacaaacactgagtatcagagttgggaatcacctcaggtatcccagcctgtacccagtgcaaaatgccttctgaactatttcaactgctgaggctgctccatttgcttttaggccattatctgtaaaataatcacagagttctctttggtttgctagtgaaaacaatgaggaacagacaccttaagaaatgtaacgagagccaaagacaaaacgggaatgttctctctttgccagaccaccttcatctgtacacctgcacatagccctgttcctacaagaaggcataggaaccgcgtgtgggtcccatttctttttcaatatttaagaacttgagaagtgggacacatgctggaatgaacacaggaagctcagtttctagttgtagctttgccaccatcttactgggtgctcttggacaatcacttctcttccttgtgccccaagttttcttctgtgaaaggataaactttgatgaatagtttgaaatctgttttagcagcaagtcccttattttaagcaaagaattgcaaagagcactgagctctaatacacaaaacatatctaagcctaatgtgttctgatggaaaaaaatggagctgacaaagaggcaggatgttacccaccttaggactccctggaaaacagtcaaatattttgaggccttttgacactggcttctcacaattctgagactagagacaaggaaaaggtagtgaaggctgtcaccatgtttctgggctggtgacagagcagctgaattcaggagcaagccaggctcctgagtgagtcatggggttcacatgcggagctaacaggctaacagccacttcttgccaatccgtgcagcgggctgggctgtcaggtctagagggcaggaatcagctgggatttgctactggttgcaagaggctgaactgcaggcactgaggagcagagctggtagcttgaaggacagaaagacaatttttcactgggctcttaagcagaactcccgggtggcaacagagaatagctcacgggccagccggtgcaggtgggataagaggttcctgtccaggctggcggcatacatgaagctcactcttcctatttaaatcccagagaatatctggagagttttaaagagccctgaggcaggcaaaagagaacatgtggattttgtataccgatctagctcagtgtcaaagtttgcctttttcagtagtacattaacttgggttccaactcagaagacaagtcagaacattgaacatttctccagatactcaatgtgaaaagaatccaaatagaaacagtttcaatttcaaaatattttttgatacatacacattcctgaggatgaatgagcctgtgtgtgtgtgtgtgtgtgtgtgtgtgtgtgtgtgtgtgtgtttggggagagagtgtaggtaggaggggacgagagaccataaacatcaacatccacacactagaaatccataaaccacagaaagaatcagagacaaaaagtgggttctccctgcagtgtaccagttcatgaaaaagtagccttcatagttgtctgctaaactttctagatcagcctaatagttttttggttggttgtatctctttaaaaaacaaaaacaaaacaaatgaaaaaccaaacctgacctccctgcagaggcaaatgaggattagccattcagtatctccttatcatctgcatcctggtatttgttctcagagacaaggggtcctctacccctaattccagtccactttagggccctatagttacttagaacaaacgcatacttgctgtgacagccgaaagagcctggagaaatatgtaaacatcatcatctcactttagaaggaaaacaagctgtataaataagaaaaactgttacaagagtttaaaaaaaaaatcccaacagtcttacttgtagttagctcttcagtcaacacatatcacagtcctggagacagacacaggaactacaactctctccagctaaaaatttcctcccgcggttggttatcctctgtttatttttgaagcattcaaaggccacgctaacagaacagactcggttttcctgaacatccacagcggctgggaagtcctgccgtgaatgcggagcaagtttgcggagacttgctccctgggctgcggctccgtagttgcttcgagcttgtaaatacaagctccgtggacaaagtcccaaatgacatcactggcagctgcttattgttgagtctttattaactgactgtcaaaaagaaaggagggggtggggaggaagagtatctcttctgcagcaaaatcggcatcttggagtggattccagttatacatgcgtaaataatcccattgattcacatttttgagaggatggcttctttcaggtctgaaaaagacagagaatcgcctccaccagcttacactggaatagctggagacctggaggaaaagtttgaagtgccagcacagccctaccaaattgtttacccacctgtttcgagtcaacttcagagcctgatgattcatgaatatatgaatactggttgtgtcttacattgcttaattacttttactgtgatatatacacctggccgacatttttcctagatagattgtcttgggtgcaactccttttagatacattctagtgtctcagcttggagtagaaggaagggatccttgaaatcacagcaacattttgtgtgcatttgcaaatatgcaatttttcttttcctgagaagagtgctggaggctttcttctgattcttaaaattttaaccacccacctgcaccacccccgacactccaaaaaacaaataaataagaatctgtgccaagtctttctaataatctcacagaacactgtaaatcccactcacaactatcaaaataaaagtgggccttttctcccctattttccactctctcatggaatctctcttctgtccgttggttcttatagtttttacagttatctcccctccaacccctagcccccacctagagaaattccacagatccaacacctagtctctgccacgaagcgcgaacactccagcccactgttttccttccttcctctggactgctataacgatgcttactatttatatttacttgctgctttttatatactgactagtatttttagtttgttttttagccatctgtgttctgtctccccaactcagtttgaaaggtctttgagggctgccttgtaagtgttatttgtttatacctaaatcacttgccatagtgaatcctaaacagaaatgtgggaggtggggggtgagcattgagggtggaggcaggaacaaggttagctgattctgtggcatggagtgtatgtttagattaagctctctccctggccttggaaaacaatgacctcacatctcactacccccagcagatgctcattgcatgtctgaaaattatttcctcaaagagtagcaattggttattgatttggtagggtcccaagaccccaatatatgctactttcatgtgggaaatagttaaagacaacacaaattgtgtatgtcactgatgggtcttcaatgagccccatgttaagagaaagtaaattagatgtacctaaagattttacaagtacagacccttagacccagcaattccacttttccatagtgatcccacaaatacactcacaaaagagcacaaagatataagcacaagttctttgcagcattatttgtaagccaataaaagggagactaatattcatcaatacaagaaaacaaaaatggaggtaactgtgaatatactgatgtggacagaagtaggttgttgcttactgagtggataaagcaaggtgcagcgtagaaggtggcatattgaacacgaaaaagaactttgcatatgatgagaggaattatataaatgattaacagtggttaccctcgggaaaaaaggtggaaagaactttcacatttgtatgctttgtgtgtggtttgactttttttcaatgatcatgtttcatttttgttattagaaataataataaaaagacttggtggtacattttcaaaataagcctcaaaaagaaaaattgctatttcttcactaaatgtctgacctatagtaggtgctcaagaaagaggtattgattgaatgaatgttgatgaagtttctcccaggatgcaatggtatgtgggagtggaatagggttgagaagaggaagacacaagcactagttttcatttctgatccaaggacccacccctttccccttatatttgaggactgatttaaagacctcttagactctgtccaccttcagaaatgattaaagttcagtgctcagaacataaagtgctgaccttttccttgtgcaatcctgtttgacaaatgaagttttaaggtaagacaagtgtgagccgcttcggttcattttcctggctgctagcaagcaccggagcgacaagtcagaaagcttgtaggggcacaggtgtgaccagctccttgtcatggctagtctaacattaaggaaatctccagggagagcttagaaagctctaacccacaatgagtctgcagagctttattaagaagggactttgccttttttcagtggccgggagtgatggcacaaaacccagccctgcctacctgctatactgcctaccaggcctttatagtagaaactcgaaggcataagccatacattagagcctatgtttttctttaggggggaaaaaaaagtccaagaaaaagaatgactgaaaatttccaccaagataggatagacttttcaaagcactatttctattcctctagagaaagcatatccaattcttgtcttacttcatagtgagaagatatcttacgtctataatcgtttcaagaaaaggaaagcatagcccatgtttcctgcatatttttattttttttatggcccacatattataggaacctgaggccagattctgtttaatgcacttttggagccccttgggtgtgatccaggtcataccttcccgagggagagttaaatacaagtatttagctagacttacgacttagcataaaaacaaaagagggtgggggtaggggagggaaaggccatcctcaccacctctacctactaggtgattatgaatgctgctgccaaaactccccccacctgctgagtgttgtctccccgcctcctgcccgcctgctagtcctgcgctcaggtaatgtcctctctccctgaggcctgggagaaggacggctgggtgacactgtaacaggcacatatatggctatttacctgatcatttttaaaaatgtcttatgctggtcattttattatgttaataagtgttttctgtcttaaattggaaaattcctgaagtcagagatggtaatcagatctgcatggagtaaaaaacagccaaaaggtctcttagagctgcttactggtgatgacatgtattacaagggacctacaaggaccatgatcacaggcacagtttctacctccagcgtctgagtctgccactcccccattctcataaacaactgccccttcttcagcatttctatgtgccattggctttcagtgcatcatctaatttacccttaaaaaagcccagtgaggaggcggaggttgccgtgagccaagatcgcaccattgcattccagcctgggcaacaagagtgaaactccatctcaaaaaaaaaaaaacccagaaccaaaaacaaaacccagtgagttacacactattatcttcactcacctttcacaaccaaggaaactgaggcccagggagatatgttcctgaactaatttgaatgtgattacacaaagagtcagtggcagatccggaatttcaactcaggtctgcctgaccctccagtgtcctaaggagccctggatccctctgaggatgataaacattgaagaggaagttagtaaactaatatgaacagtggtaacttggaataagaagcatgtgaccaccattaatactcctgggtctgattcctatatgcaaatatatgccagtgggcattcagcagagcttcagatgtcaaccgcaaacccatgtgacttctgctcctttatgtaacccagcccctctgcttagctcttccaagagaagataagtcataggcatgaaagacaagtgcaaagaccatgggaatcacactcacagggctgagtcctagggcattactgtgcagtaaattctccatgcccttggaggtgggcaagattcaattgcaggatggagaaaatatcggcggtgggggaattcagtatatttgttgcatgcttccctttgcactgagcctttagtaatgagtattgtctgctgcagtacctgtgtcttctcctggagctaattgttctaccagggcttaagagacagcctgaggccatccagtctgctctgtaagagttaatatggtcaggaataggaagcacaggaaattttagaaagggcagcataggaacacctcagcattcatcaaacaaactggcatggtgttgagagtgtgagtctcaaggggccttgagaaccctcgtgtttagaacgtggcccatgtcattctcacacatatggtcctcagaccatattttaagaggcactggttataacaagagaagcaaacagatgaccttctagtctacaatcagacattgataaagatcatgtagttttgtccaggttctttaggagggagccctgtgaccaattagaaaattcttggtaaccataacttacaatagatcatatctgacacaaagttggtgtacaaagtaaaacttagaaaagacaaaacaggtgccacattgagggccccaaacgcatagtgggataaagacatttataggctttaatcactgcagatgttatggtagccctcttacataaatcaaacaaaaacaagactaaaccataaagtgagcataaggaattccaacaaagttcagattactcccataatgactgctttgatgcatttcatgatatttcaaatttcaaacttacaaatgctgttttccctcctgagaggagtgagggctgcctcctggtcccctcaacacacatgtaatctgtctgtttggttgttgacagtattgcaaccccaaggacctttggcgagggggctgatacagcctacatctgctgggagaggaggtgaggggagagatgtaaagtttcccctattttgagaaactacctggaacctgccatggaaatgaggtgtcagcccaccatccctttgctttttcaccagcgtaggttctaggcccagcccagggaggcacagtgagggttaatgtactaaggcactggaaggctcttcatgaaaggccctatgtaaggataaagtatcatcatgaagttggaggattttatttcagcctcctcattgtgttgttgacagtacatactgtgagattgacatttttaacttctttgcttgccccaaataaaaagtgctgagacagaggaggtgggaaaagggaacgggtgtcgggagccgtaatcttctcctgactttgattttacacaaatccaatgcacaaaattgaagtccagtttgccagctggggtccagcaatactactttaaggatttatgtaaattcattaaactacaagatgcaagttgcattccttttaacctgcgaacagagtctgcctgaaaccagagcctggaggaggcaggggatatgactgtgtggaaactgagagtgcaatgaattttgtgtgccccgattgtctaaatagatagactctgagtccaattttcacctgattctgggaggccattaaaatcagttgataatactaagaaatggaagaggataagaaaaggaagaggatggggacagccactgactttcccctgtgtgaaacctggcttattgtaatcagcgcctgccctgaatggtgttgacagtgggttccctgtagtccctaaaacacactgaggcttgacgcataatagcccctgaccccaccagatcataatagtcccagacgaccacgctaggatgtgatgaggagctcccagcagataacatgcaaagatgccccagggaagaggcagggatgctctgcttttccttggtggccccagggaacagactcttcaggctctggtggccctgctgcatttgcccagatggccagcagagccctgggctgattactcagccagcccctgagttcctcctttcatgttgagaaagctttttagttaaaacgacaaaaatgggagtggtggcaaggaaggtggctcaggggtctgctggagtgggctggagttgcattttcttctttcctttttttttttttttttttggaagcacacacacaagcacatgtgcacacacataatataaattctttgctctgatcacctgatattttaagctccagaaacagcttatttttgtggcaaatatgcttcaagggcccttcagaaaaggcatccttacagatcagaggaagagtgagtcagccctaacccaacagtctgttcctaacccaacaaccctggaaagtcaacagaaatggcagaaattgggtaggggcagccagaggaaagttgccagctcaggtgcaaagaacacctgtccaggcacagggccagggctctaggggtgagcaaggctgagatgcagctgtaggcttttccatgtccagcgtggggactgctcccttgccttggcctgacaaagagagaaaatggtcatcatccaggcagccacagcgcatgtttactctttctcccgggaaaaattgcctgtgctttctccaaactcaggcaaagcccactgtggtttggagaaatggtcatttgtccaagaaaccacagtattagaattctctgcacttcccctgagacgccaggaaagtccaagggacttgaccctgggctattaggcaggagcctcttggctctgttgtcactgctggcttaaactttacaccttaaagaaatccagggtgattgatttgaaacacattgaaccttttccaggtacaataaccattgttcaatctacaaatctactggatttgggaaattattttaaatgacagccttctattaacaaaggagaataaccactcaatttatcagttgccacttattattttgactgattataagaacatgagtcctatcggttagggtcatgagaagttattgctagcttccacattttcaagcattccatattttgaaattgcttaattctacggccagtgccttctgaataaatataaaaatgataacacttcttattttataagaagagtgtagacagtatagtaaggaggcttttgagtgttacaatagcaatagaatacatttgaaatgaagtcttaggttccattcggttccataaacagctcagagggtgatgtccctgggtaacgtcctacagcccatcctaccagccctctcctactgctgctggccaaatcggcagagaaattgcagacagggctggatgaactgaattaaagtacattcttctttccctgtccagctcatcccttattgactcctgagctcttttgacccatagcaaccatctgatctcttaacgataaacatggacttgcatgttcacatttgctttttgtaggccactctcactccaagccagactgtggtcaccttgatgcagagaccttcttctatgcctcagtagttccctccatgctagcatggtgctagccatgtacagctgtgtaaacaggtttattccaactggaaaaggagatgaaagtcacagtaggcctaaaaggtaaggcaaaataggtagatttgacgcaacttgggcttccagctacagacttgaatgggtgatgaggaagtgggaaggcaaggctccagggcctaaggtccagaaacttggctgccattcttttctttgttcttcccattcttttttcttcagctactcctcttccaagccacttgtttaataaagattgtcatatctgcctcctctcctagaggcaatcagcatcacttaatagtggtgaaaaatacatggggtgttcacagaaaataatatattactgtgtaacaaagggcaggtaagcttgaagggtacatgaatctactaatctttgaaatcattaatttgttatttattattgaatgtgcttattcattcactgagtcattcaccaaacattatatggaacagtatacaatttataccacaaatcctcactgcaaacatatagtacttcaggttctatgtatattttgcaatctgaatgcctatagaacattctgtgggtgtctactgattgggagacacaattgaaaaatacattgaaatatttccacctctgttttgataaaaaaataaagtcaaagcataggcgctgtttgtctgagtgagagggggtaactaagattgtacagaactggaaaagttaggacaatctgaaaataaagtgcagctaattgaacatgatacactaatctcttggatacagagaattcagttattagtggaaacccagttcatcaatggaaatgtaattgttgacagagcatgaactatgattgacatgaggtcagaaagtccaaaggtcgcagggttagtgattcatatcagcttgtcagagcctttcctgtaatacactccatacttggaaaccagagtgattggaacatgctctcctttcatctcagagatgagaccagtttccacctaagcctctggtatttggacttgggctggtaaggcaactcatagaaatgcattcccagaagcagggaaccttcccacccccaacatcaaacttccataccaacaccaaattatgtccagtccccaggagagactcatctcaccctaggagggggcagtgggtgatatgcccagggcttcctgctaactttggccccagggactgctgaagaatgcaccacccctgtggtgagagagaaggaagaaaagaaggaaaggacattctagaattgatgtggtgaggttgtgggtagaatgaaggcccagggttgttctgtaatacacatgaatacaaaagtacctggtctggcctggaagacagggactccaggaagacccctatagcattgtaatgtttgggagcattatcacatttagctctggtttgctccctagatatattccctattttaccattatttccctgttctcagcagtttgttctctttttttcttcttttttttaataggatttttaaattattattattatactttaagttttagggtacatgtgcacaacgtgcaggtttgttacattgtacacatgtgccatgttggtgtgctgcacccattaactcgtcatttagcattaggtatatctcctaatgctatccctcccaacttcccccaccccacaacagtccccagtgtgtgatgttccccttcctgttctcttttaattcattgccctcatgttcaatttccttttgatctatatgtatgagcggccaagtatatgtgaagtactgcaggaaccatccagaatgtctctgctccctgtcctcttaaccagatggaaaaacaactgctcttggtttccaaaccctctccccattcattattccatggcttcatttgtgacccttccaggtggcttagaaaaggcttcatagaaaaccacctaagacgacccagctccagcactgaaagtcaagtgtcctttccatctgggcaaagcaaaatggttggtcaccctaagcctactacaatttctattagcaacttctcaaaatctcaaaaataagagaaagaaaatctaaaggaaacaatgtgctcctatactagttgcctaacaccatctaattgcctctaatggtccctcccatgtaaagattctgtgtggtttcctctatatcttgttgactctagttcctatggtaacaaacctctgctccattcatctccatttgtcttgccaccctccctttcttcagcatcttcccttgcacccttgcagtgaccccatctatcccccatctatccctgtaaaagacatttggcaaattgtgcagtctttacaaagtgatgccgtgttgagcctttctgggaaagtacaatctttcagcctggaactaaccctggggaagacgcagacatgcactgcatgggtcccttgtcggggagcaggaagcctc

SEQ ID NO: 450 - DNA, 20830 bp, Homo sapiens
tctatttataaagggacttcatcctgaacttagaaatttaattagaaaacataaactcggatgggaagttacagccatgactgaattggtggctctagctgaacattttgagaggactgtagagcaagaaaaaacccaaaaggctaacaagcttatgactgttcaattacaacagttacaggggccaagaccaaagggatcttctcattctcattttaaatcacaaccaagaggtattagaccaagaaattcttcaccctaagatgtctgccttattgcaaacaaccaggacagtggaatagggattgtgcccttttataccagcccaccaatgaccctccctttaggccagcctgtttcaccactagagggagcacaagagaccttagctctcctgaagataatcagcattgaagcggctctgagggatttcccagtatattgctcctcataacacccttaaaagaatatggagaaacagaggttacaataaatggggactcatgtatagtcttggtggataccagagctaccttatctgccactaccgtaaaacacactttcatacgccaacagatccctcagagttaaaaaggctatttctgtggttggggtttcaaatcaaattcaagaggttcccatatctgaacccgtccaattgactttggggcactcttcagaaaatcacacttttttactgtatgatagtgctccagtaaatttgctagagggagatttactttcaaagctgaaagggcatagaagactacctattgggtacattgtacactgcttgggaaatgggcacactaaaatctcagaactcaccagtaaagaacttgtccatgtaaccaaaaaccacctgtactcccaaaacaattgaaattgtttaaattaaaaaatttttaaaagtggggaggatgtaaaattttccttagaaggagtaagaatcagtttcctgattctcctgaaccagaattgttatgctctctataggcagaaattaataagattgaaactcaggcctgtaatgcctgatcttccaaaaatacatgaatgtttatgggtctcttcctcaactgacacaggaagaatttaaagtgtggaacttataaaagtccaaatagaccactctaaacttttgcctaaattacccaatatccactaaaactagaagcaattcaagggctctcgccaattatagaagatttaattaaacagggacttataattctatgcaccagccgttgtaacactccaatcctactggttaaaaaaaaaatggatgaggttgaagatttattcaagatttatgggcagttaacaaaattgtagtagcaaggtttcctatagtcccaaatcctaatactttattatccagtatacatgctgattcttaagtggttcacaatattagatctctgctcagcctctttttgcaatccaattcgtaaagagagtcaatgcttatttgccttcacttggaaaaatcagcagtacccctagactgtgatgccgcaagggtttaccgaagccccttcgtatttttcccaggccttgcatcaggacttaatgacattatagtttccttaaaattctactctcattcggtacatagatgacttactatatgctctcccactaaagagtgctctgaaatggactcagtttaccttttacagcaactcacacatcaaggtcagaaagcttcaatagaaaaacttcagttttcaaggggaaaaagtccattatttgggacatgacttgaagggatttccctctcacctaaaaagttaaaaactattcaaaattttccttggcctgcaaccaaaagataattaaatagttttcttggacttgcaggatatgtttttagacttgcaggatataaaattcctgggttctgaatttttccttaatagcctcaccatttcatgagctccctaaaaaatgctgtaccagagcctttatcttgggatgatagttacgagcaggcttttagctaaataaaattgaccttgtaacagcctccagctttaggacttccaaattgcactaaactgtttacctaattggctcatgaaagtaataatcaggcatttaggagttcttacccaggaacatggggagaaacataggcccattgcatattatagcctgcaattagacccagtagctaaggtatatcctaactatttaaaagcagtagcagcagcaaccaggatgaaagaagcttcagctgatctggttttaggaaatgaatttaatttggaagtcccacatgctaaattccacccaaacccagcattttttagtaagtagactaacatgaaatactctgtctccttctaatctctctctaaaacactgcaatttacttaaccatgccactgtattactgctgcctgatgatggtgaagaccacaattgcataagtgtagcatcagaaatagtggcccctcatgttaatttacaagttagtcctttggacaatcctgagttaatacttttgttgatgggtcctatgccaaaagctcagaaggaaaatatcagctaggatatgctgttaccaaaatgagttaatagagaagggaccccttcctctattagtcagctctattagtctaagctctataagtcagcttaactcttgaagatttttgccctcacccaagcttgtcgtatagctaaagacaaatcagtaagtatttagacagatagtagatacgctttaggagtagtacatgattttggcatgatagggaaactctaagggtttctcacttctagtgggatcaccatcaaaaatggactccagttagataaactcctagtttgctgttagtgatcgaagctcatacctgcagaactgaacctgaatatcaagggaatgcttagcagatatttatgctaaatcagctagtactgaaactgttcagatatgcaacctgaatgaacttcataagattaatccaatccaactaccttacaatgacctatttaataaacagtgcaatgcacctcatttggaaaaacaaaactggtatctaaaaggatataaattcaatgttaagtgcagactcacagagggcctagatggctgtctggtctttcctgagtctttgaagcttctattttcaaaagctctgtactccacaactcatcatggaacagaaaaatacgtccaaattgtgaaaaaatacttgtgggatgattgttccaaaattgctagaatatatatatatatatatatgtatatatattttgagacggagtctcactctgtcacccaggctggagtgcaagggcgcgatctcaactcactgcacactccacctccctggttcaagtgattctcctgcatcagcctcccgagtagctgggactacaggtgtgtgccaccatgcccgactaatttttttttatttttagtagagatggggtttcaccatgttagctaggatagtctggatatcctgaccttgtgatccacctgcctcggcctcccaatatgctaggcttacaggcattatccactgcacccagcctgctagaatattttataaccaatgttggcttgtcaaacccatagtcctggaaaaacaaaagattcaggtggtgtattgtattttcaccacctaatggatcatttgaacaattatagatagacttcattcagttgccaccttcaatgggggtctcagtatgttcttgtaatagtttccatgttttctggttgggtagaggccttcctgtgtaggaaagctgatgctgtgacagtagctaagaaattattagaaaatgtgttttctttatggagcatccctggaaaaatccccagcaataggggaattcattttattaggcaggttataaagcagttaaacaaggtgttatggacacaatggcactaccattgtccctatcgccctcagtcttctgaaaaggttgaaagaacaaatggcatattaaaactgaaattggcaaagttaactgaatcagttgggttgccttggccaaaggtactatcattggacttaatgacaatcagatccactctcactaaaaaacagaagtggatcccttatgaaatagtcactagaaggcctatgccccaatagtgaaacctcatgcatctttctgtctcctaaattctgatatgagtaagtactgcaaggccattataccaaagtgtactttcaccagataaaggaagcttttcaagatccaccaactgaggataatcaaaccttccacagtctagaacctggagattgtgtcttctggaaatgacatcagagaaaggctgctcttgacaactctttggaagggaccgtgctgagatcttctcaacacctacactgcagtgaagcttcagggccttgaaacttgggtccacacctcacaactcagaagggcctcttcagactcctggaactgtacacctgctggagactttaaggtaaagctgtctaaggaaatatctctccagagcagcgggcattctagctgtggacagctttcccaagatcacagatcaagacttctgtatcatcatgaaagccttacattttttcttttctccgcatttcctgttgccctaattctttctttttccctacagaaaaatccatgggacgataatcagtggatggctttagcttgagcatatgctctagcacagaaccagagtttgtggcttattgggtttgtttttattgccaaaaaaataaggaaacaattccgctaatgccaatgcctctccatgttgccaatgagagtcaccccaaaattccaagggaaggatagaaagctatccttgatattctgaacaccattgctacttgttttcctgcactcactaaaagcaacactttaacttttcctttttttttttttttctgaggcagtctcactctgttgcctaggttggagtgcagtggccttatcttggctcactacagcctccacctccaaggttcaagcaattctcctgcctcagccacccaagtagctgggactctaggcatgcaccaccgcatccagctgatttttgaatttttagtagagactagattttgctatgttggccaggctggtctcgaacctccttgcctcaagtgatccaccagcctcggtctcccaaagttctgggattacaggcgtgagccaccatgcctggccttaactgtttcaattaataacctgatcaataccaaaatatagaaaaccagtccaagtgatgcctgcaaaagatatattgtgctttcaggcatcatgcactcaagttacgggaattacctatgtgagtacaagtaattgcttgtataatatcaccagattaaattcaacagggtctctttttactaaatgtgttatacacccttacaacatactacagggcgagcacaaaaaggtcaatttcccagtggattttgttcaggagctgtgtaggtttattaatgaacaaatctaactgacccctgctcaaatgcaactatgtggccctgtttttcaactcccaagggcctatactgggtctgtggataatctgcgcatttcattctgcctcctcgttgactcagaccttgctgtttggtctggctcacttctgcctttcaaatagtttcacctaaaaattctcctaacagctcttatgattggaggccaaaatagacaataactgaaattagcactagctttgaaatagacaaagataagctagtttccactgaggaaagattccagtggggttcctggggactcactcttggtggtggtgggatactagttgtatggaatctgaagctaatccatatttggggtcttggattttatagccaatcagacatcccaatgttccagacaggtagaagctactctccaaaaggtagatgtggcctggtgcagtggctcatgcctgtaattccagcactttgggaggctaaggcaggtggatcacctgaggtcaagagttcgagaccagcctgcccaccatggtgaaaccccatctctcctaagtacaaaaaattagccaggcatggtggcgtgtgcctgtagtcccagctacttgggagactgaggcaggagaattgcttgaacccagaagacagaggttgcagtgagctgagatcaccccactacactctagcctggttaacagagcgagaccctttctcacaaaaaaataaataaataaataaataaataaataaataaataaataaaataaacgaggtagatgttacagttaatggaacatcatgcagcttcatatctcctttttactcaagctggggcctatgtttggtattgaacaaaatggaatgctgcaattttctctctactgattttgttactacagaaagcttaatgtaaaggtggctgatactgctgtttccttagacactgacaccaaatacaataaagaagtctctcaagaggaaaacatggtgtgtttacaggagcaactaacagttggtttgtaggcatcctaaatggtggatggcaagcttgggtttcccaaaggtttctagtctttatatgtcttctagtaggtgtccaggttagtatggcctgtgttaccagagtaacaatgaaaatggctacgtctttaaatcaggccactttacagtgaactatggtccttaattgctatcacatttcaaacaagaactatgaccaattaaactttactattgttgaactgcctatgttgcctgaactttgactggtttaagttggtttcatttatttcataagaactcttgttaaggggtgcaccttggtattttgatattattctcttgatagtcataataatagttccctggtgtgctgcatcctctcaagtcataaatgttttgtatgcagccatacattgagaattgaatggtctcacttcaactaggtcagcaagaacataaagaatcatttacctagtgtgaagttgtgacttgtgaacttcatagtgacaccaataaagacttgtgaactccatactgagactaaaaggacttgtgaattccatactgagccaatttacaatagtgggagagtggcatcaatgcctaaacttttgatcaatctctctaaattgagagtctgacaaagagaggggagttgataaatgaaactcaaatccggcctgaggaagccttcatattgccatgcttgagttcttaagggtgaaccgtaatgtaactagtaggcaggcagactgaaaacctaacttaggaggatgcttctttagcaatagctgagtctcagccaatcccattggccatacttcaaccactcacaggcagccgactgttggaatcatgcccagataaggcaaacaccaagctgtaaccaatctggctgtttctgtacctcacttccattttctgtatgtcactttcctttttctgtccacaaatttgctttgacaacacagcatccctggtgtctgtctgtatctgctgtaattctgagggctgcccaacttgcaaaatatttatttttcttgctcaattactctgtgaaatttaatttgtctaatggatttcttttaacagaacttataattaaaatggagagcgggtgtaaatatttataaaacttgcagcctggccatgtggtagacaaggaggaatccaagcagcctgctgagcaactacttgctggagacattagcatgtctaaaagggagccaggtgctaatattcaagacagtgggaaaaggcctcagaggcatttcagaaggcccctcctatcacaggcccacaggcctaggaggactgaatggtttcagagaccaggcccaggacaccattgccctatgtcacctcaggatgctacttcccacatcccagcttctccagctccagccttggctcaaagggccccaggtgaagcgcagaccactgctttggagggtacaagccctaagccttagcagcttccatatgtttttttttttgtcttttttttttgagacagagtcttgtcctgtcaaccaggctggaatgcaacagcacgatctcagctcactgcaacctctgcctcaaaggttcaagtgattctcctgcctcagtatcccaagtatctgggattgcaggcatgtgccatcatgcccagctaattttgtattttcagtagatacggggtttcacaatgttggtcaggctggtctccaactcctgacctcaggtgatccacctgcctcagcctcccaaagtgctggaattacatgtgtgagccaccatgcccagccttccatatggttttaggtctgcaggcttgcagaatgcaagagtgaaggaggcttgggagcttccacctaaatttctgaagatgtatcaaaaagcctgggtgcccaggcagaagcctgcacagggcggagaccccacagagaacctctactagggcagagccatgggaaaacatagggttggaacccccatacagggtcctcactgggacattgcctagtggagctgtgggaatggggccaatgccttccagacaccagaaaggtagagtcgccagcagcttgcaacctcagcatggaagacccacaggctcaatcccaacctgtgagagcagccatgtgggctgcacccagcaaagccatagagacagggctgctcaaggccttgaaagcccactcctctcaccagtatggagttaaggaagatgattttggaagtttcagatttagtgtttgccctgctgggtttcagacatgtgtggggcctgttgcctctttcttttggccaatttctcgcttttggaatgggaatgcctacccaatacctgtaacacagttgtatcttggaagtatgtaacttgtttttgatataacagcctcatgggtggaaggcatttgccttgaggctcagatgaaactatggattctggacttttgagttgatgctggaacaagctgagacattgggaaactatcaggaagggatggttgcattttgcaatgtgagatgacatgagattttggggtaagaggcagactgatatagtttagatgtttgttctctccaaatcacatgttgaaatatgacccccaatgttagaggtagggcctagtgggaggtgtttcgctcataggggtggattcctcatgaatgggttggtgctctgtccatggtaatgaatgagttctggccctgttagttcacatgtaagctggttgtttgaaagcacctagcatctttcttgtgtgctgtctcgccgtgtgacacacctgctcccccttcagcttccaccataagtgaaagattcctgaggccctcaccagaagcagatgcctgcactgtgctttttgtacagcctgcaaaaccatgaaccaaatacacctcttttccttataaattacccagtctcaggtattctgttatgatcccctggaagagttatactacttccaggtctagaccatggtaaatcccacactcccctctgaggccaccttcttccctctgcagagaccctgtggttagagtggattggttgtgtctctggccccaattcttctcccgaggctgcattccacccttttgctatgtgactttgcagcccttcatgatcattacagaggcaggttcctctctccttgaatttggggaagatgcgacgcatgcaggagtttgaaaacacgtttgtttgcttctgcttttgtttttgctcctctgcaatttccttgaaaccatgcctgagctagcctgagggaaaatgaaaaagcaccattgagctaatctttcagccaatcccactgcatttgcacaatgcagtctgagaccagaggaactgcccagccaagctcaggcaaaattgctgacttcagactcatgagctaaataaatattgatttcattttatgattgttcttatgcaacattatcctggcactagaaaaatgaaacagatgggaatcaaaaagactgaatgaagcagaaacccagaagctaccccacaggcaatcgcatgggactcagatgttaatggacaataagcttttattgcacagaaaggtcattgcagtcagaggttggggattgcttgctgctacagccgaatggattctattctgaccaatacagaaggaaagaaatcatagacgccctgcctgagcagaagggaggtgatagatgaaatgaactgtatgaagatccaccagcctggcccacacgtggaagaaggactggcccgtcttcttgaagcccaagctctggtagaggcccatggcagagagctggatgttgctggtgtccaggacaacttcactgtagccctagtcccgggcaaactggaggacagtcctgaccagggcttttgctatcccctgaccacggtgctcattgtccacagagagatgaaacagctgcaaccgcttctccctcaaggtgggatcatcaacgggcagagctcctactgtgcccaccaccttctcttcagattcacccacccagaagcaggagccacactcactcaggtaggatttggtgatgtcagacatgtctgtgcgcaatgctatgtctacataccgcgtccagggttttttggcaaggaaccacagggcaggaaggaggctgaggctgaacacgagggccagaatccaggagccagagaccaggagtagggcaagggcccccccaagtaagagtatgagggttcgaggcagcttcagtaatcgccggaaggtggctggggcgtgttcggccatcccccgggagagcaagcccacgacctacttgcggtcgctctcctggtatttgcggatgtgataaggagccatggacagacttctgtgtctgaagtcactgagtccaggaaacagagctaggcctccctgcacgcctttacgccaggcctggggaagagagaggaaaccacgtgagtgcctgcatggctcccagccttgcaggaacagggagacctgcttaagggtgtgtctttccgcgtttgcccatgaggaagcaggcctctgccactgggagaaggtagcatgagaaagacctgcattggaatctggctccatgcctttctagctgtgtgaccttgggcatgtcacttaacctctctgagcctccacttcttcatctatagaacaggggagaagaaaacctgccttctagagttgtttcgaagattgaataaaataccttctataaagccctgatagatgaactacccaccactcttccctctgtttcctttttctggctctctcagcttcttggtgcattgagagagtacctacctcaggcaggccacatgcccaaccctttggtgcttctccagggaccatacatcgcagaaatcctgtgaccaagcacaagtttcaggaaaggctccctccagctttattgtaagtttttaggttgctgaggtggcataagtgccaagcataaaaaacagcccagcctccagatcccaaggaaggtgcatgctcagagcactgtccttccacccagtcccctcacctgtcaccacaagagccttgagtgtccagggagcttcagctgtcagccgctcactggcatccaggagataccgtctggggcttgctcacccctggaaagcaggctgcctgcctcattgcttggctcctgaatgtttggtaatcatcaaccctagggtcaaagagctgggctgtaacacagcagggagcccagtgtgcattcccctttatagtcaaagggaatggcctggagggggaaactcagggtctggaaccgcctgggttccttgcccttctggaaggcctgccacctctcttgcctgttcaggccctgggcatctttctgccacctggcacacttgatactctctgagatccaccttggtccctgtacacatataccacgagcctgagaactgtgccattcaccctgcactcagtcaccattggccagaagccgagtccccacacttggcaacaaggcccttcccagctaggcttctccatgctgaggtttccctggtccacaaagcatcgattgttggcagttctttgcactcacctcaccaacccccacctccacccattcattgattcagtcaacaggtgtgtgcgatgcacttcccatgtctgggggtcatttcagccatgagcaaggttgacattcggctgacaggcatggctgtgtgtggcttgtgtgtgttctggctgttggtcagaggctgtgccacacccgttgttaaatattttgcactgcagatgttggagaggcccaaattcaagctcttgtacccgacgtggagctgatcccaaacactgacacatgggtgcttggagatagagaaagttgtattcgatttggccaaagcaagaaggcaggagaggaagatctctcaacttcagttcaacaaagaagcagcagcagaatgtttttatgcagctagagagtgaggaagggggagttcagggggattgagaggaaaagtctgtgtttcctcagtctgagataacaccttgtgcaaccaggcttctcagtgtcagcagctggtcacagtgtccttcaaggcattcattccttctgcaaacttttcctgaccctgaaggaatgtcttcctgctgaacaaagaaacagtgcatgagcagtttatcattatgttgtgggaacaaggaatattggaccaaaagcaagtggttaacatgtgcaagccagcaacggtctgatcagaatgttcattatttcagtcactaaaacatggtatggtgctgaaatctcaaggggcccaattacaaggatgcaacatatacaagataggcaaaagcaaaacctaacagaaaaagcccttttccacaccaacttacatgctattgaagggaaacttccctaaaagattagccaacccattgttgatcagccacgctgggcccgtcatctaggttaggtagtttggactctattccaagagcaaggggaggacattgatatgcacagaggggagaaggggtgtgtgtgtgtgtgtgtgtgtgtgtgtgtgtgtgtgtgtgtgtgtgtgtgtgcgcgcttcactctggctgcaggtggacaatggatctgaggaggtgggaatggaagcagctaccccttaaggctagtgccgcatccaggcaacagcagggcccccagtgcagggatgcaggtgctcactgtacaagagcagctggcccagaggggctggtaggagctaaaatcgggcctcccgttgccaagccatgagccatggcacgaaactgagactggccaaaggaaaaggcaaccttttcttatttgctcgaaggcattgcttgcctgctaaactctgcatccagtggactgcatggcttgaggctgtgcctagctctgtgttcacaaagaagccgcctgggctagcagaggcccatgagacagcagtggcttcaacagagggaggaagtcaagaatgtgagacatgagccacatggaggtgcacttggggcagaaatggcaggagttggaatgattcacacagggaggaggatgaggaagggctcagagatgacagccaggcttctggtaggggcattcaggaaaacactggagagagcccagatctggaaaagtcaaggcttcccctaaaggtgctgccctgcagccttcctcagcagaaaccagaggctgggagtcagcagcaggaacccagggccagccagtggaggctgctgagattccagatctttggtacccaacaccacctccgaggaaaagtctaaggagcatcaagtctgggcaggaagtccatggcttatctttagagtgttctcagaacagttcagtgtcaagcaggagttggcctaggaattacaagaggtgagcagctgcttcaaagcaccactgagtacttctagtgtgagtctgaccaatattcagagtcagaaacctgccggtcacttggagggggagaggtttgtgctccgtccctgtgtgctgtctcttcctccatgctcacccgtggctgtggcttcctcaaaacacagcgacctcacttgacattcaggcatctcttgctcccaggatctactgtgacttctgcatttttgtagctttcctgataaaagcctgggctttccttgtcagacctgaaagattcatttattcattcaacaaacagttcccgaggacctgaggtgtgccgggcctggacttggcatgaaggcaccagatgttggaagcgaggctgccgcccaggaggacacacctgatggggctctgggaacaggatgatggtggagacatcacatccggaataactttgttaggagggttgaacttgacagttaggacttttatgttgcacttgttgaaaagccacctaaaattgtcataagtaagagaggtgatctaatggcccatgaaactgccaactccaggaagacagacagggtgacctgaaagtgggtttgacctgttggtttttctgccattctgtgggtggcatcagcttcctgccaagactggcactgcataggatgtcgggtgtttgccagcccagttgaagctgtctgcttccttgctcaccaacagcagaaaggtgggggctattccccacattccaggtgacagagaaggtttacatggggactcagtcacactttctggggactgtacatttcatagcagaatccaggttatattaaaggagtcctggccgaaggatgccagcaccccatagagatggagagccccagggagctcaagggctgaggggctgaggggctgagtgacagtgagcactgcccacagagggggtgccctgcagtcaggaggggtgggaaacgggtgcagatcggcagccaacagaggcccacccacatgagcacaggtggagttgctggtgcgatgaagagtgtgctggttgggagtggagggctgggggccggtagccggtttgggaaacccaagctgagcgaaaggtgtgccaaggcctgtggtggtgcctgttaacagaaaaatcaaactgttagatgatctgaaagaggtatcttctgagccaatatgagtgaccacggtctggggatctcaagaggtcctgaaaacgtgtgctggggccgtcgttttctacatttgaggggacaggaattggagtaacatcataaattaatccatggaaggtgtacattgactgggcctaacaaggtgggatattgtgaagcagcagggggcattatagatcacaggtggattcaaagattttccgattggcaattggttgaaagagttcagctttgtctaaagaccgtgaagttggtacaaaagaatgcttcagttcagagagaggggtctgcctctgccacgtgatgctgtcccagagtcaggtaggaaagtcagccacagtatcctgggtcaatttaaaccccactgaaggagactctgtggtttctagggtgtgtgttaattcttgccttgcaaggccttaagtcttgttcataatctgttactgattgtcacagagtccattctgaataatctaatgatgcctattttaacattcatgccagtcaagtgattctcctgcctcaccctcccaagtagctgggactacaggtacacgccgccatgcccggctaatttttgtatttttagtagatacagggtttcaccatgtttgttaggctggtctcgaactcctgacctcgtgatctgcctgcctcggcctcctaaagtgctgggattacaggcaggagtcagcacgccaggcccagagttttctaaatgagacttggtgtagccagtgagcttctgttgcctgctgtgacatgggtgctattgttcccattaaaaactcagacctctgcctcgggagacagggctcagctgcagcctactcaactaaaacatgaagcgctgcttcgtgggcaccacagcggctccttaaacttgcaatggtgtgcaaatttgtgggctcactttctacatccgatcttcaaaggtgtctgcgatcccagaaggttgggaactattaaatttgatcatttctgaaatgtcttccagtttaaaagtcttcagttccagttcattttcaattcctgaataaagggatgagtcttggagcttctggaagctggcctggaactgagcacttactgcagacagtgcctgaagtgcaaacccaaaggtgcgtagatctgggctgcatgtgaaagctttcatattcaggtcttactttgcgacagtgaggggtgaccagggaagcctatatgaggggcgggggcaaaccaaggcagcctgggagctgccttaaccacctctcacctcacttcctcagagataaggttttcttgaagggaacgtgcagatttatacaaaatactaacaagctgagattttaattttttaagcaataaggaaaaacagaacttttcactccaaagaccctgtgttaggctcggcagaactggtggcacatctcaggagtcatggggcaatgctctcagaaacaatgttagggaaaaaaaaaaaaaaacgaaaaacaatgaagaggcttaattcttcttgttaaaggaagaggtatcctctgtcccttttcttagagcattttgtttggaaaacttgtcattttaaatccttcctctgcccctttgaggggcatgcaaagctttttgacagctaaataagcctcttgccagctttgcaacccaggactgtgttcctgaaggacctgggatcccaatctttgaaacgttatcatcagagcagccaggtccctatctcccagtctccatgggagggcaggaacctaacttttgccctgtgtgataaatctacctcctatcataaagataagggttgtttttcctttgtatgaagtcaaatagcagacgcaggttgtcgagtgaattgaggttgaatctctgtaaactcggtgtgaccaaaagtgctgtgcaggccccctgacctgaggactaggcatggcttctcttgagaacgtgtgcaatggtttggacccactggctagattagcggtgagatttctgtctgtctttgcagcttcttagcggatcattgcccgtgatgcgcatctcactctgggttaatcctttttcaaggataaaagtgtttttctttctcttcttcctctgcagagaggcttgctgggatgggagaagattttatttgtaattccatttctccacgaccagaggatgggctctgggggtcaggcagctgggaaggagtttagaacccatgcctaggccttccccaaggctcatgcactcagttccctcagttcagcagtagcagaaacactatctggaagaccccatactgtctggaaagaggaactcattttctttcattgctgacactcctggatgactgtgtgtggcggttacccataccctagtcccaccctgtgccccctctccacctcagggggccccaagagccctggccctgctagtccagagcacccccaagggagactggggttgggggtcccaccagggtgccaggtgttggtcaaggtgaatgtgaactaggaggaaggagatggagccctctcctgggaaccggacagggacagggatggggtgggggtgcccaggaagccatggctctgggctggggccgccaacctgcccaggcaactggggctgactccttgaagttgcatttctgactccccctcccacgtgcaggctcttggcccactggaggcccactggaggccacagtggcaggttcactgtgggcgggggtgggggggatggggtgccctggggagctgggggttcctgtggagcaggggtatgggtcccaccctggccaccccgtctgcccaggctccacatgtgccccctggtccccctggaaagacccttctctgtcccgctggtgcacccctcccccaactgggcctccaccaagaagaagggcccgagttctgccgaggcgtccctctgagtgaccacccacacctgaagccatcagtcaggtccctgcacaggagccacccctgagcctgtgctcccccacccctggctggctgcatctgggctccagatacgtgtcccccacccagaccccattgctgggttaggcccttcttgccacccctcagctcttctccctagggaacagcatcattgccaacttctcatatcctgtcattgtccaccaggagagctggggcgggggaccccgcttgtgcataactggcctcaggcagccgacctggggctccacagctcttgctgccgctggaagttgggccaaggctggtggcacacacaggtgtgttcctgctgttgggatcaccagacaaggctgcttcgccttgggccgatcttttgccccggaccactcagccctaggtactttaggccaatctgctgatcaaggccataagtgcctcataaccaatcagcagggtaccttcccggcagcctcaagggtgactaggtttctaccacaccctgatcccaggccttcctctcagccagtcctacccagaacaccctatttcacagtgcacttcacccctagcctacctggccattccctatccccatagctggctctaagttttcttatcacctctaacctgctctaaatgctaaggatatgcatctgttgttgatttgtatttagtaggctctgcaagcagggatctttggctcttcggttcactcatgtatgttaagtgcccagaacaagcctgacagatattaggtgctcggtaagtgcgtgttgagtgagtaaacaacagacagccagtttgggtattcccagtagggcaggaacagagaagagacacgttttattgggaagctaacaaatcttaagcttcaaagttcctctttcccctgcaccagcaccttacaaaaaaaaaaaaacctactgtggttttacaatttatattttgcaaacaggctctgaaatgtatttacctcaggctccaaaaaacctggatcttccttgagggcagtgctgcctactggatgaaatacagattttagagtcagagttgggttcaaatcctagctctgcctcctgcaggtgtcttaacctctctgacccccctctcctaatttgtgcaagggaataatatccccacatgtgtaagactcaacagggtgggaagggcacatttgtatctaacctgaatattaatatatgcattccacagtttcttttgtatgtatccattataacataattttaaaaactgatgacacgatctggttttcaaaacctttctttattatttgtggaataaagttcatggtacaaatatcaacagagtcgaaggcttctgtgatgggtcaagtgagatggggcctgggaagtgactgatattgaccacaggatgcagcaacatggggatgactgatgaccttgacaggagcagcgttggttcagtggtccccaaagacctcctgacaggggaaggtttcacaggagaggaactggagctgagtgcagaggacaccatggagcagttttgccacagagtgaaacagggagatgcctggcagctgcagaggagggtgcagtcaaaaagatttgttacagaactgccgtttgactcagcaatcctattactaggtatatatccagagaaatagaaatcgttctaccatagagatgcatgtgaatgttcattgcagcagtattcacaatagcaaagacatgcagtcaacctaaatgcccattaatgacagattggataaagaaaaggtggtacatatacaccgtggaatactatgcacccattaaaaagaacaagatcatgtattttgcaggaacatggatggagctggaggcccttatctttaccaaactaacacgggaacagaaaaccaggctgggtgcggtggctcacgcctgtaatcccagcactttgggaggccgaagtgggtggatcacctggggtcgggagtttgcgaccagcctgaccaacatggagaaaccccgactctactaaaaattaaaaaaattagccaggtttggtggtgaatgcctgtaatcccagctactttggaggctgaggcaggagaatcacttgaacccaggaggcagaagctgcggtgagctgagatcacgccattgcactccagcctgggcaacaaaagggaaactcagcctcaaaaaaaggaaaaaaaaaaatcaaacaccatgtgttctcactcataagtgggagctaaatgatgagaacttatgaacacaaagaaggaaacaacagacactggggccttccccagggtggagagtgggaggagggagaggagcagaaaaataattttgagtactagtcttagtacctgggtaatgaaataatctgtaccataaacccccatgacatgaattcaccaatataacaaacctgcacctgtacccctgaacctaaaataagagttaaagtaaaataaggttttgcttcctgggatgtaggtgaaataattgtttgctgaagagatccagaggcaagccaaatagtgacggtataggggtggggatacctttgggacggtgctcttgactggttgggaggggctggcccgtatgagacagtcaagcaaaaggggcaggcaggaatgtgaacagggactgacagtgtgttatgtgctgggcttggcagaagttctctccattgcctcttctgttgtgtcttggtttttaacaatgaactaggaaaggatattaccaactaagagtgagggtcagagaagaggcattgttctttgagggggagagaaatgataagccgttgtccagtagttgcctcttctgttcagtaaggacagaatctgacagggtggagctgggggagaagaagaaagccaatgaggagccagttctgtgatgaaacttacagg

SEQ ID NO: 451 - DNA, 54740 bp, Homo sapiens
gaaaaacaggactgggtatggtggttcatgcctgtcattccaggattttgggaggccaaggcaggcggatcacttgaggtcaggactttgagaccaccctggtgaacatggcaaaaccccatctctactaaaaaaaaatacaaaaattagctgggcgcggtggcaggtgcctgtaataccagctactcgggaggctgaggcaggagaatcacttgaacccgggaggcggaggttgcagtgagctgagattgtgcctttgcactccagcctgggagacagagcaagactctccctcaaaaaaaaaaaaaggccgggcgcagtggctcacgcctataatatcagcactttgggaggccgaggcaggtggatcactgacacccaacaccacgccttctaattttttgcatttttagtagaaacggggtttcaccatgttggccaggcttgtctcgaactcctgtcctctggtgatccacctgccttggcctcccaaagtgctggaattacaggcgtgaacccagcaacttttcccccttttatcataccttaatttgcctccaccacccccagaagctccaagtctctacgccttttcatttatgtatgtatgtatttatttatttatttatttattttattttgagacagggtctccctctatctcccaggctgcagtgcagtggcgtgatcttggcccactgcaacctccacctcccgggttcaagtaatcctcctgtctcagcctcccaagtagctgggattacagggcacaccaccacacctggctaatttttgtatttttagtggagactgggtttcaccctgttgtccaggctagtctcaaactcccgacgtcaggtgatccacccatttcggttcccaaagtgttgagattacagaccgtgagccactgggacggacacccctactcctttcttcttcttcttctttttttttttttttttgagatggagtctccctttgaagcccaggctggagtacaatggtgcgatcttagctcactgcagtttcctcctcccgggttcaagtgattctcctgcctcagcctccggagtagctgggattacaggcacacaccaccacaccagctaatttttgtatttttagcagagatggggtttcaccatgttggccaggctggtctcaaactcctgacctcaggtgatccacccaccttggcctcccaaactgctgggatcacaggcgtgagccactgcaccctacactcttatactcctttctgtagctcaggcagctagatgagcttcaatcatctggcccttcctccagtctcacatttttgtgggactcctgtgcatacataattgaatctggtttttcttctgtcaaactgttttgtgtcaatgtaattcatagcccatccaaagaacctaggagggtggagggaatccattttctctcctccacactggagggccatggagcccaagagttcaagactggcccggtgtacaaagtgagacccagtctctatttaaaaaagatggggagggggccgggcacggtgtctcacgcctgtaattccagcactttgggaggcccaggtgggtggatcacctgaggtcaggagtccgagactagcctggccaaggtggtgagaccgtgtctttactaaaaatacaaaattagcttggtatggtggcaggagcctgtaatcccagctacttggaaggctagggcaggagaatcgcttggtttgggattttctccctgaggcacttgctatctccaggattatgggtctcaggtgaaagaaagacaaagaaggagagagagacagagagggacagggaaagagaatttcagacttatctaacattgacacttaggagaagtagggagaaagaggtgggaaaataaagtggctaggtaaaaatgaacatgtcagtaacaataatagcattaacaataactagtattgccgggtgcagtggctcacgcctctaatcccagcactttgggacgccgaggtgggcgaatcacaaggtcaggagttcaagaccagcctggccaacatggtgaaaccctgtctctactaaaaatacaaaaagttagctagctgggcatagtggtgcatgcctgtaatcccagctactctggaggctgaggcaggagaatcgcttgaacccgggaggcaaaggttgcagtgagtcaagatcaggccactgcactccagcccaagggacagagtgagactctgtctcaaataataataataataataactagtggccaggcacagtggctcacgcctgtaatcccagtgtagcaggacgagccacagacaaaaacctctcagacaccgagttgtagaaggaagggctttattcagctgggagcatcggcaagctactgtcttaaaatccaagctcctcgagtgcacagtttctgtcccttttaagggctcacaacactaaagactgcgcatgaaagggtcatgattgagcaatctaggggatacataacaggggtttcgtgcactgctggtcagagagaaagaatagggcagggagtttcacagtgttcttctatacaatgcctggaatctatggataacatcgggttctaagtcatgagttgatttttatctactaggtttacgccaggcaggcccaggcctggtttcgggtctggttttgggtctggtgcctggcgccgggctacctgcctttggtttcacttccttgtttttttctttttctttttttttttttttgagacagagtcttgctctgtcgctaaggctggagtgcagtggcacaatctcggctcactgcaagctccgcctcctggattcaagcaattctgctgcctcatccttccgagtagctgggattacaggcgcacgccaccatgcccggctaatttttgtatttttaatagagacggggtttcaccatgttggccaggctggtctcaaactcctgaccttgtgatccacccgccttggcctcccaaagtgctgggattacaggcgtgagccaccgtgcccggcctccttgttttttttctaaaacaagtactgagtataaaacaatataaaacaatatgagacggtttctctcttccctcaccagcactttgggaggctgaggcaggtggatcacaaggtcagagtggatagcactttaggaggttgaggtgggaggatcccttgagcccaggagctcaagtccagcctgggcaacatagcaagacccccatttccaattttagtgtatgtgctgccaaagcaaatactctgagaccctgtttctacaaaaaataaaaaaattaaaattagtgcttggaaaaaaaaattagtgcttgaccaggaggcaagcacacctcctcatcctctcatggatgtctgtctgtagaaagtaaatggagacagcttcattttacccaactgctccgttttaggtccgctcctgagcttctgttgttcccagccatgcaaccctgggagccgactcccggctgcagagccttgtcagaagcaggcaatgtacacagagacccaaggcctggtgtagacaggctttcacagacctgggcattttgttgaattgtttttgaattgtggtttcttatcagttcatccgatactctgttctaaccacgtagttcctcttttggatctccaaacccctttgcaggttccatctacccgaaccaaactcacttattccaacagaagtctggtgtttcttgttttttttgtttgtttgtttctttcgttttgttttttgagatgttgtctccctctatcacccaggctggagtgcagtggcgagatctcagctcactgcaacctctgcttcccgggttcaagcaattctcctccctcagcctcctgggtagctgggattacaggtgcctgccgccacacccagctaacttttgtatttttagtagagacgggatttcaccatgttggccaggctagtctcgagctcctgacctcaagtgatccacccatctcagcctcccaaagtgctgggattacagccttaagccaccgcgctcaaccagaagtctgtttaaatccatccttctccccagccacccatgagttatgtgaccttggggttgctacttaacatttcagtctcaatttcctcaatagaacaaaagttagaagaattgtaacaaaagatagttttatttttatttttatttttattttttgagatggagtcttgctctgtcacctaggctggagtgcagtggtgtgatggtggctcactgcaagctccgcctcccggattcacgccattctcctgcctcagcctcccaagtagctgggactacaggcacccgccaccgtgcccagctaatttttttaatttttagtagagacggggtttcaccgtgttagccaggatggtctcgatctcctgacctcgtgatccgcttgcctcggcctcccaaagtgctgggattacaggcgtgagccaccatgcccagcacaaaagataatttcttaatcccatgcatttgagtcttaaaaaaatattctatataattccaaggtcaaagaagaaataacaaagggcatttttaaaaatgctagaactgagtggtggtgaaattgctgttgaaatgtgtttgttgcactgatggaaatttataaatgtaaatatttatattaaaatataaaataatgggccaggcatagtggctcacacctgtaatctcagtactttgggaggccaaggcgggagggccatggagcccaggagttcaagaccggcccggtgtacaaagtgagacccagtctctagttaaaaaagagggggagtgggccaggcacagtgtctcacgcctgtaattccagcactttgggaggccaaagcaggtggatcacccgaggtcaggagtccaagaccagcccggccaaggtggtgaaaccccgtgtctactaaaaatacaaaattagcttggtatggtggcgggagcctataatcccagctagggcaggagaatcacttgaacccgggaggcagaggttgcagtgagccaagatcatgccactgcactccagcctgggcaacaacagagagacttcatctctaaataaataaataaataaataaaagaaaatacaaattttttaaaaaaggtactgtggctgggcgtggtggttcacacctgtaatcccagcactttgggaagccgaggcaggtggatctcagatcaggagttcaagaagagcctggccagcatggtgaaaacctatctgtactaaaaattagcctggcatggtggcaggtgcctgtaggaggctgaggcaagagaattgcttgagccccggaggcagaggttgcagtgagccgagaccacaccactgcactccagcctgggcaacagagcgagagtctgtctcaaaaaggaaacaaaaaaaaaagtacctccaaattatggtagggtgtccatattaagaaggtagaaaaaggtcgggggaagtggatgcctgtaatcccagaactttgggaggctgaggcgggtggatcacctgaggtcaggagttcaagaacagcctggccaaaagggtatggtgaaaccccatctctactagaactacaaaattagccgggcgtggtggtacatgcctgtaatcccagctacacaggagtctgaggcaggagaatcacaggaaaccggcaggcagaggttgcagtgagctgagatcgcgccattgcactccagcctgggcgacaagagcaaaactccatctcaaaaaaaaaaaaaagaaaaaatgaaaaagaatttattgaaatgtgcagtctgaaaactgctcctgcacattttcattcatccttcctattccctccatccctcaattttttttttttttttgagacagagtttcgctcttgttgcccaggctggagtgcaatggcacgatctcagctcactgcaacctctgcctcccaggttccagccattttcctgcctcagcctccagaatagctggaattacaggcatctgccactacgcctggctaattttttgtgtatttttagtagagatgggatttcaccatgttggtcaggctgatctcgaactcctgacctcaggtgatccacccgcctcggcctcccaaagtgctgggattacaggcatgaatcaccacgcccggcccctcattttcttttctttctttctttcttttttgtttgtttgtttttgagacagagtcttgctctgtcacccaggctggagtgcagtggcgcgatctcagctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtctccatctcctgacctcgtgatccgcccgcctcggcctcccaaagtgctgggattacaggcgtgaggcaccacactgggccccctcactttcttattctttctaggataggcaactgagcgcggcagtgaagagctgggcttccggaagctgacagctgtttgtgatcttcaagacctcagacaggttttctaaatatgccttgccttcattttctcaaggaaagtgaaaaatgggtaggatcatggcaatcactactgtgtagcaatgtttagaggacttaataagtaaacacagggtcaagcatggtggctcacaccggaaatcccagcactttgggaggccgtggtgggaagattgcttaagcccatggggttgagaccagcctgggcaacatagtgagacctccatctctataaaaaatacaaaaatctagtcaggcgtgatggcgtatgcctgtagccttcagtaagctatgattgtgccactgcacaccagcctaggcgacagagtgagaccctgtctcaaaaagaaaaaacgaaaagaaatatagatgtacatatacatatgttggttctaaaacatgaaaaaggctgggcgcggtggttcgtgcctgcaacccaagcactttgggaggccgaggcgggcggatcacgaggtcaagagtttgagaccagcctggccaacatagtgaaaccccatctctactaaaaatacaaaaaaaaggctaggcgcagtggctcatgcctgtaatcctagcactttgggaggccgaggtgagcagattacctgaggttgggagttcaagaccaccctgtccaacatggtgaaaccccatctctactaaaaataagaaaattagccgggtacagtggcacgcgcctgtaatcccagctattcaggaggctgaggcaggagaatcgcttgaactctggaggcggaggttgcagtgagccaagattgcgccactgcactccagcccgggcgacagtgccagactcagtctcagaaaaaaaaaaagcaaaacaaacaaagaaacatgaaaaaaagctataaaacccaacttttttctttttttttttgagacggagtctcactctgtcgcccagggtggagtgcagtggtgcggtctcggctcactgcaacctccgcctcctgggttcaagcaattctctgcttcagcctcccaagtagctgggattacaggcacccgccaccacgcccgactaattttttgtatttttagttgagacggggtttcatcatcttggccaggctggtcttgaagtcctgacctcgtgatccacccgccttggcctcccaaagtgctggaattacaggcgtgagccaccgcgcccggccaaaacccaactttttagtcttatttatatggtgtttttttttttttttttttttttgagatggagccttgctctgtcgcccaggctggagtgcagtggcgcgatctcggctcactgcaagctccgcctcccgggttcacgccattctcctgcctcagcctcccgagtagctgggactacaggtgcccgccaccacgcccggctaattttttgtatttttagtagagacggggtttcaccgtgttagccaggatggtctcgatctcctgacctcgtgatccacctgcctcggcctcccaaagtgctgggattacaggcgtgagccactgtgcccggctatatgtttacaaaattaatactgccagccaggcacggtggctcacgcctgtaatcccagcactttaggaggctgaggctggcagatcacctgaggtcaggagtttgagaccagcctggccagcatggcaaaaccccgtctctattgaaaaaaatacaaaaattaaccaggcgttgtggcgcatgcttgtaatctcagctactcgggaggctgaggcaggggaatcacttgaagccggcaggcggaggctgcggggagccgagatcgtgccgttgcactccagcctggggaacagagcaagactccattaaaaataaaataataataatactgtgaatgtgaaactgatgaacttggtgcttttcatgcgtctcatagttgacgtgtcattgatatttcacttgaaatacggttggatttttattaataatatacctggggtgatgggagaaggtagccaatcacagctgaggcttctaagcggtgattctcagcctcggccgcaatcacaattatctgggactctcgaaagaactccagggtctgggcagtcccagtgtaaccaatcaagcagaatctctaggcgttcgtgctttgaaatgaggctccacataggtaagtttaacaggcagtcaagatggaggaccacaggtggagatcgggaagctcaggtgaaggaccgccccccaacaccccccgcccccaaaagacctctcagtaattccggtggatacaggaagtgctcagcaacgattacgccccgagggccaatcacagggctgcggccgagaaagaagccttaatagagctttctcaacctgcagccctcatctccgccggcgagtagggccaggtgttgggaggtgagtagctctccggcagctctgcaacttcatttctttatttctccattccacagttggtaaaatttctccttttatttcatatattttttttctgagacggagtctcgctctgtcgcccaggctggagtgcagtggcgcgatctctgctcactgcaagctccgcctcccgggttcacgccattctcctgcctcagcctcccgagtagctgggactacaggcgcccgccaccacgcccggctaattttttgtatttttagtaggtggctcacgcctgtaatcccagcactttaggaggctgaggctggcagatcacctgaggtcgggagtttgagaccagcctggccagcatggcaaaaccccgtctctattgaaaaaaatacaaaaattaaccaggcgttgtggcgcatgcttgtaatctcagctactcgggaggctgaggcaggggaatcacttgaagccggcaggcggaggctgcggggagccgagatcgtgccgttgcactccagcctggggaacagagcaagactccattaaaaataaaataataataatactgtgaatgtgaaactgatgaacttggtgcttttcatgcgtctcatagttgacgtgtcattgatatttcacttgaaatacggttggatttttattaataatatacctggggtgatgggagaaggtagccaatcacagctgaggcttctaagcggtgattctcagcctcggccgcaatcacagttatctgggactctcgaaagaactccagggtctgggcagtcccagtgtaaccaatcaagcagaatctctaggcgttcgtgctttgaaatgaggctccacataggtaagtttaacaggcagtcaagatggaggaccacaggtggagatccggaagctcaggtgaaggaccgccccccaacaccccccgcccccaaaagacctctcagtaattccggtggatacaggaagtgctcagcaacgattacgccccgagggccaatcacagggctgcggccgagagagaagccttattagagctttctcaacctgcagccctcatctccgccggcgagtagggccaggtgttgggaggtgagtagctctccggcagctctgcaacttcatttctttatttctccattccacagttggtaaaatttctccttttatttcatatattttttttctgagacggagtctcgctctgtcgcccaggctggagtgcggtggcgcgatctcggctcactgcaagctccgcctcccgggttcaggccattctcctgcctcagcctcccgagtagctgagactacaggcacctgccactatgcccagctaatttttttgtatttttagtagagacggggtttcaccatgttggccaggctggtctcagtccgcctcggcctcccaaggtgccgggattacaggcgtgagccaccgcgcccagccttttttttttttttttttttttttttcttctcttttttgagggtcttactctgtttcccaggctggagcgctgtggcaggatctcggctcactgaacccttgacctctcaggttcaagcagtcctcacgcctcagcctttgaagtagctgggaccgtgggagggtgccaccacatctgttctggctaataatattattattaccactgtttgcagagactcactagatgtagggtcttaatatgttgccgaagctggtctctaactcctgggctcaagcgatcttcctgcctcagactcccaaaattctgggattataggcaggtgccaccgcgcccggcctaaatcttttcttctgttagaaattaagtggttctgcctgtctcagtggctcacgcctgtaatcgcagcgctttgggaggccgaggcgggaggatcacctgaggtcgggagttcgagaccagcctgaccaacatgtagaaaccccatctctactaaaaatataaaattaggtgggcgtggtagcgcatacttgtaatcctagctactcaggaggctgaggcaggagaatcacttgaacccgggaagcggaggttgcggggagcctagatcataccattgctctccagcctgcgcagcaagagagaaactgtctcaaaaaataaaataaaataaaattcagtggttctgactggggaaagagtagcagatgcttagatctagagagactctagttaaggttggctcataagaggatagttgtgtgtgcttttatttctgttctcttgggggatttaggatagagctatagagagctccaaaaaaaaaaatatattggaacaggtcagatgctgtggttgctgtgtgtggagtcctgggcagtgctaaggttttgtgtctaatgagtcctcttaacaagaaggtattgttttttattcactgaggtgagggagcctcttagcatcattctagtccagcttccggacctgagtcttatgcaaatacctatgccagttgccattctcacgctattcacagctatcatataaagaggtgttataccctttctgtaaagtttttgttgctactgctatttttttttttttttttttgagacaaagtctagctctgtttcccaggctggagtacagtggcgctatctcagctcactgcaacttccacctcccaggttcaagcaattctcgtgcctcagccttctaagtagctgggactacagccgcctgtcaccaacctggctaattttcgtatttttagtcgatatagggtttcactatgttggccaggctggtctcaagctccagacctcaggtgatcctcccaccttggactcccaaagtgctgtgattacaggcgtgagccaccgcacccggccctgttgtttttaaaatagagacagggtcttaagttgccaggctggtctggaacttctggactggagtgatcacccacctgagcttcccaaagtgcggggattgcaagcgtcagccaccacccccagtgttgtgtttttgtttgttttaccaggctggagtgcagtggtgcgatcacagctcactgcagccttaacttccctggctcaggtgatcctcccacctcagcctcctcagtagctgggactacaggtgcatgccactatgcccagcacaattttttttttttttgtatttttttgtagagacagggttttgccatgttgcccaggctggtctcaaactccaagcaatcctcccaccttggcttcccaaagtgtttggggttccaggtgtgagccatggccccccggccagcttcagtaaagtaaaagccacacacctgtgtcctgagaccaggctccaccactaagttatctttaagccttttttttttttgagacagtttcactcttgtcgccccaggctggagtgcagtggcgccatgtcagctcaccacaacctctgcctcccactcccaggttcaagcgattctcctgcctcagcctcccaagtagctggaactacaggcacctgccaccacgcccggctaattttttgtatttttagtagagacggggtttcactgtgttagccaggatggtctcgatctcctgacctcacgatccgcccgcctcggcctcccaaagtgctgggattgcaggcgtgagccaccgcgcccggctgtgtgtttgcattatcatattcagcccagttttcacgaagtttcttgtctcctgggtgatccacgtagctccccacttccttatctgatctatgcttgtcctttcattgttgtgttactactttgctataatgagagagtgttttcgctttataggttaacttttagaacctgagcagcccctcagggaaaaccctgacagtagctggttattttgcaattagaaaaactagctgggcactgaggcaggtgaatcacgaggtcaggagttcgagaccagcctggccaacttggtgaaaccccccatctctactaaaaatacaaaaaaattagctgggcacagtggtgaatgcctgtaatcccagctacttgggaggctgaggcaggagaattgcttgaatccgggaggcagaggttgtagtgagccgagattgcagcactgcactccagccagggtgacaaagtgagactccgtctcaaaaaaaaaaaaaaaaaaaatacaaaaagtagctgagcgtggtggtgggtgcccataatcccagctagtcgggaggctgaggcaggagaactgtttgaacctgggaggcagaggttgcagtgagctgagatcgtactactgtactccagcctgggctgcagagtgaaactatctcaaaaataagtaaataaaagtaaaatgagttgaggtcttgctctgttgcccagatgggagtgcagtggcacaatcaaggctcactgcagtttcagtctcccaggctcaagcaatcctcccactgcagcctcctgagtagctgggactacaggcatgtaccaccacccactgctaacttatttttcatggagatgggggtctcactatgttgcccaggctgggagtttgttcttgaagaagcagggtagatggtgagtgtccttgttcgtggcacagcaggaactggcatttgagacaggagtgctaatcaccatccctctccactcctcccttgattgtcatcacagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagaggtgagtggaaatcggtccacactgtgtcctaggaggaagcaggcgtcctctccaggactttagaaattcagaaggccaggcgcgctggctcacgcctgtcgtcccagccctttgggaggctgaggcggttggaccacctgagggtcaggagtttgagaccagcctgaccaacatggtgatgaaacagcatctctactaaaaatacaaaaatttgctggacgtggtggcagacacctgtaatcccagctactccgggaggctgaggcaggagaatcacttaaatctaggaggcgggggttgctatgagccgagatcacgccattgcaccccagcctgggcaacaagagcaaaattctgtctcaaaaaaaaaaagaaatggcattgaggcttggagagggactgcttgttctgaatgcaggtgctggatcttcataaaccctggtgtctgtcctggtccttattttctacctacttctttttttttttttttttgtccttttatttttttattttttattttattattattattttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatgttccccttcctgtgtccatgtgatctcattgttcaattcccacctatgagtgagaatatgcggtgtttggttttttgttcttgtgatagtttactgagaatgatggtttccaatttcatccatgtccctacaaaggacatgaactcatcattttttatggctgcattgtattccatggtatatatgtgccacattttcttaatccagtctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatccccacaccgacttccacaatggttgaactagtttacagtcccaccaacagtgtgaaagtgttcctatttctccacatcctctccagcacctgttgtttcctgactttttaatgatcgccattctaactggtgtgagatgatatctcatagtggttttgatttgcatttctctgatggccagtgatgatgagcattttttcatgtgttttttggctgcataaatgtcttcttttgagaagtgtctgttcatgtcgttcgcccactttttgatggggttgtttgtttttttcttgtaaattattttctacctatttctatcgctttcaggtatcgtacagttggcctaacatatctgtggatttaaccaatcctagatcaaaaataatgggggcaaagacaattaaaaataacaatacaataaaatgcacatgaactatggttatttaactcttcttgagagaggatctcactctgtcacccaggctggaatttagcagcacgatctcggctcactgcaacctccgcctcccgggttcaagcgattctcctgcctcagcctcccgagtagccgggattacaagcatgtcccaccatgcctggctgattttttttttttttttttttgtattctaaatagagatggggtttcaccatgttagccaggatagtctcgatgtcgtgacctcatgatctgcccgcctcggcctcccaaagtgttgggattacaggcgtgagccaccgcacccagccagcaagtgcatttagaactactctactttctaccccataacttttttttttgtttgtttgagacaagtctcactctgtcacccaggatggagtgcagcagcacaatctcagcttattgcaactcccgccccctgggttcaagtgtttctcctgcatcagcctcttgaatagctaggattatacaggcacctgccactgtgcctggctaaattttgtattttaatagagatggggtttcactatgttggccaggctggtcttgaactcctgaccacgtgatcaacccgcctcagcctcccaatgtgctggaattacaggtgtgagccgccatgcccagctacacttttttttgaaacggggtctcgttttcttgctcaggctggagtacaatggggcaatcacagctcactgcagccttgacctcccagacttgagcaatcctaccactatggcctcccaccacacctcgctcattcttgtatatatatatatttttgtagagatagggtttcaccatgttgcccaggctggtctcgaacttctgtgggctcaaccgatcctcctgccttggcttcccacagtcctgggatcagaaacatgagccacagtgcctggccagtgcagctttatttacagtaaccaagatatagagtcagtctaagtgaccatcagtggatgaataaaaaatgtgcccgttgggtaccctgcctactgcctgggttatgagattgttgggaccccaagccttaaaaaggaaacatggtaggccgggcacagtggctcacgcctgtaatcacagcactttgggaggccaaggcgggtggatcacttgaggccaggagtttgagaccagtcaggccaatgtggtgaaaccctgtctctactaaaaatataaaaaaatcagccgggcgtggtggcacactcctgtagtcccagctacttgggaggctgaggcaggaggattgcttgaaccagagagtcagaggttgcagtgagccaagatcgtgccactgcgctccagcctgggtgacagcaagactccatctcaaaaaaaaaaaacaaacaaacatggtattaattacacaatggaatactcctcaaccttaaggaactcctatctttttatttaaaaattgccagttttatttcagctagagatcactttttagcataatgtttcctgtctttaacaatgggtgagggtttttttttttttttttttggtttggtttggattttggttttgcttttgagtcgaagtttcactcttgtctcccaggctagagtgcaatggcgcgatctcggctcactgtgacctcctcctcccaggtttaagtgattctcctgcctcagcctccagagtagctgggattacaggcgcctaccaccatgcccgctaatttttgtattttagtagagacagggttttaccatgttgaccagactggtctcgaactcccgacctcaggtgatctgcccacctcagcctcccagagtgctgggattacaggtgtgagcaaccatgcccggccaagggtttttaactttagctgacctccggaggttacaagtttgaaaacggcaggaggaaacccagagagttgtaaacttacgaaggtctgggctctgaaaaagatacaaattttctttccatgccaatagcgctcacacagacatggtgaatgttcctgaaacccgccggactttctgtaagaagtgtggcaagcaccacccccacaaagtgacacaaggcaaggattcttggtatgcccaggggaagtagtgttatgacaggaagcagagtggctatggtgggcagactaagccgattttccggaaaaaggctaaaactacaaagaagattgtgctaaggcttgagtgccttgagcccaactgcagatctaagaatgctggctattaaaagatacaagcagccaagcgcggtggctcacgcctgtaatcccaacactttgggaggccgaggtgggcggatcacaaggtcaggagtctgagaccagcctggccaaaatggtgaaaccccatctctactaaaaatacaaaacttagctgggcatggtggtgtatgcctatagtcccagctactcaggaagctgaggcaggagaatcgcttgaacctgggaggcagaggttgcagtgagccaagattgtgccactccagcctgggcaacagagtgacactctgtctcaaaaaaaaaagatgcaagcattttgaactggaaggagataagagaaaggaacaagtgatccagttctaagtgtcatcttttcttttatgaaggcaataaaatcttgagcttatggtaaaatgcaaaattttccccccttctcctttttcagaagcagctttgaaatcctttaataaaaggaagcctctatcattaggtaagttacctcatttataacttttattcttcatgtgagatctggggactcgggcctttgttttaaggagaatgtgctgagcactaagaatgcaaagaaatgccggacttagcatccctgctcccagggcggagctggtctcgcaggtgcgtagcagtaagacctgggaagctgaaacacgatcgcgtttgttggaaatctataaatacatacaaagcggggaagggtaagcttggcctttgaatctggataaggtagagacttttcttttttgagatggaggcttgctctgtcacctaggctgaagtgcagtggtacgacctcggctgactgcaacctctacctcctgggttcaagcagttctcctgcctcagcctctagaatagctgggattacaggtacctgccaccaggcccggctaattttttgtggtgtttgtagagatggggtttcaccatgatggccaggctggtcttgaactcctgacctcaagtgatctgcccacctcagcgtcccaaaatgctgggattatgggcatgagccaccaccacacccggttttgtttttttttttttttttttttttttttttttttttttgaaacagggcttcactctgtcacttaggctggagtggtgcaatcatggttcactgcagccttgacctcccaagctctggtgatcctcctgcctcagcctcctgagtagctgggaccacaggcacttgccaccatgcctggctaatttttttcactttttgtagagacagggtcttgctatgttgcccaggctggcctcgaattactaaactcaatcagtcctcctgcctcaccctcccaaactgctggggtacaggtgtgagccatgacacctggcccttaccagctacttatatcctgaagattattattattttttttttttttgagatagagtctctctctgttgcccaggctggagtgcagtggcgtgatctcggctcactgcaagctccgcctcccgggttcatgccattctcctgcctcagcctcccgagtagctgggactacaggcgcccaccaccacgcctggctaatttttttgtgtttttagtagagacggggtttcaccgtgttagccaggatggtctcgatctcctgaccttgtgatccgcccgcctcggcctcccaaagtgctgggattacaggcgtgagccaccgcgcccggcccctgaagattgtgttttgagatggggtcttgctgtgttgctccggcttgattgcagtggcacagtcatagctcattgcagcctcaaccttccaggctccagagatcctcttacctcagcctcctgagtagctgggactacaggtgtgcactgccacacctgactaatatttgtatttttggtagggacagtttcactatgttgccagatatggtgtcaaactcctggtctcaagtgatcctcccaccttggcctcccaaagtgctgggattacagacatgattcaccacacctggccatgaagactttttttttttggacaaagtctcactctgttgcccaggatggaatgcagtggcatgatctcagctcactgcaacctctgacctccgcctcccggttcaagtgattctcttgcctcagcctcccgagtagctgggattataggtgtctgccaccaagcccagctaatttttgtaattttagtagagatggggtttcaccatgttggccaggctggtcttgaactcctgacctcgtgatccacgtgcctcagcctcccaaagtgttgggattacaggtgtgagtcactgcgcctggtctcatgaagaccttttttgagacagagtcttgctctgtcacccaggctggagtgcagtggtacaatctcactgcagcctccgcctcccaggttcaagtgattctcctgccttagcctcccaagtagctgggattacaggcgcctaccaccacgtctggctaatttttgtatttttagtagagacagggtttcaccatgttggccaggctggtctcaaactgctgacctcaaatgaactgtctgcctcagcctcacaaagtactgggattacaggcatgagccacctcacctggtggtgaagactctaaaggctcttctcagatcagcctttgtcctgaatttcacatgcccgtgtccagttccctccccagcatcttttcaggagttccatggactcacctcttcattatccagggttaagctgcagatattgttattaggattccaccttgttctctctctttttttttttttttttgatacggagtctcgcttgctcttttgccaggctgaagtgcagtggagcgatcttggctcactgcaatctccgcctcctgggttcaagcaattcccttgcctcagcctcgcaagtagctgggacttacaggtaacacaccaccatgcccggctaattttttgttttagtagagacggggcttcaccatgttggccgggatggtctcgatctcctgacctcatgatccgcctgccttggcctcccaaagtgttgggttacaggcatgagccaccatgcccggctgattccaccttgttcttacattctttcccagttcattttaaatttatctacctcatcagaaactagggggttaggcctggcaggcagatcacctgaggttgggagttcgagaccagcctgaccaacgtagagaaaccctgtctgtactaaaaatacaaaattagccaggtatggtggcacattcctgtaatcccagctactccggaggccgaggcaggagaatcacttgaacccaggaggcggaggttgcagtgagccgacatcacaccattgcattccagcctgggcaacaagagcaaaactacatctcaaaaaaaaagaaaaactaggcagttaatcctcaaagcctttccagtggccttatgcgtgagtagtttgtgtgtgtgtgtgtgtgtgtgtgtgtgtgtgtgtgtctttcacaccatgtgttctgaactacttaggaattctcaccagaaaggcacataaacctgggatcatggcctaatgtactttcacttttacatccagtaccttatcaacgtcctttttagtacctaatctaggcttcactactgagactcaggggtccaacttgagccatcttggagtcccactgccagcacagcaacaggcctgtaatgccgccctttttctccagggataacacggaaagaacgaccacctctagacgtggacgaaatgctggagcgcttcaaaacagaagcacaaggtgggtgtcaggacctccaatgttggagtcagctgaggaagccccccgttcttgctgctatctcctgttcctttgaagaaccccatctctctccaatcttttcctccactattcttaatgtgcccactgtctcctggagaatgccaacctcccttccgtaagaatagagggaagaacgaacgttgcagagaattagaactcagtttgtagaaagttaggagcacagcgcagagagtttttgtttttgtttttgttttgagacagtttctctgttggccaggttggaatgcaatggcgcgatctcggctcactgtaacctccacctcccaggttcaagcgattctcctgattctcctgactcagcctcctgagtagctgggattataggcacctgccaccacacccagctaatttttttttttttttttgagacgaagtcttgttcttgtcacccaggctggagtatagtggcaccatccctgttcactgcaacctccgcctcccagattcaagtgattgtcctgtctcagcctcctgagtagctgggactacaggtgcatgccaccacgcccagctaatttttttttgtacttttagtagagacaggtttcaccatctcattcagggtggtctcaaactcctgacctcaagagatctgctccacccacccccaagtctcccgaagtgctgggattacaggcgagagccaccgtacccggccttctttaaattatttaaaagttgacaggtggccaggtgtggtggctctcacctataatctcccagcactttgggaggctgaggcgggtggatcaagagatcgagaccatcctggccaacatggtgaaacccaactctactaaaaacacaaaaattagccgggtgtggtggcacccgcctgtagtcccagctactcaggaggctgaggcaggagaatcgcttgaacccgggaggtggaggttgcagtgagccaagattgtgccactgcactccagcctggcaacagtgcgagactccatcttaaaaaaaaaaaaaaaaaattgacaggcataaatgtatttatggtacattgctcagacaactttaatataaacaacttacagagaaaattgagtcttttgggtaggtgacttgcctgagctgactttgtgataggttttttctgttttttttgtttttgaaatagagtctcactctgtcatgcaggctggagtgcagtggccccatcttggctcactgcaatctctgcctcctgggttcaaggggtcttcctgccacagcctccccaggtgctgggactataggtgcccaccactatgcctggctaacttttgtgtttttagtacagatggggtttcaacagggtagccaggttggtctagaactcctgacctcaagtgatccacctacctcggtctcctaaagtgctgggattacagctgtgaaccaccgcacctagcctgtgatcagtttcagatcagccttgcttactccacattccctcttatcttcctggtagcatttttgttttttcttgagaaagagttttgcccttgtcgcccaggctagagtgcaatggtgtgatctcggctcgccacaacctccacctcccaggttcaagtgattctgcctcagcctcccgagtagctgggatcataggcgcccaccaccacatctggctaatttttgcatttgttagttttatttttagtagacagggtttcaccatgttgggcaggctggtcttgaactcctgacctcaggtgatccacccacttcggcctcccaaagtgctgggattacaggcatgagccaccgtacctagcccacattgacttttgatacagcaagtatttcttgctatggctctgtataatagaggtgagtaacttggttgaaggaattgtttgccctgttcatctctctagacacggccaatgtcattcctggcacacaatctttttttttcttgagatggagtctcactctgttgcccagactggagtgcagtggtgcaatcttggcccactgcaacctctgctacccaggttcaagcgattctcctgcctcagcctcccaaatagctgggagtacaggtgtgtgccaccacgcccagctaattttttgtattttagtagagacagggtttcaccgtgttagtcaggatggtctggatctcctaacctcgtgatccgtccgcctcagcctcccaaagtgctgggatgacaggcgtgagccactgtgcccagcctagcacacaatcttgacaaagaatttcggtgcgacttggggtactgtggtgcctgctctatcatcatgcttcagcaggaaatgtgggtgaatagtgcctggtggcatggcaggtaaagaaatgttttgttttgtttttttttttgagacagtcttgctctgtcacccaagctggagtgcagtggcgcaatctcggctcactgcaagctccatctcccgggttcacgccattctgcctcagcctccccagtagctgggactacaggcgcccgccacacgcccggctaattttttgtatttgtagtagagacagggtttcaccgtgttagccaggatggtctcgatctcctgaccttatgatccacccgccttggcctcccaaagtgctgggattacaggcgtgagccaccgcgcccagccgcgggtaaagaaatttatgaagacaatcgtaggtaaaggaaggcagatttattggagaaagtaggaaaagacattggcagagagaccccagcgggcaggttgtcatgagtagctcactgccaggagaccaaagcttcctgcagattttatagaatagggcttgggctgattgataatgtcaacagggggtttaacttgcggtcttctttcagcagaagtgtttgataaactgaggcgtttcatggcaaacagggagtttgtgagctctgtgtgtgatctggccaggaaggccaaacatcttgggccgtatctcctggaccataaaagcagacctggcccagtgcagtggttcatgcctgcaatcccagcactttgggaggctgaggtgggtggatcatctgaggtcagcagttttagactggcctggccaacatggcgaaaccccatctctactaaaaatacaaaaattagcctagacgcagtggcacatgcctgtaattccagttacttgggaagctgaggcaggagaatcgcttgaacccgggaggcggaggttgcagtgagctgagattgcgccactgcactccagcctgggcaacagagtgagactgtctcaaacagacctatagctgacctgtttcctcttgtttgtatgccctgaaccatggaggaaagcttatttatttattttattgagatggagtcttgctctgttgcccagggtggagtgcagtagtgcgatctcttactacaacctccatctcccaggttcaagcaattctcgagcctcttggcctcccaagtagctgagattacaggcatgcgccaccacgcctggctaatttttgcatttttagtagagatggggtttctgtgttggccaggctggtctcgaactcctgagctcaagtgatccaccccacctcagcctcccaaagttctgggattataggcatgagccaccacacctggccggaaaacacatttgtagcttatttgctttatctgatcccgtgccccccctcccccccgccccatcagcctgcctccttttctctaattgggactccacaggaaatacacctgattttgtgtcaatctcacatgagtttgtattttgtagcgtttacagaaacgaaaggaaatgtcatctgcctgggtaaagaagtctttaaaggaaaaaagccaggtctgtaccatatcttcctgcagggagcttgggatcagatttctctttataaacttgaagtcctcttaactttcctatgtaacacaaagcatttatttatgtatgtatgtatcgagacggagttttgctcttgttgcccaggctggagtgccgtggcgtgatctcgactcactgcaacctccgcctcccaggttcaagcaattctcctgcctcagcctcccgagtagctgggattacaggcatgcgccaccatgactggctaattttttatttttagtagagacaaggtttcttcatgttggtcaggctggtgttgaactcccaatgtcaggtgatctgcctgcctcgacctcccaaagggctgggattacaggcatgagccactgtgcccggccaacacaaggcattttgttattttggttttccctatgggtaactgattgcatcctctctcccttccctcctcaccaatgataaagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagaggtgagaaccgtttcactctaccagtcgttccatctttagcctcatcccatgcccccttaggaagaggccagagcctcctatgcactgtggcttagggtcaggaattccctcttgttggactctttgtttgtttttgttttgagatggagtcttgctctgtcgctcaggctggagcgcagtggcgcgatcttggctccctgcaacctccgcctcccgggttcaagtgattcttctgcctcagcctcctgagtagctgggactacaggcgcctgccaccttgcccggctaatttttatattttcattagagacgggatctcagcatgttggccagtctggtcttgaactccgcctgacctcaggtgatccacctgcctcagcctccaaagtgggattacaggcatgattcaccatgcccggcccaaatatatttttttaagacagggtcttgctgtgttgctcaggctggagtacagtggtgaaatcagctcactgcatcctcaaacttctgggttcaagtgatgttcctgagtacctgggatgacaggtattaagtgtgcaccatcatgtccagctaacttaagtgggggtttttttttgtgtttttttttttttttttttttttggaaagacaaaatctcactatgttgtccaggctggtcttgaactcccaaagcactgagattacaggcatgagttaccacacgccctgcctgaatatttcttattgatatgtatagatatgtatattcccaatctttttttttttttttgagacggagtttcactctttttcccaggtcggagtgaagtggctcgatctcggctcactgcaacctccgccccaccaggttcaatgattctcctgcctcagcctcatgagtagctgggattacagccacccacgaccatgcccagctaatttttgtacttttagtagagacggggtttcaccatgttggccaggcaggtctcgaactcccgacctcaggtgatccacccgcctcagcctcacaaagtgctaggattataggcgtgagtcaccgtgcccggtctatattctctatcttttatcaatgatgtgcttagcattttaacttatttttaccctctattggatttttgtctaagaagaataggttctttctcctgtgatgcttcttgggtgttgagttgtctgatggtggtgctaataagtgattacatggtccagctttcaattgtactcatttgtcaggggtatatgcccagagaaaccctaaatacttcagccgtgatggacacacatttggtgtaaccctttcttctcttccctatagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgtaagtagaaactaattcatgaactcaaatccttagggtatgaaaatggtacaatgttaacatcggagcaatattcagattcctgtactagactcttaagtgctcgagacacagggaattgagagagtcctgtccttaaatttattttgtgggataatcgtataaagtaatttctaggggctgggcatggtggttcacacttgtaattccaacacttcgggaggccgaggcagacagatcacttgaggtcaggagttcgagaccagcctggccaacgtgacaaaaccctgcctctactaaaaatacaaaaattatccaggcgtggtggcaggcacctgtaatatcagctacttgggaggctgaggcaggagaattacttgaacccaggaggcggaggttgcagtgaaccaagatcctgccactggactccagtctgagtgacagagcgagactgcgtctcaaaaaaaaaaaaaaaaaaaaagaaaaagaaaaaaagggccgggcacaatggctcacgcctgtagtcccagcactttgggggcccaaggtggggggatcacttgaggtcaggagttcaagaccagcctggccaagatggtgcaagaccctgtctctacgaaaaatacaaaaatttgccaggtgtcgtggcaggtgcctataatcccagctactccggatgctgagggtaggagtcgcttgaatccgggaggcagagtttgctttgcagtgagccgagatcgcgccactgcactccagcctgggcaacagagtgagactccatctcaaagaaaaaaaaaatctgtaaagatggacaaaaatttaaacatggaaaaaatagttcctaaagtttaaatatatcgagcccctggtttccatttaagtacgatacaggtgtacacactaaagatttcactttcgttctcttttccctaggttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggtatatctcttaatcattaaaatccttcatcatacaaacataagctaccacaagcttatgtggcaattttgtgtaaataagaaaaagttcgttattctgactagaaacagtactaagggcagatgacccaggatgcagcatgggctgaacttgagtttctacttgccttgaacagtaaacaccctggacaaccatacgtgaggaccctgaatccaaagaaactcccagaatctttatcatctttttttttttttttatgaagtcttgctctgttgcccaggccaaagtgcaatggcacgatcttggctcactgcaacctctgtctcctgggttcaagtaattctgctgcctcagcctcccaagttgctgggattacaggcacccgccaccacgcccggctaatttttgtgcatttagtggagctggtttcgccacattgccaggctggtctcgaactcatgacctcaggtgacctgccctcctcaggctcccaaagtgctgggattataggcatgagccaccatgcccagccagagtccttatgttttggttttggttttggttttttctttttcttttttctttttgagatggagtctcgctctgtcacccaggctggagtgcgttggtatgatctcaggtcactgcagcctccacctcccaggttcaagtgattctcctgcctcagcctcctgagtagctgggattacaggtgcacaccaccacacctggttaatttttgtattattagtagagatggagttttaccacattggccaggctggtctcgaactcatgacctcaggtgatctacccccccacccccaccccaccccgccgtcggcctcccaaagtgaggcatgagccaccgtgcccagcccagaatctttatcttctatcagagatcattcactcatggttcatgcttctcctgtatgatgattcagaataccagctattgacatttttcaagcaagaacccttcaggaacatcaagttgccccttttctgttagtcctctggtttgagagctctccccttgggaagctgtccagtggctgcccaggcgatgagaacctacatgcatcatggggttccatgaagcctcacttggccacactggtgtagtaggtggtcattggcctcaaattattgccctgggccaggcgcagtggctcacgcctgggaggccgaggtgggtggatcacttgaggtcaggagttcaagaccggcctggtcaacatggtgaaactctgtctctactaataatacaaaaattagctgggcatgttggcgcacgcctgtagtcccagctactcaggaggctgaggcaggagcatcatttgaacctgagaggcggaggttgcagtgagctgagatcacaccaccgcactccagtctgggcaacagtgtgagactgtctcaaaaaaaaaaaaaaaaatcttggctgggtgcggtagctcatgcctgtaatcccagcactttgggaggccaaggcaggtggatcacaaggtcaggagttcaagaccagcctggccaacatggtgaaaccccacgtctactaaaaatacaaaaacattagctgggcatggtggcgcgtgcctgtaatcccagctactcatggaggctgatgcaagagaattgcttgaacctaggaggcagaggtagcagtgagccaagatcacgccattgcactccagcctgggcaacagagcaaaactccatctcgaggacagaaaaaaaattgattgctctggctctactgatacaatcttaggctgcttaatgggatcttagttgaataggatgctgtacatcttacaggtattggaaggttgaatgaaaccaagcccatgcattcaatagtggctgctatcattactaaccgttgcaattaccctcttttctttttgcctgagaataatgggatgcagggtgagggggaatattgggtgaattaaagatttgggtcactaatttctttctttttttctcaagatatagtcttgctctgtctcctaggctggagtgcagtgccacaatcttggttcactgcaacctctgcctcccgggttcaagtgattcttctccgtcaacctcccaagtagctgggattacaggcacccacctgtatttttgtatttctagtattttgtatttctagtagagacagggttacgccatgctggtggccagggtggtctcaaactcctgacctcgggcaatccaccacacccagctaatttttggtatatttagtagagccggggtttcaccgtgttggctgggctggtctcgaactcctgacctcaagtgacatccatcttccaaaatgctgggattacagccatgtgccaccacgcccagctaattcttgtatttttaggagaaatggggtttcatcatgttgttccggctggtcttaaactcctggcctcatgatccacctgccttggcctgccaaagtcctgggattacaggcatgagccactgtgcccagccactcatttcttatgaatttattctaacacattttccggatgaacagggcaccttgaaacataggttagtgggctgggtatggtggctcctgcctgtaatcccagtactttgggaggcctaggctggtgtatcgcttgaagtcaggagttttttgttttgagacggagtcttgctctgtcgcccaggctagagtgcagtggagtgatctcggcttactgcaacctccgcctcctgggttcaagtgattctcttgcctcagcctcctgagtagctgggactacaggcacgtgtcgccacgcccatctaacttttgtatgtttagtagagccggggtttcaccatgttggccaggatggtctcaaactcctgacctcctgatctgcccacctcggcctcccaaagtgctgggattacaggcatgagccattgccccggccaaagttaggagtttgagaccagcctggccaacatggtaaaaccccatctctactaaaaaatacaaaaattagccaggcaagatggcatttgcctgtaatcccagctactcaggaggctgaggcgggagaatctcttgaatctgggaggcagaggttgctgtgagctgagatcgcgccactacactccagccagggcgacagagcataaataactccctttcaaaaaaccaaacaatgaaacataggttagcggagtctgcatccaacattagagtcagattgactaagttctgtatttccagctgattcctgggcgatgttggtgccactggtctgaccaccctttgacaactgctgctccagataattcaagtcggggtataacacaaccagtgagatgtaaaccaaagacgattccacggttagattctcaagaatgacttgttctgccgggcgcggtggctcacgcctgtcatcccagcactctgggaggccgaggtgggcagatcacctgagattgggagtttgagaccagcctgaccaacatggagagacccccacctctactgaaaatacaaaattagctgggcatgttggtgcatggtgcatgcctgcagtcccagctactcgggaggctgaggcaggagaatcacttgaacccaggaggcggaggttgctgtgagccgagattgcgccacctgggcaacaagagtgagactcagtctcaaaaaaaaaaaaaaaatgacgtggtcctatttctcccacaggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgtaagtctctcctctcttacagagcagctgtgctttcgatctggggccacagacgagcaatggtcatgcctgacttggctgtatggaacctctcgctgatgtgaacacctgttcccatgtttagatccaggccgatggcctgtgaattttgttcttctctcattcctattccttcataggatcaccagtgcatgatagaaggtggggagttcacaagaaggggcttttggatgctggcacttgtggagctagccgggaaggttgaagttggacctgtcaaccgtgttgccatttgtgattcttttgtaggttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgtaagtccgtgctggctgcctgtgtgcgtgggtgtatatgcacacgccccccacctccgggtttgagtagggtggttatgagaacacttaattcctctaaaagttccaagcatgatgctaatgacaactggtaagacctgggtagatgatggtaggaaaaaagtataagtagtagtagagtagtagtaatattctatagggatttggggaatgtagctggttttcgggttttttttttcctctttatgtatgtatgtattttagagatgggatctcgccgtgttgcctaggctggtctcaaactcctgagctcaagagatctgcctgccttggcctcccaaagtgctagaattacaggcatgagccatgtcaccccatgctgtgttttctcttaatctgtgttcttagaactataactgtaacataaattgcatgcaattggttgtaaatggaattcatttacttattttttaatgaatgatttgcaaatcaggtagtcttctgggccagtgtacgctcagactcccaatggaagctattggaagctacatgctcaatgtgatcctccttttaatactaaaatcacaggacacgtggcctggcatagtggctcacgcctataatcccatcaccttgggaggccgaagcaaggcagatcccttgagggcaggagttcaagaccagcctgcccaacatggtgaaacattgtctctctactaaaaatacaaaaattagtcacgcatggtgggacatgcctgtaatcccagttactcaggaggctaaggcaggagaatcacttgaacttcggaggtggaggttgcagtgagctgagatggcaccactgaagtccagtctggccaatagagcaagactctctcaaaaaaaaaaaattataggacaaatctttagaaaggaattggggcctggcatggtggctcatgcctgtaatctcagcactttaggaggcgggcagaacacctgaggtcaggagtttgagaccagcctggctgatgcagtgaaaccctgtctctactaaaaatacaaaaattagctaggcgtggtggtatggtcctgtaatcccagctacttgggaggctgaggcaggagaatcgcttgaagtcgggaggttgcagtgagccgagatcgtgccagcctgggtgacagaacgagattgtctcaaaaaaaaaaaaaaattgtatctgcactgatggtttctgttcagagattcgattttatgttaacatctctggtattttttttttttttttttaagatggagttttactcttgcccacgctggcaatggcatgatctaggctcactgcaacctccggcttcaaggaggttgattctcctgcctcagcctcctgagtagctgggattacaggcactcaccaccacgccgggctaatttttatatttttagtagagatgggatttcaccatgttggccaggttggtctcgaactgacctcatgatccgcccgcctcagccttccaaagtgctaggatttacaggcatgagccactgcgtccagccatacatatctctggtattctttgtctctaacatcacctccaacagttaggaactgtcctcttcctatgaagtaactaatctaggatatgtacctggcatctgaaaactacccacttaaatttaatgacatattcagttcatggctggagacgatgagtagaaggaaaggattcttcccacacccactatatctaggccctgaaacattaaaaaagaagtcccacaagcagtgagatgtcaccgactcactaactgtatcttcaaatgaatgtctagtttttttggttgtgtgtgtgtgtggtgtgtggtgtgtgtggtatttttttgggggggggggggttttcttttttttttttttttggttttttttttttgatagtcttgctctgtcgcccaggctggaatgcagtggctccatctcagctcactgcaacctccacctcctgagttcaggtgtgattctcctgcctcagcctcccagggattaaggtgcatgccaccacgcccagctaacttctttatttttagtagagacgagttttcaccatgttggtcaagctggtctcgaattcctgacctcaggtgatccacccacctcagcctcccaaagtgctgggattacaggtgtgagccaccgtgccggccccctcaattcaactttttgatccatgcccctattttgctaagttgtcaacttccctttagtcttatgtgggttttcctccattacagtcatggaagtttctagaaggccgggtagggtctttgagaggccgaggcaggtggatcatgaggtcaggagttcaagaccagcctggccaacatggtgaaaccctgtctttactaaaaatacaaaaattagccaggcgtggtgtcggagcctgtaatcccagcttacttgggagggtgaggcagagaattgcttgaacctgggaggcggaagttgcagtgagctgagattgtgccactgtactccagcctgggtgtcagagcgagactgtctcaaaaaaaaaaaaaaaaaagtttctatacattcataaagtttcaagatttgggggtgtgttttcacttctccatcgtcatggactccaatctgccatctatttccaaggcccttccaggtcctgtgtccctcagctagtggtatgcttcacttgggacccagagatacatgggcattatagttcaaattataattaagtttagaactctattgagacagaagaaagaaaacagagctaaggtgaaatatctctgataatctgtgttggttaatatctaggatcctagtaccagatatgttggagtgtgagctggtgtcttctgcctgtaagacactacctctctagcaactgaatttagcaaatacaatcgtaatcccagcatgttagggaggccagggtgggcagatcatctgaggtcgggagttcaagaccagcctggccaacatggggaaaccctgtctctactaaaaatacaaaacttagctgggtgtggtggcacgcgcatgtgtgtacacacacacacccccctgtaatcccagctactcggaaggctggggcacaagaatcgcgtgaaaccaggaggcggaggttgaagtgagccaccgtgccagctgagaatcctttttacttctccaacttctgttggccacctgcattccttggcttgtggcccttcctccaacttcggcagagcatcttcaaacgttgccctggctcccttatcacgtcacctcctgctggctttgactctcagctccctcttatgaggatccctgtgattgctggacctacccaaataaaccaggatataaaccatcttaagatgctcagtcacctctacgaggtcccttttgctcgcaggtgccaggagttgggacttggacatctttaggggaggccattcttctgtccaccacaccaccccatgattccatttccatgtcaccactgtctctaagtgtgtctaacccacggctcaagagtcaaaggtgcatcacagcagtgagaactcacaggttcgggtttgctttcttcctgtggttgatttctaggctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggtgagttaacttataagttcaacttcctatacttacaccttactgaatctgtggctagtgtaaaataatcagtgaagccgacttcccaagttatataattgagaggacctttatagagtcgatcgagcatttactaggatggttaaaggaataagttctagtctatgtctaagtttttgtttttttttttcttgaagttttgctcttgtcacataggctggagtgcagtggcgtgatcttggctcactgcaacctccgcctcccaggttcaagcaattctcttgcttcagcttcccgagtagctgggattacaggcgcccgccaccatgcccagctaattcttgtatttttagtagagacagggtttcgccatgttgaaggttcatctcaaactcctgacctcaggtgatccgcccatctcggcctcccaaagtgctgggattacaggcgtgagccactgcgccaggccctatgtctaagttctagtctgtgtcatgcaaagaacacctgtgaaattttaaggatacagtgcctcaagccattcagccaaaagccactgcccagcaccccacattcagagaggtgggaattgggccaggcacagtggctcatacctgtaatcccagcacttcgggaggccgaagcgggcggatcacttaaggtcaggagctcaagaccagcctggccaacttgaaactccatctctactaaaatataaaaattagccgagcatagtagtgggtgcctcttttttttttttttttttttttgagatagtttcactcttgttgcccaggctgtagtgtaatggcgcgatctcagctcactgcaacctccacctcctgggttcaagtgattctcctgccttagcctcccacatagctgcaaataaacaggcatgtgccaccatgcctggctaattttgtatttttagtatagacggggtttctccatgttggtcaggctggtctcgacctccggacctcaggtgagagccaccgtgcccagccagtaggtgcctttaatcccagctacttgggaggctgaggcaggagaatcacttgaaccctggaggcagaggttgcagtgagctgagatcctgtcactacactccatcctgggctacaagagcaagactccatctcaggaaaaaataaaaaagaggtaggaattagatatcgtgccagaaaatgctggctctatcagcaggtgagtggtctcaacttggctatcttacaaataccttgtgagttagctacaatcagatgcacttgaacctggaatcctatctgggaggcaatcttaaaagaatttgactcgggatgggcaaggtggctcatgcctgtaatcctggcattttgggagtccaaggcaggtagattgcttgaggccaagaatttaaaaacagcctggccaacacaatgaagccctgtctctactgaaagtacaaaaatccgctgagcatggctgtgtacctctgctcccagttactcaggaggctgaggtgggaggatcacttgagcctgggaggaagaagttacagcgaattgagatcacgtcacctcactccagcctgggtgacagtgagatcctgtctcaaaaaaaaaaaaaaaacaaaaaaaacaaaggcgcctttttaatcactcactgacacgtgtagaggagcaaaaagtttgagttgctggttggcccaggaggtcaaggctgcagtgagccaagatggcgttaccacactccagcctgggcaaccgagtgagaccgtgtttcaaaaaataaagtggcagggtgcagtggctcatgcctgtaattccagcactttgggaggccgaggcaggtggatcacctaaggtcaggagttcgtagaccagcctgtctctactaaagagacaggtgaaaccctgtctctctaaaaccacaaaaatcaggcaggcatggtggcacatagctataatctcatctacttggaggcacgagaactgcttgaatccaggaggcagaggctacagtgagccgagatcatgccacagcactccagccctggcgagagagcaagactgtctcaaagaataacttcaaagatggaagttatttaacctctctgctcaaaagcctcagtgcttccctatgtcaatccaggtaaaatcctatattgacgatggcttcagggtcttctgtgagctggccactgcttacctatgacctcatcttgacaatcctccctgtctcactcatgcccgctgcctggatgttctattttacgtgtcagtcacatgtatcttcagggcctctgcacaagctatttctctgcctggagaactcccccccgagctctatgactcggtctcttcaccccctcacctccaaccattgtagccagaacccccagttattccctgtaccccttgcccttcagaacccctcatcgcctccatattttcctgttagcagatgagccctgagggcggagacgttttgtttgttttttgagaccggagtctcactctgtcacccaggctggagtgcaatggcgcgatctcggctcactgcaacctccgcctcctgggttcaagcgattctcctgccccagcctcctgagtagctgggattacaggtgcctgtcaccacgcccagctaacttctgtatatttagtagagacacggttttaccatgttaggttggtcttgaactccttgacctcaggtgatccatccacctcggcctcccaaagtgctgggattacaggcgtgaaccaccgtgcccggcctgagacttctgttggtcatgcagatccccaacacacgagggtgggcttggcttgccggagggcatcgatcagcactggctgcattaacgtgttgatttctgtgtttccccaggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggtatgatccatttacttccccatcaggctttctccagagtggtaggtttaggggaagcataatgacatggacctgctgtaggagactgatctggtagctggattacaggttcccgccatcacacccagccaatttctgtatttcacttggagaaacggggtttcaccatgttggtcaggctggtctcaaactcctgacctcaggtgatccgcccgcctcggcctcccaaagtgctgggattacaggcgtgagcaaccgcacccggccaccttttttttttttttcctttgaggcaagaactcactatgttccccaggctggagtccagcagcacaatgatggctcgctgcaggctcgctccagctcctgggctcaagcaatcctgcctcagttcctgagtaggtaggtttataagcatgaaccattgcacccagccacggctgccgtctacctgctcatgatagccatttgtcactgggctgtgttttgtttgttgcattttgtcagggttttggggttttgttttgttttttctttctttttttttttttttttctgagatggagtctcactctgttgcccaggctggggtgcagtggttgctaactgcaacctccacctcccaggttccagctattctcatgcttcagcctcccaagtagctgggattacaggcatgcaccaccacacctaggtaatttttgtatttttagtagagacagggttttgccatgttggccagggtggtctcaaactcctgacctccgtgatttgcccacctcagcatcccaaagtgctgggattacaggcatgagccaccgcacccggcctgagttgtattttgataccatggcatcaaagaaccaagaagccccttcctaggaatgtgggaacttcagaaattctcacaagcaatatactctactgctggcttaaaataatctttatgtagaagaaacatagattacttgtttatttaacatgaaactcagcctaagatactttgtaagtcaaaagacatatggacactaagggtttttttaagctttaagtttgtttgtttgtttatttattatttattttggagacagttttactcttttttttggggtgcatcttttttcttttttttttttttttttcctttttttttttttttttttttattgatcattcttgggtgtttctcacagagggggatttggcagggtcataggacaatagtggagggaaggtcagcagataaacaagtgaacaaaggtctctggttttcctaggcagaggaccctgcggccttccgcagcgtttgtgtccctgggtacttgagattagggagtggtgatgactcttaacgagcgtgctgccttcaggatctgtttaacaaagcatatcttgcaccgcccttaatccgtttaactctgagtggacacagcacatgtttcagagagcacggggttgggggtaaggtcacagatcaacaggatcccaaggcagaagaatttttcttagtacagaacaaaatggggggctgacccccccacctccctcccggacagggcggctggccggttagaggggctcctcacttcccattaggggcggccgggcagaggcgcccctcacctcccggacagggcggctggctgggcggggggctgacccccccacctccccgcccggccagagttttactcttgttgtccagcctggagcgcaatggcgctatctcggcttactgcaacctccgcctcccgggttcaagaggttctcctccctcagcctcccaagtagctgggactacaggcatgtgccaccacacctggctaatcttgtatttttaatagagacagggtttctccatattggtcaggctggtctcgaactcctgacttcaggtgacccgcctgcctcagcctcccaaagtgctaagattacaggcgtgagccaccatgcctggcctgcatctcctctgtttaactggtactccggggtccactgagtagaagttgccaaagtgggtgatagagcgggtaagcaggtattagagctatagcccagctgtactcagcaattccattttctgtgtatgataatcaacaagcatctcaaactgcacaatggctatataccattacaaggttaacctgatgttatgtttttctctatcagatcaacatggttgagaataagaggaatgaaaaaaaggattaaaaagagaaatgaaagtctttaatattacattttattatttacttcatttattttttagacaaaaatctcactctattgctcaggctggagtgcaggggcccgatctcagctcactgtaacctccgcctcccaggttcaagtgattctcctgtgtcagcttcctgagtagctgggattatagggatgcaccatcacacccaactaacttttatatttttagtagagatggactttcaccatcttgcctaggctggtctcaaactcctgacctcaagtgatctgcccacctcactctcccaaagtgctggcattacaggcatgacccaccacatctggcctcattttatatttaaaaataaaaaataagcaaatcaagccaggtacagtttaggcaacatggtaaaaccccaactctactaaaaatacaaaaattagctgagcatggtggcaggtgcctgtagtcccagctactcgggaggcagaggataggatggcttgaacccaagaggcacaggttgcagtgagctgagatggtaccactgcactccagcttgggcaacagagagactgtctttttttttttttttttttttttttttttttttttttttgagatcgcccaggctggagtacagtggcacgatctcggctcactgcaagctccgcctcccgggttcacaccattctcctgcctcagcctcctgagtagctgggactacaggcgtccgccaccacgcccggctaattttttgtatttttttagtagagacagggtttcaccgtgttagccaggatggtcttgatctgctgacctcgtgatccacccgcctcagcctcctaaagtgctgggaattacaggcgtgagccatcacgccccacctgagactgtcttttaaaaaaaaaaaaaaaaaatcaatgtggaacactcctttgccacctagaataatcaggaaaggtgacccatgccctgtgcctccttaacagactttcaggtacttgggaatttgaaacaaatctccttgatgcacaaagtaaccttttcttcccccattgtaccccaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatgaagctgttacttaataatgggctttgacaagttagagaaaagatatcttactgggtagaacctggggggtgggggaagtgacagtgtttaattgcattgatttctattgccttgtcaatctttgccttgccttggtatttcctttcttttttcttttctttttttttttttttttttttagactgagtttcactctgttgcccacgctggagtacactggcacgatctcagcttactacaacctggcaggttcaagcgattctcctgtctcagcctcctgagtagctgggattacaagcatcccccaccacacccggctaaatttttttgtatttttaatagagatgaggtttcaccatgttggccagtctggtctcaaactcctgacctcaagtgatccacccacctcagcctcccagagtgctgggattacaggcatgagccactgtacccggcttttttttttttctttttctttttcctcaagcatgagtgttgctctgttgcccaggctggaatacagcagcatgatgatagctcactgcagcctcaagctcccaggttcaagcgatcctccagcctcagcctcctcagtagctgggactacaggtgcacaccaccaaaccaggccaatttttgtgggattttttttgaagacagggtctcactatgttgcccaggctgatctcaaactcccaggcgcaagtaatattcctgcctcagcctcccaaagtgctaggattacaggtgtgaaccactgtgcctagcctgtcttgttacttgttgacctgcgtggatcactgcctgctgagtattacttgccagaggatttctcctaccaatctacaatattttaggtgcttcggtgtagctcatatatgaccatgtcattgctctgattttgctttttaaaaattctaacttaaaatagaatctcggccaggcacggtggctcacacctgtaatcccagcacttcgggaggctgaggtgggtggatcacgaagtcaggagttggagaccaacctggccaacgtggtgaaaccccgtctctactaaaaatataaaaaattagccaggcatggtggcacatgcctgtaatcccagctacttgggaggctgaggcaggagaattgcttaaacccaggaggtggatgttgcactgtgctgaagactgcactactgcattccagcttgggcaacagagtgactccttctccaaaaaaaaacaaaatctcatggtatgcatagtttttcactatagagtctccattatttccttgtgatacagaattccaaattcaacaaagcagcagtgcaagctctacgctgtaaaaccacaaacaaaacgaactgtactataaagacaacactagttggcaaagttgcttctcatggggagactttgttgctgtctgtgtttactggatgagcaaacaaatggacggtaagggggaaaaagaacagtacaaatttttattaaacactaatcatgtttttttttgtttgttttgagacagtttcttcttgttgcccaggctggagtgcaatggcacgattttggctcactgcaacctccgcctccccgggttcaagcgattctcttgcctcgacctactgagtagctgggattataggcatgtgccaccaagcctggctaattttgaatttttagcagagacggggtttttccatgttggtcaggctggtctcgaactcccgacctcaggtgatccaccagccttggtctcccaaagtgctgggattacaggtataagtcaccgcacctggcaacatttttttcttttttttttttttttttttttttttttttggtggcagaatcttgctctttcacccaggctggaatgcaatggcacgatctcgggtcactgcagcctccacctccccagtttaagcagttctcccatctcagcctcccatgtagctgggaccacaggtgtgcaccactgcacccaggtaatttttgcatttttggtagagatagggttttgccacgttgtccagactggtcttgaactcctgagctcaggtgatctgcccaccttggcctccccaaatgctgggattataggcatgagccaccacacctggtcaaaagtagttttaatatttaaatttaaaactaaaaaagttaatctctcttcctactttcatttcttcatcaggggctattggtttattcccaccgactagatccaagttctctgatactacctttaaaccactccatcactttccagttccactgcatacagtgtgggcttctgaggtttcctggttcaaggtgtccttgttcaatgcggcatgggtcattccctgagcatttttttttttttttgacagtctcgctccattgcccggtttggagtgcagtggtgtgacctcggcttactgcagcctctgcctcccaagttcaagcaattctgcctcaggctcccggataatttttgcatttttagtagagacagggtttcaccgcgctggccaggctggtctcgaacccctaacctcaagcgatctgcctgcctcggtctcccaaagtgctgggattacagacataagctaccgtgcccggcctccagagcatctttattctcagtttcagcgggaagaagggggaaggttggtaaaaagagaggcacaaagtttaaaaaggacattgcgtgaagaaactaaaggtttctccttctccacactattgacatttgggatcggatcactactcgttgggaaacgtcctgtacatttccagggtgttcggcaccatccctagcctctaccccctagataccagctcacatcctcacagttaacagtgatcaaaaatgtctctgggcagtagaaaatatttcctgaaatgcaaagttttcttaggttgagaaccattgtaatctagccccatctttagagaagaaattgagtaacggatctacatccattgaggaactatcgacaccccaggggcccatgaaatgtaaactcgcactcacaattaaccatctttctccaacgtgtgtatttcatgtagccacactctcagatgcccacccccatgacctacaagtcctaaacagggaaacctgtggcacatgggttcatgtgtgtctgaatctatacgttcagagatgaacaagtactgctctccctatacctgtgaccactcgcctccgcccatcactgaattctgaaaatgtggcctcaggctcacagcagcattagcacttgcttgctctggatctcatcacattgatgatcaagaacaaagtattcactgggttctctgctaaggatacaaaaaaaaccattccacaattccacggccatgtttgcacccaggaaccacgagggctgggttagcccagatggtgggcttgggaaatgttcctggagcaaaaaaaagagccagaagtcatgagagcctgaccccctcccccaacgcgcacacacacacaccactctctacctccaagcctcattttcaggcttctcaaagctaaggtcactcccatgagctaagccgcgcttttctcaatcctcagctcttccacaagaataggaagaactctctcctgttcaagatcctgtggctcagctgcagctctggaagaaagaccccggtgagggtcttgcttttcacaatccccaatcccagaccacatcctgtgccccaaaacaacttccatggtaaccacatccttcaggaagtgaagtcaggcaggaagtcaagtcagaagacggaatgggctgggcatggtggatcgcacctgtaatcccagcactttgggaggcagaggcaggtggatcacatgaggtcaggagtttgagaccagcctggccaacatggtgaaaccctgtctctactaaaaataccaaaagtagccaggcttggtggtgcatgcctgtaatcccagctactctggaggctgaggcaggagaatcgcttaaacccggaaggcggaggttgcaatgagccgagatcgcaccattgcactccagcccgggggacagaaaaaaaaatgtagctgagcatggtagtgcacgtctgtgatctcagctacttgggagtctgaggcaggagaatcacttgaacccaggcggtggaggttgcagtgagccaagattgtaatagtccaatgtgttcaccttgcccactgcctagacagagctgattcgtcaagacagggaatcgcaatagagaataattcatgcagagctggctctacgagagaccagagttttattattattcaaatcagtgtctcccagcattcaggaagcgtttttaaggataacttggtgggtgggtgggaagccagtgagccaggagtgctgtttggtcagggatgaaatcgtgggagccaaagctatcttcttgcactcagttcctgagtggaggccaaaagataagatgggccagtttattgatatgggtggtgccagctgatccatcaagtacagggtctgcaagttaaacgctgatcttagaagcagtttagggagggtcacaatcttgtagcctccagctgcatgactcctaagtcataatttctaatctcgtggctaatgttcgtcctacagggccaatctagtccccaggcaacaaagaggtgtgctttggaaaagggctatcatctttgtttaaactataagtttctcccaaagttcagcctatgcccaggaatgaaaaaggacagcttggaggttagaagcaaaatggagtcagttaaatctctttcactgtctcagtcataattttggaaaggtggtttcaagctggcacaactgcactccaccctaggagacagagcgagaccctgtcaaaaaaaaaaaaaaaaaacaagaagtgaagtcaagataggaggtaaattcggaagacaggaagtggtggtagaagacaagaagtgaagtcatacaggaagtaaagtcagaagacaggaagtgaagtaagaagacaggaagtggttgtagaagacaggaagtgaggtcatacaggaagtaaaatcagaagacaggaagtgacgtcaaaccaggatttgcagtcggaggcaggcaagaagtgaaatcagaagacgggaagtggctgaggggaacgtcttttctctctcctgctcagcccgaagtgaacaggtagcatcaggtgtgccatttcagtgactgggcacagcccaggcacccacatctctctgcagcgcctattcttggaacaccagagacctctacactattttctgttgcttttttccttcattttcagagatgagatcctggattgaatgactactatggaaagtgattgaccaaggtaagtcacaactatcttgttctttaattttggtgttgtttgttatgacttgttagccgtctagcactcatagctttgcatttccactctgcattacttgtatttttattattttgtgatattcgtaataatttattataaaactgtgttatttttggatatttttaagttaaaatgcgattttttaactaagtggcagtatgcaaagcaagtggttcagaactctcccccattaataagtcttctctcctgaaagaaacaattttgagacttcctgttcttaattctgtttaacagcatacttctaaaagaaaaagtgtatactgttattatttattgtgttacaaaaatatacacgcacctttcatgcacgtccgtgtgaagagaccaccaaacaggctttgtgtgagcaataaagcttttaatcacctgggtgcaggtgggctgagtctgacaagagagtcagcgaagggggataggggtggggccgttttataggatgtgggtaggtaaaggaaaattacagtcaaaggggggttgttctctggcgggcagagtcggggtcataaggtgctcagtaggggagcttttgagccaggatgagccaggagaaggaatttcacaagacaatgtcatcagttaaggcaggaacaggccattttcgcttcttttgtggtggaatgtcatcagttaaggcacgaaccggccatctggatgtgtacgtgcaggtcacaggggatatgatggcttagcttgggctcagaggcctgacattcctgtcttcttatattaataagaaaaataaaatgaaataggggtaaagtgttgggacagcaaaaatttttgggggtggtatggagagataatgggtgatgtttctcaaggctgctttgagcaggattaggggcggcgtgggaacctaaagtgggagcgattaagctgaaggaagattttgtggtaaggggtgacattgtgggattgttaaaagaaacatttgtcatttagaattattggtgatggcctggatacagttttgtatgaattgaaaaactaaagggaataaggaaaggagaaaaacaggtattaaaggtctaagaattgggacgactcaggacatctaattagaaagtgcctaaggaggttcagcatagccttgccagcaaagattatttatttattttaagagttaacagtggcggtatggggatagtaccaggagataccagctgtgctggcttggagaaacagtgtaaactggcagtgtaaacaagagcagggcatgtgtgagtagttgagaacggtgaataggagtatgactagacagaagatagtagggatgacaagttttttggggcacaatctaagttggtctggtgtctggaatgagactggggcctaataaaaaggagtgtctacacaggagcttaaatgggctgtatcttgtagcattccaaggacaggcctgaattctggaagcgaaaatggtaaaagtattgtccagtcctttttaagttggtggctgagcttggtgaggtgtgtttttaatagaccattagtctgtcactgaatactaagagcctgaaaaaatgcttggctgatttgactaataaaggctggtctgttagcagactgtatagaggtgggaaggctgaactgaggaattttgtctgacagaagggaatgacaaggctaaactgaagaattatgtctgacagaagggaagaaatgactgcggtggccttctcagaccctgtaggaaaggactgtacttacccagtgaaagtgtctacctagactaagaggtattttagttatcttactcggggcatgttgagtaaagctaatttgccagtcctgggcgggggcaaatccttgagcttgatgtgtagggaagggagggggcctgaataatccatgaggagtagtagaatagctgatgcaacactgagaagtgatttctttgaggatagatttccacaatggaaaggaaatgagaggttctaagaggctggctagtggcttgtaccatagcatagcctgcctttgctggtgtgtggcgattaggcctggtggaaccgccatcaataaactaagtgtgatcagggtgagaaacagggaagaaggaaatgtggggaaatggggtgaacgtcaggtggatcagagagatgcagtcatgggggtcaggtgtggtatctggaataatgtgggaggccagattgaagtccgggccaggaacaatggtaattgtgggacttaacaaagagtgagtacagctgaaggagccagggagcagaaagtatatgcatcaggtgtgagtaagaaaatagattttggaaattatgagagctgtagagagtgagttgagcatagtttgtgattttgagggcctctaaaagtattaaagcagcggcagccacagcacgcagatatgagggctaggctaaaacagtaaggtcaagttgtttggacagaaaggctacagggtgtggtcctggctcttgtgtaagagttctgaccgcgctaaccatgcctaggaaggaaaggagttgttgttttgtagaaggtgctggggcttgagagatcagtcagacacgatcagcagggagagcacgtgtgtttttatgagaattatgccgagataggtaacagatgaggatgaactttgggcttgactgaagtaatgggggctgtctgtgaaaccttgcagcagtacagcccaggtaatttgctgagcctaatgggtgtcagggtcagtccaagtgaaagcgaagagaggctgggacgaggggtgcaggggaatagtgaaaaaagcatctttaagatcaagcatggaatagtgagttgtggaggaaggtattgaggacaaaagagtgtaggggttgggcaccacagggtgcataggcaaaacaatttgataaggcgcagatcctgaactaatctgtaagacttttccggtttttggacaggtaaaatgggggaattgtaaggagagtttataggttttagaagcccatgctatagcaggcgagtgataacaggctttaatccttttaaagtgtgctgtgggatgggatattggcattgagcagggtaagggtgattaggttttaatgggatggtaacgggtatgtgatcagttgccagggaaggagtagagatgtcccatacttgtgggttaaggtgggggaataggagaggaagacgcgaaggaggctttgggttgaggagaagggtggcaatgagatgcggctgtagtccaggaatagtcagggaagcagataatttggttaaaatatctcggcctaataagggaactgggcaggtggggataactaaaaaagagtgcataaaagagtgttgtccaagttggcaccagagtgggggagttttcaggggtttagaagcctggccgtcaatacccacaacagttatggaggcaagagaaacaggcccttgaaaagaaggtaatgtggagtgggtagcctccgtattgactaaggcgacggacttaccttccaccgtgagtgttacccgaagctcggcatccgtgatggtctacagagcttccgaggcgattgggcagcatcagtcttcagccgctaagccgagaaggagtcagagagccttgggccagagttccaggggctctgggagtggctgccaggtgagttgaacagtccgatttccagtggggtcccgcacagatgggacacggcttaggaggaatcctgggctgcaggcattccttggcctggtggtcagatttctggcacttgtagcaagctcctgggggaggaggttctggaggaacgcctggccgctgcggttcagttcccttcttgtgtgctggagatgtggctggggtttgtctcacagtggaggcaaggaattgcaacttttttctattattgtacaccttgaaggcgaggttaattaaatcctgttgtggggtttgagggccggaatttaatttttggagttttatttaatgtcgggagcagattgggtaataaaatgtgtattaagaataagacggccttttgacttttaagggtctagggctgtaaagcttctcagggttgctggcgaacgagccatgaattgggctggatttttatatttgatgaaaaagagcctaaacactatctgatttgggataaagaaaaaggagcattaaccttgactatgcctttagctccagccacctttctaagagtaaattgctgggcaggtggaagagggctagtcactgaacgaaactgtaagctggaccaggtgtggggaggggaggtgataaaaagataatacggtggaggagcggaggctgaggaagaattgggacctagctcagcctggggaggagggagaggtcagacgggtctgtagaaaaggaagattagaaagactcagcgacgcttggggttgagactgaggggacaggcaggagggaaagaaggaagatttgggacgagttgcactgggcacagagactaggaagggactgatgtgtaaaagaatgcctggacgtcaggcacctcagaccgtttgcccattttacgacaagaattatttagatcttgcaggatggaaaaattgaaagtgctgttttctggctatttggaactgctgtccagtttgtattggggtcaagcggcattgcagaagaaaataagg

SEQ ID NO: 452 - DNA, 58002 bp, Homo sapiens
aaaatcagctttcaattatgtcagaatgaagaggtcagcaatactcctccactaaaaaaaaaaaccatacaactggacaaaattgacaaaagcatccagggaactagaaatctactagagatgggcagcaagttgaaaagctcctagagattcaaggagaaacagcagaaggctaattctttcccccacctcccatcaagctcaatcagcaagaatcgtagttttccagtttggagttggccaaaaacccagtggctcttctgccagaggagaaatacttataaagttttaaatttcaatatttagggtcgagaagtggcatgaaattttgtgactttgcatatactaaaagtagcaaactcagaaatgaatagggaaaggccacagctttgttagcccaaggatgcagtcccagttggggtgagcagcaaaccaaccagagtgctaatggggagatcctggaagggttgagacaagttttccacatacccctggctgactgagaatacgaaaaaactaacccagaaaaaggaaaaaaaaggagaaacataagactaaaatcaagttgggacaaatagaaaataaatcacaaaatgatacacctcaactcaactttaacatgcattaaatattagtgtattaaacactccaaataaaaggcacaggtgtcaaaatggttttttgttttgttttttttttcttaaaattgttttgaagaaaagcaaaaccaagcatatgatttacaagagacacttttaaatataaaaacagtgataatgaaagtaaataggtggaaaatgatacaacaggaaaatatttagcataagaaaactagactggttctattactacagctggcaaaaaaaaaatttcaaagcaggcagtattaccaaagataaagtaggatatctcataaaaataataaatgaaaaccaaatagtcttatccatttatgcccctaataactgagcttcaaaattcacaaagcaaaactaacaaaaaaagaagtaaacaaatctccaaagttgaagacttaacaccttcttttcaatagcatagaacaattagacaagaaatcagtaaagtttagaagattttaacaaaactacatacctttgcttaacactaatcagaacactatacccaaccacagcagaatacatattcttttcaagtgtacatggaacatttatcaagataagccatattttgagccacaaaacatctttatatgtttcaaacaatggaaatcttataaaatatgttatctgaccacagaaacaactaacttagaaatcaggaacagatacatatttttagaaaatccccaaacatttggaagttaaacagtgtatctctaaataacctttggatcaaagaagaaataacatgtgaacgattgagaaaatacaacttcaaaatttgtaggatgtagcaaaagcagtgcttacagagaaatggtagctatatgcactcatgttagaaaagaggcttaaaaccagttatctaagttcccacttaaggaagatgcagaagaaaggcaaagtaaaaccaaagtaagtagtaggagagatgttttaagatacacaagagcagaaattaatgaaacagaaagcttaaaatgatagagaaaattgacaagaacaaaattttattctttgaagagactggtcaaaaaggagaaatcacaaattatcaacatcacgaacaagaggggtatcactatagtggaagagggaatgtcactatagatcttacaggcattaaaaggataataaaggaatttttgaaaactttatgacaataaatatgatagcttagatgaaatggaaaaagtccttgaagcagaatttaccaaaaaatatacaatgataaatagaaaatctatataaccttgtatctattaagtaaattgaatttgttatcaaaaacattcccataaagaaacatccaggcccagatggtttcagtggtgaattccatcaaacatttaaggaagagataatgccaatcttatacaaactctttcagaaaatatagaggaagcagtttgcatcacattttaagagaccagtataatcatatcatctgacagagataagaaaataaagttacaggtctatatcatgattacaattgcagcattggtggtatagtggtgagcatagctgctttcaatgattatgaatgcaaaagtcgttaatgaaatatgaccaaaacaaatcagaattccaaaaaagagagagacagagtattattctggacaaagcacatttattccaaagatgcagggttagtacagcattagaaatatcaatgtaattcaacatgttaatagaaaaaagataaaaagcatatgatcttaactgaaaaattaacacaattctacactcattcacgtttagaaattctcaaaaaactaggataaaaaggaacttcctcaacttgacaaaagcatctataaaggtgacagctagcatcatagctaatggtgaaatattgaatgtcccccacaaggatatctacccccaccacaatgctatttaatactgtattaatcgttccaactaatgcaataaggaaagaaaaaaagcataaagatcagaaaagaagaaaacagtctttctttgcagaaaacataattatttacattgaacatcctcagtaatactaaggaataactactagaactatttaataaagtcacagttatatctcatcaatataaatatatatacatacaaatatattttctatatactagcagcaaacaattagaacagcggtgtttttttttaaattgacttagtatccaaaaaacgtaaaacacttaagaataaacttaacaaaagacatggaaggcctctgcactaaaaactacaaaacactgctgagaaaaataaatgatctaaattgagagttatgccatgttcacatgttggaacactcaatgttgttttgtagtcagttctcctcaaatcgatctggcaattcaatgcaatcacaatcaatatactaacaggcattttaataacttttcaaagttgattctaaaatttatacggtaaagcaaagaatacaggaatagccaaaatggctgggcacagtggctcacacctgtaatcctagcactttgtaggggtggtgtgggggctgaggcaggaggatcacttgaggccaggagtttgataccaatctgggcgacaaagtgacaccccatctctacaaaaacattttttttgaaattatctgggcctcgtaatgcacacctagctactcaggaggctgaggcaggaggatcacttgagcccaggagtttgaggctgcagtgagtcatgatcacaccactgcactccagactgagtaacagagtgaaaaaatgtcagaaagaaggaaagaaagagagagggagagagagaaagaaagaaagaagggaaagaaaaggaaagaaggaaagaaagaaaagaaagaaggaaggaaggaagggccaaaataatcttgataaagggcaaagttgaaaggctcatgctacctacttcaagacttgctataaagcctcagtgatcaagacagtgtgatattggcataaggatagataaatagacatatattgcagaatagggaatccagacatcatctcatacatgtatggttaacatacgttttttttactaaagttgcagagctaaataatggggaaaagagagcctttacaacaaatagtgctggaataacagaataaatgaaagaaggaaaaatagatcttgacatctacaacacaccaaacacaaaaattaatttgagatgggtttcagaattaagttaaaaacttaacaaatatctagaaaaaaaaaaaacagaatgtctttatgacttatctacaggactccaaagacactggtcatttaaaaatgacttacagatgcctgcagctcattctggggaaaggtcattcattgttatgaccaatgtggatacaaagcctaacacaaaaaggtcttgaacttttggattaggttgttcttgtattgatcactgttctcaaaaggaaagcctcaacacaagctgtctacctatatcatccccttgtacaaagaagggaactgaaacataaagaagaaacaagtcgtccactagcattggtgacatcagcaaaattgtagaataggcagctccaaactcccgtccctctacagaaatactgaaaaacaagaagcaactgtcagagccaactttgctagaactctggaaaagagtcagaagtttacagcaattaagaaagtgctgaaccaagaaaaagcaacttaaaaatgataggacatttgccagttttttaaattggggggaaaatgataggaaaactttgtggcatttttacttgtccttgccacatcccctctttgtctcagcagcagtcttaaagacagcatcccgtgttcccagtatgggaccctgaaccctggttctggagggagcagagcaggcttcaattgcaaattactggagtttgtttgtctgttctaacctattcgggagctaactgaagaacttatatgaggtatgcatctcgttttgcctaactgagaacccgtgaagagggagaagtgacaatcattgctcagaaacattgtaaggtgaatacaaaacctgcagccacctgggggcaaaagattaaggttcagacatacaatagaatgtctgaggtctgggagcaaaagccaggaagagagttcctttgggaaattagggcaattcaaaactgccagtgtgtattcgggagtttagaaagcaacatgcatgccaggacaggacgcatgttcagaaaagacctgagaagaccctaaccactggctgatctctgggctcagtacaagtagaaagtaaaggctcatgggaatatatatatatatatgtgtatatatatatgtgtgtgtgtatatatatatatatatatattttttttttttttttttttgagacagagtctcgctctgtcacccaggctagagtacagtgatgtgatctcagctcactacaacctctgcctcttgggttcaaatgattctcctgcctcagcttcctgagtagctgggattacaggtgcctgccaccacacctggctaatttttgtatttttagtagagacaggattttgccatgctggccaggctggtctcaaactcctgacctcaggtgatccgcctcccttggcctcccaaaatgctgggattacaggtgtgagccaccatgcccggcctcatggggaattttaaatggcctaccaaagtgttaatagtgccccaagacagagccaatccacaaagactagaagaggagggggttttacttgttttgttttacttagctcctggcaatcaaggacagctctatcaaaaacactggctgaacacaagctaagccttcagcaatcaagacaagcaaaccgtaaggaactggaagaatctgacttccagagttaaaacactgtaatatttgaatgttcaatttttaaaaatcacaaggcatacaaagaaacaggaaaggataatgcattcaaaggaaaaaaaataaactgacaaaactgtccatgagaaagctcaaacattgaaattattaggcaaagactttaaaaacaactgtcttaaatgtattcaaaaaactaaaagaaatcatggaaacgaagaaaggaaaccaggaaaataatatatgaacaaaacgagaatatcaatacagagatagaaattataatgaggaatcaaatagaaattatgaaggtgagaagtatgataactgaaatgagaaatttcactagaggagttcaacagcaggtttgatcaggcagaagaatgatttaacaaacttgaagataggacaattgaaattatccattctgagaagcagaatgaaagagtgaagaaaagtgaacaaagactaagatacctgtggaacaccatcaagtggaccaacatatgcattatgagagtctcagaaggacaagggagagagagagacagaaattatatgtgaatggccaaaagtgtcccaaatgtgataaaagacatgagtctacatatccaggaagctcaacaaagcccaagcaaaataaacacgaagagatacaccaagatacagtataggcagattgtcagaagacaaagagaatcttgagaacagtgagagagaggcaactcatcctgtacaagggagccttaataagattaacagttgatttcgcatcagaaaccatggaggcctgaaaacaggaggcctgatgccacttcacacctactaggatggatataattttttttaatggaaaataacaaggagaggatgttggagaggacatgaagaaattgggacccttgtacattggtggtgggagtgtaaaacgatgccactgctgtggtaaagcttggtagttcctcaaaaagttaaatgtggaactaccacatgacccaatgtcttagtccatgcaggatactacaacaaaaataccataaactggatagtttataaacaacaaaaatttatttatcatagttatagagaccgagaagtccaaggtcaaggtgccagcagattcagtgactggtgaagggatctatgatcccttcctggatcatagatgacagtcttctcactataacttcaggtggaagaacgggcatcaatcatgagggctccaccttcatgacctaatctcctcccaaatgccccacctccaaaaccatcaccttgggggttaggatttcaacatatgaattttgagtggactcaaacacctagcagttccactactaggtatatatccaaaagaaatgaagcagaagctcaaacaaatatttatataccaatgtttatggcagcataattcatagtagcctaaagataaatggataaattaaagatgctatatgcatacaatggattattattcagccataaataggaatgatgttctgacccatgttacaacatgcatgaacattatgctcactgaaataagccagacacataaggacaaatattgtatgattccaattacataaaatacctagaatatgcaaattcatggagatagaaagtagattagaggttaccagggactcaaggaagataacaatggggagttgcttaatggatggagtttctatttgggatgatgaaggggttctggatatgaatagtggtgatggttgcaaaacattataattaatgctactgaattgtacacttaaaatgatttaaatggttaattttatattatatgtattttttaccagaataaaaaatgttggctgggtgtggtggttcatgcctgtaatcccagcactttgagaggccaaggtgggaagatcgcttgaattcaggagttcaagaccagcctgggcaacctagggaaacccgtctctaccagaaaaaaatagctgggcatggtgacatgtgcctgtaggcccagctactcagaaggctgaggcaggagaatcgcttcagcctggaaggttgaggctgcagtgagccatgattgcccccactgcactccagcctgggcaacagtacaagatcctatctcaaaaaaaaaaaaaaaaagtaaagactgataaattgtaccttataaaaataaaataaatacataaaatgtgactagcaattttaagacacttaaatatttgaattaatttattgaatacctgctctgggaattagtgttgtgtttccatttacagagacaaaacaggtctaattgattgactaaacaatagatgtaaatgtggtcagtgtttggatgtctattcatagaataggaacaatttttctgagaaatgatttgactctcagctgtttcctgtatgacctctcaatttacattttattcaagagtttctaatataatattgtggagcaaagaaacttgacagcaacagctgttgagagaaggtaactgtcatattaatatttctgggaagaggtattgcggtgttaccagattccagatttgcaccttttcccctcaatccctttatccctctcaaacattatagtgatttatgaaaatatatgtataattccaaataagttttagataattccatatataccaaatacccaattatctctttgctgtcaaagggtaatttatcctcatcatgacacttgccatcattacaagtttaaagcctaaaaatgaaaagaggtttcacacatttaagagctaactcatttaataataaatcaaaagtaagtatgagtttcatttagtagtagcatgagctagctgcagggaaggtcctctcaaggtggtcctttttcttctcttcaataaaggcagaactctattaaagcatattagtaaaaaccatatttaaaagaattactacactgaactgagcagccaccaaatgcaattggtaccaggtgatataagggcttctcctctcagggggcttataagcaactaaggcaggaagtcacagataccatattctgcagtgtaatttacaaatgaggtgaaaacaaagtgttccaaaattctaagagagacattggaattctgaccacaagtgtaatttatggagcctcagagtaattataggatctggaacagctggtgctcaaatttagtggtcctccagttgctggaatctgcgatttctgggaagttaaactttgtgtcactgcttctacttgtgataaaatgaaaccgctttcaaagagaagattcctattcctagcctttttgggtaacttctactacctccacttaaggatgaaaagggagaagtttcctccaagactgcctcatggggatcagagtgtcacctccatgctcctgccctaagtgcccctgagcacaccccagagggaggctaagagatttttgagaaagaccatgtgactggctgataaacacctattttcctcagattccacctgaatttatatcatcagtgcatcactcttttattttgttctctctgttcctctttttaaatattaatattctctggagaggggtaaaacattaaatgaattcacactgaggaaactggccaggtacaatggcttatgcctgtaatttcagcaatttgggaggccaaggcagacagattgcttgagccccagagtttgagaccagcttgggcaacataatgagacctcgtctctacaaaagaaaaacaaaaaaaaaaattagccaagcatggtggcacacacctgtagtctcaggtatttgggatgctgaggtgggaggattgctttagcccaggaggttgaggctgcagtgagccatgaccatgccactgcactccagcctgggtgacacagcaaaacactgtctcaaaaaaaaaaaagaaactcttcaggctgatcagatctgcttttctctgatgagtttcttaggagctctacatttctggttgctgcaataggcaaagtatagaatggaggtcaaggcctcaaatttctctgacttcccagctgggcttgagagtgactctggccctcaactgagggcattagtaagctgtccttaagaacgagagtgtattttctggctgtattcttaactcatttcactatagagccatgtctgatattaacagtgcagtgctagactagagaggcctggcactcctacagccttctcctgtcttctagctgggacttcacaccacagacccaaaggaaaagagacccaaagatccctgcagaaacctgagaatatttcctttacctcagtggtttcataatctgttcttagtttcctgtttctgctgtaaataattcactatatttttaagagagagaaggtcaggcccttgtgagccagaagggatttgagagatgatgaaagctacgtatgttacccataacctaaggacttctggcaaggtggcctacctgagctggagtcatgccttttttccctggacttggagatacctgtcagtgcagaaaggcctacttttgatcttggaaataagtttcctggggtgagttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactctttttctttccaatatcctcatgacattcaatatttcacttactctaggtcctccctgcctaaggcccaagtcaactttctgtccagtgggatttgtaatccaatacctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcaggtatggtttttctttctttctcttttgctgggggctgaccgcccttcagctccagccaaaagatgtgtgtgaacacaaatataccttctgtttgaggtcagcatcatagtgggtcgtgaatcatgttggccttgctgctgtctcctcatttctagggtggaaaaaaaaaagcatgaaaacaatcacttaatgttgagccccattactgatgctctctggtcctgcactagcctcctagaaaaatcaccacaggagaagccttaactactgcatgagttaccacaagtcacacatacaaccagctccctgttacagggctggagtccctggacccaggaaataccacctccaaggactgtgggagctggggactatgggaactgggatcaactcagtcctgattccttttggcctgctgggttagtgctggcagccccctgaggccaaggacagcagcatgacagtcaccaggactcaccacttcaaggaggggtccctcagagcacctgccatacccctgcacagtgctgcggctgagttggcttcaaaccagtgagttttctacctctactattgaaagggcaccttgtcccacagaaccgagtcttgcctgcatgtggtcagtgccaccaggtccttcttctctccactttacagcccagctcggctgaagctatggccagaggcactgctttaaggccactccatatctaggacaggtcaacagacacctctgaggccactgagtcttgactcaatgaatcagctatagcaggcactattcctctcccacatggcctctaatgatatggtcagagttgaaaggatgctaagggaggcctcagaggcttatttaatcagttggttaatgggaaaaagtattttgtggtacacaaatacgctttaaaaatattttagttatgtcataaaagtctaaacctggggttgacaaactatggctcacaggctaactctggcccaccagctgtttttataaatgaagctttattggaacacagccatgcccattcgttatgtattgtatatggctgtttttgccctacaacatcctttcaactctggccatatcattagaggccatgtgggagaggaatagtgcctgctatagctgattcattgagtcagcaaaattgaccaattgcgaaagagacagtatggcccacaaagcctaaaatattaactatctggcctttaacagaaaaagtttgccaactcctgatctaaaagctgtcaacttgttccaaaattattatggaataaacccaagacaaccacaaaactgactagactaggttttttaggtaataactttttaaattataaagtaatacatgatttcatgctccttgaaaatgagaaagcagtatagataaacctaaattcacctttggccattctgtcaatcctaatctccagtttccccaaaagtacttagtgtgatatatttactgccagaccattgtgtctgtgtgtgtgttcatctatgcatagatggactattaaacctatctgttgccatgttgttctaattctgtttttccactcaatagcaagacttggagactttccatatctgtatagagctctacttcatttattttaactgctacgtcatatttcacagtgtacacttcttttatttagccgttttcttttcgatagatatttaagcttttccaatttttcagtcttaccaatgaacctcactgtgtttgtctgcttctagacatgtgcacgtattgcactagaggaactactaagacgttgaattgccacatcacaggatatatgtggttcaatttttggctgccaaacagccctccacagtacccgaaccgactgtactcccaccagcagagaaggatagttactgttcctccacactccaaacaatgcttgctgtttattcagtattttattattttttccattgaattagtgcaaatgacaacccattatttcaatattttaatttccctgattattaatgaagttgagcattctttttataggacccctcttggccattgtatttctcttcttaaattacctattcatatccttagcttattttatgtcggattttttttcttctttgtaggagttttttatttattctcaatgcaaattatttgatatgtgtgtaatattctctctaagctttgtttaaatcatactttttagccaacagaaatttttactattattgttgttgttattttgatgtagttgaatctgttagtttccctctttctggattttactctttgaggctgatttttaaaagatttctcaacttccaaaattatgaagctactttggtgcaccttcctgtaatacttttatttaaaaagttagtctttattcacctggcacttattgcaatacattatttcaatactatttattgaaaagtccatctttttcctatttgtttgaaatatcacctctatcatgtactaaattcccacttacacatgtccatttctgtgtccttttgtatttatttcctattcctgagccaatttccactataatgtttaccttttctacttgattttttcccccaataaatagaaaatctattttgtgttttgatattttgcctagttaccttatggaattctcttaatagttataaaagcttatcagttgattcctttggaatttctagttagacaaacatatcatctatatatagtaagagttttgctccttcctttccaatctttacaaaccttaattttttgtgtcttattggtttttctttgccattcagcataatgctgagtagtagccatgaaagtagatagtctcagaagtgatgcatacagttgtgtgggttctatactgcacaattctaggagatactctttacaaacacttagatgtcctaggaattcttgtcatgttcctgatttccatttttattttgtactatgaactcatttggaaacttctctttgggacttgttgagattgaaattgttttcctctagaggatttatttttgcttttgccaggaacctgaggacagaactaactgggaccaccataagcttggggtctactggccacacaaatagtgagaatcctgacccaaacttacttgattgcaggcctgttgttaagaatttcaaaggagacttttctttttgctctacccagagccaaggctgagaaggcctgggatagacctgtctccctccatggtttctactgaggatgtcacccttaggggatcttgagtttatagtctatgatctggttaggctccaggctttgtctcctattctaccattaaaatccaggccccaggcctacaggagtccagaaaactccaggatgatcatgacttccctttctcatgcctctggcttagcataatcttataaattttggcctcttgagacttcctttactttcctaccagctcaatcctgcatgaaaaatgacattcttaaaaatttagtatttctaggtgctgcataccaggaggattttctgtaaccaacttctccatcatagtgccagcaataaaatctttattttttattttaatgagattgattctaatgcttctccaataagatagctagtaaaagtgtttagtaactattccatatcaagttagtgaagctctcttctattcctcttggttaaccaagaattttaaatcatgaatgaatattgagttttattaaatgctgttaagcattgattaatttccttatcatatctccatagttaattatatagctcatcccaagggtgatagaagcagagatgatccaatagccactaggacccttggaatgcagacccatgatttttccattaaaaagaacaataaattcagggaacgtggacaacattaattcaaattcttagtgtggttgccacgttctgtttgttgagccatcagactcttgccctcacacttcagatattggtgtcctgggcacaacctggggaggacaggaggaatgtgtagggaacctctcttgcatacaggggctttttaggtggcacaatttgaagggggctgggaaaagttccctgcaacacctcctgaacctctttgaaacatcgatataacaaactgaatatccaactggaaattgacataaagagacatatccaaatccctcatgtaatgtttgaaataattttcctggatctgtgtaagttccaaagagtcaaactataaaaccacaggcaacactggcactacacatgcattgataagacataggcagttaactcagaggccactgtgtcctgttaaatattggaagagggtactgtgtgtacttatgacctgggctggtgccagctctcaaccctgatctgtgtctagtaaccttctgacctcttggatctgatgaccaagtcccaggaagcataaaggccaattttcatttatggccccctgaagagagcagctgacttctctttcttgaattcataaaccgtgactttggctatctgagtttcctctggaggcctgccccatgccagggccagtgaggaggttttgttaataatacttgatttgtttcataaagaatttaaaacatatagcctcattttgcccccatgaattctgtgaaaaaacaacttgcatcatgtatctatttacatgacaggaagaatcagaataagggaaaagaaaagatgttctggccaggcatggtggatcatgcctgtaatcccagcaccttgggaggccgaggcaggtggatcacttgaggtcaggagtttaagaccagcctggccaaaatggcgaaaacccgtctctactaaaaatacaaaaataatccaggtgtggtggcacacacctgtaattccagctacttgggaggctgaggcacgagaatcatttgaacccagaaggtggaggttgcagtgagcagagatcataccatggcacttcaacctaggggacagagtgagactgcctccaaaaaaaaaaaaaaagttccgtcattaattgacttcatgaactggaacacaccccagagccccagtttcctcatttgcaaaagggataataagaactgccctgcccccgactcccttattcaacttgggataagccctgccctgccttcctcacaggcaccttgacatgaagttgtaattttgaaatcattttgtaaacagcaaaacttgtgcaaatgtgagttaaattcaccaaacgtctcccttcactgaacaacgtcaatggttttataggcatcacttgcctgcatcttagaaattcagtattcttatattacattccccttacttgcttttttctctttatcctctggccagttctgctattaatatgtgtgtgtgtgtgtgtgtgtgtgtgtgtgtgtgtgtgtgtgtgtgtgtggtgtgtatgtgtatcttggagatagtaggatgattatatatatatttaattatgcgtgtgtgtatatatatgtgtgtatacacacataattaaatatatgtaatcgtgtgtatgtatatgtatgtatacacacacacataattaaatataatcctgctatctccaagagtttctatcccaaagattatgatttttgtttttttatccatttacccccttttacttagactctgttgcttcaaattcaagttgcccactcttctcttcccataatctcagtgacctggttccaaagcttgtgctttgactcatttgaagactaaatttatctgtatgtcctccccacatccttttcctgggaaggaactatctcaccctcaaagtacattgactttttaaaaaattattattattattactttaagagacagggtcttgctgtgtcacctaggctggagagcagtggtatgatcatggctcactgcagtctcgaactcctgggctcaagtgatcctcccgcctcagccccccagagagctgggactacaggtgtgtgccaccatgcccagacacttttaaaatttatttttggtagagacaaagtctcatgttgttgcccaggttcatctgaaattcctggcctcaagtgatcctcctgcctcagcccccctaagcattgggattacaggtgtgagccaccatccctggccatcattatacaaatttatttatttattttcatttgattgagacaaggtgtcattctcttgcccaggctgcagtgcagtgggacaatcatggctcactgtagccttgacctcctgggctcaagtgttcttcctgcctcagcctcccaagtagctgggactacaggcacatgtcaccacacttggctaattttttatttttttgtagagatggcatctcactgtattgcccagacttgtctcgaactcctggcctcaaatgatcctcctgtttcagcttccctaagtgctgggattacaggtgtgaggcactgtgcccggcctgtatattgactttaaacaacaatttataatgtgagtcatttcacatatctctttgattatttattttatttcctagcaccataaagttgtttttattgacaagatcatcttctccatgccagtctgtttgtgtactgccaattttctgtctggttagttggatttccctgctactactgcaagtgtggactgcagacccatagcatcagctcacctgggagcttgtgagatgctgaagctcagacccaccacagacctactgaatgggaatttgcattttcataagctcctgggtgatctgtatgtacttgaaagctggagcatcactctcttagattgtaagcacaggctccaggttaccttaaacgggggcacttctgaagcaggcatgggagagaaggaaggcaaaaatctcaattgccagggccctgacctcctagagattaaaatgtagttcagaactcaggttgggatcaaatgcactttaattgacatggttatctttttcttcctgattgtagtgcttttaactactgtattagtccatgttcacattgctgataaagacatacctgagactgggtaaattacaaagaaaaaaaggttcaatggactcacagttccatgtggctggggaggcctcacaaacatggtggaaggcaaacggcatgtcttacatggtgtcaggcaagagagagaatgagaaccaagcgaaaggggtttccccttataaaaccatcagatctcatgagacttattcactgccatgagaacagtattgggggaaccgcccccatgattcaattaccttccaccaggtccctcccacatatgtagcattatgcaagctacaattccagatgagattttggtggggacacagccaaaccatatcaactattgatgttactttcctttgtttcctttctttctgctgcttctcctcctcacaacttctgtttcctcggggcccttcctgcttcacagcttccctgtcctgccttctctctgagtgcactgtggctgccatgcacagggcaggactgaggcaccccaaccagtctactattttggcttccttttcaatttaaattcaatttaaatattatttaaatatttgatcaacatttatttggtgatgttctttttttaatttgtaaaatatacagaaggagcaggattgaaaaattaattagttctggtaaaattcaaataacaaattttaccatcttaagcatttctaagtgtatagctcaataatgtgaagtatgttttcatcgttgtgcagccaatctccagaggtttttcatcttttaagatggaaactctacccattaaacaactcccattcccctcaccccacagcccctggcaaccaccattctactttctgcttccatgagcttgactactatacctcatatttgtctttctgtgactggcttatttcacttagcataatgtcctcaaggttcatccgtattgtagcatgtgttagaatttccttttttttaaggctgactcatattctattgtagtatgtcccatgttttgtttatccattcatcagttgatgaaatttgggttgcttctacattttgtctattgcgaatagtgctgctgtgaacatcagtgtacaaatatctcttcaagaccccgatttcagttctttttggatatacatccagaaatggttgctgaattatatgataattctatttcaattttctgagaaattgccatattgttatctataatggctacaccatttttacattcctaccacctgagtccaaggttcccatttgtctacagccttgccaacacttgttattttctgtttatgtgatagcggccatcctgaatataaagtgatgtttcattatggtttccctttgcatttgccttatgattaacgatgttgagtactttttcatgtgcttgttggcaagtgatgttcttttaaatgtgtactatgttctttatggtcaaaataaataatttattctgtgtaattttccaaaccacacaacttcttggaaggcatgtttaagtgttcacataataaaacagtacatttcttccttgcaaacagccctacaccacatatttttccatttctggctctgtctgccaacttcaatgggctgtcctcagggttgggttggctggagtggccctgtgtgacaggcatgtgagtgtccctgagcaccgtacagatactagtctgcattgtcaaggagtgttttaagtctccacctcagggtgatgactgctttggtaggaaaggaggcaatctaaaattcacctgatttctgattcattccaataatgttttggtgtctttgaatatggcagccccctgggcagcagtccagccagcagaccttataacttagctctgtctgtatgtctgacatccagactcactagaagaggatctaaatgggccagggaattacttgtccctgggacagagcaattacaccatccctcataggccccagaaggcctatggacctttgcttgggcaccaggagcttctctgagagcaggtttggggtgggcttggcctccagagtggcctcctcctgcaatgtcaggctagattaacatctatgagagtctcctgtacaaggagaggtgggaggctgtgaacactcctatgtaacaccatttgtccccttgtgtgattgcttcaccaatgttgacagctcatgtgacacacctgtcttcttctgatggaggaaggaagtaataccattttctatcaaaagcattctttgatcatccctgtcctaaaaaaaagttacttgatgggtctcttgtcaaaatcagtgatatggtttggatgttttatcccttccaaatctcatgttgaaatatgacctctaggccgggctcagtggctcacaactgtaatcccagcactttgggaggctgaggcgggcggatcacttgaggtcaggagtttgagaccagcctggccaacatggtgaaaccccatctctactaaaaatacaaaaattagatgtggagttcagagtggaaacaggtgtgagagggttcaacagaagaaaacatagctgccaagtgtttgagtccatcggcaagtttggactggccttagctgttgcagaaggcatggtgaactctgccttatataacatggatgctgggcacagaactgtcatctttgaccgattctgtggagtacaggacattgtggtagggtaagggactcactttctcataccatgggtacagaaaccaattatctttgaccaccgttctcaaccacataatgtgccagtcatcactggtagcaaagatttacagaatgtcaatatcattccgtgcatcctctttgggcctgtcactagccagcttcctcgcatcttcaccaggatcggagaagactatgatgagcgtgtgctgccatccatcactactgagatcctcaagtcagtggtggctcgctttgatgctggagaactaatcacccagagagaactggtctccaggcaggtgagcgacgaccttatggagcgagcagccacctttgggctcatcctggatgatgtgtctttgacacatctgaccttcaggaaggagttcacagaagcagtggaagccaaacaggtggctcagcaggatgcagagagggccagaactcactggccactgcaggggacggcctgatggagctgtgcaagctggaagctgcagaggacatcacgtaccagctctctcgctcttggaacatcaccaatctgccggcagggcagtccgtgctcctccagctgccccagtgagggcccaccctgcctgcacctccatgggccaactaggccacagccccagtgattcttaacactgccttccttctgcctccactccagaaatcactgtgaaatttcatgattggcttaaagtgaaggaaatacagataaaatcacttcagatctcaaaaaagaaaaaaaaaatttagctggacgtggtggcatgtacctgtaatcccagctactcgggaagctgaggtaggagaatcacttgaacccaggaggcagaggatatagtgagctgagatcgcgccactgccctccagagtgggtgacagaggaagactccgtctcaaaaacaaaaaacaaacaaaaaaaaagaaacgtggcctccaatgttggaggtaggcctagtgggaggtgtttggtcatgggggtggatccctcatgactggtttggtaccctcggtaatgagtgattctcactcttagttcatagaagagctggttgtttaaagagcccggcacctcctctctctcttgctccctcttgctgtgtgacatgccggctcgcacttcaccttccaccatgcttggaagcttcctgagacctcaccagaagcagatgctggtgccaagcttgtacagccttcagaagcacgagccaaacaaacctcttttcttcataaattacccagcctcagattcctttgtagcaatacaaaatggactaacacaatcagatctcactgtaactctggaaacttgctgcccacccattctcttctagccaaagtccactttttcccctccagagttaccacaaggaaaatgaacagcctcaatccttaccactcaggcaagattaaagagttacagtgcagcagagaggcaggacaggaccaccgtgggccaagcgatcccaactctgcccaatcagtggaggctgccttctggaggctgtaggggaggatcagtttcctcacctcttccagcttctagatgccgtggcaatccttggctcacagccccttcttccatcttcaaagccagcaacttagcatctgaccctttttccacattacgtctctttctctgatcaaacccaggaaagcttttctaattttaagattcatgtgattagactaggcctgcctggataattcagcacactccccatctccaggttctgtaccctcatcacatctgcagagacccttttgccatataaggaaacatattcacatgttctggggataagggtgcagacatctttgagggcctttattctatctaccataaggacacgatcaaaaacattatagaggcatgccaggcaattaattaatgaaagtgttatgacatttttctgaattctgtgatgttgttacttgtcctttttaatgtctgtcatttgttgtgatttcttttctcattctttcttacaaatattctcttcggtacataattttgtatttgtaattgcgtgttttttaaaattattttttagacagggtctcactctgtcacccaggctggaatgcagtggcacaatcctagctcaccacagccttgaattcctgggctcaggcaatcctcccacctcagcctcccaagtagctaggactacaggcatgcaccaacatgcctggctgagtttttttgtttgtttgtttttttggggtgtttttttttgagatagagtctcactctgttgcccagactggagttgtgtgaacatggctcactgcagcctcgacctcctgggctcacgtaatcttttcatctcagcctcctgagtagctgggaccacaggtacgtgccaccacacttggctaatttttaaatttttttgtagagacaggatctcaccatgtcacccaggcatgtctcgaactcctgggctcaagtgatcctcccactttggcctcccaaagtgctgagattataggtgtgagccactcacccagcctttttttttttttttttaagagatagggtcttgctatattgtccaggctggtctcatactcctcacaattgatccttccacctcagcctcccaaagtgctgacattagaggcatgagcccccacacctggcctatattcttttttcttaaataggactgcccaggccaagcgccatggttcatgcctgtaatcccagcattttggttggccaaggcagatggatcacctgaggtcaggagttcaagattagcctggccaacatggtgaaaaacctgtctctactgaaaatacaaaattaatctggtgtagtggcccatgccttgcggtcccagctacttgggaggctgagccaggagaattgcttgaacccaggaggcacaggttgcagtgtgccaagatcgtgcctttgcactccagcctgagtgacaagattgaaactctgtctcaaaataagtaaattaaattaaataatgtaaaataaaataaaataggactgcccaaattgtgtaagcctcagaacccacgtaagctgactaaagggcacctctacttgcccattgactaacctgaacaccagatgaaattgctcttccaaacaccactagctggggagttggctcttggctggggttggtcagtgcacaggccagtaagggagctgggcaagtgcagaagtggagactagctgtgtcccagacagcgactctccggctgtgaccctggagagtcctttagcagggcaaagtgcaacataggcagaccttaagggatgactcagtaacagataagctttgtgtgcctgcagggggatgggaagagggtggggcaggagagggacataaaagggctctgaggcattgtactgtgaattccttcagtctcctgctctgctcagccagtcagccctgcctcccttgtttaggaccacacagcactgctgggtgtctgcctttccttgtgactcttctctagcctctgcatggccagcagccctcttcttttctcctattctcttaagaaacatgcccatcacctgcagtttctctgggctccccgttaatctgccttcctcatctcctaatgctgcctcctccctcccattgccggtgcctggaaatagtcaaggctgggttctgttcttttgcttgaatttctttcacttggcttcttgactctttctaaactacaatccccccattctcactgccttagttttccctctctctgtgtttctcaaactatatcccaccacgccctgacaagggcttctctcctgtagatcatcccttttctagtattttgctagaaatatatagtgggattttctcctttgccctacatcatcactaaacttcccaacctaataggcagtgtcttgcaccttctactgatcatttcattctttcttgcactaaagatgaccacttcccatgtctgtacccaattcctgtttggcccaaatgtatctgcagcactcacccgtgttctcacactgagtctctaaatatttgactccaaaggtcactagtggatcacctccctgcctctcactttcccccaaggcacaaagtcttctcccagcacttctctttagtcctcctcttcctcatgtttcttctgtagggggaggaccatgttcaactttgtgatttttttctagtttgtagttgtgatctaccctgtaccactgagtcatctcaaatcacttaaacactcacaccaagtgtaccgcacttcacggcttaatcccctgttgatcagaaaaccccaggtccctggaattgaagcagggtctcattcagcctgacatgacctgaaatttctccctgactcctttcccagccccaagacaggggacttgcaagagtcccattgttgagcctccttggaacccactgtcttccattggtcatgttccacccagcaggttctatctagttctaatcctcaatgctgcttcgcatcccttccttgctccattgtccagccctgagctcactcaagccttgtactgctctccccttttcccttccctcccaaccctattcctctcctctctacatactcctgggagccttgctccttctgtagcagaaacttcacacacattttctttcaaattctcctccattgctatctccagttgcaccgctcttcttcatttctttccctccacattcaaacttgtcttctctggagggcatgctctcctgggggctccccctggcccagcctcagcatggcatctgcctttctggttccttcccaccttctctctcctcacttcttgccctgccagatctgtctatggcaacagcccctgcagcagtgcactctcctcttcctcttcatgcccaaagccatgtcagcctctctcagcagcttccattttattgtagagacactaagcatagagaagttagtgagtaaagtgagttagttcaacatcagtggcaagggctaggacatggcctcctgactatgacaacaagacaatgcccactatatctccagccgccaggagcaaaaaacaaagtcctctgacctccaggaggctgccggctagctgggtcctgtttggtcacaatcagtcattcccatgtttatgtgtgtgtcattcatggaagacctcccttctccctttaataggggatttggggcctcttagcaaatgaagtaactgcacaaagatatgtgtgtgtgtgtgtgtgtgtgtgtgtgtgtccccttctcattcttatgaagtcctaatgctcctccattacccccaaacaaacacaggggatcttatactgaaaatcagcattcacagaaaggaaatggcctcatgaggaagcagcaggaacaatctgtttatgggagagctcagtgggccaggcaggaggtgtcatggcccttcctctgcgtctaccatacctccttcttcaagctgtttaggtggtgctctggggtgtcagcctccaggcattcagctatcggactcttactctaaagaggaaagggaaaactgaggaaatacagacaattatagaggagaaaatgaaaataattccaaccccaaattcatcactatttcaattctatatatatacatatctacacacacagatacatacatacatatctctaaaagatagcatatacaggacattattattattgtagttttaaaccttcaatattgttttatatgcacccacatatttaccctttttagttctccatattccctcctgaagttccatgctccccactggcttttgccaggataactttctttggtattacttgtaatgcaagtatctgctggcaacaaattcttcagtctttgtctgaaaatgtctttattttgcctttacaatagaaggataattaaactattggtcaaattcttggatagcaataaagatattaaccattgtcttttctgttttacaatttcaactgaaaagtcaaccattaatcttaattttatttctttgtggttaattttttttttctgggtatttgtaagattagttttcttgtcatcgattcccagcaattttacgatgtgtgggtaggtatgtgtgtttttaatcctttcattggtttcaaaaacttcttggcaagtgtgctttcccagattgcttctgtccgattcttgtgtccgtaacatatgttaggctatttcactgagtctcgtgtgtctcttacgccctgttcttttcttaatgctcttttttgtttgtttctgtgcttcggtttatatattttctgttgacctaattttgaactcactatcactgtctgttgctgattcaatctgttgttaaaacatccaatgagttgtcagtttcagatattgtactattaatttctggaatgtccagaaatgtccagttgattatttttaaaaatagcattattgagagataccttatgtatcataaagtctaatcatttaagtgaacaattgaataactgttagtatatttagagttgtgcagctatcatcaaaatctaattccaggacatttctatgctccaaaaagtactcgggaggctgaggcaggagaatggcgtgaacccggggggcggagcttgcagtgagccaagatcgcgccactgcactccagcctgggcgacaaagagagactccgtctcaaaaaaaaaaaaaaagaaaaagaaagaaagaaaaagaaacctcatgttcatttgcagccactctctattccactctcagccacaggcaaccacgaatctactttctctatggatttgcctttcctggacatttaatataagcggaactatacaaaatgcggtctttgggtatacttctttcacttagaatgttttcaaggttcatctgtgctgtagcatctatccttcattcttttaaaccgctgaatagaatttcattgtatattagtattccaggtgcattccacattttattgatccacgaaccggttgatgaatatgtgggtcgggttttgggctattatgaataatgctgctatgaacatttgtgtgcagtttttgtgtgtgggcataggttttcatttctcttgggtggatatgtagaagtggaattgctgagttatggtgaatgtgtttaacattttaggtaactgagcaattgttttcttaagtggctgcaccattttacactcctgctagcagtgcataagggctcagtttctccacattattgccgattcttacctctttttgatttgtagccattcttgtgtattgtaagatgtatttctttgtggtttcaatttgccttgctctaataatcaatattcttgagtatattttcacatgtttattggtcattcatagcttctttggtgaaatatctattttaatcttttgttcatttttaaattgggttatttgtatttatattattgagttgtaagagttcttcatatattctggatacaagtcccttatgggatatgtgatttttaaaatattttctgtctgtgtcttatctttctactttcttaatagtgtagaaagcacaaacattttcaatttcaatgaagttcaatttatcaacttttttgtgccatattttttctgattaaaaaacaaacaaacacaaacaaaaaaaaacttttaaaagacaggaatagaataagtcttccgaatgtaatatgacaatctgtcttaccaaccaccagtaatatgctttataaggaaaactaggctgggtgtggtggttcatgcctctaattccagcattttgggaggctgaggggcatggatcacctaaggtcaggaatttgagaccagcctggccaacatggtgaaaccccgtctctactaaaaatacaaaaattagctgggcgtggtggcaggcacctgtaatcccagctactcaggaggctgaggcaggagaatcgcttgaacctgggaggcagaggttgtgcaccactgcactccagcctgcgtgatgagactttgtctcaaaaaacaaacaaacaaacaaacaaacacacacacacacacacacacacaaagacatataatacccgaagccttcacgcttttggtgtcacatctaagaaatctttccctaaccataagaacttattcctgttttcttctcagagttttatagttatagctcttacatttaggtctatgattttgtgatccattttgagtaaatttttgtgtatggcacgagataagagctttaattcatcttgcatgtgaatatccaattttccaagcacctttttttagcaaagctggcctttcctccattgaattgccttgcatttttaccagagatcaattaatgataatagtaagggtttatttcttgaatctcaattatgacccatcaatctctatatctgtctttatactaatgccacattatcttggttattttagctttgttgtaagttttgaaatcaaaaagtgtaagtcctccaactttgttattctcttccaacattattttggctattatgggtcttttacttttccatagatcacagttctcctttgaagcttttcttgccttcatccctttgtctatattatcttccatttatttttcattaatcatagggtgttttttggtcgtttttttcccctttttgtggagaatgcggtcttgctgtattacccaggcaggtcttgaactcctgggctcaagcccttcagagcgtataggacaagatgcctctggatgtggtcagagtggcagtaaggttcctcggtccattcttctatagctggaattgaaatggcaagaaaaggagtgagggtcttagggaatcacttcctgcctgggaacagagagctacattaaaggagtcccatggcatggagggaccctgtctggggtgaaccacctaggaaaaagtttgcaggcaatcatggaaatgaagaaagtttaataaacggtttacccactcaaagacaaaccttgtgaaggatgcagcatagcactgaattaagaacacaggttttggagtcagactgacatgggttgagattctggctccacctcctcccagctaaataatgtcaatgaatcactcacctgaagaggagaggggctgtgtgtgctcagtgcagcctgacagtgccttcagcaaactgacaattttagtcacgtagaaagactaaattcattgatttattcactcatttattaaataaatgaattatattcttcctttctgagaacgtagtccttagctttaatacttaccctgcataccggattttacaattaattatctttgcaaagccctctctgaagaagtgtttactttcactcagtacaggagatgatcctttcaaccttcttctgatgagatttcaccgattactaagcaccgtgagaagcaggtggagccctcagaagcaaacacagttgtattcagttaaaagtacacatctaattggtctccctaaatttgcatgaaagagagatgtagctggcacacctcagacacccagtcactgtcattttcctgcccagagggcaacattctgtaaaggaacagtgatggaagagtggcatgggagcaggactgcagctgctgggctggctcccccatcaccacagttcagatctatttctaacccaactccaggggttccacttccattatttcttgccgtgtaacaaatctcccctaaactcactggattaaacccaccactgtttcattttctgacatgattttctgtgttggctgggctcagctggggagttcttctgcatcacaggaccttggccaaggctgcagtcacctggaggcataattgggctggggagtccaagagggctcactcacacatctgctgtttggtgagggcggccgggaggctggggtggctggtcctgtctcatcggtgcgatctcaggcctctccctcttcacatggcctctccgcatggtctctttgggtggtcactgagcagggtagccagactttgttgcatggtggcttagggctctccaaagacaaaagcagaagctaccaggcttcttatagcgtagacccagaattgtctcttccccacattctattaactaagcaagtcacagaccatcctagactcattatgggagggggctgcacaagggtgtgaatctttcggggcatggctcctgggggccaccttggataacagctgtaatgggttctctagcgggggcttcataagcatatgagagaaggaactatagaatgtgccagagtcggcttgcttaacacttgggcaaaacaaaatgaaagttatacaaatactgcggaatgagattctagcattaattctactatctcctcattaagaaattggggaaagtgtaaattagacatgatttaagtaaatgtcttttttctggtcctttggtgatatttcttttatcttcttggtccatgtcacctgtgggcttctcctgtgattcatgtagtcatgttgtacttgtcacttccattatggggaagagcatttatatttattgcgagaaagcagcatctcaccatcttcaattgtccaaagttcacaattgatgtgcagaatctttgccaactgtctccattgccccaggtgctgctatccctcatggctcctgaatgatgctgaaaatgtaagggaggttggtctcttctaatgtacactctgaaatactatcctgctaataacattttctctgcctgcctgtgatgctctttgattttggaacactctttgtgtctgtgaacagttagagggttatgtaaagtccctgggtttttgtcataagagtgacttccaagttatttggaatacataacagaatatatctggtgtgtagtagatgctcaacacatgtctgttgagcaatatgataaatgctatgatgattgttatgaggaataaatgagtgccatgttctgaatgtttatgtttcccccaaattcgtatgttaaaatcctcatccccagtgtgatggctttagaagatggggactttggggggtgattgggtcatgagggtagaaccctcatgattgagttagtgtcctcatgaatgagaccccagaggccgggtgtggtggctcatgcctgtaatcccagcactttgggagtctgaggcaggtgatcacttgagcccagaagttgcagacaagcctgggcaatatggggaaaccctgcctctactaaaaatgaaaaaaaaaaagtagctgggtatggtggcatgcacctgtagtcccaggaggctgagttggaggatcgcttgagtccaggagatagaggctgcaatgagctgagatcacaccactgaactccagcctgggtggcagagttttttcttttctttcttttttttttctgtctcaaaagagagagagagagagagagagagatagagaggtcccagagacccaaagagctagctggctagcccctttcactatatgaggacagagggagaaagtgccatagatgacaggaagcaggctcttaccagacattgaatctaccagtgccttaatcttggacttctcagcctccagaaccatgagagataaatttctgttgtttataagccactcagtttccgatattttgttatggcaacctgaatgcactaagacaatgagtgaccttttacaaaggacctgaataatcattattttccattttggtatctgttccatcccatattctctaatacaaaatctgtcccaaaacactaatcctgaacctaagattgctgcagctacctgctgaaaccatctttctcagtgtacttttttttttttttgagacagagtctcactgtgttgcccaggctagagtgcagtagcgtaatcttgtctccctgcaacctctgcctcccaggttcaagcgattctcatgcctcagcctcccaagtagctgggattacaggcacgcgccaccacactcagctaatttttgtatttttggtagagatggggtttctccacgttggccaggctagtcctgaattcctggcctcaagtgatccacccatctcagcctcccaaagtgctgggattacaggcgtgagccaccacatccagtcccacagtgtcttttaatatatttacatttaatggccaggcacggtggctcacgcctgtaatcccagcactttgggaggccaaggtgggcagataacgaggtcaggagatcgagaccatcctggccaacatggtgaaaccctgtctctactaaaaaaaatacaaaaaaattagccaggcgtggtggcaggcacctgtagtcccagctactcgggaggctgaggcaggagaatggcgtcaacctgggaggtggagcttgcagtgagccaagatcatgccactgcactccagcctgggtgacagagcgagactccgtctcaaaaaatatatatatacatatatatttacatttaatatatttacatttaactaccaacatagttggtatttttttttttttttttttgagacgaagttttgttcttatcgtccaggctggagtgcagtggcgcgatttcggctcactgcagcctccgcctcctgggtttgagcgattctcctggctcagtctctcaagtagctgggattataggcacccgccaccacttccggctaactttttgtatctttagtagaggtgaggttttaccatgttggccaggctggtctctaactcctaacctcaggtgatctgcctgcctctgcctcccaaagtgctgggattacaggtatgagccaccgcacccagccccatatttggtatttctaccatacatctgtgttttctattcgtctcaccctttcagtttcttaactctctaattgccttcttttgaacttttttccttccattttttcctttctattagcttccaagttatgcattctatttttggacttttaatgataaccctagacatttcaacaagcacactttactaatcaaaatctaagatttaccatctttttttcccttcaacaatacagaaccttagttactgcatccatccatattttagttgtattttgtttttcctaactcccaagatattattattattggtttatgaagtcattgtttattccgatttttacagtaaatttttattcattttcaaatctgcttggtcaattttatggtcgtttattctttgtttatgtcttcaacctctcgtactgtttatttaaacatttctgtgtttgataactcagggcattttctcatgtctaattctagaagtttttttggtttgttttgttttgttttgttttgctgactcttgctcatcatgctgtgccagtcttttcattcatgacttctgagtatttgctcatatttctttgaaattatatgtgattatttgtgcctaggtataaagtggaaagtgagttcccccaaaaaggaggatttctggccagacgcggtggctcacgcctgtaatcccagcactttgggaggctgaggcggaggctgaggcgggcagatcacttgaggtcagcagtttgagaacagcctgaccaacatggtgaaaccccatctctactgaaaatacaaaaattagctgggcatggtcgtgggtgcctgtagtcccagctactcaagaggcagaggcaggagaatcgcttgagcccgggaggcagaggttgcagtgaacttagatggagccactgcgctccagcctgggtgacagagcaagacttggtccccccctcccccccaccaaaaaaaaaagaaaagaaaagaaaaaaaaggaggatttctgttgggtgtctgggagaattaccaacccaaatgcactttaaatcttaaatcaactttttggcttgaggtttttgtgaacacctaaagtatacattttgtctgcaagcctacataaagtcaggattatgatttgaaaaatcagggattttcccctgtgcctgttcagttcaggtttccagtcaatgtattttattcacagtgtaatggagggccagggtcagagacagattaattccttatttactcttacaggtgaaactgtcagatgtcacctgtcatgatgttggaaacagaaatttatgtgttagaattttactaaagtttcgattttggcattagaaaaagcatcgtcatctgtggtggtgtctgcccttgtcagtcagtgcctagagagaattttggggatggtagtaacaggacaatcccccatttctactgaacatcctcagtgtctgttccaagtagaattcaagttatgctctcaaggtggaagttgcctggggaggacatccttgagtacagctcaattttttttctttcttttagagatgaggtctcactttatcacccaggctagagtgctctggcatgattctagctcactgcagcctcaaaccctcaggctcaagagatcctccccgctcagcttcccaagtagctgggactataggctcacaccatcgatcttggctgtttttttttattttttgtaaagatgagatctcactttgttgcccaggctggtctcagattcctgggctcaagcgatcctcttgcctcagcctcccaaagccccgggattacaggcatcagccaccatgcttagctacagctctattaataggcacaagttcttcaatattcactgagaccccagctctgctgggaccacaggccatttttcttcccatgttgtgatcttgcccaccatgcctccactttttccccatctgcctggctacttagttgaaaactctttctgctcagcctttctagctccctgtgggagcttgggccacaccccacctgaaagactatcctccctcaatgtccccagtcccagaaatcatcttgaacaagtaatctgtccatgagctgctccccattcagacctctggccaggttgtggcctcctaacctcagtccactcagctgtggcctccatgatccgacccagacagcctgctctcttttcttctcatttcttcctccctcttacccttatctttcccatgctcctgttcacatgttctactccagggctctatttttgtgtacaaaatgtcatgattacagctctctttataacaattccaacccccattccccgctttttttccccatgagaggtcagctcccgagttcacaggcccaaatgtgagtgatgcatagaagggacagagtgtttcctctgaggcctctacacatccctgtccagtcttttcattctctgtggttttctcatttctagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggtagagttacccatcagccttcacccacgtgccaccactgacccactgggtaacgtctcagggcctcagcttgacctgtcccccaggttcagagtgtgggctggtggcccacccaaaggccttgtaattagtctcaagggagccatttatatcccagaggaatccttcatcttcagtcttcctgttctacccaggaaaggtctccttccattaagatatcccttggtttctccatgtgctcttgaataaaatggaaaatgactcagtgaaagataaggaatttgaaaatcccaaatccaagtgttcacatccgccttctggggtggttgttacataaagaatggcataaaataaatgcttagaccatgggaagagaaacagaccgaagggaggggaagggcggggaggggagaaagccatgtgtgaggaagcactccaggtgcaccctccggagggcacagggtatgcaaggagcagctcccatctcgggagccacatgtgggaccctcatgcattcccaagacagccagcctgacagccctttgcagagttcttcgtggtggctgggcattcaaatggaaaagggcaggttccagggagaaatgaacattcgtgttgcatgagttataacaggggtgagacacatcagcagtgtcagactgggttcagctacaagtcacaggacacttgtcgccaattggtttggcaataaggaaaatgtgttacctctcctaacaggaagtctgaaggcctccaggttagtgagttcagcagctcatttctttccatttttctcttcagccatcccacctgagagctctgattgcagtctggctccccttgtgggggcacagtgctggggccccaggcaggaatcattatgttcagcagaagcgcacaaaggcccatctttgagagtaaggaaatctttcccaggagtcccctcacattggctagagccgggcccagcctatgcctgaactagtcactagcaaagagcagcaggtatgtccctgagctgggcacacgccacttgactgtgtggaagagggtggatgtctgcaccagctccagatgctgctggcacagaagaggctgcccaagcagtgttcgtgcatcctgcctcagcatgcaggaatcttctgctctcccttcctcatttgggtactattcctgggactctcagaaaaaggcaacatgttgtagtgggcaaaagctaaatccagtatcaggcagacctggattcaaatttcagcttgtcatgtacctggaggacagctggggatccatcgtctccaagcctcagtctccctcatctgtgctaggcagatgagattatgagtttcacagggttttagaactaaatttacaaaactgcaaaatacctagcctagcatctgatacatagcatacctttaaataatgtgagccccggtttcatcttttacccattctcagtggactttgatgtagcatcagagttttcttacccaggccagttgggaaggcaaaaggcagggatggcatctgtgaagaacatgcccctgggctggtcactggtccgaggcccgaggcctccaagctcaaacctgccaggtcactgcgggcttggctcagcttcccaggcctgccctcggggacctctgcagccctacctggctgttccatgctcctgggccagccttccctcagtttccactctggaccagaatcagaggccagagccaagggagagattgtttctttccatccagctgtggagatggggaaagtaaaggtaggactgcactgaccgtgtcttttgtgggacaggcaggacttccgggctgggaggaggagatcttgtaccagagtctccaaaaggcatctgccccattgcctctctgcgcaccgcagagaggggtgtgcgggcccgtgggtcccgcctgcacgctctgctgttccaggcgctcgacctctttgccccctaggtcaacgaggggaatccactctgccatggggaagtcgctgccccgtagggtataagaacttccccatagttcaccccttcctccctggccgcccagtctggaaggggagctggagaaggcggcggggggtggggggaaggcgggggggaaggcgggggggtggggcgggcttctctggtttcttaccctcctggggtcaggtttcctcagctccctcccttaaggaggggaaatcgaggaagaggcccatctccatggaaactttctggtaacaaggctgtgaaagagaaggggacaggtgtttcaggaagaagggaaggcgctgaggatgggcctggagaggaagtgtccctgaaagtggttttggggctgcccgcgccagcgaaaagcacgtgtcccatttcctgccggaatggccagaaaaggtctcctccccggctctgccccctctagctgagtcctggacctctagggactcccacctacacccttcccataaagcctgacccagctgggacgcaaaggctagtgtccccctccccgagtcggtaggggctggggagggaggtggtatggcccggagccccaggccgagggcccgggcacccgtgcatccccccttctgctccccattctctcacaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagagtgagcagtgggcgcgcgggcgggccggcgccggggtgcacggctctgagtaaggacgtgccgtgggtgtgggcatgcttgtgtggagatgcgcgccgagtgtgcgcgtgaacacacgtgcacatgtgagctggtgtccgtgtgcaacaggcagccacctgggggagcgcttgcagtcggccctctgggagatggagggagtcggtaatctctgccctgggatgtgtgctgggcagccctggacagggcgtgccctctgtctcccctcagttgctcctgcatcattctttttgtccccttcataattgttgtaatggtttgaaaccacatttgcgggtaggagtgtgaatctgggggagggaagcaggagccacatgggtgataggacccggggccttctaggtgctagccccatcagctgccccagacctggatctttataggggaactgtttgcagacaggtgacatgaggtgttctcattctacctatttaactttgatatatttgtgctcctaggtcactatgagattaaggctcatgcggaaaaggctaggtgtttctagtgcatatttgtctccatggaacacaaagggacccaaagctgcttctttcaaggacaagttctctaggctgctggcaggcattcttgatctctccccaccaaggacctcatagctttgttctacacacatgagtgggctccagaaatccacagaagaccctaaggctctgggctatataagaagtctctggagttgctatttcttgctaagctgtagcccagctctctagggtcttggagacccagacacctctgaagagtcttggtatataattcaccagaaaatgataattgtagatgccatttactgaacatctcttatgtaccaggaactatattaggcaccctacatgcaaggtctcatttaacagcggtgcgaggtaaacacggtttctccggatcacaaaggagaaacctggaggcaggagaggttaaggaggttgcttggggtcacaggtagtaagtggcaaagctttcatgcaaacccagcgcctttggattctgaagcccgtgctcttgccagggccccacagtgtcctcacaaactccactgcagagggcaaaacaccagcctcacctcatctctgtcctcacccaagtgtttctccagaagagcccacaggcctcttgagtccagacaggggagaattgcttgtcaccattactttctcttttgcctaacggcttctgctgccttgagagggttacacagtggctctccagggggctggaggctcaccaggggcacgtgtgcctgagccagcctcactgtccctgcagtgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccgggtaggaggaactgcacagtgacccgaggtgtcactgccatcttcattctcacatagaaactgaggttccccaaggataagaaacttatacaaggtcacagctaatcagtggtggagggtagatttggagagctggtcctgcatctgtgctagctcctcaaagccttagtctcattcccaaaggttctgaaagtgtggtccctgggtcagcagcatcagcatgcagattttcaggtcacctcagatctcctgaatctgaagctccagggaggggcaggaccccccggtgattctgttgcaggttcaggtttgaaaaatcactgctctctcctttaaggcaggtaggaactgggtctaagcaataagtggagggaaagctaggcagttccccagtgttgctggcattcggggctttatgaggacaggatcaggacctgttgggggtgtgacttttgtgaactggtgtttcttgatcccagcacattaactatgtctgtgctctaagtgccctccttcccctttgcactgatagatatctcaagtggcccttcacagcccaaataactggattagcccagtgacctcagatctgctcttcccatccatagcaccctaaaccttctgagtctcctgagcccaacatctggaatgcttgggatgacacaccatggttgcagtcccccttaccctccattttaaccaagcagggatgtgtgtgaccattaattcatagatccccaaagcaccttcatctgatagagaacaccagagagaagaaacaaatgctgtgtgtgtatatgtgtgaggacacacgcatgcatgtgggtgtgaatgcctgcatttgtgcatcctctcgagctgcaactgtggctgtgcatgtttggctggggcctgagttgggacctgtctatgaaagcacatgctgtctctcctctgtccacctcctggcatgtgtcctagctgccaggggtgcttagcagtggctgcgagttgccagagtctctgcaggccccatcgagggaagaagctgccaagtggagccaggtccggaaagatctgtgctctttgaaggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcaggtaggacatggagactgggtggttgggtgtggaaaagaactggaagtggccaggaggttcaaagggcctggggtagatcctgaatttgggggatattggtgtcagaagaccctccttttcctgtgccctttccccgggcagccagtgctgctggggagtagagcccttgctgtatggctggttagttttgtggctgtgggcctgccagtgtctctgcctcttcacctgctcaatggaagctaaaaatgcctcccctgcagggctgttctgtgaaataagaacacatccgaagaacacccagcacagagtgggcattcagatagtcttttgtactctcccttaaaggggcaggaatcacatgttgacagttccagagcaaggaatgagaggaatagaaaagataaggctgtgaaggccatggggagggcgggtggtcctcagagcccaagggtcaggtctccccagagctagatgtggaggcaacaaccatcgggcaactggggttagtgggagacatgggaacttcctggggtggcaggaaccacagccccagaatatgtgtgcagtcgtaggattagggatggtgccaggtgtatctgtccttgggtaggccaccttgccttgccaagcctggtcaagtggggctgaaacacacctgccacaagctcctggtttcttcagcaggttgagggtaggttatactctaggagcccagaggttcttctctggccctgtaggagtcatgcgtgacttatttaatggggtgatgctgacagcaggtttggaatggggttcagatggtagcaaataagcttaaaggggcagggagagaagaatacttataaatgtggacattgggagatctttggtgaaatccagtgactgacaatttaacaccagggcttcccacttgctatttctcaaggccaccaatgtcgagcacagtgacctgaggtgtcactgccatcttcattctcagatagaaactgaagttccccaaggataagaaacttgtacaaggtcacagctaatcagtggtggaggctagatttggaagtaccaaagccagctcgatgccaggtcctaagctgggcaatggggaggcacagaagaataagatcaattacatggcatttgtagctcagtgttagggatctaaaagaaggatgggcgccagtagcacagggtctgaattcccaaggccaagaggtagtgtttcctcaaaacccagagtaagcagcctccctctcaggctgtgaagcttcctccttgtaaggaatgcctccttactggggaggtgggggcccctcccaggttgggagggagtgatccctgcaggaccggaagggtatccatgtaaccataatctcagaggcttgttaagccgcctccatggttaggcctgtgcttcagcgctaggagtggggcttcaggcatctgggctgcagggaaacagtagaaatacatgtgtgcacattaaacccaacaccgacagcaggaagcaaacatccccactactggaactcaggccaaaagggcggcactttcactctggaaaggggagactgcactctggaaagacttctgagaggggcaaagacatagcatggcctgaggggctagcaggatatactaaaggggaagtcattccaagggggaaactgaggcagaaaggaggaggccagggaccagaagccaaagcactagctgtaggtcaggatttgtataggagctgaaggagatggggccagcctgtaagggacctggatgccaagctcagtgggtggagttcccggaggttggaggggaggagaggatgctgcggggcagagctgtctgctgggttgtgaggggagagatgagaggcagccagacagcagccacagtcatcctcagggaaaggagccatcctccctcttcctctcgcccccaacttctggattatgggatggctgctggtgccggtctgtgggctgcctcccagggagctgtcctcccctccccatccttgctgccagggacttgcccatcgaggaccagatctccctgctgaagggggccgctttcgagctgtgtcaactgagattcaacacagtgttcaatgcggagactggaacctgggagtgtggccggctgtcctactgcttggaagacactgcaggtgcccgagagagcctgcctgccctggcagagggagggaaacactgcagttatgggaggaagggagctacgccaggatatgcaggttctgggatggcagggcaggaagatggaatggtggaaaacaagatattggtgagggatgattagatcttggtcagcttgctgagaagctgcccctccatcctgttaccatccacaggtggcttccagcaacttctactggagcccatgctgaaattccactacatgctgaagaagctgcagctgcatgaggaggagtatgtgctgatgcaggccatctccctcttctccccaggtgaggatctcccctaggctgcctgacatcccccccagccttatctgccctccccagggaaggtcccagtctatggccttgctcctcattcactgcgcagccaggatgggggctctcgctggtttctcctggggtcagtgggtgatgcccagccctggtcttccttcacttccctgcctgggtgactccagctctggagggtggttggcgagcaatgccctgactctgggctggactgagcttgtctttgccccatgatcttgcaccacacctccctcccctccagaccgcccaggtgtgctgcagcaccgcgtggtggaccagctgcaggagcaattcgccattactctgaagtcctacattgaatgcaatcggccccagcctgctcataggtgagcacagcagggggtgaggacccgtgagggtgatgtgagggagccgaggttcagggaaattgcccaagacttcatggccagagggtggcatctggaggtagccccagccagaccaggtccaaagctcacacttttgagcactacctaaccacttcccaggaaaaacacaagcaaacagggggacgtggcccagaaaggggcttctataccttcactggtcctcagtagctcctgtgacctactgcccagactgatgcccacagacccagagacaaacttggattttacggagcccaaggccatgaagggttaaggccaacactgagtattatagtgtgaacctataaactgaaatccttatttggcctgcacagctttctttttggcttggtgtcctgggatgctgggagtggccatgtctttatttgctcaacccttccttgtatggaggcaggaggctggaagtgccaactttcttttccatcatggggatactgaggcatatggtacatctcagacactagatccaaagctagttccaggaagggattccagcctgcagcccctaacctccacaacgactctgctcagtcctggcccctggacattaacgaaggcagtgacagccccacacccccaaactggtagctgcaatatctacattttcccacggaagtctctgtgtacaaagatgcaactcccgcagctgggtgtcgtggctcacacctataatcccagcactttgagaggtcaagacaggaggatcccttggggccaggagttcaaaaccagcctaggcaacatagccagaccccaactctagaaaaattttaaaaaattagccaggtatggtggcatgtgctctagtcctagctacccaggaggctgaggctggaggtctcttgagtccaggagtttgacactgcagtgagtccatgatcgtgccatcatgctctagcctgggtgacagaacgagatcctgtccctttaaagaaaaaaaaaaaaaaaagacacagctcccatgaatgggatgggagtggggagagtattgggcaggctgttctgcctttctcatctacagggtaaaagagaagcttacggaattcagccaagccttgtctcttggctgacctgaaatgtccagagattatgcttgtgcagcctcagagcagccctgaggcttgtgggtcagggcgggctgcacccacaatcttttctctggctggcatgcaggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggatgggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggcgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacgatttggatcaaaaggagaaatgataagtgacaaaagcagcacaaggaatttccctgtgtggatgctgagctgtgatggcgggcactgggtacccaagtgaaggttcccaaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggctagaggggtaaacttttttggcttttttctggggaaaataatgtgggggtgtggaaatagaaacatacgcaagcatacatatttttactacttattttattattatcctgtataaatctgaagactccggcgtaagaacataaaaatgaattatttaacttggcttacttataaaatgattgttctgtataaaagtttaacatatgtgcataccataattaaaatgtagtccgggcgaggtggctcaggcctgtaatcccagcactttgggaggccaaggctggcggatcacaaggtcagaagatcgagaccatcctggctaacacagtgaaaccccgtctctactaaaaatacaaaaaattagccaggtgtggtgctgggcacgtgtagtctcagctacttgggaggccgtggcgggagaatcacttgaaccaggcaggcggaggttgcagtgagctgagatcgtgccactgcactccagcctgggggaaagagcgagactctgtctcaaaaaaaaaaaaaagtaggaattaattttaaatgtctaatatttcattcaaatgaaacttcacagtaactgaattttaaagaacagataattacttagcttttgacattttacaagaagcaggccaaactttgagaacatggtaaatcatcagtaatataaatcaaagcaagtaaacatattctgtcatccctctgactttaccagatttttctgcattaaggagatatagggagcacttatttttagaaaagatactgagggaaaaaaagagcttctctttccaaactcaatgaatgcagcttttgctcccaggaattttaattatgaatccatttataattagaaatacaaatttctaatttggaaagatagatttcactccagtgtattcataaatcatatgcatctccctttccttactgaaatgattcgagtgctatttgttcaagagcctgaaactgttgtaagctgtaggacagggtaaggtgaggttaagatggaatggagggcaaatttccatctcccagtcttgatttaaaaactccagggtagttctccaaacattgaattgatatgtacatataatttatatagattataaaaactaaatgtatttcaagagtgaagaaagattcaatgttagatgccctgaagagttcacatagggtacttcctttcagtaggtctgtggatcacaagtttatgggactagaagccagattttaaccttcctactccaacatttgagtttcttctttactcccttccctgaacttttgagtaaacagaactaagcatcagtttttaggcatccttgtgaccactttttttttttttttttttttctgggtcagtgaggagaggatggagtcagtctccaaagctcagggcaaaagacctaagcaagctactgctaccatctgccccctcattagtcagggccactcaacagcctctctctacctagcccagaactttgtctaattaagtcttgacattgatgacaaatctgtgggaagggccagagtggccactcccttctggagaaagaggatgtaaggagaaacatacgtatgattatccatggcttcccagctcctgactcctaacttgtgggcctcattatgccatcttccacggcagcttgttttttcctggtaggtttccctttatgtccttcagctctcctaaatctgatggtggtgatgagtgaaatattcctacacttgagaaatgtgtgaccatcccaacacttctgtttacttcctttcacaaacttctcaatgacagggatctaaaagctaatctctcctttcctcactaccttcctagaacacgtttctaaatgacatctaccggctgggcacggtggctcatgcctgttatcccagcactttgggaggctgagacaggcggatcacttgaggtcaggagttcaagaccagcctggccaaaaaagtgaaaccctgtctctactaaaaatgcaaaaattatccgggcgtggtgtagtctcagctactaaggaggccgaggcaggagaatcacttgaacccgagaggcggaggttgcagtgagtcgaggttgcgccactgcactccagcctaggcgacagagaaagactctgtctcaaaacaaaacaaaaaaaaacgaaatgacatctaccatcactgctctcctgaaatatgatcccgaaggactgtttggtcagtactttttggaaagacttagaaactaaaaaggcaggggccgggcgcggaggctcacgcctgtaatcccagcactttgggaggctgaggtgggcggatcacgaggtcaggagatcgagaccattctggctaacacggtgaaaccccgtctctactaaaaatacaaaaaattagccgggcgtggtggcgggcgcctgtagtcccatctactcgggaggctgaggcaggagatggcgtgaacccgggaggcggagcttgcagtgagcggagatcgcgccactgcactccagcctgggcaatagagcgagactccgtctcaaaaaaaaaaaaaaaaaagaaaagaaactaaaaaggcagtctttcaggattctaaattaaaaggtcttgcaggacactaacacaatatttaactcaatcccagaacctatgcaagacagcagcaaatcccaaacaaatgcacttcagtgccagcaggaggcgcatcgcacaagtaacttctgtttctgctaatccaatcctcccctgccgcccctactggttaaatgtgtttaactgttttaccaatgttggaattagccaaccccaccaccacagtaaataaataagaggaccacactttatcgaatataaatttgtttttattgaagcagcagtcacatgaccttatatctagcctttagattaggcctgacagagtgagccagccctaaaaaaatgatgtttctttttgcactaagagacataacatgtttacatacatcatccagtattggaaatgagcagactcaaacacaacatgtgttggttacctgggaggtacagccccactgttcgtggtgtccatatattttacagagacccccaaagaccattactaataggatgaaagttaaaagaaaatacagccacaccaaatcatgaacacagtaatcaaagacagcagcttatacacatttaaaaactgtccctttcagagttgttttctttcttttctaagcagtgtctgcaaagcttcctctacatcaaatccaaaggtttccaaggtggaagctgcacctcttggggctacacaatggaataaaatcattggaaagaacaagaagtggtattgatatcttgttctgtataacaaagattaatgtttccctaattagaggaatggaaatggtgatgtgactacatattgcagcggcaaaatagtagggtgaaggaagagggttgggtactgaaataaagaccacacacttgtgaattttaatttcatttccaggctaacctactttttatttaatgcaaattacagtaccagttaactatttccaaaccaagtcacatagaacaaaatgtatttacaagggaatggggaaagggaaaaaaaacattgagcatacttttcacaaaaaagtttatatttaaaatgaaaaaaaaatcagtcacagaggcattcaagtagtaataatgttatacagattttgcttttcctttatatcaagacagatttgcacaagtgtttgcaatagtttgtatacaacccacagtcctttatatatatatatatatatatataataaattttgttttttaggtttgtttttaagatggaagtggtcacgctaattggtatgtgtacaggcccaagtgatccatcggcaacacatttataaatgcaaattttacaggcaagcagattttcatacaactatctgtatctgcctgtagacagatatagttaaggaaaaaaaaacttaaaaattaacacaaggaagtctactttgtcaagctaaccccttatgtactggttgtcattttgcttttattgcagaggtgcaaaacggagcaacaaacttgaataaaacggcataacccttgtgaaaataatccaaaccccagggattactttcaaagcctctcaaaggtagatctcagtctgggactctactgtgcttctagttgtctcttttattttcagtggctcaggtttctaccagaaaagacagattttattgtaaagcatacctacttttccacacaggggagaaaagtgtttggctctgtgattagatgatcactaacatgaacagtaggaatcagatacaatttcagttgaaaagaaagaaaaccccccaaattcctggggatctggcattggccaaacttcctttggaagattccaaagttaaatcctttaaaaaggaaagggaaaaatagatgaaatgccagtgtcttcatatccacagggatagagaatactcctctcagaaacctttgcattggtgcagacaagatgactggttaggcatacattgttaaaacataaaccaaaaatgtgtctaaaaattaagaggacttaaaaaaaatgacacagcatgtcactggaaagaaggtgcagtcttctgccttgctggaatgaacacacgatgtttcaaaaatagtaacctttggtttggtagttttttcttctattcaagacattttatatggactactttgaggcaaaacattctatttttctttcaaaaaaggccttcgtgttgggcacacagtaagaattaaactgattttttttaaaagaaattaaaatgatatttcattgagcaagggtagagatggcgggagggaggaaatgggctaagagttcccttgttaaaacaacagtcctctattggcacggtggcactccgtgcagtaactgctagtaattgcactatagcattttagaccactgacgtatcaaaacctgatactattaagaaacttcgatttataaaaaaacaattctctgtcactctctcatttgggagggaagtagataaaagaggagagagagagagcatggaaggctcccagaatctgctgtttttaagacccatggttagggcttgtggaagagacgagcaaaatttaatctattcgatatcctccagctctagggctccctggtgctacactaagtccctgaatggactaagtatgaaatgaaaccggtctcactgctaccgaggaggaaagacattcagaaccaaaacaaaggcagggcttcaacgaaatgaaattacgaatatgatttcctcttcccactcctgagtatggtatcactgaaacttaactgtggaaggggcaaagatactgttatgagtgagttattatttcaaagggaaagggggtggacagggagacatggataaaggaaaccaattaaaatttaaaaaagaacaaattaaaaaaaaaaacacatggaagcgaaggcactccaaactatatagatacactatacattgctagagttattgttacaataatacaggccggtacctactgtacagagttaaaactatatggctttaaaaagctcgtctacattttgtctgattattaaacagaatcactgccctgaacagtaactttttgctcattaataacagttcctgggtccacatatttacatacaaaacaataaaacttaaatttaaaaacacagaaagaaaatataatgtacaagcttgaatttggtgaggagctttttattattattatatacaaaaagatattcagagacctggatctcacttgtataaaagagttctgtgatcccaccatgatccttgagaaagaaaaatcacacatctcagcacacacacacacacacacacacgcacacatgcacacacaatgaaatgagagaaaagcgtgacttttctctcttcttttaccccagttgtggggggcaacctgtttcctaaaataagcactgatttttatggactctggggagtataccacgtccagagcagtgtctgcatccaaacgcttgctgggcagttggatctgaatgcaggtccatttctctatcacagacctgccttttcagattctttataaattctgtctgaaaatggtctatcaacgccactacctttaaggagttatgctgccaaatactttgatttcagacttctttcaaatcttagctttcagaagcactttataaaacataaaattcaatttgtttgatttggtttgactgagcatgtttcctttctcataaactctgatatatccagaggtttgtgaaaccccttttgtggcccaagacctcagctaaacagcgagtgaaaaccaagatggctcacagttgtctttctgggtactggttcacttcagcaggcaggacaactctcttggagagtcacacacacagttaaggagcaggacagggtgctagggcctgcaggagggctgccaacagactccacttccgaaccctctggaggacgagacccataaagtgacctaaggtggcaatgaggagggtgagggcaagttacacacaaccatgggctcagctctgcagccctacagttaccagctaaccttggaaggcatgtggggaaggagcgggtaggagggaaaggcggccatcactcaagtgatctttaaatgtaaagtacaactgattgtgccttaaagattcataggtcaagtaatggcccataagcaccaaggtgactaaagttcattttagagtatataaggcccacatagatgccaaccttaaaagtataaaacaaactagtcatgaaaatctatttcctcacggcaaacatagtccttcaattctccttgctttccaaggaatattgctttttcttcaaaaagagagactgattcttaacatcgttcactgatacacaaagaaaacagacacaaaaactcttaactgggtgtgggggaaacattcttctcatgcttcaaccagtcaattttgatactgtagacaaaaaaaaaggcagtattgaatatatgtatatataacatatatacacacatttatatcatcagctttcctataaagtcagcaggtataagtgactgtatcattctgatgtgtagtttttaatatttctaccatctgacatgcatcaataaataaatgtaaaaagcatgaggttaaaaaacaaattaaatacagattctagatttggatttaaaattagaactatgtgtagaatgtggctatttctgcaagctcaattttcaattaaaaaatatgaaaaataaaccagtagatgactgttacagttcacattatttaactacaatgtcctctcaagtgtatctttccaagggaagtaactttagaaaaaaatctggacaaacttattcacagtggtgagatgtatccctgacctgtccccttcctctgggctcatcagcctttgacctcagcagctagctcagcctgctcaacaccccttccatctcctcccaggtcactagtttgaaactgtgctaagatttgcaaagaactttggtcaggcaaacaaagagccacctgtagagcatgtgtgcctgagtcttgcttgctgcttcccctctggcagcctcctgtacaagcctctacatcactagcactaactgagagcaaaacaaaaccttaacaaatctactaagaatcttccctgtagagttccaaactttattgacctccctgggttacgaatgatacacatttctttgtctgccacacctgccaccaacatgccaaaggcaagtctataaatacccgaagatatggattaattttacaagtgacatttaagtccccgttgagttatacctgctaagctcccaaccaatttcaagctgtgcactataccaaagtctcacactagactttaaaagaaaacaaagttcaaaaaaacccatcagcacagaaaaaggttttcttcttttgtggaaggggcatgaggcaggagtcctgtttttaaagtatacaacagcagacttttaataaaaaaagattgtcgtgggagagagattgtatgttctagtgctccgctttccccctccccacaacccctcccaccccctggatctccctcaaagtgagaatacaatgaaattggtttgtatttatagatattttacaaggttaaataagaacaacaataataataaaaaaattgaacactaaaatgaacaggatttttttctctttttaatattctttccaaacgtgaccagtgttgctgagtgacactcaagtaactggtggtttttcctgtgcagctggctgctcgggactgttcaggtggagttggaagctgatgcagaagcagcattattggtctgtccacggtctccagtattagcatctgcaagtcaaaaagtcccaagagagagcatgagcaatgctataacaacaaaagagaacaagtacactgtttcaactgcaggctgtgaactgtatggccttccaagctgttatttggaacgttgttttaaataaggccaacactatgaaatctgaatttctctattcttggatttaagttcatgcctcagcatggtcctggtaccgggaagacagtgtctttgaataagttgcagactcagggagccagagaccatttcagtcaaagctcttgctacagctgggatcagctgtatatgaacactcagctggagtctagttcacttgaaaataaatgaacagtgcacagctgggaaaacttgctaaaaatttgaaccatgttacaatatgccatctgcttaagtaagtaaataggtggaggcaatgaaagtaacgtgggtcagtgttgatgggcagaacagaccctcttcattattcatagagatggaagacagacaaccagcaaaaaagaaacagcaactgcagtaccaattcacttagtcaatttaataaagcatcttgtatcaacagatgaatggataaaagaaaatgtggtatatatacacaatggggtaatatgtagccataagagagaaagatgggaggctaagtgggaggactgcttgagccagagaggttgaggctgcaagtgagccaagaccacctgggagacacagtaagataccgtctttaaaaaaaaaaaaaaaaaaaaaaaagagagagagagagaagaaagaaaagagaaaagaaaaagaaaaagaatgagatcctgccatttgcaacaacatggatggaactgaagtcattatgtgaagtgaaataagccagacagagaaagacaaactttgcatgttctcacttatttgtaggagctaaaatttaaaacaactgaactcacggagttagagagaaggattgttaccagaggttgggaagggtagcgggggtgggggaagtggggatggttaatgggtacaaaaaaaaaaatgtataagacctagtatttgctagcaaaacagggtgactacagtacaaaaataatttaattgtacattttaaaataacaaagtatgactggattgtttgtaacataaaggataaatgcttgaggtgatgaatatcccatttaccctgatatgattattacacattccatgtctatatcaaaatatctcaggtaacccataaatatatacacctactatgtccccacaaaaattaaaaattaagaaaaggaaagcatcttgtagtcaaatcttgacgtagaacttacttagagcttactttgccctaatcttttagaaatacgtacaactctacaactaaccattatctcctccccccttttaaggtctattattatttcacagcatccattaacatttaagtgggcatctaactgtgtccaaattggtttagtagactgctgttttagtggctatcaagttgcatccttgtcatctctcttaatgacagagaaggtactgctggccaaattttctcccaaagatttcacactaagccctgagcaagagaggtagcttgactgggatgggcaactttgaaaagccatctctctagaagccacaatg

SEQ ID NO: 453 - DNA, 177582 bp, Homo sapiens
attggcttgtcttttcattctcttgacattgtcttttgcagagcagaagttttcaattttaatgaagtccagcttatcaattctttctttcatggattgtgcctttggtatttgtatcttctggaatttctcctatattatcttctaggagttttatacttttgcattttacacttcggtttattaatgttgaattaatttttgtgaagggcatagggtctatgtctagattcattttttgcatgtgatggccagttccagtgccagttgaaaattctttgctccattgaattgcctttgttcctttttcaaagaccagttgactatatttacacaggtctatttatgggctttctattctgttccattgactatttgtctattgctaataccacactatttttattactgtaacttcatggtaagtcctgaattcaggtagtgtcagtcttccaactttgctgttctccttcaatattgtgttgtctattttgggtcttttccctctccatataaactttagaattggttcgttgatatccacaacataacatttctgggattttgattgggattgcattgaatccatagttcaaattgggaagaactgctatcttgacaatactgagtcttcctatccatgagcatggaatatctttccattaatttagttcttttttgatttctttcatcagagttttgtaattttaattgtaccgatcttgtacttttttgttagatttatacctaagtatgttatttttggaggtgctaatgtcaatggggttgtgtttttaatttataattccacttgtttattattggtgtatagatgagtgattaactttcatatatttactttgtatcctgcaaccttactgtaagtgatttttagttccaggagttcttttgtcagttctttcagattttctacatagacaatcatgccatctgtgaacaaagacaattttatttcttcctttctaatcagtatatatatatatatattttaaatcttactgcaaattagctgggaattcaagcacagtgttgaaaaggagtggtgaaaggcaacatcctggccttgttcttgatcttagtgggaaagctgcttgtttctcaccattaagtataatgctagctataggttttttggtacatatgtaatttttttaatcaagtagaggaagttctcctctactcctagtttactaagaggtttatcatagatggatgttgtatttttttttcaagtactttttctgcatctgttgataggatcatgtacttttcttccttagcctggattacattaattgttttttgaatgttgaaacttgcatgcttggggtaaacctcacttggttgtagtatataattcttttttggatttgatttgctaatattttttgaggatttttacatctgtgtttatgagggatatttgtagttttcttttcttgtgctatctttgtctggttttggtactggggttatgctggcctcatagaatgagttaggcagtatttcctctacttctgtcttctgaaagagattgagagacttggtataatttctcaacctcaagtgtttggtagaattcactagtgaacccttctgggcttggtgttctctgctttggaaggttattaattattggaaggttattaattattgattcatctattttttcttgtgtgaattttggcagatttttgtccttcaagaaatttgttcgttttgtctaggttataaactttgtgggcatggagttgttcacagtattcctgataatcctttcagtgtctctgggatctgtagtgatgtcccctctttcatttctgatattggtaatttgtgccctctctcttttttctcccttagcttggctacagccttatagattttattgaacttttaaaagaaacagcttttggcgtcattgatttttttttctattaattttctgtttttgattttattcattatcctctaatttttattattgctctacttttgcttactttgtatttaatttgctcttttactgatttcctaatgtggaagcttagatgattgattttagggctttttttattcttttctaatatatgtattcagtgctctaaatttccatctaagtgctactttcattgcatcccacacattttaataaattgggttttcgttttcatccagcccaaagtacttttattttattttttgagaaatggcctcactctgtcacccagggttgagtgcagtggcatgatcacggctcactgcagtcttgacctcccaggcttgggtgatcctcccacctcagcctcccgagtagttgcgactataggaacgtgtcactgtgcccagctaatttttgtattttttgtagaggctgtgtttcaccatgttgcccagctgatcttaaactcctgaggtcaagccatcagcccgcctctgtctcccaaagttctgggattacaggtgtgagccaccacacccagcctcaaactatttttaaatttcttttgagatgtcttctttgacccatgagttacttattaatagaagtatgttgtttaatctctgtgtattttgaaatttccagttatctttgttattgatttctaatttaattctactatggtctgagagcataccttatatgatttctcttctcttaaatttgttaaggtatgctttatggctcagaatgtggtctgtctttggtgaatgtcccatctgagcataagacaaatgaattgcctttgtgcttttataaaaaatcatttgtttttgtacatttatatgtgggtttacatctggactttctattctgttccattgatctatttgtctgcctttatgcagtaccacactgttgtgattactataataatttttggaatcagatagtgttagtcctttaactttgttctttgaatcatagatattttggttgtcttaagtccatttcatttccatgtgaattttagaatatacatgtcaatttctacataaacctgctggaatttttattgtgattacactgaatctatgtgttaatttgaggacaattgacatcttaataatacagtttcagcatcccaagcttgaaatcctaaatactccaaaatccaaaacttcttgagcaccaacatgttgctcaaatgaagtgctctttctagagcattttggatttcagatattcagatttgggatgttcaactactcagtataaagcagatattccaaaatcctaaaaaatttgaaatccaaaacatttctgatcccaagcattttggataaggaatactcaacctgtattaagtctttgaacatatccatctctccatgtatttaaatcttgaactttcctcagcaatattttgtagtagaggtttttagcattttgtcagatgatttgtctcttaaatatgtcataattttgaagctattataagtggtatttttaaaaatactaattactggttaattgctagtatgtagaaataaaattaatttttatgttgattggtatctcaggcatcagaaaacttttcctgtaatggatcaggtagtaaatattttaggctttgcgggccatatggtctctgttgcaactacttaactctccttttacagtatgaaaccagcatagacaatatgttaatgaatgagtatctatgtttcaaaacattttatttacagaaacagaaagtgggttgggtttggctgtaagtcgtagtttgccaaactctgttgttgtatcctgcaaccttgctaagcttgttagtcctagtagctttttaaaaagtaataatttattgaagtgaaactcacctaacataaatgtaaccattttaaagtgataaatttagtggcatttagtatattcacagtgttgtacagtcaccacctttgtctggttccaaaacatttccatcactccaaagtaaaaccccttacccattagcagtttccccccgtcccattcccttcttcccccagcccctgacaactagcaatctacattctgtatctataggcttatatattctatatatgtcatataaatggaatcacactatatgtgactttttgcatctggctgcttttactacgcttaatactttggagcttcactcgtgttgtagcataaatcagtacttcattcctttttatggctgaatatttcatttttatatatactatgatttgtttatctgccattccttgatggagacatttggactgttttcaccttttggttgttgtgaataatgctgctatgaacgtgtctacatgtgtttgcttgagtacctgttttcattcttgtgggtatatacctaggggtggaattgtgggatcatatggtaattctgcatttaactttcttttttctttctcgagacagggtctcaccgtcacccaggctggagtgtgatggtgtgactatggctaactgcagcctcagcctcctaggctcaagtgatgtttccacctcagcctcccaagtagctaggaaaacaggcatgtgccattatacccagttattttttaaaaaaaaaaattgttgtggagatggggtcccactgtgttgcccaggctggtcgtgaacttctggcctcaagcagtcctcctgccttggcctcccaaaatgcagagattacaggcatgagctaccacgcccagcctttttgaagtctagtagtgttttttaatttttaaagatcacatcagaatttctaaacagatgatcacgtcatctgttagtaaagagttttacttctttggtgatctggatgccttttatctctctttcttgcctgatggcattggctggagacaccagtaaaatagtgtatgaaagtggtgagagcagaccatgttttgctactgttcttaagaggaaagtatccatgaagtatgtataatgctggaagataatttttttgtgtgtgatgccctttattaggttgaggaggttccttctatttctagtttgctgatcttttttttttttttaattcagagtgtatgttagattttgtcaaatggtttgtctggcatcttaatcacatggattttttcttttccactattgtgaattgcattggttgatttgtaaatgctaagtcaaacctatattcctgagataatcctttggtcatgatgtatcttcctttaatatattattatattctatttgctaagattttggttagaacttttacatttatgttcatgagggatattagtgtgcagttttcttatattttgtctaattttgttatcagaataatgaagacctcatggaattagttgagaagtattccccccgcttcagcttttttggaagtttctgtagaattggcaaataacagaacagcctccctcagccttatgcatagctttgattaattaagaaatgcagggttggaaatttgtgtgcagttactgtgttcatactgctcttcatcatttgcctcacttctatacatttttggggacagcattaaaaaattccccttctcttagattttcatgaggacttaaaaaacagctaacgtgtattgaatgcttgctatatggtaggagttgagctaagcagctacatatatttttcagatgtagaaacagatataaagtgattatggaattttctcaaaatcacagacttagtaaataaagaagcaaggcttgaacccagatttgtttattccgaagttgtaagaccactaaggtcttaacagttattaacacttagaattcatacaagacatgagtagtcatgtatatgctgtgagtttttttacttgtcatgttggtgatctctttgtacatggttgccctctctggggatgggtagaacatatgactaattaaacattacaggggcatccattaatattaaacgagtaaggctttgtgctgctgaactccagctcatcctttaacatgtagcacaatgaagacatcttctgacaggctttccaaaaaaaatagctgcacttgttttagtgcattcaaagtgcatttagtgcatttgtacctgcttttgatacaactgaatggcaattacacatttgcttggctgcctctatttttaatacgtatttattgagatttaatttatataccatataaaatccacccattttaagtgtagcatttattaaatgtacagaattgcacaaccattactacagtctagttttagaacatttccatcacccccaaaagtaccctcatgtgcccatttgcacttaaaccctaatattatccctagccataggaaaccactgatgtgctttctttctctatatagatttgccttttttgaacgtttcatgtaagtgaaataatatatggtccttttgtgtctggattcttttacttagcatgattttgaggttcgtcactttttttttttttttttgagacgaagtctcactctgctgccacaggctggagtgctatgacacgatcttggctcactgcaactgccacctccctggttcaagcaattcttccacctcagcctcccgagtagctgggactacaggcgagcgctaccacactcagctaatatatatatatatttttgagatgaagtttcgctctttttgtccaggctggtgtgcaatgacgctatctcggctcaccacaacctctgcctcccgggttcaagcaattctcctgcttcagcctcccaagtagctgggattacaggcatgcgccacccggctaattttgtatttttagtagagacagggtttctccatgttgttcaggctggtctcaaactcccgacctcaggtgatccacccgccttgtcctcccaaagtgctgggattacaggcgtgagccaccgtgcccggccaatttttttgtatttttcatagagacagggtttcaccatgttggccagactggtatcgaactcctgacctcaagtgatccacctgccttggccttccaaagtgctggaattacagatatgaaccaccgtgcccagccacattttgtgtgccacattttgtttatctgtacattggttgatggatatttgaattgtttccactttttgactattaagaataatgctgctaagaatatttgcatgcaagtcatttgtgtggacacgttttcatctcttctgagtagatacataggagtagaattgcttagtcatttgcctttcatctttaattccttgagggcaggaacctctccttggagtcttagtattgccttagtggtctttgaattgcttcatctagcatgcttgccacatagtaggtcttgaaattgatcaggtggtgtttgtgacatattctcctgttttgtgagcctttgcttgcttttatgcacactgtccccctttcttgccatattgaaagagtttcatttttatcttgattctttgcaatcctagtgaacaactgtagaggttttggatgacctagatttttatttctagcaaaaccccatgtatatactcagtacttttaagacaatgcaactttaacaaaaatagaaaaacgtgtgccttatttacattatatacacattattaccctattgaatatttttggtgagggtacataaggtgaacagaatataaattgtctcttactcaagtgggtagagtgaagaaagtcttttgagtgtctgatatggtctgcacaaactcttttgttctgagacttacatgtttgtaaccaagtgaagtaaaaatacttccctaacaaagtactgccccattttaactaggaaacaggaagcctaaataagagggaggatggggttatttcaccagaaagaaagtgctatgaagttaccaatactgttaagaacgacttaagttaaaagagattagttgaaattctaaaaaaaaaaaaaaaaaaaaaaaatcaccttatgtaaaagcctcagtattttcaactttttttctacacccaaagtctggctctttacctgcaaaactaggagcaaattttaacttgcactatagttctcatttataaacaactttcttccttggtttgactgtaccctatatgctccatatcacttgaagaaatgtttgatttttctgtgggcattagtgagacaggctccctgttgtatattagacaaaccaaagggcattctgtaatctgtgggcaactagtattttccaccatcaaccaccccagggtacaggacacgtttttaagagaaggaaatacaatagtgcccgccttatctgcggtttcactttccgtggtctcagttaccctcagtatagtacgattttttgagagctcacattcacataacttttattacagtatattgttgtaattgagttattgttaatctcttgctgcatctaatttgtaaattaactttatcataggtatgtaatataggaaaaaacatgcagttcagtactatctatgtttcaggcatccattgggagtcttggaacatatcctccgtagataagcggggactaatgtatcattgttaaatttctaagtcaaaattgatacggtagcaaaagggattagattaaatgaggacatgtcaaaaggccagacacataatgatcaatatgggttcattcgccctagttagctcatattagtaatttctcaatagtggtttttaaaactatggattctggagctagctttgtgactgtaggcaagttactcaattctttaagccacagtttcctgatataaatgcaatgaggataatagcactgctttacagtagtactttagaggggtactatgattaaatgaaataatatattgaattatcattgtgcgtggcacatagtaagtgctcagtaaagcattagtttaatttaaaacagaaaaacataaccagttccctgagaggctcataggccagagacatgctctttgacatctgatagatgaatggcctcattagaggctttccattcaaatttcaataacatgggagctaggggctatgaatcagtgcttaaattctgagcctgtttactttcttacagagtttacttccttataaaatggaaacgagaataatctgcctcattattttcatgtcattaattcattcagtgaggcttgttaaaaatgtatgtgaaggtgttctacagaaatgtaaggttactacttaaagtgaatggtacagccataatgtgtatacacattgatgccgtatctggtatctctgcattatacctgaagacactgggaaaggtttgttatacacttttccaatcacatactctgattgagggtagcaatagtatttttcttattcacattgtatcttcaatattatatagtaggcaggtagcaaatacttggtgcacatgatgatggataaggcaaatttggcttttaaatcacaatgctttttttcttagtgatggagatctcttgtggaaaaaaaggtactcagagaagtttgttaggtcatccagttcctggatatggcctgaacatcaaatgttttggaaaataccgaatggattgtatagaatagctgacttccactaccctgcccgacctttctattctatgtgcaatactgctatgatatttatattaaatgtttattccttttcttgaagagttgattttaaaataagctaagaattttgactagataacattagcttacataaaatgtcatcttttgtgataaagacatacatttgaagcagcctcaggagtgaatttctccttcccttagtaccctttgcagtaattggcacacaaccatttgaggcatggatgggataatcttcaggtctttggcaccagggttaagcttattttgaatctatgccatattagcaggcgaacattgccacactgacatttaaatgcccaccatattatcttaaggttcctgaagcaggggtaactctactttcagtaaacaaaaatcagattggacaatcggaactgtacaagttctacaaaagcatgttggagtcacataatgaaaaagcagatttttttattatgatgtttctccatatttggcattgctgtaaatggctaacatttactgccaattcggtacaaatgtgtggtttggtaataccagaacagcaaatttaaatgaaaaaataaaagttaaacatttccacacaaggttttacagtctgacatttcactgcgtaggtaaaaagacactttttttttaactacagattattattcagcatgaataaaaaactacaacttttatttttaaacaggagtcactggttttaatttttacacattttaaaattactgtgataaaaaataatgaaaaagcttcttaataatgccatacacagtataatatagatttgtccccattatatagcatttaatatacaaaatagaatattgacacacttgaatctatatgtagttaagcaagttatttgaggagggtattttcatacagcctttcatcagaaaataaaatcctttcagacattttctagagagaagcaaatcctttcctgaaaacctggtcactaatcctgggtggaccaggttgcttgaaaatagtctgggaaattacgaaactccacccaaagggtttaaagtgtcctccttacacttttatttcccttctgacactaaaaccagacacacacacacaaaaacacattcacctacagctacagtcagggagtgaccagccaagatggaaatctcactgaaggctaccatggttctggaagtttgacagatcaatgtattgtataacaatatttttcattccatggtgatgtagttttcagggtttttaaaagggaactaaaattatgagacttaggtgaaactggaattgctccctgcctctgaattctgaagggagcgtggctttccttcatggcatgcccagagctcatcccatgctaattatccagcacttcatagacacaaatcatgttagttttccttttggggtggccaaggtttcctcccatagttttaggcatttggatatatataccccaaaagtgttatgtcctaagtgcctcagttctgcttgtatagtatcccacagaatacctacaaacactaaaaatacttttcaggatttgttgtgagtaaccaactctcactgaagttactacaaacttcaacagtttgggttgggatggccagataacacatacataggaaataaatctgctttcaaacagcaccaccatatagcacttaaatccacaattaaacataattaagatgactttcttttcccccacgtatcctaaaagggcacagcttcttttcccatttaatgaaaagcctcctatagttgtcgatgagcatcagttgacttattattgacaacgaagtgcacataatcttctttttctcattgagttctattttttgagcgccaagattgttgggatgaaaatcagattaatgtgtgagatgtgctttctggttttaaccacataacattctataaaggaatgataatctacgttttagaagctctttttgaaacttaacactgtcattgataagaatattcaagcagttttcttaggcaccaaaaatttatccagccgggttacacaccatcttaaaatattacattcccttttagagagcattcaaaaagcaaatgattgtttttttattaaataatttctccaaaatactgaaaataacaaataacattcaaaaagcattcaaagaaaacaaaaacatgtcctcattttatttggaaataaactcttgttgtaggatagaaaggaattagtgtattattggcaacctatgagattctgcactatttacatattgctggtacctctatgcaaactattgccaaacttctgaagcttctgttgtcattcaactgctgggggagggctgtatgtgaaagtaacccgctattagatggtgcctttaaggatgtaagcaccaccttcctgtctcctgtttacatactttacatactttagtgcaaggggagattgagtaaactaaacctgcgctgacagactcactgttggaatgagaagggtggtcagaatgggaggcagaggataacttcctctgtaatctcactgggtcagagcctcagcaaccttcactgcacacaggaccagtctccatctccctcttcccctagagcaaactgtttggtttctgagaccatcgctgcctgtatgaatgcatgtacaaactataaatcatataggttatccatcagcatttctttgacccctacaaaaaatatataacatgtcatgataaaacaatctcatctaaaaatcattcttattttacactatacaagctattttacaatcattttaataaattgcatgtaaagctgcagtagcccttcccttcccagattagtgaataccaatatgatatatatctgaaactataactaaatataaaaatatattagaagttccatatttttaatattagattttcagttttctattacacaaataatttggccaccttgaatagaaatcaaatttcttgtggcttagtaaatatgttaagttttgagtttacagaaagttggtaaggtgcacacagaaagggctactacagcttctattttgtttaaaataattttcaacagtgaagaaattcacaggacttgtgttaaactctatggcacacattagggatgtgtagttttacaaacatggatgtctgacatacagttctaaatcacaaaaatcagtagctgagctttcctgtaccatcaggaaagattaaccaattggtgacagatgggaatgtgaaaatgggtgtctagccatttttgccatattagagatttagtttttgggtaaagtttagtgagaggaattactttgtctgattaaaagtctctcagctgtgttacagctggttatctggaatcacaacttttaagaagttatacaaactacttcaaaaggtcctgaaagacaaatagtttaccagctttcttgccatatagccattgcaaaaatagggcgttaggtacagacagggcctcttggtagttattttttaaattagtcttttgcaaccatcatccacagtttacccagcaggtcactggactaggtgctctataccagttaggactgttaatttgcacaacctatataattctccactgaagcagatatatacaaaatatgagcttttttttttttttttttgacaagaatactggagatttgagtcaatttttgtggtcttctgatagctaagtgccatcaggttagaagcaccaacccattttcacacagatgattgattaatgtttagagtttatttgggaaagctacgaactagctgcccatcttaaacagctgtacaataacttgaataaaaaattatgtaagaaaaaatgagcaagcgtagttcactaaatataaaggaaattgttaaaaccagacagtaatagctataaaaggcacaacttcccttttctgatatacacttgtaaactttttttcaggtttccatgcataaatcaaaaatgctatcctaactatacaggggggggatacaccaacagaaagtctagaaaatttcatccagccaactgtgaaaaaaagtatgaagagaaagttcatcacacagactttgggcactggtggtttaggtgccatccttctttgactgtggagattacgtccacatattaaggtttctaatttctgggatatattaactaataaatttcaccatctactctcccatcactgaaaagtgatgacgactcaactgcttctgttgccaagtcttggccctctataaaccacatgtagtgcgtatttaaaacaaaacaacagatgaaaacaataaaaaataaaacaacaaaacctctacaggacaaactgatagtttatacaataaaagctattaattcgactttctttaaggcaaccattcttattaaggcagtcacttttgatgaaacagaagttttttgatatttccatttgaatattttggtatctgattggtgatgatttcagctaacatctcggggaattcaatactcatggtcttatccaaaaatgtttggaagcaatagttaaggagattttcaaccacctgcaagagaagatatggtaatgatcaggcttccaaattggtcagtgggaacatctcatgtttgttgtcctctattttgaaaaaattatctggcctagaatataccaatctcactggaattccccagatgaaaaataagcacttccgtacaaaacacattttatatttctttgattgtatgtagaattatatagaattatttcatgaatcactgtagtaccataatatatgaagggtgcattattctaatttaatggattaatcatactttttaaaaacagtattactaaattctgtaataacatggtgattttatatacacatgactaggtgaaaggatatttcataattggccttaggaaaaatgtctacaaaactgaagttcataagttgaactcaagctatcaccaacatccacaaactgggggcgggggtgggggcgctgctggtatataattatattcactaatcaaaacatactttgtcccagaaaactcttatatttggctttatgtttgacacttacttcatgcatagaatccaagagttttgtcagttgataaaaccgctgccagttctggctggagtttccttccctcttgacaatggcttttcctagctctttgatgtaggtcattctaatttcatcaaatagctcttggctcttcagaccgtccttaggaactaaaaggttaagatgaagtcagttaaaggattttctttttcttttcttttcttttttttttttttttgagatagatagggtctcactgtgtcatccaggctggagtgcagtggcataatcatagctcactggagccttgacctccttggctcaagtgatcctcccacctcagcctcctgagtagctaggactgtaggcacaagccaccatgtctgagtggcataatcatagctcactggagccttgacctccttggctcaagtgatcctcccacctcagcctcctgagtagctaggacacaagccactgtgtctggctaaatttttttgtagagacaggatctccctatgttgcccaggctggtcttaaactcctgggctcaagcaatcctcctgcctcggcctcccaaagtgccaggattacaggtgtgagccaccattcccagccagatttcttgctataactttttatacatgcaagatgggcatttaacattgtttatgtactcttactgcactctaaaatataagcattttcttaggattattaattaaactacagccaagagaaaatgcaggataacaaagaattggaggacttaaccttgagtaaatcacttgatttctcatctataaaatggaagtggtgatgatacaccttctcctccttagctcacaaagctatttggaggaccaaatgaaataatacagtgatttttagttaactttgtctgccattctgcacttgagtttaattctagtactgagatagatagaaggcttcaacaacagtgtttattccagcaattatatcttggaatatctgtgatatcaccagttaattataactttaaaatcggcatgcaatactttttttaatgtagctaatagatatgtcttagtagggagcaaatatctgtccttccttatgtacatggattctggttagtgaaactagtataaaagttttggggggatacattactcttcagaaaatggtactaataaggacaaggaacagagggttaatcatggtttcacttaatcctgtggagattaggacttttgtagagtgctacatttttcacagtgtgctcctgggaacactgattctgtgttaactatagttagagcgagacaaaggatttggtggtcaaagtttgagaaaagctaaatgtttaatacatattaggcagacttctgaatttcagtacttcttggagatataactgtgcactctccagagaggggaaatgcattatttcccaaactgaaacttcactgctgctgacatttttagaagatgctggtatagaggaaaagctatggatttaggagcttctagaagtcttattattattatttttttcccgagacagagtcttgctgtgttgcctaggctggagtgcattggcatgatctcagctcactgccacttccgcctcccaggttcaagcaattccgctcaccttggcctcccaaagtgctgggatttcaggcagtaagtcaccatgcccagccgagtagtcttatttcttacttgccatgtggacttgaatataacctccttgagcatctttcctgctctttttcattggattatgattagaattagactaatgaatatgtatgaaaatgtttgattccataaagcattacaagacatcagtattaacatgaaaatgaagaccgcttaatcaggagtgataacggcattctatattaacaatgggttaattttacacattactatactacagaaaatctaattattgcaaaattgtaaaacagcgatggcttatagtttttttccctgccgtatagtttttttccctgccggttagtcctaattctaaaaataactatggtgaagcccaattcaatatgcatataaaagaatttcatccatcttaaatttttttttaatgttttaatattgaaatcactaacattacttcctcttttggctgcaggaagtaagtacagcctggaattcccctcctactggaaaactggacaacaagcaatacatgattatgatccctaggaaaagagaaacaaatacggtaagccatacctagcccaggagtaagaaatcttaattctaaacctttgtgcttgaaagtaattatcatactgcagtgaagggaaagggaacccagggtctagcaatcttgctgggttgaggagaaagagattgaagtttggggaggctaaagcagctttaatttatgggtcagactactggaaacgaaggaggtacacaaagaaaggcctccagaaatctgtacaatttatgggtcagactactggaaacgaaggaggtacacaaagaaaggcctccagaaatctgtacaatttatgggtcagactactggaaacgaaggaggtacacaaagaaaggcctccagaaatctgtacagtcttcggctgaataaaaatttgtgcatacttagggtgaaatcccttgaggccatagaggaaagaaagatctaattaaatatgccgggcattcagtagagacctaggggccacatctcagaagcaaggctaaattagtcccagaaaaaaggctacatagatcagtggttctcaaaagggagggggagattttgcctccaaggggatatttggcaatgtcagagatatagcagacaaatctaacattataaacacctttgtctcagaatcaataagaataaacaagacttaaatttgactgacatttctgaaacagtctacccaagaacttgcattcttttcaagtatacacagaacattaatctagaacataaaacaagtctgaatacatttaggaggattaagtcatacaatgaatgctgtctgacaaaaatgagattaaaatagaagtcagtaacaaacatatctggagaaaaacccaaatgtttagaatttgacatttaataagctatagattaaataaggcatcatgattaaataaggtatcataaaattaaaaatctctagtactgaaaacacagcatatcaaaatgtgtgggatgcaatgaagacagtgcttagaaaatttacagcattaaaagctttgattagaaaagaaaggtctcaattaattatatatgcttctaccctaaacacaagaaaaatggaaaggataaagagtagaaacgaataactaagaacatgcataaacaacaacaaaatcaagaccaagctggttctatgaaaacattggtaaaactgaaaaacttttagccagactgattaaaaaaaaaaaaaaaaagcaagaatatattaaataccaatgtcgggaatgaaagggaataacactagagatactggagccattagaaggatattatgggaatattatgaataacttaactttataccaataaattcaacatttgaaggaaacagttaaattccttcaaagatgtaaaccaacaaagctcactcaagaataaacatattatcagtaaacatttgatgaacttgtacttgaaaacctttctacaaaaaaggctccaaacaaaccaagacagcttcactgctgagttttaccaaacgtttaagaaagaaataataccatattatcataacaccaaagctatagaatatatccctcatggatttagatgcaaaaataccaaaattttagtacaatgaattcagctatatgtaaaaaggatactatatcataaccaaataggatttatccccggaatgaaaggctagtcaattactcagaaattaaacagtatattataccattataccatattagtgactaaaaacgaaaaatatatgatcttgaggcacaaaagcatatgataaaagttttttttgctattatgaataatgctgctatgaacatgggcagtcattaaatgcatggcaagtcacaagggtcaactacatactctctaggatagcgataataaaaaaaccataccaagctctggcaaggatgtagacaaagttgtaggatctagaacaactagacagaaaatcagcaaagatacagaaaacttgaattagtctatcaatcaacttgacctaactgacgttcataaaactctacttaacaagagcacagtaagttttttttcaagcactcatggaacactcaggatagaccatatgcaagtgcctaaaaaagtctcagaagacttattggagtcattcaatattagagtccttcaatgtacctcctacctcagtggaattaaattagaaatgaataggaagagatatggaaaatccccaaatatataaaaattaagcaatacacatgggtcaatgaaaaaaatcatgaaggacattagaaaatgaaatgaatgaaaatatacaaaaaatgtatagctttaaacatctatataagaaaataaggtcttcaactaacaatggaagcttctaccttaaactagaaaaagaggaacaaattaaatgaaaagcaagcagaaaagaagaaataataatcaatgacataggaaacaaaaagagaaaatcaatgaaactaaaaatttcaatgaaactaaaaattggttctttgtaaagaccaacaaaattgataaatttttaactagactgaccatgaaaaaaagatgatcaggcacaaattatgaaaatctataatggaggggacacctctatggatcctacaaaacttaaaggattacaaacaactttatgcccaagttagacaactcagacaaaatggctcatttcatagaaacacacaaattacaaaactatgtcaaggaaaaatataaattctgaatagatctatataacaaataagcaaataattaaaaatcttccctgaaagaaaacacagacccagatggcttcactggtaacatgtatcaaatatttaaagaataaataagatcaatactctataaactctttaagaaaacagaaaatacttctcaactcattttaagaggctagtactaccctggtagcaaagccagaaaaagatatcacaagaaaagaaagttgtagatcagcatccttcataaagagagatataaaaatgatcagcaaaatattagcaaaccaaattcaaaatatatatggaaaagattatataccatgatctagtcagaaaactagatcttaaaccatttcaagccattttcctgattttgcaaataaatttgtattagaacacaagcattcacatactgtatatagctgctttcctgttatagctgtagaattgagaaattgcaacagggactatatggcctacaaagacaaatatgtactgtgagtctctttacagaagactatttgtggaactatactctgctcagtagtattttagtagtatttttggaaagaggatttgatggtctccccactcctccaaagctggaattcctattctttctcaacaactggaatttttttttttttttttggagacggagcctcactctgttgcccaggctggagtacagtggcacaatctcggcttactgcaacctctgcctcccagattcaagcgattctcctgcctcagcctcctgagtagctgggactacaggcatgtgccaccacgcctggctaatttttttgtatttttagtagagacagggtttcaccatgttggtcaggctggtctcgaactcctgacttgatgatctgcccacctcggcctcccaacgtgctggaattacaggcgtgagccatagcgcccggccagaaattggaaatttaagatgttaattattttcaaatggatctatagattcaaggctatcctaataaaaattctatcagactgtgtttttgagacagagtctcactctgttgcccaggctagagtgcactggcatgatcatggctcactgcagccttgacctccctcctcagcctcctgggtagctgggactacaggcacaagctaccatgcctggctaattttttctattttgtgtagtgacagggtttcgacattttgcccaggctggtctcaaactcctgggcttaagcgatctgcctgccttggcctctcaaagtggtggaattacaggcatgaactaccacacccagccccaaaagactttttggtagagattgtcaagctaattaaaaaatacgtggaagaccaggcacagtggctcatgcctgtaatcccagcactttgggaggccgaggtgggtggatcacctgaggtcagggtttgagaccagcctggccaacatggcgaaaccccgtctctactaaaaatacaaaaattagccaagcatgatggtgggtgcctgcaatcccactgctggggaggctgaggctgcgatgagccaagatcatgccactgcactccagcctgggcaacaatagtgagactccatctcaaaaaaaaaaaaaaaaaaggaagtggaaatgcaaggaaactagaatatccaaaacaacagtttggaaaagaacaacagatttggagaattcatattaccaaatttcaagatttactgtaatgcaacagtaatcaagacagggtgttatcaatatgaatataggcatacagatcattgggtaagaaatacagatcgttgggtaagaaaaagagtctgaaagtagacccacacatatacaaacaactgattttctacaaaattgccaagtaactcaatagggaaaagagagtcaagttctggagcaaccagatatggattttggggaagaaaatgaaccttgtcccttaccttgcatcatatacttaagcatgtgagctgaaactacagaatttctataagaaaacaaatagtagaaaatctttttaaccctggattaagcaaaactttcttagtaaacaaagacacgaagctttcttcaaaattatacacttttgctcatctctacatttttttaagaaaactgtaaatgtaatccacttaaagaaaacatgcaaaacatatatttaacaaagggccacattgagaatatttgaacaattcttaaaacccagttaaaaaatgggcaaaagattaaaagaggcacaataccaaataagaaatataggtggccaataagcccatgaaaagatgcttaatatttttaatcatcagtatacctacgatgaaagaggctgacagtaccaagtactgaggaggatatagaatggatcttaagaagtctcatacatttctggtaaatgttaacaattgcggaaaagtttggcaattttaaaaataaatttaaacacacactcaacctatgtcccagtgatctcacacctcagtattgacccaagagagatgaaatgtacatccatatccttatttttttgtctgcttaatttgtaagaaaggtatagtaaaatctcattatttttactagatttatctaagtattcttgttctatgaatttttgtattatgtaatttgaaactatatatttacaattatttttcctgaacaaatgctttaaggagtattttgccttaacatctattttgcttggtaataatgtagctccttcggttttgttttggtcaatataggggccagcaaactttggcctatgggccaaatcctacttgcagcctgtatttgtaaataaagttttattggaacacagccatgcctgttctatttgagtaccgtcaatgactatgttcctgccacaagggcagagtttagtagctgtgacagagactgtgcaaagctaacaacatttaccatctggccctttacagaaaaagttggccatgtcttgggttatactatgcaaagtagatccttttacttcagcctttcaatatctttattcagatatagctttttttaaatagcataaatttggattatttctaaaatcctgtcagattagcttggagcattcagtccatctctacatttattttatttttgagacagtgtccctctgtcacccagtttggagaagagtggcacgatcttggctcactgcaacctccatctcccaggttcaaatgattcttgtgcctcagcctcccgagtagctaggataacaggcatgcaccaccacacccggctttttatagttttagtagagtcggggtttcgccatgttggtcaggctggtctcgaactcctgacctcaagtgatctgcccacagcctcccaaagtgctgggattataggtgtgagccactacacctggccccatctctatatttaatgaaactaaactactgatgtgtttgaatttagctgtactaatgtaccttatctgttacttcctgttatcatgcccttgtttatgcatttttttctccctcctctcatgtctttcattcttttggattgtttttcttaggtattctcttcccccaatggtttggtactttgcataccctgcataccctatttctagttgtcatccttgaaacttactttagttctactttttagccctcaaggaaattgttactgttgttattttatatacatagtaaatgtcagtttaaatgtatctatattatttaccacttttgttattcttcagtccttcttaaagatgggattacttttattattttttttctaagatggagtctccctctgtcactaggctggagtgcagtggtgctatcttggctctctgcaacctctacgtcccaggttcaagtgattctcctgcctcagcctcctgagtagctgggactacaggcgcgcaccaccacccccagctaagttttgtatttctagtagagatggggttttaccacgtaagccaggatggtcttgatctcttgactctgtgatctgcctgcctcagcctcccaaagtgttgggattaccggtgtgagccaccacgcctggctgggatatatcctctaataattttttagtgagcatctggtggcaaactttattttcacctcctagttaaaaaaatagctgattggtgtacttagagcattcaaatttaaagtaattactgatacagctggattaatgtctactatgtttatattgcatttgagtttgggggaatttcctttgacctatctatcttcaagctcactgactctttgcttggctgtgctcagtctactgatgagcccatcaacatcattctgcatttccttacagcattccttagcatttatttttagagtttccatctctctgcgtacatcacttcttgcatgttgtctacttttttccattggagcctttaacctactaatcataggtattgtaaattccctatctgataattgaaatatttgtgtcatatctgaggactgcttctgatgcttgttttgtctcttcagaccgtgggtttttcttgccttttagcatgccttgtagtttttttgctgaaagctggacatgattgatatatcaaaactgaagtaattagacttttagtgtgaggtttcatgctaatctggctaggagctgggctgtatttaatgtttgccataattgtaggtactggaggcttcagtttcctctagtttccttgtttttatttactttttcttctgttgtttttgggtttcctaagagctccttaaacagcttgtgtcttgcagctctctcagttgtaatccactgttattttatcctggagccctgtttatatggtggtaaggtgttggggagggggaggggaattgttttttaatctttatgattaaatctcagttttttttagtgggtctgaatccctgggctgtgactttcagaaatgagacaagaaggctaaggaagggctagaatcctctatttgcctttcccccaggtcacataagggcctgttgaattagttttccttacagggcaggccttttgttgtgaacactctgctacgtatttccaaattttaccttccctctactcctaccagaaaaaggagggaatttttcttgcatcttcaccataagaaccttgtggagtttctggaagttagaaattttgtggggtaaacccaagaaattgcaggaaacccccactaagactgggtccctgggagtttttaactctgaagctagtcctcactcagcctccagcaattcatcaaaattgccatagtcttcctggcttcagtggcatcttttcccaaattgccatagtcttcctggcttcagtggcatcttttcccagtaagctgatcttggctgtttctctgtatttgtctattcttctagattttgaagtggtggtttgtcctatgacctccattctctgagggatctaagaaaagtcattgcttttccagtttctatagctttgttgccattttcctgttgtgattttcagtacctacagatttcccttgtggtttatatacacaaacatatacacaatcattaaaaacaattgtattcttctgcttttagatccatccactgccttttcaactgcatttatatttccatcccttgtttttaaacttactaaatatacagaaccagtccaaatgcccatcaatcaacgagtggataaagaaaatgtggtatatatataccatggaatactactcagccacaaaaaggaacaaaataatggcatttgcagcaacctggatggaactggaaaccattattgtaagtgaagtaacccaggaatgggaaaccaaatattgcatgttctcacttctaagtgggagctaaactatgaagatgcaaaggcatgagaatgatattatggactttgtggactagggttggggaggggatgagggatgaaagactacacattgggtacagtgtacactgctcgggtgatgggtgcaccaaaatcccagaaatcaccactaaagaacttattcatgtaacctaccactacctgttccccaaaaacctattgaaatcattttaaaaaagattataaacttaaaaaaaccccaacttactaaacttactaatttaccaggttctacaaatgccgtcaaagagcaagttggcttgagttccacttatctctgtaggttcctgccttcacttagttcttaatttttttagtctagcatttttggtgggaggttatatacctattccagtagtctatcatagtagaagtctatatcttaaggtatatatttccatccttatgattctattattttttaacaagaagaactcgtgatattatttacaatgaaaaaaatcatatagctcaattagtctgggatgtatacaattgaaaccattcttttttttttttttttaaacaagtaaagttgttagtatccaggcactgaattataccttcatggtatcaatcaaagctatgatcagaattttatgtaactgcttaatcacttctttaacaagtgtaccgctacaggtaacattaaacgtctctagcaatgatctttatcgggttctcttgccttgactgaaatattattaatacttcttatatccattaacataaaataactttttgttgagcaaaaatagtgtgaaaacattaagatgaatgtgcgctttggaaatgtttaaatagatatgaaatgattaaataaaatcacagtcttgtgcaacatccatagcttacagttatttggcaactatgaaaccacagttactaatggaattaagactttttaaaaaattgcaaatgtacttatttgtatatgaaagaggtattcagctattaactcagtatttaataaacattgatatgtaatttttacttgaaatggcctaaggtttataataccaactagttcatagagctttttttaaaaaagactttttttagagcagttttaagttcacagcaaaattgggaggaaggtacagagatttttcatatacctcctgtcccacacatcatcacccaaagtccatagttgagggttcactcttggtggtggacattctttgggtttggataaatgtataatgacatgtttccaccattgtagtatcatacgaagtattttcactgccctaaaaatcctctgtgctctgcacatttatccctcccttccttctaaaccctggcaaccgctgatttttttttgctgtcttcacagttttgccttttatggaatgttatatagttagaatcacacagtatgtagccctttcagattagcttttttcacttagtaatatgcatttaacgtccctccatgtgttttcatggcttgacagcttatttctttttagtcctcaatagtattccatcatctggatgtatcatagtttatcacttcacctactgaaggacatctttgtctttgctagctaaaaagtaatctcacagaagttcgttttataaactcttgttgccattttctagataatgaatctctgacaatccagctcccatgctatgttaaccaatccccaatagtaattaagcacaccttttctaggatgcgcctttttctcccataatttctcatacatgctaatactcattaggaaactaaaatttttaaccaaataacagtgtagtggacaaaatcactgtagttagctttctttttccatgtcttcccatgatcaaagatcaaaggaaggaaggagaaaaaagtctacacagattcttatcaacagagatccctatgcagctcatatacctctctgtttctgccatacctatttgtcttattaatcttggtgtcacttactgtgcctttctaatattttacattcataaaaatcatctgactagtaggaaataatagtagacttggtataattattagtactatgtatataaattaacctttgtttctaggccttcatatttcatgcttttgacataaggtgaaaaggtgttctaccaacctgaagagagaagcagtaaggttttcatacagagatactcttcataagatacctgaagcctgtgtaactcagaggaaacatacagcatgtgtttacattggtcgtacatgcagggtagagtcattctctgcctgtgaaagataaatagcagggtattagttagaaatactgctacttccccccaaaaagcacatttttgttttgttttgcaaaactatgaactcataaagaaaaacaactactgcaataatattattgctaattccctataaaatcagaattttggagaactttccttaaacttcctgcatcttggctgtttaaatagactaatgaataatctaatgtaacagtggagatattattttctatcatgcatgccatgtattattttattatttaattaaagtgttagaattcttatagaacttattactagttgctcatttaaatcaaggtttatcatttgaatacggtcaattagacgacagttttaggtcctacacacttgatttttaaaggtaaattttttcacagcagtccatcctaaagacaaaaatgtgtgacactgttcacagttatgcagagggcgagacctagaacttgattctagacttctgatgctcaaaatctgcctctgacaggcatatgccttaatattctttaaactaaaggtactaaaccaattcttgcttatgattctgaagtcattacatacctatgattttcaaataggtctctaaagtttcctgacttgtgaaatgacactaagagcctgaaactgggcccagttcacagcttttaaaatgcttcaagatttttttttttttttaagtttctgacagaaagtcgtcttggacttaacaacagaaaggttattatttttctctactgaatatgtggtttattcctttatataaaataaattagacatgacttatatgctgccaaagtgatcagaggctcttcaaatttaaaatctgctcttaccgaagaggcacctccctagtccttaatagtaggtaaagcactccttttctgggaggcacctttttttcctttagtttcttgtacatggttatactcatataactgaaaatttcaacaaagttatagtgtagtagaataagtaaaaactcattcttgttggctgtaaaaacaacaacaatttttttttcccccacaacgttctgacctaagggcaaccatgagagactgtttgacagctctatagagggtcagaacttgaatgcatactttctgatatgcaatatctgcctgtcacagacaccagagcagtatggaaacatagtgggctaagaaaaaagggtggagggctgggtgcggtggctcacacctgtaatcccagcactttgggaggccaaagtgggtggatcacttgaggtcaggagttcaagaccagcctggccaatatggcaaaaccccgtctctactaaaaatacaaaaaattagccaagtgtggtggagtgcgcctgtaatcccagctattcgggaggctgaggcagagaatcacttgaaccctggaggcagaggttgccatgagccaagatcacaccactgcacttgagcctgggtgacagagtaagactcgtctcaaaaaaaaaaaaaaaaaaaaagaaaagaaaaaggtggaggactgcccatcttttaggcagcagcatgagaacacaagaataggaagtacatatcccttaatgaaaatgaaactaatgtaaatctgttgaggaaaaaaaattataaatcccactttatgtaaggaatgtatgtggcatgattagattttgctgtgactgcttaaagctaaatctgaatgccctaataataaaaaccctaaattaggttagttttataaaccaggataagttggtgtttcatacaaatctgtttatgcttttaattccacttaaatgccttcaaattacatattagaaagtgactaaaaaacaaatactgccaacatggtattttttaaacagcatggtaggattatgatgagtaataatgtcttcagtttccccagaaactaaatatatttaccagttaatttaaaattggatccaactacctaatcttgttacattgtgatgcagtagtttgaacagtcctctttttggcaataaaagtcaaggtgacttctgttttctatacaaacagaaatctccttcattttttattcttcttagaccaggggtatgtgtgtgtgaactccctgtttacattgtactaatagcaataagctaggggtacgaaaagtagtaatacaaggtagaaagtgagagtaactaggatgtgacttctctgctgtgtatctggtgatgtgaacaccaagagtctaagagtatgctggaaaggatggatgggaatgaagagtgtgtgaaggaaaacaatgggagaggaagtgaggtcagattctggaaagtctgaaatcatgcagaatatgtactggagggtcagtgggaagatactgaagacaatctgtgtactggggagatatgtgatgcagtcagactgtgcttgaggaagcaaacattagccaacatgatgaacgttacactggagggagaaaacgagtgaggaaacaactgcaatgaggtaaggggaaatggacacctgaagtatttcgcagacacaggaataagcttagaggataagagaatagctgatttataaaatcttaaaggcttggtcttctctcagttaaacaaaacaaatttgttcccatattcttaaaccacagacactgggtgagccttgccatgcaaagagatacctcttgtgtctgggtccatatgtcccaccccatcagcctagatatcctcatctacaattgtccccactgaatccacatgagttttaccatgctcctttttctttctggaatagggttatgtaaatgatatcacagtaagattccttgttgcttgcgacagactttactaacctcagatatgctgttaaatatcctcaaacatgtcctgggacagtaataatgccacatgtacatttgctttacattacacttgtcctgccccaagcactcataactctatttccagtttgcctagatcctagatacctagtaggattgtttcagtcctgaattatcacaatagcagtcaatcaggaaaacatcagctggttaaagataccctatgaatacagggaaaatgacacacatacaacttactcattaataatcagatcaggagcaaaacacagcaggtttgcacttgattgtctatatgatctccaccccagagcaaatgccataagaaacatccaggagtactgcagtagggtcatttggtcatccaggtgtaagttcctgaaacctgaattaagagaaataaaggtatgaggcaacactcttcagaagatcatctctgtgggaattgccaaggagcaatgagatcaattagccctgtcaaaacaagggcacccctaacagaaaatggaaattaaatactaggtagacacagttttcttctgtcatctgacactttaagactcacaaaccctcttgtgtttttttttttttttttttttttaattgagacaaagtcttgctctgtcacccaggctggagtgcaatggtgccatctcggctcactgcaacctccgcctcccgggttcaagtgattctcagtgccagcctcccaagtagctaggaatacagattcataccaccatgcccggctaatttttgtaattttagtagagatggggttttgctatgctggccaggctggtctcgaactcctgacctcaactgatccacccacctgggcttcccaaagtgctgggattacaggcgtgagccatcgcacccagccccctaggtgctttttaatagcttttaatgtaaaaaaaaaaaaaaaaagccagttttgtcacctctgtctgcttaagtaaacatgaactaaatagtaaaatagccaaaattcttggcttggcggttaccagtgaccgggaaagatagtggtgatggggatgaagcgggaatggttgacgggtgcaaaaatacagttagaagaaataagttttagtgttcagtagcacaacaggatgactatagttaacaataatttactttatatttcaaaatagctaaaagagaagatttggaatgttccccaaacaaatgtttgaggtgatggatatcccagttactctgatttgatccttacacgttgtatgcttttattaaattattacatgtaccccctaaatataaatatgtacagtaaatatgtacaactattatgtattgattttaaaaaacagaaaagaatcttggcttgaggtattaatcaatgagttaagcaaaacatttgccctgctattcacacctctttcccccttaataaaacaaggatgacaggaggtcaggttactttcttgctctctccctaactatttgcgtgaacacaggcttgtcaattccctgtctttaaagtcagagctgacactaacattgacctctgccattccacaccaaattccaatagggtaacttttatttaaaattatctttaaaattacattcaatgtgtagcatttcatttagtgaagggttaaaatcattctactttagtacaaattttgacaatcaacatacttgatgtttaccaatcttacaaacaacctgatttttaaaagtggcacaatgaaggaaaacaaatggaattaactaaaaacattttctttccccaaacttcagtgtaaaaggagttttgagtgagtcttgtaacttgaattctgatattacatcatcctatgtgaaattaccatcctgtgcataatgatttgaaaagcagggagtaatgtaaatgttttattataaactccctatcacctgtattcacctgactctccccttcatagtccccagaactaagagaaacaagataagccatgggctcacgatgatataaaagccaaagtgtttttgctgaagaaaacacaaaggtttatatagttgctcttttatgttttgcatcttacctggtattgcctttgcccatttcactgctgcaatcacttgccgccctcctaacatgttgagcgtagtcatgatcctccaagttgagtctggaacagagctatcatatcctgcatataacacttcaggttcaataacctccaacagtgacaccagggtaggggtgagttgtggtaacgttgcaggaactattgttttgttaccaggattttcagaggtttcttgtgagactcctgtagtggcctgctgaattccttttatttttttctttgtttttcgagctgtgggtatttaaacaaatacatagaaatgaactgtaatgggaaggtctgcgctacacagtttattcaagaagtatttttactttctaaaactattaagatgggagaaatattttatttagcaattatgataaagtgacatggaaaaggagaaaaaacttttttttttctgaaagcaaaagatccagaggaacctattcccaattaattttgcctacaaataggccagaaacttcattagagttattccttatacaaagtattataacggtatgttaaaacaatctgagtaaataacttttgtaaattcttctataaattatttttttatctcactttcactctaaatgcaacaatttcattggttatataaggcaaattactcttactataaactgaaaaaaaaatctaagcttggagtaacggattacaaactgtggtttaagattaatctaaatcatggtagtatatataatgaagagaattacactatttacacttgttcaaagccacttataaagataggaagatgacagcagattacatgctaaaaatagtattagttctaccagtagaaaaaattcacttttcacctttacataggtactaacataaatactgcgtgggactaaaaacatttgggaagatgaaatgaaaaactttacattacataaattataagtgggaaatttcccttttataaggaagatttatattgattactctataaacctaaagcagccattttcatattatatataaattatcttttaccttgacttggtatggaaccatctactcaaactacaacatggatcctgtagactttttagtagacttattcatactcctgaagttattttagtgactaaataaataagaattacattgttctctcagagggaaagtactcagaattccagggaaaggcaagaaatgtaatttatatcacgaagaaatgtacttgtctaaattattagggatgcaaaccattttgcaaagggaagagtaaatgtaaatcacctttaaaaatcatttttagatcctctgtccttaaaatgacacaccatatagtctatggaggacagatatggtggtgggaacgatatctcaatgtacaatgttagaatagaatggttccattcttattgtgttctatactaaatggggtaactgagaattgcaaaaatttttattaatagttcaaaatagaaacagaatcatgatagaaccatgctaattagtttaccatgctctcttggaggcacagtatgatataggactaaagggcagaaacctgaaatcagcatatttggatttaagtcctggttctgccatgttgtagctggatatctgtgcaagttactccctgactcttcatttccccttctgtaaaatgaggacaatattagtccctacctcatagggttgttgtgagaattaaatatgtaaaatgcttagaacagttcctggcatatattatagtaagtaccacataacaactatcattacctcaacttgcaggagaacatgtttttagaatattttaaatttggatatcacaacttaatagaggagtgataaaattttaaaaaggaaagacaccaatacataaagaaactctttaaacaaccagaagtatctcagtgaaatcttgatccaaaatcataaaatgtacttttgttgacaatgtaaaagagaacacacatgtgccaaatcaatacactgaaacagtactttgacagcctcaattagtcataactttaaatggtttggaatgcatatttctttactccacattagaacaaggaagaaagagtaacaagctggaggattaaaaaaaaacattttctatgactcagtttgtaattaatttctcactacttatatatagttctaaatgagaaaactgatgtttttcaatacagctcagaaagtacaattgaacccaactgtgctgtactgactagagcaagaaataatactaattaatttttcaaaatatcttcaggaaggagttaactgaactgaatcatttagttaagcaatcactattttaaagcaacttagttaatacaactttatataaattcctgacccattggagcatatagttgattagcagtcaatacaggagctccacagaagtgttcatgagtctgtggtaacactacttccttcttaatgaaagtagagaaatcttaattagcttaaaacctagtttataaaagttggttacttgaaaggataaacaagattgatagaccactagcaagattaacaaagaaaaaaagagtgaagacccaaataagcacaataaaaaatgtaaaagatgacattacaagagattccacagaagtgaaaaagatcttcacactattacaagcacctctatgcacacaaagtagacaatctagaggaaatggataaattggaacaaaggctttaaaaaatctagggtttatgtgtgtgtgtatgtgggtgggggggcgggtggagtttactatgaaagtatcatttttgttttcagctgacccccgtatatataaagccattatttggagtaagtatgtatgtggaaatggaaacacacaacctgcctagattgaaccaggaagaaactgaaattctgaacagaccaataacgagttctgaaattgaatcaataataaaaaacctaccaattaaaaaaagcccttgaccagatggattcacagccaaattctaccagatgtacaaagaagagctggtactaatcctactaaaactattctaaaaaagcaatctagaaagagggcctcatccctaacttattctacaagggaaacatcattctaataccaaaacctggtagagaaacaacaacaacaacaaaactacaggccaatatccctgatgaacacagatacaaaaatcttcaacaaaacactagcaaactgaatccagctgcacatcaaaaagttaattcaccacaatcaagtaggctttatttctgggatgcaaggctcgttcaacatatgcaaatcaataaatgtgattcaccacataacaaaaaaaataatgatcatctcaatagatgcagaaaaagttgcgataaaatccagcatctcttcatgataaaaaccttcaccaaactaggtattgaaggaacatacctcaaagtaataaagagccctgtatgacaaaccaacagccaacatcataccaaatgggcaaaagctggaagcattccccttaatgcaataagacaaggatgcccaatgtcaccattccaatttaacatagtactggaaatcctagtcagaacaatcaggtaagagaaagagataaaaggcttccaaataggaaaataaataatcaaacgatctcttttcacttatgattctatacctagaaaaccctgaagactctgtcaaaaggctcctggagctgataaacaactttggtaaaggttcaggatttaaaatcaatgtacaaaaatcagtagcatttctatacaccagtaatgttcaagctgagagccaaatcaagaatgcaatcccatttgtaacagtcacaaaaagagtaaaatacctaggaatgcatctaagttagtttaaaatttttacaaggagaactacaaaacactgctgaaagaaatcaaagatgacacaaacaaatggaataacattccatgctcatggactggtagaatcagtatagttaaaatggtcatactacccaaagcaatttatagattcaacactattcctatcaaactacaatgtcatttttcacagaattagcaaaaagcattctaaaattcctatggaaccaaaaaatgccccaaatagccaaagcaatcctaagcaaaaagaacaaagttggcaacatcacattaccccaaatcaaactatactacaggctatagtaaccgaaacagcatggtactggtaaaaaaaaaccacacacaatggtacagaatagagtccagaaataaagacacacacctacagccatgtaatctacacaaagttgataaaaataagccatagggaaaagactccctattccattaatggtgctgggataactggctatccatgtgcagaagaatgaaactggacccctacctactgccatataaaaattagtaaggtggattaaagatgtaaatgtaagacctcaaactatgaaaatcctagaagaaaacctaggaaataaccttctcgacattggccttgggaaagaatttatgactaatccccaaaagaaactgcaacaaaaacaaaaattgacaatgggacctaactaaagagtttctgcaaatcaagagaaactatcacaatctacagaatgggagaaaatatttgcaaactatgcatctgacaaagccctaatatccagagtttatatggaacttaaattaacaagcaaaaacaaccccattaaaaatgggcaaaggacatgaacagacacttctcaaaaaaagacatacgtgtggccaacaaacatatggaaaaatgctgattgttaatcatcagagaaatgcaagtcaaaaccacaatgacaccactgtggaaagaagtttggagattcttcaaagaattaagagtttaactaccattcaacctagcaatcctattgctgggaatatacccaaagaaaaataaatcattctatcaaaaagacacatgtacccatatgttcactgcagcatggtttgcaatagcaaagacatggaaccaacccaggtgcccatcaacagtggactggataaagaaaatgtggtatttatatgccatggaatactatgtggccacaaaaagaatgaaatcacgtcctttgcagcaacatggatgtagcaggcggccagtatcctacatgaactaatgcagaaaaacaaataccatgttctcatttataaatgggagctaaacattgagtacacatagacataaagatgggaacagacactgggaaatacaagaggggggatagaggaagggaggcacaggttaaaaagcacctgttaggtactgtgcttacttcctagatgaaaggttcaatcatactccaaacaccggcatcacacaatgtatcttagtaacaaacctgtacatgtacccctagaatctaaaataaaagttgaaaataagagagaaactactagattgggtttttgaacttaaaaaaattagtttcagtaatatttggttataaatctgacaatgccacaagactaagcttcatttgactgtttatactaaaaataaagccatactttggattgattacaatatatcttaaaatgaagtgaataaaaacatttagtttcaagagaaaaacaagcaagttttttaaaaaaaaacatttaggatcaccattaaaaatcttatctgttcttaaatgctaggccctttaagcagtgaaggccactcccttaaaataaatcttgagatttacttggtatggggcaagagtataaaaatacaccacttggagtcctaagttacatttatggagagacttgggcaaagttattctggggctatcatcgaaactgcttggcttaggggaagcactctgatgaacaagagaatatttctgaaggttgttaaaaaaaaagtgtgaaacacatggctcatctgtattgtaagtgttagggtctgccaaagattcctggcatacgtacataccaggccaaataaagattttatgtatactgaggttagttcaatacaaaaatgatagttttacagtgaaaccacacacacaaaccctaagaacttttttaagcctttctttcaattcatctacaagtagaattggatcatttatatgatatgtgccacacggtacatatcatagtaggaaataacaaatcagaattttcttccactatgtagtataaaaatggatataaagtaaatcatggccctattcaaaggtgtttttaataatcagggtccaaaaagtagaagaatgtatatcaaagactaacatgtagtagttttcaacaaatgccaatttctacactaactggatacgttatactgactataaaagcatataattggttatttttaatacaatattttgagaaactgcagcctaaattgtatgcttaaattttttttttttttttttttttttttttttttttttttttgagacggagtctcgctctgtcgcccaggctggagtgcagtggcgcgatcttggctcactgcaagctccaactcctgggctgatgccattctcctgcctcagcctcccgagtagctgggactacaggcgcccgccaccacgcctggctaattttttgtatttttagtagagacggggtttcaccgtgttagccaggatagtctcgatctcctgacctcgtgatccacctgcctaggcctcccaaagtgctgggattacaggcatgagccaccgcgcccaaccgtatgcttaaattttattcatgtaagaaaaatttctgatgtccaacaaaagattcaactggaaatggcagtgatggtataattaatagaaaaatcagatgtcagtcactgcctggggtcgtcttctagtacagtaagggcaaagggcactgcaattgctattaaactgtaagaaggaggaaaaaatggacagatttcgtagcctagtccatcaaaatcattactttgtagttgatatatcttttttcttttgatgaaagaaggccctcatagtttggatagggagaaattgcccagaaaaacattatatacttaaaactccaaagatcttaaactttatatgtattcagaaaagcacctaaaaatgttactgggtaagcaaccacaatatattagagatacgacagaattttatttgggtttgtcctttgagcttcattcaaaacctatttcgaaatataaaataggtaaaatgaaaaaatgaagattagagataattgggaccggagaaaataaaccaaagggcactaaaaactcaagtgtcttaatacatatttaaatggtcaaagtatattacatacataggagattagagagcagcaagatgaaactgggtaaaatctgggcagagatctggtatctaagaaagtggggaatactgtttttataacaaaaataaactacccttgtggaactgaaagcaaacttctgtgtgcattttttagttaatctctacagtttttataacatttacaagaaagtgggcagctatcattttatgtaaatcaatgtttaacatgctgacactctgcagttaagtttaaatagcctggtcaaacgtagatagagttgtgtgtgtggtttggggaattagactcttcatagtcatacccataaatctattttctatttaacaagatgtctacacacagtgtgtgctagatagcaccaacaattagtctctcctatcaaaagaaccacataggtcagttgcagtggctcacacctgtaataccagcactttgggaggccacgttgggaggatcacttaaggccaggagttagacaccagcctgggaacatagcaagacccctttgtctctacaaaaaattaaaacaaaaattaaaaaaaaatcagctgggcatggtagtgtacatccgtagccctactgggtgggaagatggcttgagtctaggagttcaaggctgcagtgagccatgttcatgtcactgcactccagcctgggtgacaagagttagactctgtctctaaaataataataatcatcataatcataaaaggaaccacatggtttccattctctctcagtactgccatctcttatctggaggactgccatattcacttaattggtctctccatgtaagattagtctttgtaaaatacaaatctgatcatgtctctgcccttatttttcatctatctaattcctactcagcttatagatttaaaattcaatgttacttcttccttgacttccaagacagaattaggtgaccttcctcttgttcctgtggccctatgccctctatggtgtgccatgctattttgtgactgactctgcaacctaactagcagataaactacttgaatacaggcactattttattcattttatacctagtgactgccttgttggtgcatatttgttgaataaaagtgctaatttcacaataaatactaagcatatgtgttatgagatcaccactaccttcacagaacttgcaatttcaaccacagcagaattccaaacttttttcagaggaaaattttttaatgctgagatcagtgttaattatacaacttgttatataaacagggatatgaaactctaacttataactagtttcaggtttctttttttttttttttttccaagacggagtcttgctctgtcgccaagctggagtacagtggtgtgatctcggctcactgcaacctctgcctcccgggttcaagtgattctcctgcctcagcctcctgagtagctgggactacaggtgacaccaccacgctccgctaatttttgtgtttttagcagagacagggtttcaccatgttagccaggatgatcttgatctcttgacctcgtgatccgcctgccttggtctcccaaagtgcggggagaccaagaaactttctcagaaacttctcactgttgtgtgcattcaggtcatggagttgaacgtttcttttgattgagcagtttttcaaacactcattttatagaatctgcaagtggatatttggagcgctttgaggcctacggtggaaaaggtaatatcttcacataaaaactagacagaaggattctcacaaacttcggggattacaggcgtgagccactgcacccggcccaggtttcttctttacttgaaaaccaaaacaaaacccatccagttcttccttgaggttttttttttcccaccaccccccgcttgaagatctgtaataaaacacagatctccaagtaaaaggtatgcttttaaaaggcaaacagaaaaatggacatgtaaatatgtctgatacagaaacatttccaaccctagggaatagttttgaggctgaaaaaaggagtaagaataataaagttgctgcatgttgtgtaagtttcattattacataatttcctttctttgtatatagtctggctgtactgaattcagtgtgtgtaagaagaactggtggataaacaaacaatatgacatattcatgaaaaaaatttcccatttttattgggcagtaacattatgctagtcaagcatatatatactgaactgactacattaattacatctgcttacgtgtatcttcaaaagtaaaatgataaatttttataagctacagagacaaacaattgctttcagatatttatattaccttccaggttcattccagcctgaagacattttcgatagcggcatgctgggcagttttttcttcgaattttatcgatgatgcaatcattccttccagcacataggtaattgtgctgtcctatatggaataaaaggcactattaaagtttcacaggtcttcaaacatattttataaggacagcctctgtctttgtttccggtggaatataaccaagacacccacaggtattgccttgagggaatgttcttgcctacattgccattatgaggtcgagaggtcaaaaacaacaaaaagagtctccctttttctgttcaacaaactgaaaacagtgcaataaaaaaccttattgcagtattcacatataaaaaaagtacacaaatcagtgaaccatttaataaatttttacaaaccaagaacctttatgtaatcagctctcagatcaagaaacagaacagtaccccaacaggccccctttctgcccaattccagccagtacccaccaagggtaactacttttttgataaactgtgttttacacagtttgatagattatgtttttttatttttatttttttgagatggagtctcgctctgtcgcccaggctgggagtgtagtagtgtagtggcatgacctcactgcaacctctgcctcccaggttcaagcaattctcctggctcagactcccgagtagctgggattacaggtgcacgccaccacgcctggctaatttttatatttttagtagagacagggtttcaccatgttggctaggattgtctcgatctcaggacctcgtgatccacccgcctcggcctcccgatgtgctgggattacaggcatgagccaccacgcccagccaatagattgtgttttaaacaaataatagtttggggtagatggttaactgtatcaggttcaattctttgtaaagaataggccacaaaattgaccactagactataattcacctttgttcagagctgctctccaatgccaaatatctgtaccagctgtttcaatttctttttgtactctataaatatcctagcttctttacttggacagaaaatggaagcactaacccaattctatcccctataaatcaaaagtacgatcaacagatacatctattgatgaagtggttataatacaaaaaagttataccctataaggaatctctaaatcactgtcctacagttactggaagaaaaaaagaaaaaaaatcacccactgctaaaaatgaaaaattccaaagttttgtttatatccaactgaaatgtcaggatgtgcacattacgccaatcttgatttctttatcccaggtatgtcttgtgcacagctaagactctgagctataggatcagaggcaatgtaccttcataagttaaaaatagccctttgtggttattagcatgaagttggacaagtctatctatctgttccttatctataaaatgaggagttttaactagtattcactatttcataacacatggccacgtacaactaatagtcatttcctgtcaatccattcattcattccttgactcatttatttatttatttttagacaagttcttgctacgttgcctaggctggagtacagtggtgtgtcatagctctttgcagcctgaatctcctgctttagcttcctgagtagctgagactacaggtgcgatgcctggataacgttttttttttttttttttttcctgtagagacggggtctcgttatgttgctcaggctggtctcaaactccaggcctcaagcaatcctcccatcttggcctcccaaattgctgggataataggtgtgagccacagtgcacagcccattttccttgagccacagtgcccagcccattttcctgtcaacccttctgataagacaatgagatatcttattttggagttcctgtgtcttctactacttggtaaattccctttctaactaatagaaagatgagtcttcaagtcagctgaaattttgtgactttgttttgtttatatggtattcatttttgtggttaaagtctatttttggcaaataattctggttttctatttatggtgggtgtggtagccagcctcccaagatggcccccagtgatctctgcctccttgaatgcatggtcttgtgcagtccctttccgtcctttaccaagattggtctgtgtggccaataaaatatggcagaagtgatggcatgttacatgtgaaatcagataataaaagacaatagttctgctgcattgatcacatactctcttggatcatttgttatgggggatgtaaattataatgctactcacgttactccacagagaccacaaggatgccagctttggctagtgtagtagtcccacctattgattagagtcaaaagtaaagcccacccctgcctagtgtaaagctctgaataaagtgcaacaacttgctgatacccatattatactatgccaattttgagggataatctataattctagcaggtattaagaatggagtgctaagtgtaagatattttcaattcacaatgggtttatctggaggcaaccccattgtaagtcgaggagccatactgaatgcgtatcactttcccaccatcataaaagttgaaaaatcgttaagtcagggactgtccgtattattattatcactgcatttatatcgtggaaatacttaagcagttaagaaagtgaggagtaaagtgaggacacgaagacgcttctgtcttctgcgtatgtgttaagtaacatccactttattaggagcaatgcacaaagcagggctgggctttacttttgactctaatcaataggtgggactactacactggccaaagctgccatccttgtaatctttgtggtgtaatatgagtaattttataatttgctaatgtattaaaaagtaaaacaaaagaaaatgactcatctaactctcatggatatgcaaacacaacatgagacaaataataataatcctcatacagtgaatgaataattgtttctttaaaaaattaatataatcagagctttaggccaagctactttcaaactgctttagaaataactaaattatatgacaatttttttcctagaggagtcactggtagtattaggacattttagactctcttctaataaatttgctatggaatgaatttctcattctttagggagataatgctgttgccctgtcagcagtctgaatccataacaaagtaagatttgtgttaatacaacatttatatagtgaaatcagtttctctaaaatacctttcctgacctcctcaggccgagtttctctctccctcatctatattataatctctgtaccttgtcattgttaactcatctttcacttcagtggagtgtgacttcccagagggtaaggatcaggtcttattggtatttataccacttagcacagtgccctggcttaatagaaaaaaaaaatgaataagaaatgaaatgaatatcttttttttttcctgtcacagttctcactgtgactcatttttgccaggccagtaaagttggtgactttgaaacctattagcttatggaagttaaagcccatgtttctaatacaatgaacattatgttatgcccaaacttaacaccatcatttcatatgatagcactttcttatagtgttaccttatgctccctgaccaaactcccagacatcaacttgtacttttctattttattctagatctttttgtattgttgttttaaatactttcctgcccattagaggacctaggagccaccctcctctcccctcttaactgatatttagcctttcatgggctttgcatataatggaaatttcaaaatccaccctgagaaatgaaaaccaagtagaggaaaaataaactcttcaaaacacacactaccttccactgctcttttgaagaaaactttacagcttccacaagttaagactccataatgacatcctgaagcttcatcagagcacaccaggcagagtttgggaggtggtcctgttgttgctgttgaggagctggatggaggagagcttacatctggtctcatgctggggctaaagaaggggaagaacagtgttatgatttaactgtcaaaggaatatcaaaatacagttctcttagcttctcacttcatagtcagaatgctcacagtgaactctggcttcaagtgctagcaggcactaaaatatcctagctaaatatattcaaatcatgttatattcttctttaaacaaaattaagaatgaggtcatttcttttgaagtgtctccaaaatagaatggtgtggttctggttcacttcttcttctttttttttttttttttagatgcttaggatttatttttataatcacgtttattaaggtgtcacatacagtaacatttactgttttctaagtctataatttatggtttttgttaaatgaatattcatgtaactactatcacaatcaggagagaggatatttccatcatcccaaaaagatgcctcctatgcctttaattgcttaggccataatttttttcctaattttaagatcttatacaggcatcttttaaaattcaatcaagtgtcattacaattctacccatgtttcctactagagtcaaaatttttttacaatcttaaagtttttgtcccatgtctctaattcctaatgtcatcttggctgaaaccacaatttcatatgactcagagaagactgatccagaaacattttctataaccttcctgtctggcttgcagtaagattggacaaagcactaggctttcaaaagtgagttccattctgcccactccactctatgactgtttggcttgaagaagaagacagaaatgtgaatctgcttctcttactaggtctctaacatttttcatagtctcaccacaaagagtgcaggtctagtgattattagctgtttaaaagataatttgttgttttaaaaattttcaatctcaaaaaaaattggaaagaattgtacaatggatatatacttttcaccaatattcaccaagtcttaacattttgccacatttaatgataaagatatatttttataaaccaatgaaacagtgatctttctattactggaggaaaaattaattattgcatttcatattacatgacacaatggttttcaatgttgtattttcctaaggaattttcctcttacgtgctgactttagaaccaaaactgtattatgcagctaaaatgattttgtagccttctgcttgtaattagagactgcccattccatttttggttgtgttcttaagcaaatcttcaaaaacatggatgctggcaacctgttgattctggaattctacatattaaagtccgttttgcttatcatctatacaagttcataaatatactagtacctctctctaaacttttcttaatttgccttttctctaaaaaagatggaacttagaaataaacttaaattgggtgttcgttgtctctgttattctttattatctcttgcttttatttatttcagccaataacagtagtaagtctcaattacaaatatgtttaaactaattcacagagcaaagtaacttaaaatttttttctagttatcaatctggttagaaattacatttatcaagtaatgtagtttgttgctaatgttccgtttaggaataaaagttaaaaggtaataataatggaatgacaatttcttttataaatgttaccttaagtaattaagccagtaaatccaaacgatcgccctaaattctatcttcaaatgaagcttcctgaatcttgccaactgcctgcttacctaacaggcttagtcaataggacagcattcccaccaccctaattctgggaaaaggccccagggtttcacattgttctctgaacactgttaagaagaatttgtagatgcttccgtattacaaggcattcattccctgctagatttgggcgagtggactgactacacgtcgaaagcctgtaacagaataacctgaaatgactctgctgtaggtccggcacaggccacccctgattaatggaaacttgtgactaatgtagaggagctgctttgggccagagttttccagagaagtaggaaggtcctggaacagtgaatggtgcgacaatgtgttggggaagcaaaaactcctctggcttctattctgaagatactcctattcttgctcagccagtctctgtcacctgacatctatttttagggaccaaacagttgtttgtatattagtttacagaaaacgagtgcattgtttaaaggttaggacagtattctgtaatgtttaccccattaattatatatacacacatatgcatatatagtatgtatttatattttaaataatagtttgtagtacttcgtagttttagctctcaataaccctgtgaaaatgacatcatcacccctggatgcggtcatacgggccgtggcaggtggttcatcagggagcctatctacggtgaagctgacatattttagatcccagctgtaccacttcacagcttctgttaccttgggtaggtatctactactttgacccctgagtttcctcatcagtaaactgggaaggatatcacctgtgtgtgtgttgtgaaaataaggtaacacatagaaaatctactacaagttcctgcttctagcaggcactcaatacatgttcctttttctttttcaggaacactgaagattttatgagtaagtattatataaatggaaggtagtattaagtctaaatcctaggaccgtattcccaaattcttagatattacaatgtatgcaaaacatgttcaggccactcaactgtaagctacagatgacaagggaaagtaaaaatgaacaaatggattgatagtacagtagctgaaaatttggaacctcaatcaggcttttggcatcccttcaggcagtcgttctgggctacatcagataagaactgagtacatggaaagctgccagatgtaccatagacatcggtgaaaaaagccaatttttgtcatacaaataggaggagtaagatagcctataatgaacaccattggaaaaaatggatgaatgctaaatggtattcagttgcaagtttgatattgttaaaagggctagggtacaacaaaatggttagaactcaagagaaaaccatatggaattgacatcttttattaaggatacatggcagaaggaaccaaaagtataccatagtaagagtgcatatttcaccccctttgaatgggaaagctaaaatatcctggtcttaagggcatcattatctgtaatagttattgattgctcaatgtgtgttcactcacagctgtgccaaacattctgagaatgttaagaagttccattatgaactattgctagggtgcttgcttttaagtgaggaacccttggaacaaaatgccttgttccaggtgaatacctgaatgctggtggttcccaatcagaatggcaaatgtagtagaaaccgaataattcctgaggctgagtttatgttagagttcagagagagaaaaccatgcataaagctagatatgtctacttagttttgttgcaagcaaagcaattgctacaaggaggattatgggtgaaagtcatggatggattatgagttaatcacacacctagagaagcatgtaaaatgtgcaggtaaattacacccattcattcaggcagacgtttcctggcacctgaatgaaaggcaagcactgtgaggatccagtatcatgctacaaatgataacgaaccttgaaactctggtctaggatggagtaccagaatattttgtagccgcctcttgtgtctcagtactattacgaagagaatcagctttacatacagacaaatctgggttcaaatcctagttccagtgctctaatagctgtgacagtggctagctgacttaacttctttgagtccattcccttattagtgccattttagggggtttgtgtggattatatatattagagttatataaagcattgttacatacttggtgatcatcacacaataggtctctaccctacccccaaggattaccttcttcctttctggaggatcttagggaaagagaagtgctacagtcttccccatgagcctgtagaaggttaatggtcctccagaaacttaagttcaggtaattatagattgccttttctgattactacaccaaaattggacaatttcgttttttaaaggttttagtattgcaatgtggaatccaaaactgttatcaatgaacttttgattgttacattgaaatatgtcagtctatcttgcactttgaatgtatcttttacccatgcatgattttgtattatcatgcattagtcatctggaaaatactggttcactgagttatgcagatctttcaaatgttgacatagttcattatgtaatataaaagagtcacatttgtcaagctcacagtggcagatacaagtcttcaaaaattctgatttttgcttgaaacctatattttatcaattggcaacaaatactttaagttgttttccttaaagtgctaagtttacttcagtcatttttgggaaaacatcgccaaatacccaaggctgaaaaccagagtttatctctcatggtactccatgaaaaaaagtaggttaactcacagtttaatcttatacacttttctttgagacaactatcaaatgctatatgcgatataagtggattatgcaccttctcattttgtcacactgacatgagaaagaccacatgtatttaagggttgaaatttaatgtaattaataatttttttgcttcttcaaagattttaagtgcatgacagtgaatacagtaactactgtatactaagatgccaacagttttactcatctttgcttttgtaccattattgcaaatgctgacataatgaaatggcaaataaagtacgtgttactgtgaaaatagtctgccctttaaggggagactcccagggccccatggaccacactggaagaattgttgttatggagactagtaaggtaaagattctaaaccagataggctacaattcataacctaattctacaatgtaatagcttggtgaccttttaatctttctcaatctcaattgccctattgctaataggaatggtaatgtacctgacaaaaggatacagtatcgcttactaaattagaggcttccctgacagagaaaggggcagagttggtaaactattacccaaatgacatgattggcttagtcttcaatttaagtgaattaatcagcaatttttcagtgtaatgcaagaaatctatttgggagaaaaaaaacaaagatattatcacctcagaaagcaagtgttaatatggaaaaaaattccagaaatacagctgctataactggattaattttttacaactaccaatagaatattcccattggcttgtcagtttttgtccaaacaccgtaacacagtagttctcaacagagagcaattttgctctctaggagacatttggcagtgtctgaaaacacttttggttatcacggttggggaaatgctattggcatctaagtgagaagaggcgagggatgctgctaaccagcctacaaggcacaggacagcccccaccacaaagaagtatccagcttcaaatgtcaataatgctgaggatgagaaaacctggccataaagctttaagcaacataaagtggaaaagaaaaaaaaaaagggaccagaaacattttaaaacctaaactatgcttaaaaatgcaacaactgcactactgaagcagccctaaacagtccattcaagacaagtccaaaaagagattcaaaacagaactgaagccaagccatggactatacggcttagttatcaagtacaggattggcttgagccagtaatttctttttccctctagcgctagcactaaaaggtagtttttacacattaaagtcacctgcacttttcttatctttgttcattaggaaaaatgtaaatactcagctgcacacaccaggtgattatattttctgactgcccatttatctctgcattagctaaagaattactgatttgtttgataataagctatggaatagttttcaaatcaaatagaaaaatgctttaggggaaacctttcacaatatttctgttaaatggttttagcagaacacattttatcttatttaacaagccaaagaaagactgattattctctttgctttgcatttattgagagaggtttgcattggtttcaactttaggttcttattaagatagttcatccaaactctgcatcatttatattcactcctcttggggagagggttacagcaacaaaacctatacattaatagatcaagagaatgttcagtaaaggatttttcagacctctaagacaccagtggcctactactcagtgtctctgggcttggtttccctgtctgtaaaacgaaggtcttgatttaattaactccaaataagctggccatatcttgcaagatgggtttggggatggaaaagtggagaggaaaacacttggatctgtaaagggtttcttaggtcctgtgtatttatttgtagagagaatataatcatgttatctatgctacttaaagtctaatctgtctcacagaaataatgtatttctttctcattggaagaattaatccagtttggtcactgtgtttgggtaacttacttcctaacagctgtatccttctttgctcttcaaaccaagtgtcaaagatggagaaaaacagaataagtcttgagaccccaagcactcccttctcaggctgtgtgttatcagttctgtttgctcaggcttgcattaggggatgcgagttttaagcagaagcaataatagtacattgaatggtaaacagaataccaagaaccagtatggtaagaagaaagactaaaaactttttgatcgcatagttatttctagaatgaagaccggattttgttcccaccttatggttcctcacacataagagcatacaaggataatagatggttcataattcagaattaggaacatgatgtcttcagagaaggcaagaacatgttggagacaatagtgcagttattgactttttccaacaaggtatctcgagcatctttgaaatgccatttgtgttcacctcaaatacaacagtaacttatttctaaatattttattcgattcttaaagagagatttgaatttctctcactatatttagtaacccagacttacatgcagagattttgccaattctaacccatcttccacatcctatttattactccctgtaacactatgtcaggacctattccttcccatccactctgaccgctgccattctaatgcatgccttctctcacctcttgctttaaccactgcaatggttgatactaagtagtccttctggcactggcttctctttccattctatcccccacacactgctaaaactcttttctcaacatgattaaaaatctgaagggctcctccactgtttatagtacaagctcagtatggtccataatttggtctttttatttttccagtcatatgtcttatcactcccctacataatccatgtagtttctttatcactacagggatcctggattctacaaatatttatcaagtacctatgataggagtagcttttgctaagatctgttttccctgcctgaagtgtccaccatggtattcctgatccatgacagcttctagacttcctaaaacactgccatatagcactttgcacagatgatcctatgttaccttttgatgtatatgtatcctgtttctatcaataatctcttttaggtagggcccatgtcttgggtctctccatatcgccagcatcttgtacaaagttcagtatatgttcacttatttttcttatttatactttctatctttatctgttttgcaaaagaactctgagacagctaacatggtaaatatttatgagattataatcagaatacaggtataacctcaccattacttggcactattatgcaagctctttctttgtatagattatctcatttaatcctctccacagacctaagaggtgggtactattttcagcatttacagatgaagaaacaagatttagaaaagttgagttgcctaaagtgatctaagtaactagtaaagtcagggttcaaacccaggtctttctgacaccaacatcagtgttcttaagcaatcttcttcattttccactatgataaagtgtcagaactgagaagctgaggtatatccaggccttcaacttgagaaataacactttctactttgtaggctgaagtttgatgtcttgatgacataatgcaaaaaaggtggcaattttttttctgtgcctgcctccaatcatgacctgcaaatgaagatttttgcccaaatagggattgccagactaggtcaaataggtaaaaacatttgtcttaaaactgtgtgacgatctgtgtcatttgaccaaattttcaaatgttcctcaaactaacagatatctcatattgcataattagcagttcctaaatcctaaaaagacatttataaaaacaaatggaaatgcagaacagttgtgtctatattcatatcaatataaaggaaggaaaaggaaccctcagaaccaatctcaacctgatttaaagccacattacccctttccttccctcaaaggcaaaggcttaattctttaattcttagattctcacattaacttgagaactttttggtttctctgtcatgccagtatactagacaagtttcttttgctatctggatttccctcaggttttgatgctgctgctctcacttcacactcaggtccctacatatccactgaaacaatttaaaggaataatcttaggtacaggactccccacttatctgtggtttcacttttgacagtttcaggtacctgcagtcaaccacagtttgaaaacattaagtggaaaattccagaaataattaataagttttaaattctgtgcaattctgagtaatgaaatcttatgccctggaacgtgaatcatccctttgtccagcatatccacactggagacgctccctgccggttagtcccttactagccatctgtattagttgttttcacactgctgataaagatatacctaaaactgggaagaaaaagaggtttaattggacttacagttccacatggctggggaagcctcagaatcatggcaggaggtgaaaggtacttcttacatggtggtggcaagagaaaaatgaggaagaggcaaaagttttggaaacccctgataaacccatgagatctcgtcagtcttattcactatcatgagaatagcacaggaaagaccagcccccatgattcaattactgcacccccacccccgggtccctcccacaacacatgggaattctgggacatacaattcaagttgagattagggtggggacacagccaaaccatatcattccacccctggcccctccaaatctcatgtcctcacatttcaaaaccaatcatgccttcccaatagtcccccaaagtcttagcttatttcagtattaacccagaagtccacagtccaaagtctcatctgagacaaggctagtaagtctcttctgcctatgagcctataaaatcaaaagcaagctagttacttccagatacaagggccggagggatggggggcagggggtaggggggtgtcacaggttaaatacagctgttccaaatgggagaaattggccaaaacaaaggggttacggggcccatgcaagtctgaaatccagtgagttagtcaaattttaaagccccaaaatgatctcctttgactccaggtctcatatccaggtcatgctgatgcaaaagatggattcccatggtcttgggcagctccgcccctgtgactttgcagcctacctcccggctgctttcacaggctggcattgagtgtctgtggcttttccaggtacatggtgcaagttgttggtggatctaccattctggggtctggaggatgacggctctcttcccacagctccactgggcagtgccccagtagggattctgtgtgagggctccaatcccacatttcccttctgcactgccctagcaaaggttctccatgacagccctgccctgcagtaatacttctgcctgggcatctaggtgtttccatacgtcttctaaaatctaggcagaggttcccaaacctcaattcttgacttctgtgtacccacaggctcagcaccatgtggaagctgccaaggcttggggcctccaccctctgaagtcacagcctgagctctatattggctcctttcagccacagctggagcagctgggacacagggcacaaagtccctagcctacacatagcatgaggaccgtgggcctggcccacgaaaccactttttcctcctgggtctctgggcctgtgatgggaagggctgctgtgaaggtctctgacatggccatggagacattttccccatggtcttggggattaacattaggctccttgctacttatgcaaatatctgcagccagctttaatttcttctcaaaaaatgggtttctcttttcaactgcattgtcaggctgcaaattttctgaagttttatgctgtttcccttttaaaacagaatgcttttaacagcaccgaagtcaccttttgagtgctttgctgcttagaaatttcttccaccagataccctaaatcatctctctcaagttcaaagttccacaaatctctagggcagaggcaaaatgctgccagtctttttgctaaaacataacatagtaacctttgctccagttcccaaaaagttcctaatatccatctgagaccacctcagcctggatcttattgttcatatcactatcagcatgttggtcaaagccattcaacatgtctctaggaggttcctaactttcccacattttcccgtcttcttctgagtcctccaaagttccaaagtcgcttccacatttttgggtatcttttcagcaacacccactctactggtaccaatttactgtattagtccattttcatgcttgtgataaagacacacccaaaactgggaacaaaaagaggtttaattggacttagagttccacagggctggggaggcctcagaatcatggcgggaggcaaaaggtacttcttacatggtggtggcaaaagaaaaatgaggaagaggcaaaaggggaaacccctgataaacccatcagatcatgtgagacttattaactatcacgagaatagcaagggaaagaccagaccctgtgattcaattagctccccctgggtccctcccacaacacataggaattctgggagatacaattcacgttgagattctggtgaggacacagccaaaccgcatcactatctctgttaccagttggactgccacagtatcacagtgcttgtgttcaagtaacccttattttacttaatggtggccctaaagcacaagaatagtgatgctggaatattgttacaattgttttattttattattagttactattactcttttactcttcctaattagtaggttaaacattaaccataggtatgtatgtataggaaaaacaatatacatataggatttgggattatctgtggtctgtggtttcaagcatacactaggggttttggaacctatcctccatgaataaggggtgggggctgctatatttagtaaataatgaaaacattggtaaccttacccctagaagatcaaggaggaaagaaatagtttttaaaattatataaaagttatatagcagacatctgcaatacagccagttagataaaaaatttaagactgaaaaaagttttcagtaggtgaaacaaaatatctctttcacaataataatcatactggaaactactgacttgtaattctgtgtgtcaagctgcatgcctaggtacagtacacaaataaattatctcaaataatttttactgagtccattttacagataagaatacaaaaattgggccttttatttgcccaaagtcgcattataaggcaacacctggatctgaattcagctctgcctaattccaaaatctatgcacctcataaccttgtgactgttgcctggcaggggcctgcagagtagcatccattaagcttgacagagttttttaagattatgtgggtcacttaacagacagtcttaaggtaaggttaaacatcaaagttaatttctgttttctatctatcctgccccttctatccttcatatcacaatggagcacaaattataattaagagatacaaaagcattcagtcacttccatttttttctttagatacttactatattaagtcttaaatgaacatattggcattccaaattattaagataatgtcatgctggtcattgaaatgctaaattaacatgaagactacatttcaaaaatacaaaagtataaataggagtgttttgtatattcataccacgatttttgcccttagaggaactctgaagtacattgttatatgtctgactaatgtattcaaccctggaatttttggggaagcatttgtttttttctgaaatatactgtcccactaaagtatcaaattgggcatacatgatgacatgaaaagcatttcccaaaccatagttaatttaagtaaaatgaacttaatattatacagccttaactagaaatgagatgtcttgccacactaccagttctgtcaatagaagttgagtgaatagatttatatctattaactagaaaaaagtataggcataaattaacatgtcatctgatgtgagcagattgagaaagccaacaaatttctagttattcaatttaaaggacactgaagtaccacaatgtatacattcaatttgactacataataatagctgctatttacttagcacttcttcatctacatattctgtaatcttcattactatcctgtattagtccattctgacactgctataaagatactatctgagactgggtaatttatacggaaaggaggtttaattgactcacagttctgcatggctggggaggcctcaggaaacttatgatcatggtggaaggggcaggggaagcaagacacgtctcacctggcagcaggagagagaaagagcacaagggaaactgccacatttaaaccatcaactctcctgagaactccctatcacaagaacagcatggaaaaaacccccccatgatccaactgcctcccaccaggtccctcccccaaaacatgcgggttacaattcaagattagatttgggtggggacacagagccaaaccatattattttgcacttgctccctctcaaatcccatgtctttttacattttaaaaccaattatgccttcacaacagtcccccaaagtcttattacagcattaactcaaaagtccaagaccaaagtctcatctgagacatggcaagtcccttccacgtatgagcctataaaatcaaaagcaagttagttacttccaagatacaatgagggaacaggcattgggtaaatgttcctgttccaaatgggagaaactggtcaaaccaagggccacaggccccatgaaatctgaaacccagctgggcagcccttaaatctaaaagctccaaaatctcctttgactccatgtctcacattcagggcacactgaagtaaggggtgggctttcatacccttgggcagctccgcccctgtggctcagcagggtacccctgtggctttcacaggctggcattctgtggcttttccagacgtatactgcaaactgtcggtgaatctacctttctggggcctggaggacagaggccctcttctcacagctccactaggtagtgccccagtggggactctgtatgagggatccaaccccatatttcccttccgcattgccctagcagaggttctccatgaaggctctgcctccatggcagacttctgcctggacatccaggcgtttctatacatcctcttaaatataggcacaggttcccaaacctcaactcttgtcttctgcgcacctgcaggcccaacaccacgtgaaagctgccaaagcttggggcttgcaccctctgaagcaatggtgcgagctgtaacttggccccttacagccacagctggagctggagcatcagggatgcagggcaccatgtcgtgaggctgtacagagcagcaaggccctgagcaggaaaccatttttccctcctagttctcaggcctgtgatgggaggggctgccccgaagatctctgccatgccctggagacattttctccattgtcttggttattaacatttggctccttgttacttattacttattactttttacttattattacttattactccttgttacttattcagatttctgcagctggcttgaattcctccccagaaaatggggttttcttttctactacatggtcaggctgcaaattttccaaacctttatgttctgcttcacttctaaacctaagttccaatttcagaccatatcttcgtgaatgcacatgactgaacgctttcagaatcagccaagtcaccactaggatgctttgctgcttagaaattttcttctgccaaataccctaaatcatctcaaagttcatcagttctctagggcaggggtaaaatgctgccagtctttttgctaaagcatagcaaaaataacctttgctccagttcccaataagttcctcatctctgggaccatttcagcctggacttcattgtccacgtcactatcagcattttggtcaaaagtattcaaaacaagtctctaggacgttccaaactttcctatatcttccagttttcttctgagccctccaaactgttctaaccactgcctgttacccagttccaaagtcacttccgcattttcagattatctttatagcagtacccaaccctgccagtaccaattctctgtattagtcagtttttacactactataaagaatatctgagactgggtaatttataagggaggtttaatttactcatagttctgcatagctggggaggcctcaagaaacatacaatcatggcagaaggcaaagaggaagcaaggaaagtcttacatggtggcaggagagagagaaagcacaggggaaactgccatatttaaaccatcagatgttttgcgatctcccacactatcacgagaacagcatggaggaaatcacttccatgatccaaacacctcacaccaggtccctccctcaatatatggggattacaattcaagataagatttgggtggggacacagagccaaaccatatcacatcctgaaagtaggtatctctaatcccatttgacagatgcagaaactaggactcagaaatgttagagaattggtcccagaacactatattatacatttattaagaggcaaaatctaaatttgcattcaagattccaagtctactgctgctttatttttttgcacatgccaatagtaaaagcttggttttcaaactgtatcacagattaagatagattaaattagaacaatattataataattagaggatgttagaactcctctatttcacagaaataaaggttaaatgatacccaaagtaacaggtatcataggtaagaaattaacacctttttttaaataccaatactcatgtattattcctttaccctgcattctccagatacagataaaagggctgactacattttttttaaatatgtgaattgttctaaaattcaatacttttctacattctggtgagatcctcttggtaaattatataattaaatatcagtcaaaacatactaaaaaatgtattgtggtgctgcatataatgtatatgtactctgattttcacatatttgtctacatatacatttgtcaattcacaataacagagtgatgtgccaagtaaactatcgtgtagtttcacttttgaaaatttaacaatagaatataagttttgtttttcacagtctaagtaagtataggttactgtggttcattttagaacattcattagaaaagtaacgtgtctcttctaaaatgctatttgctaacattttagaaactgtatgttaaataaagaagaaacatttaaagcaagtgatgatgtaatttttgttttaaaattttagggatattctgcacaatgtaaaaatttcaagggcacacttagcactttttttgagaaagaataaatggtagctactgttgtagtgggagatgtgcaatgtggaagctttaaaattgataaacatttataagcaaaataatagtaaataatattttccttttttctaaaataatcgtcagatttacaagtgaaatcaatactgtattctctcaaacttgttttaaaagctttgtcagagtttgtatcttcataaaagtattgcaaaaattaattttaacaaaccaaatccctcttgaaaagaatcaaaaggaataagaatgtgaatgtcagccataagaaagcatttttaaaactgtgttttcatataagcagttctgcatgcaggaaacagaaactgctgagtaccactgcagattggacactgctgttaacagctccaaagtctaagagaagtggaatctctgaaaataaaagtcattacttaaaattttaattaccaacataatttttagagttgtcactttcaacaaaatcatccctgaaaaaacttcacaagtaaaaatagttaaatacaacaacaaagaattgcaggggatagaaagaatcgatattgttaaaatcgccatactgcccaaagcaattagcgggttcagtgctattgctctcaaaataccaatgacattcatcacagaattagaaaaaaactattttaaaattcatatagaatcaaaaaagggcacaaatagccaaagcaatcctaagccaaaagaacaaagctggaggcaccgtattacccgacttcaaactactacaaggctaaagtaaccaaaacagcatggtattggtacaaaacagacacatagaccaatgcaacagaatagagcccagaaataagaccacacacttaaaaccatccaatcttcaacaaagtcaacaaaaacaagtaatggggaaaggactccctattcaataaatggtgctgggataccatctcacaccagtcagaacagctattattaaaaagtcagaaaataatagatcctggtgaggttgcagagaaagggaaatgcttatacactcctggtggaagtgtaaattaatccagccattgtggaaagcagtttgatgatttctcaaagaacttaaaacagaactaccattcgacccagcaatcccatcactgggtatatacccagaggaatataaatgattctaccataaagacgcatgcatgtgtatgttcactgcagtactactcacaatagcaaagacatagaatcaacctaaaagcccatcaacagaagactgcataaagaaaatgtggtacatatacaccatggaattctacacagcgataaaaagaatgaaatcatgtcctttgcggcaacatggatggagctggcagccattatcctaagcaaactaacacaggaatagaaaaccaaataccacatgttcttctcagttataactaggaactaaacattgagtacacagggacacaaagaagggaaggacagacactggggcctacttgagggtgggaagagaatgaagactaaaaacctatccatcaagtactgtgtttatttcctgggtgatgaaataatctgtacagcaaacccctgtggcacaaaatttgcctatataacaaacctgcacatgtacctctgaacctaaaataaaagtttaacaaaaaagaattgcagggttttttggggagtgggcaggggagaaaaggaaccaataaaacaatgattatgacaaaacctttatccatagtttaaaattagaacacaaaacatctaaccacctgccaaaacatgaatcacaaaattgatattttaaggacaagtcattaatttgtagcataaatagctgacaaccttagactaaatgtgtcattgctgataaatgattcacatcttcaatactgaaagctgacaagcattcagaacattaaaacaatatatcacaacacagactgttaaatattaggtggacagtcagtgcatgagtttagctgtaccaggattattttaagaaagttcgggcactttgagtgtttttttttttttttaatccataactttctgtaagaaccacactgtggatcataacatctgagctataaggattaagagtgtaactggggcccgttgggtgggggggcgggacagcattaggaaaaatagctaacgcatgccgggcttaatacctgatgagttgataggtacagcaaaccaccatggccacatgtttacctatgtaacctgcacatcctgcacatgtaccctggaacttaaaataaaaattataattaaaaaaagaattgagtagctgcaccactagaaagatggcagtagcaagacagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgatggcgtgagtttacgggtgcagagaaccactgcaagacttcgcctaaagaaaatttttagtggtatctttgtaaaagttaccccctagaatctaaaaatgctgcatatagtggaaccttatgtgacctggggatttccaaatctgaagtctgtccgagaactcattttgaaacgtggacaagccaaggtcaagaataagaccatccctctgacagacaacacagtgattgaggagcacctggggaagtttggcttcatttgcttggaagacctcattcatgaaattgccttcccagggaagcatttccaggagatctcatggttcttgcgccctttccacctctcagtggcccatcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaaagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcacgtgcctgtagtcccagctactcgagaggctaaggcaggaaaatcgcttgaacccaggaggcagagactgcagtgagccaagattgcgccagtgcactccagctgggcgacagagcgagactccatctcaaaaaacaaacaaacaaacaaacaaacaaacaaaaaactattgctgcagtcattcagatggaaatggggaaagaataatattaataactgatttcaaaaaggacttgaagatgtgaatcatctattttgctgaagaaatcttaactttttgaaattactttttattgctgttgtcatactcttaggtgacaaactgcggtaaattttttatcagtgaagtggaagcatgcgttttgttgttttgggaatttttatcaagtatcttcagagaagattatttcctgctttatcttcaaaaactggaaaggaagggtcaaagaaaagacagtagctggccggtcgtggtggctcatgcctgtaatcccaacactttgggaggctgaggcaggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcttatgttcatgtcaagcacctctcatcacagtctagttccaaggaaaaattccagcgttttctacattgggtgctgtgtcatctgaaatcggcacattccatggaggaaggagtcctgctttgttgcatgtatcctagggtttaatgttggtaaatgagtcactctagcatttgtagaaggctccctgagactcctacagcagtcgaccaagcccaaggacataattgaatctggagagtcctggggccttgttttgataaagacttgaaatacacataggaagaaaggcataaaaataaatgttcacttgtctctgctgtgaaaaaaaaaaaaaagaattaagagtacagagagcaatagaaagagggagatcttttaaattacattggaagcagtaagttttcttagttagcctgaggaggaactctgtccctgtccctgcctcccaaaagggagcaaaagggtataaatagtttataagaagcatccacttgaaagtttaatttttctcacagtgcgaaaaagaataaaataataccagaaaaggttattatgatttctgaaatgtagcataaagccaaaacctgaaaagaagaagaaacactgaattagacaagggtatgcaatagagaacatgaggggttcacaccttcttgacactgcagggagtagctgaaatgactggttgacgctatttgtgggtcttggtttgaataggaggcaatttgattctctccctactagcatcaagaaatcacatcatacacagtacagtggtacatgccgaggcccttccagttgtaggctggccccatttttcattcatgtgggaaaggaaaactgaataaactcaatacagctatgatccccacactgaggaaaactctctgtaaccataaagcccaactcatgtttttacatctaatccgtagtctactctaagattattgttgtaaattcatctgctctaagattactgctgtaaattcatttagaattacatagctagatagaatgaaaaggtaatttgtcaaatgaagctaaattggaagatacttttacattataaaaactataactatttagacaatttagaaaacagcaaaaagtttaaattagaaaataaagtcgccattcttttgacagaaaaccagcaaacacttccatatatagcctgcatcttttaaaaaaactgcatctatttattttggggataacaatataaatggctaatttgcaccttgctttttatgtgtggtactattcatctgtatacttcacattttgataaaactcctatgtcaatagatattttacatgattctttagtagttgtaaagtatttggctgtaacttccattctcccgttattggtcattctttggtttttcactattataaataccactgtacacacctttgcaaatgtctgattatttccctaagttaaattcctagaagggactggaaagccgatggacaactttagggtttatcacatggatccttaaactgcctctccttacctgctccaggaaaagtaggcaaaacatggacacatgtatttccccatattcgcttctaacagaaaacaaatctggtgaactggctattgataaaatttgcctatttctctgttggggtgtttgtcttctcttgattagtaagaatgttttggatgttaagtacttaaacacttagtccattgaggacatagctataaagctctcattttgaatcaaaatttcaaatatttcaagtatgatgatataatctgtgatgttcagagccctggctgttgttcacatgataattcctttagccatatctctgtttgaagtgtatgtgagcttgaaaataaaatgaccagtcaaatgtagttctggttaaagatggtatatttaacacatgcttttatttcagctccctctcaaacccagtatatgtttttaaaagcatacacctctaagaataaagagaagagacaataccagcaacagttcacaagacagaaagcagatggacaaggattgttggcttcctaagatctgttaagtcaccagtggggaaagctaagaagcaacctaattattatgaaaaaaaattctgaaaggctcaaaaactgggggtaaaggtaggggttcaaaatcaggaagactggttcaaagtctgtttaagaacatttacaggtttctttttatagaaatggtaggtcagactatgagtgccaacctgcctgccaaaaaccaaagtgctagataaaaaatatttttaaaaaatatccaggccaggcgcggtagctcatgcctgtaatcccagcactttgggaggctaaagcaggcagatcacttgacgtgaggagttcaagtgaggagttcaagtccagcctgtcaacatggcgaaaccctgtttctattaaatacaaaaattagcgggtatggtggcatacctgtaatcctagctactcgggttgctgagacagggaaaagcttgaacccaggaggtggaggctgcagtgagccaagactgtgccgctgcactccagcctgggtgacagagtgagaccctgtctcaaaaaatacatacatacatatacatatatatatatacacacacgcacatgtgtgcgcacacacacatatatatctccttaaaagcaccatcaagctgacaaaatgataaagaattaggctaaatctaaaggaaagcatcccaagttacttgtgctcagagaataacagatttaggcaaatttggatttcaactaaaaggacagaaaactagaaaaatggacaaaaaaacttatactttacaatacaggaactccaaatggccaataaacatatgaaaagttactcagcttaattagtaatcagggaaatgcaaattaaaacgacaataaaataacttacatacccatcagactgacaaaaattaaacatttgacaataagatgtgtcctgagtttaaggatgtaatcattttggaagacagtttggtattatccagtaaagtcaaagacaagaatgtcctatgatgtagcaactccatcaatagatatgtattcaaaaagaaatttatacttgtaaataaattaatgtgcatatacagtaaaatgtgtaagaatgttggcagcagcatttttttggttaaataaaaactacaaactagtcaaatgttcataatagtggaatgatttataaacatccatatatcttatctctgaggatataattctatacagcaatgaataaacgacagctgtacactacaacatgaatgaatcctacaatgttgaatgaaaaaagcaagatgcaaaatgacatatataatattctattcacataaaattcatatacatatgatattctattaacatggaattcaaaatatacaaactgagttatattgtttaaggatgtttatataggtagtaagaaaaacaagaaaacaacgatcacatttgtcagggcagtggttacctctggggaggaggaacaaaataggatttgtaaacttatatggtcatactggaggcctccaaggtattggcaatattctatttcttgccctggttggtaattacacactgctagctttattattattatttttcattaaattgtatgtatggtcatgcacgacataaatttcagtcaatgatggacagcatttatagtgatggtcccataaaattataatggagctgaaaaagtcctatcacttagctgcagctgtgcattgtaatacaacaccatgcttatgtttgtggtgatgctggtataaacaaacctaccgtgctaccagttatagaaaagtacagcaaatacaactgtgtacagtacataatactcgataatgataataaatgactatgttggtggtttatgtatttactgtattatacttttttcattattttagagtgtacttcttgtccttttttttttttgttaactgtcaaacactctcagccaggtctttcagtaggtatatcagaaaaaggcactgttatcacagaaaacgacagctctgtgtttgttattgcccctgaaggccttccagtgggataacatgtgaaggttgaacactgatgacactgactttgtataggcctaggttaatgtgtgtgtttgtgtattagtttttagtaacagttttaaaaataaaaacatcttaaaaatggaaaaaagcttacagaagaaggacataaaattttctttacagctgtacaatgtgtgtgttttaagctaagtgttactaaaaaggagtcaaaatgttaaaaaaattaaaagtttacaaagtaaaaaagttacagtaggctaaggttaatttattattgaagaaaatttttctataaatttagtgtagcctaagtctacagagtttacactacagtagacttcatataataaatgtcctaggccttcacattcactcactactcaatgactcacagcaacttccaatcctggaagccctattcacagtaagcacctatacaggtgtactatttttttcctcttttatattgtatttttattgtaccttttctatgtttagatacataaatacttaccgatgtattagaggtgcctgcagtgttcagtacagtaacatgctgtaagtttgtggcctggaagcaacagctataccatatggtccaggtgtactgtaggacataccattcagatttgtgtaagttcactctatgatgtctgcacaatgatgacatcgcctaatgatgcatttctcagaacctatctctgttgttaagcaatacatgactgcatatttgttttgttcattctcatgtacatatgcttgtttcacagtaaaaaaaaatgtaactcaaaataaaaaatagaaaaagaaacagatagcatgacctcccctactccagtctttgatgatttcttaccttttgttgtctacattttctctttctagaactcctaagctggttctctaattctcttatcttctcccctattttacattgctgtctttttgctcttatttctgggatattttcttacttttatctttcaatccttcaactgagcttttcatttatgttatcatccttttaactttcaagagtttagttttattctctgaatgttccctttttcaaaatcctttaatttgataaatgcattatttttcttatttctgaggatataagtaataggtttgagggaagtttccttatccaagatgactgctctgttgtttgttctgatctctgtcctgaagctagaagctctccccttcctttcaccctatccttctcctccttccttctaggctgagggttggtggggctccggactaaaggattccagacacagctgagagtagaaatatcttaaaaacaaaaggaagtttaagtgagccattacataccaaattattaatggcattcattcagttgaagaacacagagaaaaagaagaatgaagaaaaattaacagaacttcatggacctgagagacagtatcaaatggccttacatatgaatggagtcccagaaggggaagacaatgaaaattcaagagaaagataatgaagacataatgactagaattagttaatttagcatggtcacaggacacaatatttttaaaacattctatatatgcgacaaacaattggaaaataaaatttatattaatataatttaataactagcaaaacacatatacacaatagatatgggacaaaagatgtgcaagagctttacaggaaaaatgagaaaatattgctgaaaggaactaaagatctgaaaatattgttgaaataaactaaatatctgactaaatggagagatatacagtgttcctggattggaagactcaatatagactcaatccccaaattgaagtctcttatacccaaattgatttaatttcaatgcaataccaatcataatcccagcaggctttttttgtgtgtgtatagaaattgacaggctgactctaaaatttatagggaatacaaaggacctggaagaaccttagactttggccctgccttctggggaagggttagttatctctttaaagatgattttttttttttttttttttttttgagacagagtctcgctctgtcgcccaggctggagtccaatggcacaatcttggctcactgcaacctccgcctcctgggttgaagagattcccctgcctcagcctcccgagtagctgggattacaggtgcgcgccaccacgcccagctattttttgtatttttagtagagacagggtttcaccatgttggccaggctggtcttgaactcctgacctcgtgatccgcccggcttggcctcccaaagtgctggggttacagacatgggccaccacacccggccaaaaggcgatattttttaaaacacatcaattgatttaccaaatatatatttttaaacttttaggcttggggatacatgtgagggttcgttaaataggtaaacacatgtcacgggggcttgttgtacatattatttcatcacccagatattaggcccagtacccaatagttgtatcttttctgctcctctccctcctcccaccctcagtaccaggaattaaatatgaataatgaaggtagctcagccaataaaactgaatcagttcttcagtctgtgggcaaacacaaaattcttctttcagaggtttgataagctgttgtagtttcgaaatgatccaaataataacttacatgacttgatttattaagaagcctgaaatatattaaacaaatcacagctccaaagaatgaacaataggataatggaatgttaaaggaaaacaaaccaatttaaaggaaatttccatctgcaaaaggcttagtaggatctgctaactcagaatcaggagtgttctttaatttatgaggttctcatttcagtactttaaaaaattaacggtaaatggccccatggcttatagcaaaaggagacattctatttaagcaaagttattagaacaatggtgattgtgagaagagctgaaaacaaaagtcagtcactcagcaactagaatgccagaaagaaaaaagaaaagacaaaaatagaaatacatctaccactggtcctttcaggacatctggatacatggctcataactaccccaagtaacatccctttcaaacacaagaagagaagtcttctaactgccaaaactgttctaacagaacatgtgtatcatatcctaattagtattagcatattttttgaccaccagaaagttgaaagtgaaatgatgttatttaatataaacctgttcttaaataatacttctcctaagaatattttttagttattaaaatagaattttggggaaagaaaagacccacttcaaatactctgtggtcaaatataaaattataatttacaacagataatatattcaaatgccctcaaattttattatgaattgaactgaaatattagtactatgggcttaacatcaataattttatagcaaagaaaatacagagagggaggaggggcaaaatgaatgtctttttatcacatgtcctgactcacttctactggtgcttgtccaggatgatgcaattattgaatcataagctgttccactgatgccatgttcaaaatgacaagtctcagtctctcagactttcaacaagaatctacgacagccacagtcaaaacagtatgaataacaaaaaggtgccatgcaggtgtttcacagaaaaaaaaaaaccaagaaactattacattttaagaattaaaatttctttccttctggttacttcgtttagtctgttcattttttatgatcatactataatgacggaggctaactcttgcttagtacgtggcaggcactatgccaaatcatctacaggaattatcttggttattttaatcttggcaacatctctgagaatgggttctattaatatccccacttaagggataaggaaactgaggcttagaaggtctactgtccaaggtcaccaaggtggtggctctgtgagaactggaatctagattctcagacctccaggggaggagtttactcaatgcattctgttgttgctctccatattgatgacatatcaatgacatttattatggaaaaacatttgctgaatcaatttaagagaagttggaaatgtcagtaaaaaccttcatagcagtatgagaatatgtttccaaaaaccaggagaaggagatgccccaaaatgttttaagaaggaatcagaaagtcctgagcaaggaagcatcgaaaaatgatcgagttcctagccaggagccaggaaatgtgctttgtaattggaattataactgccctgagtaaaacagattgtgttttcatgaagcttcaacagctcattgtaggagacatacaaggaaaaggccagttaaaatacactgtgattcatgccgccatgtgagaatatcaaaggacctttagacatagagaggtgtcagagaagtcttctgatttgctacgagctggaaaggtaagtagagagggaagtcgaggaagagaagacagtcatgtgtgaagtttcctggcacccagagtatagctcttttaggggaacccaaagacaacagaagatgacaaaaaaatatactaaataacactagaaaacactgtccaaccaaggttctaagtgatctgaaagtcacaggttaaatttcataaggacaaatataagatagcatctagggaatggaaagtgacaagcacaatggtcatactgccttttcatatttagaatggcacagtattctagtgcaatgcagagcccagaactaggaaatgggcaactactgggattccagatatctttctatcaccaactcacagggtgacaatcaacagctctttcagcttccctgggtttcggctccctctttggtaactcatggataaagctaattgtctagcaggaggcaggttgcttgacctgatagtctcctcgggactttctaaaatcaatgactctctaactcagatacatgatggctaacaaccagggatgaacaacaatactatcttaatgagaaccactaatagaaattaacactatgtgtgaggtaggtactattattatccccattatatagacaaagaaaaatgcaaactcagagaagttaaattatctgcacaatttcatataactagccattagtggagtcagagttctctttcaggcatcccagctacagagtccatatccctaaccatcagaatatgccatatgcttcctctttcttacaagttgcaatattcccagtattgttactctgtgtgtatttatgatacgtaactttttaatcttcataatattcttggaaggtgttattcccattcagagatgaaatcaaaaccttgagagttcctacagggatttagttgtggcactgggcctagattttatcatgacctctatcactatgctctttcaaatacagcaaattatagagattaaataaaccagcatcatagataaatgaactgcaaatctcattcactcaattttttgtcatcaattaatttataaaaagaatattagtattaacaaaagatattttacttttataaatcagtcactgtcagctatttttttttctaaattgtagaattttactaattatgttccttttggactgtataagatgtagcacctttaagttatttaactatgacatagtgcttagaatttaaacatttttaaacattatattttgctatggctcatttggaaaatctaagctttaaaaagactaagacaaattaggtaagagagaaaaagtagactcccaacaatttttcatacccatatcgtacaaaagtttgcttttctaatattataaagccaattcttaaattttatttcagcatgtcctgatagtacacaggtgaaaccaaacaaccaccacatcaaaataatagcaaagacaacaactaatactaattagttattatggtctaagtactttattaattctaattcttacaaaaaccttatgcattattactagccccattttatgaatgaggacatttaagctcagaaagggttgctaactttcccaaagaaagtcacacaactagaaaatagccatacggcaggtctttgaataatgttttgttcaacattgttttaacgttgatgagaaaaaaaaaatgatgctgactgggcgcggtagctcacgcctgtaatcccatcactttgggaggccaaggcgggtggatcacctgaggtcaggagttccagaccagcttggccaacatggtgaaaccttgtctctactaaaaatacaaaaattagccaggtgtggtggcgggcgcctgtaatcccagctacttgggaggctgaggcaggagaaactcttgaacccgggaggtggaggttgtagtgagctgagatcacaccactgcactgcaatccagcctgggtgacagagtgagactccatgccccaccctcaccccccacaaaaaaaagaaaaaaaactgatgcctgcccagctctgtccagggccactgtctgtgtagagttggctcgttcttcccatgtctgtgtagtttttctccagatacttcgctttcctcccacatcccgaagctgtgtgtgatacggtaactggcatgtctgaagggtcccagtttgagtgtgagtgtgcatttgagtgcaccctacaatggggtggcgtcctgtctatagggtcagttgctctgagctatgagtataagctgcaggccccctggaccctgaactggaatgaacacattggaaaatgaatgaatacaaattattattattgttttttgagacagagtctagctctgtcaccaggccggagtgcaggggcacaatctcggcttactgcaacctccacctcccaggttcaagcaattctcctgcctcagcctcccaaatagctgggattacaggtgtgtaccaccacacctggctaatttttgtatttttagtagagatggggattccccatgttggtcaggctggtgttgaactcctgacctccagtgacccgcctgccttggcctcccaaagtgccgggattacagacgtgagccactgtgcctggcctacaaattaatataaaatgaaaattcataaagtctgcgataatcattcaaatgcatgacaataaacagtgcagtttaaaaatgctcagcaagcctgccctaattattatttctgagctatgtggtgacagggggtgcttcttacaattttcactttgcaaatatttattccttgatttcatccaccatcactatgatcactatcactcactggttcaccaaaaattgggtaaataattattttttgtttttattattcttaaatgtatatatatagctcacatttatttcagtggttaatattataagtgttttgggtctttatttagaagtttagtgatgtttttgtgaccagaaatatgccacaggaacttaactcttgtttatatcaattagcctgtggtaaaattggtttcattagaggttgttttgcttaaggtcacagtttccaagaacctactgatgatgttaagtgagagcttactgtatgtggatcccaaataagtagaccattccagatggcaggctcttcaccattatgctaaacatacaatgttatgactttcataaacagcagattattatgaggcatacactgcatgctgtcagactcctaaatctaggttatcaaagtaagttactgacaagttagagataatcagcaagcaattgagatgatatctacttgctcaagtgagatatctgctgtggtcaacccaggggctgtgtcagggtcattgtgcctcttcttctcctccttcgtaacaggcttagaattccatggtatctgccacttaacatacagcacaatctcctaatctgttctagcctaggtcctaggatctcaaaccttcagtccacacagagtggtctccagaagaggagatgtaacagaagaggaaaacagatttctatctagccttttaacaaagtcagtatcagtttggcctgaacatagtttatgattttttcatttttcattgatactttattttgacaaaggtataggggccttgaaaatatataggaaattagacttttgtgttactgtaaaatttataaatctaacaaatcaaaatttcccaaatttggttgacgtcgtgattacaaggagatcgccaccaaaataatgtttatatcctagttgtgactaaaatgaaatattcctaaaatatgttaacaaagtatagcagcaaaattgaaacaactgtaaacttcaaaaacttaacacaactatactttaaatgtctttttacacattagctgtcttaaaaactaaaaacgtagcatgccattgttcaatttaggatattttctttatgagcagaaaacaagagaatcacaaaatcaaataagattcttttataatttaagattgcttggcagaaatagtgaatggtataaggctaatgaaaatcgacttctgatgctaccaaagcagcaacatgtgtgctcagtgctttctgatttacaacacaggctttagtacacagcactgtaaaggaaatcccttttcagagagggtgaagctctttttaatgagcactttcctccctgcctgtctctcttttctagaatgtttatatagtacaagaaatgtatatttgacatagaaaatgtcaaatgttcaaatattcagaattcttttgcaattattgcagtttattcaaattgtcttaccaaactaaaaagtagagactaaatttcaaaatcttctcatctgttacaaaagggaagaatatagtctgtaacatttttataagttgcagtcattaatatttgtaagaactgaaattggcatttcctccttctatgtgaaacacacacagacacacacacacacgaataaaaagaaaaacttgcacttgaaaacagactttaacccagtgctgctatttctaggcctcaactctaatgttagttatttttttacagggcatcacactagtaaagaattaaaggcccccttcctctgtaaatcccacttaaagtacatgttatttctaatgtctattcaaagggatagagagtgactttctgggaaatccattttaccattatagaactggagattgccaagggctaacttaagtgttaatttttgctacacaagaatttcggcctgaaaaacctacttccttccccagtaaagactataaaatcacattctcattgtagaaatttagatcaaacaccaagggataagtatcatttgtgtgaaatgacattgatgttttcaggcaggtaacagctctaccaaaatatatgctgctaaaatgcagcttttatgcaaccttcaaaaaccaatagctttgttttgtagaggataaagtctaaatttcttcagttagcaaatatagctctccacattctgtgcccagtctgcctttccaaaacgggctctcatttttttaagtacacattccagtgtcagctttcaatctctgttccccagtgaggccatctgagtttgttcatttggtgtctttttggtttgaggactacaccctcaaaatacaggcagcttgacagagtaaacctgcctatgattcttcagtattcatctcagctctctgggcctccaaggtttcttgagcattctagcccacagttgtgatggtggattacctgttgattttgtctcacagcatcagctcgtgtttccggtagcatactttggagcttcaattacaaaatttgaaatgtgacttcagataaaactactgaaaatgcccaatgaaactataaactacaacactcagtgaatggggcaggttataaggtgttacaatagtactttaaaaaactgatttaatgatcagactaacatagttgattctaactacttgtagattccacatctgcaagtttacacatttgctacattttatttgtaacccccaaatccacacttgctttcctatcgattcgtggataagcacagaatagcaaaaaatttgagtcgactgatatgcatgttcccagctgaagtcaaacgaagtgacacgccaccttcttgttttagctctcaaactgtaaacaagtgtccttttcatggtaaatttagtggcacattttttgagttttgtgctttttgttgggaattttgctgtttaaaatggcctctatgcatagtcctgaagtactacctagagttcccatgtacgagaagactatgatgtaccttacgaagaaagtacatgtatcataagttttgatcagacatgatttatagtgctgttagccatgagttcaatgttaatgaatcaacaatatatattaagtatggtatctttaaatagaaacacacatgaaacaagggcacaacttaaaattttcccataaatatagaaagagaataggtcttactgtatttgtaaatatttttccctacaaatgctccttgtattattgacaaaggaaaacatctgaataatttttctctccatgcatgccaacctggtgaaattttacacaaattcttaattattgttgcattacatgtggtaaaactgaagtggagggaggatcagagagagaagcctcttctacagatttctctcttcttagtcctccaagttcctgagaaaggatgaggggggtcaaagatgatcctactgtctttttgtggcgattgttaaacagtggtagtatattctttcttagttgctttgctttaccaaaatgcaggtttccccaaggatatcattttccttacaacactatctgatgatggctgttccttctctaactgcttctacctgagagattcaaggttaagaagggttagcatccccttcttcactggacaattgcctactctcttcatgatgactcatcatttcatgtttgagatctatgagtggaacaggctcatatttctatcccctaatccttcttactataatctatcttcttagaagactttaccccttctgttttggaatctggctctcttcctctccaactctgccatgcatcagtatccactgttatcagatagtggactctatccacacccaggccttgggtttttgcttcagttatagtggtttaaaacacagtatttcctaaaacaaactcttcttctaggttttaacctgctgctttcctgcagctttcatagccttgtttcctagtcttgaaacttaccctcttcctgttctctttctcatttcttcatacatctaacaaatattttgagagcttatcatatactaggcactggggtataccacagtgaaaaacacaaacatgaacctttgctctcccaaaacttttagactagcaggagctgtagagacgagtacacagtagttgtaatacaatgaggcaaatgctaggataggggacacacctggtgcggtgatggtactgaagagggatatctaacccaaacgtgggagatcaagaatgggcctgcatgacaatgtgatattcagctggattttggaggaagaggagaagtgaaaaggagatgaaggttagacgtgaggtgaagtatagggaacagcattatgcaaagacacagagccaagaaagagggaagtaaaggcagtttagaaaggttatacaataaaaagctcaccaaatcataaaagaccctgtaagccatggtaaacccttagactgtactcaggacagtgagaaccctagggtgttctaaagaggggactaatctgatcacatgtttatgtttgaaagctctagctgcagtatagaatatagattgaagatgacaagggagccagtcaagatgatgatgcagtcatccagctacaaaattatggtagcctggcttaaggtaggagcagttaagaatataagtagaagggtttgcgaggtatttatttagtccaatctatgaggcctaatgactgaaattatgtgcacagagaggggaaaagggtagttagggattatgtccagatttctgctttggggttgatagcaccatatatttcctgagatagggactacaggagaaagaggaagcaggccttagaataagtcaatgaattattctggacatgttgtgtttgagagacctataactcatccaagaaaagatacccagttagatagttggaaatatgggtcaggaggcaaagagatacatctgagctggagatacagtagatatggctgtcctttgcataaggacaaatggtaactgaagcaacagaaaaggatgggatcacttagagaaggagaaaatgagaagagggcctagcacaaagctctgagaaactctgaaagaagaacttgccaagaggctagagaagtagaaggaggaaaactagaaacagaattgtgtcacagaaaccactggcagatgcctttacaaacaggatcctggtgtctagcacagggctggtgccaacagtaggttactggaaagtgcccactgaatttaaggacaagcaggtcactgataaccttggaaaggtcaatgtgaatggagtggaagcagaaaaccagtgattctgtaaggtcaatgaattgcctcatactttccaaatgactcccacatctatccttttatttccttccctactgctaccactccagttaatgcttttactacttcttgccagacctttagtaatgactcatataactgccttcgtatgtagtctctcttcgagaactgtctccccaaacaaaacaaagcaacatacagctcatcctatgtacaactgccagagtaatatttctaaggtacagcttagaacaagtcaatcctggcttaaaaacataatggttctctactgccttcagagtaaaacccaaacctcttagcatgatgttcaaagccttccattatttggtcccaatctaactgtccagccatatcgcccacattccaaacacctatctttataaaaaaatgctgactttaaaaaaattaaagccattcaaagagtcaggattatagacatacagacaagaataattttcctcttttgttgaggaaaaaaagatgtgtccagggctctcttcatttattcaccaaaatgaacaaacagcatctgacagaacagaactgtcataaaacacagacaattgtcccttttgtgttgtggcatgaaacacatggcttacagagaaaaaaaatggtgttttagcatttaataacacatttgatcaatattaatctgttacagaaaacatttctactctattattagctaacttattttatattctcagctaagtaaaatgacaaaaaatttataaagatataactttctttataaaggttctccccagcaatcctgtagaagctatccgatggttcctaattgaaagatggtagtttttacatacttcactaacctagcaagtgtgatagctttgcacctatactacaagctagttgggaaataattatataggtaaaaagccattttaggctttcagaccaattttaatccaaacagatgagagagacctataacaaatttaagagaagatgttctaaagatgacctaataatagatgaagagagttttgttatataattttaggggtagcttaatcccttcacaacattcctagtcatttaacttttctggggtggctttctaatattttatacaatcacacacatgcacaaacacacacatgcatgcacacacaatgcggtatgctgatgacaaaatatgcttagcaaaaactttgtccttctataatttggtctgcttgtcttggtactacattgtaatatggggtaagtggttgtaaagtgatcctaggattgatcataagaagattactgtgtactttataaattctatatcccaaagaaataacagctattaaaagtattcttactgagattggtataatgagttttcatattatgaactgcaagaattggctatctcagacatattttcttggtttatatccttccctaattataatttatcatgttcttcagttagagaaaaacattttcatccatattactgaactctcaacatattctacgttttttttatatgctgggttttttacttgcaaaataatattaatacaggcatacctctgagatatttcaggttcggttctagaccacaataaagtgaatattgcaacaaagcaagtcagacgaattttttggtttcccactacatataaaagttatatttatactatactgtagtctattaagtgtgcaatagcattgtgtctttaaaaatgtatttaccttaatcttaaaatattgcttaaaaatgctaacaatcatttgaactttcagtgagttgtaatctttttccttgtggagggtcttgcttcagtgttgatgcctgctgactgatcagagaggtggttgctgaaggtggggtggctgtggcaatttcttaaagtagacaacaatgaagtttcacttttcttttcataaaagatttctttgtagcacgagatgctgtttgatagcattttacccacagtagaaactctttcaaaactggaatgaatccactcaaaccatgctgctgctttaccaattaagtttatgtaatactctaaatcctttgttgttatttcaacaaggttcacagaatcttcaccaggagtagattccatctcaagaaaaaaatttatttgctcatttgtccataagaagcaactcctcatccattcacgttttctcatgagattgcagcaattccgtcacattttcgggctccacttctaattctagttctcttgctgtttctaccacatctgcagtgacttcctaaactgaagtgttgaacccctcaaattcatctataactgttggaatcaacttctttcaaactgctactaatgttgatcctttgacctcctcctgcgaatcacaaattcttaatagcatctagaatggccaatccttttcagaaggtttttgatttactttgcccaggtccaccagagcaatcactgtctatagcagctatagccttacaaaatgtactgatttgaaacttgaaatcactccctgattcatgggctacaaatggatgatgtgttggcaggcatgagaacaacatccatcttgttgtacaattccattagagctcttgggtgagcccaggtgcactgtcaatgaacagcaatattttgaaagtaatcatttttttctgagcagttgaacaggtctttacagtggccttaaaatattcagtgaagcatactataaacagatgtgctgtcatccaggctttgttgtttcatttctagagtacaagcagagtagattaagcataagtcttaagggtcttcggatttttggagtggtaaatgagacctggcttcaacttaaagtcaccaactacattagcccctaacaagaatgtcagcctgtcctctgaagccagacattgactcctttctagctatgaaagtcctagatggcatcttcttccaacaaaaggctttttcatctacatggaaaatctattatttagtaatcttagctagatcttctacataacttgctgcagtttctgtatcagcacttgctgcttcaccttacacttttatgttacagcgctggcttctttccctaaacctcatcaaccgacctctgctagcttccaatttttcttctgcagctttctcacctctcacagccttcatagaattgaagagagttaagctttggcttaaaggaatgttgtgaatggtttgatcttctgtccagaccactaaaactttcttcgtatcagcaagaaggctgtttcactttctgatcattcacatgtttgctggagtagcactagttatttccttcaagagcttttcctttgcattcacaatttagctgtttagtacaagagtccttgcttttggcctgtcttggcttttgatgtgccttcctcactaagtttagccacttctagctttttatttaaagtgagagacatgcaactctttcacttcaacacttagaggccactgtagggttattaattagcttaattttaatattattgtctctcagggatttgagagtcccaggaagagggagacagacagggaatggccagttggaagagcagtcagatcatgcgcaatatttatcaattaagtacggtgccttatacaggtgaggtttatggtgcctgaaaacaattaaaatagtaacatcaggctggcacggtaatcccagcactttgggaggccaaggtgagcggatcacctgaggtcaggagttcgagaccagcctggccaacatggggaatccccatctctactaaaaatacaaaaattagccaggcgtggtggcacacgcctgtaggcccggctactggggaggctgaggcaggaggattgcttgaacctgggaggcagaggttgctgtgagccaagattgaaccactgcactccagcctgggtgacagagcaaaagtccgtctcaaaaaaaaaaaaaaaaagaaaaaatcaaagatcactgatcactggtcgtaacagatacaaaaatgatgaaaaagtttgatatattgagagaattaccaaaatgtgacacagagacacaaaatgagcacaagctgttggaaaaatggcactgacagactcgcttaatatagggttgccacaaaccttcaatttgtaagtgaaacaaaacaaaataaacacgcaatatttgggaagtacaataaaacaaggtatgcttatatctaaatatgacagaatacccctataatggccacagctattatgttatcaattgttcttagaagcaataccagaaacatttggagggctttactaaaattcagatacccaaccccaaaattctaatttaggaaatctggtatacagccttggaatttgccaggtgattcttacttgatacttagccacttgggctgaggtgggaggacagtctgagcccaggagttcaagaatacagtgagctaggatcatgccactgtgctccagcctgggtgacagagcaagaccctgtctttaaaaaataataaataaataaataaatacatctaatgggggaaaaactccaaaactcttggtttctaaatatcatataacattttccccccaaatagtgatggtcagtaaattaaatacattgaaagtagggcagagaaactcccaaatgtgatcctaaataaatcaacataaggagcaagccaatttgagaaattccgtttaactataaaaccaccctttaaaaacttctcattatcatgttaaaggtattcagattcaatgaaacagtactaataacttccaggccattcctaaaagatcttataagccctaaaagaccttatgaaatacttaataattagtacagttgtgcctttaatgtttaaaagaggcagagacaaacaagttaaaaggcattttcctaaccctgactgtgagtcacaagcttgatgctgcctgaagccaactggcatggtgcccatttacagtaagttgtttactccctgtctaccaatcacaccacagagaaggaatgcctagagacatagagtgtcttttcaagatagatcaacagagaaagaggaatttataagtttattaaattgttacagatactgtttttaatattgctccaaaatattccaatccactttccataatctcagcatttttaaaccaaataactagccctcaatagacaaacttacagtaatagtttatcagtggaatgggtagtatcctctcatcagtttaaatatcttttaaataaaatttttaaaggacacaatatcgatcttaaaatggatttgaacttaagccaattagactgaagttgatttaaattgttttaaataaccaatttttagcataaagactgagagcttaatattaatattaatattaagaaatggagcatccagagaaatagaaaatagaaaaaatgaaccctgattatcaagagaaaaatgggtgggaagtatctgtctagtatatcaacaatttcacttaattcccaagcccaaatagcagagcaaatcactccagtaacaatatttaatactttctttggaccctcagagctagtctggactgtccctttcctccactgccctgtttttagtacattatgcccaataattttggagttttggttcctgcaatcttttgatcctatagtgatatttctgctgctgcttcttttacttttctgtttctcacaatttgtatttctcaaaaaaaaaaacacacgcaaatgttgtcacattattaaattactaaattatcctatacttctttataaacatatactttttgctgaaaaagctcagtgctaatgatcatcagatgtacgttacttttccttttaagagcccaaatgagaaagaatatacacacagaatactaggattagtttacaggtcagagtacacacgttatttctaagatcttactaggtgcaagatttaagttagacttcagtcaataggtaaataaataaaatcaaattctatctttgtcccaatagttagtacctggaaaggtgctggattcatgaccttggaaattgtatagtttataaacagaatttcgaaataatgctgaggcagcagtggtacttcctcacctcttcagtgcttgtattttaaatccaaagggctaaaaaagcatcaactgtaaataggttgaaagttacatatttataacgtattgctagtgtatttgccacaggaaagcaagtttgtcaacatggtaaatagcttgaaaaaagattatgcacaaagaaaattcaaatttagattgatactttaataattacagggaaagttacattttttagataaatttctagcttccactttctctttaaattttaaccaatgggaaaaagaagaacaaaaaacaccactttgtcaatttaacaaaactatatatggtatacaaaattgagcatagcaacatgagaaagctgaaattggagaaaatcaaaaaatacacgttttacctaataagtgaaaaataattctacaaacatttaaaaagaattctgtaatcctcagtgtgcagctgcattggcaaaaggcaatttaaacccacctcatgaactacaaacaggggaatgccatgctccctttctcttgctctccttcagtttccacacttaaaaaatttcctagagccacgtagattcctagattccacactcactttttctttttatgttgtgcaaggtagtatctccaaaatagaatttctaacactcaataaaaaagaaaattctgtgcaaacattttagttgtcttcactgaaaaatacatatcttcataactgcattgtaatttgtctattttaaggtggtatagttactagaagttcataggccattccgaaagtctcccttcatcttctcttattactcctcaccttctcttatatattttagacttccagaactaaaactagttcttttggttaataactaacgtaaaaccctgagataacaaaaaaacgtaagcacttgagtgaacgaataaatactaaatacttgatcaagccaaacgatagttctttcatctgaaaacagaaaagttaagatgccttgatcgttaagttattgtgtactactgaataggaagtttatgttctgtaaagcgggtaaggatttgggtagatttctcttcccatcctctcttgccagcagcacttcccgttcaccaccccaataaattaaacatttactatatacagaactccccacctaagatgttttttcttaatcattcagtgagacccatgttagctcagcagtggacataagaggacatgagaaaggaagaaaggctctgggacaacttctacattaaaagcaagttttccacaggagtaacgtatttaattctgaagagggatagccttataatgttcattttgatcatgaatcatgaatatgatagcatcctttgaacacttttgccattataaccatctaatatctggtaccattaaatatttgtggagagaattatattgtgtaaatattagcaaagaattccaaacataagagcctcctctttgcctttagttttaatcagtcttaatccattcttgctaaaacaagagtttccaaacccttagcaaaatattttcttttaaaaaattaaatcttggccgggcgcggtggctcacgcctgtaatcccagcactttgggaggctgaggcaggcggatcacctgaggtcaggagttcgagaccagcctgaccaacatggagaaaccccgtctctactaaaattcaaaattagccgggcatggtggcacatgcctgtaatcccagctacttgggaggctgagccaggagaatcacttaaacccgggaggcagaggttgtggtgagccgagatcacaccattgcactccagccccgtgaacaagagcaaaactccatttcaaaaaaaaaaaaaattaaatcttatgcagaacctccaatacgtaagacagataaaagttgctattttactgctaaagcttcctttgtacattcaaatttataatattaatctgcataggaagcaatcagtaagatcaatgaagatgttttgataaaaccaatacaactgaaatggaagttataaacaatagttatgtcagggttatcatcaaagtttggatttaaacagtttgaaagccactaccctaaaacctcactgtgtccccattaacagctccaagcctcatttccaaacccctgtgaaactttctccccgtataaaaataaagcccaaactttaacaaggctcaccaaaatctagactgtaacatatgtctcaccagtttcttgtaggaactatcttccagtcagtatggctttctcagtgttcctcaatataccaagttcagccattcattctaacaaatacatacttgagtgcctacaatgagtctctagatttttgcttattctgcctattattgtcttggactcttcctcaaccatcctcaacaaaagttctctcttatttcccaaagtactcagtccttctgccactcatgaatcctgaagtgtttgcttttacaagctgtttaaatgataaacagccatatggtatagcgtcaaggctgctaataaatgtactaaaatacacaattctgtcttcgatttggatttttaaaaatcaagtttttagctggatgcggtggctcacacctgtaatccccagcactttggaaggctgagacagacagatcacctgaggccaggagttcgagaccagcctgcccaacatggagaaaccccatctctactaaaaatacaaaaattagctgggcatggtggcaggcacctgtaatcccagctactcggcaggctgaggcaggagaatcacttgaacccaggaggcagaggttgcagtgagctgagatcaccctcctgcaccatagcctgggccacagaacgagactccgtctcaaaaataaaataaataaataaataaaataaatcaagtttttatttctactggaaggagaaaaaacccatttctgaatttcaaaagtgaagacttgaaacccatgtactatttataggaaatgcatgtgcaaatgtgtacagtttaagtggtatttgtggtttgtttactctgttgagtactttaaaattttaaagtcacagtttggcacacagaaaagctacttggttgtcaaaaaaagccacattttacacacacatgattaaagaataattatctaaaatgtttttcatagcacagtatttgatcaaaagtttcaaacatattaaatgcatgagttccactctactaatatttgtaaacttaataaaagtacttctagtggcttgtatacaattcagttttaaactatgtttacatttttctgtgactttctgtgctatcaagcttttctaaatttataaatgactgcctttttttagagaggacttgagacagctttaaaaaacaggtaaaattcaagatggcaatttaaaagagagtgaaaagtttatcaattacatttctacaggagtagctaattggatcactgttaaattatttagaaacacaaaatatttaggatagtatcagacttttatctttgtttgctgattaacttaagcctaatctaaaattttctattgctacatcaagggaacaatttcaacatgacaatagaagaatacaggtctttaaacacctaaccttgatgccacaaatagtactaggctttgtcttacctataacacttaataaagcattaaggacactgttccacctaatgatgtttccggggtttctggtatctcattagggactcatctaatatgactgatatatcaacagtaagcagagtgacctccaagttagatacatgtaaatacacagccaagttctaatgtaaatttcctctgctataaactgatagctacactgcagggtaccaggttttatcttgagtctatccagtgaaaaatagaaacaagcacacaaaaatcacaacatattaaatacaatttcaaacaaataagctatcctatagaagaacaggaatgagataaaatgatctactgcaggacaattctgaattaagcattctcctgtcaacaactagagagtctactgggtatttagtttgaaaacagttcaaactgtttttcttaacttaggcaacagctttcttttttgattgttagattaagctagcttattcagtataagtaggaagcatggctgaatgactaaagacaaaataggtagcagcaacactggcattaacttcattagattgaaaccttggtctggattacagcataaactgaaaattgttaaattttaataaaattaaaaaaggaaataaaaaattaattgccagaagctttaaccaacattcttaacactagtatcagtgccttaatttttctactttccattgatttctctaaaataaaattaaaatgcaatataagtggcattcaaggtaattttttaaaccttagaactccttcttcaaaggaaagcttctctagaaataagatgtgtaatgcaagccgggtggatttctctacttgcacccaactctctgagctacctctataacccctgatagttcttctgagtagttaggaaaacactaataaacaattgctcaaacactgccttatagataaagatcgctctactactgaagctgttgcctggtggacagtactaccaggcactgacttgaaatatttgtcagctgctgtaagaaattcctagatgtcccacgaataacagtttgatggagggggcatcaatgtaatttccaaacaattggaaacttgcacacaaaaagttcatttgttccaaagttgaacttatgacaattgaggaccaccagtatgctagacaatgtacaggaatcattagattctaaagtttagataaatggtaaaacagcttgaaagacctctagtattgaattttggtcaatacgaattcatttccaaaatcaaaggggagtaacagtatttttaattattggctagccttgagagagacaacatttgggttttacaaaaagtgcttttaaaacaatgtcagcaaaactggtggaaaaaagaactcaagttctacatatccataaaagcaaataaaaagggcaaaaactgtcaaactgaactttttcggaacctgaaaattaatcaacggcttgaagcagcccagggaatttttactgaaaaacaaaaacaaccctcttccccagcttattcttggtaagaacagcaaactctgtggtgttttacccagtccccatctatcccttgattcctagcttagcagtagccatgaaaataacagtccacattccacattcctggtatgaaagacagcagaatggacctctttcatgaagacttgtttttttttttttttgttgagacggagtcttgctctgtcacccaggctggagtgcagtagtgtgatctcggctcacggcaagctccacctcctgggttcattccattctcctgcctcagcctcccgagtagctgggactacaggcgcccgccaccacagccacctattttttcgtattttttagtagagacagggtttcaccgtgttagccaggatggtctcaatctcctgaccttgtgatccacctgcctcagcctcccaaagtgccgggattacaggtgtgagccactgtatccagccaaagacttgtaattaattatttggtttacctgtctggtgactccatggaagaccacctcaaaaggattgtctttattttgcctaacttagaactggcttagtgcttccctggggcacatgacgggtggaggagttgaaaacatttatgctaatctcttaatttgctgctgcctgacagataactgttgaagaaaacaacacactagtctaaagattgagaggaaaagctggggagtctgtaagggctttgaaagggtccaacatactcctggaaatctagagggccacatgcatgagtagggctgtgtatatgctcaggaaagatggagtaggctccaaactctcaccacctgttgaccttaatgctctgcagaagctggtagtaaaggctaaggcagggttgtaaactccctgggtaagagttcaaggcctgccctaatgcatacacagaggccatgggcaaagactggaagatattttgcttctaggcatttaatgaaatctctgttaattattaggtgaccactaaactaacaaacagagacttcagggtgcccacaatcttcaaagaatataaaatttacagaattagccatgaaaagtcactaaacaaacatctacaatactcaccaacaacaaatactggggaggggagacagtctgactgccagagttgttacactataatattcaaaatgtccagttaacaacaacaattacaaggtatacaaagaaacgaagtacacaggaaaagaaagaaagaaaacagaaactatgcctgaggaagcccagatactagacttcatagacaaagacttaaaatcattgcgtgaacccaggaggtggagcttgcagtgagctgagatcgtgccactgcactccagcctgggtgacagagcgagactccatctccaaaaaaataaaaaaaaaaagacttaaaatcagctattttaaatatattcagtgacataaactatgtctaaagaactaaaggaaagtataaaacagtatctcattaaactgagaataatataaagatagcaatgataaaactgaaccaaagagaaattttgaagtagaataactgaaatgaaaaattctctagaaaaaaattcatctcacagatgtcacttggagaagagaaaatccatgaactcgaagataggtcaaattgagatcatccagtctgaggaagtgaaagaaaaaagaatggggaggaaaaaactggacagagtctcagagacttctgggacaccaccaaacaaagcaacacacaaataatcagagtgacagaaggagcggaaaggggcaaaaagattatttaaaaaaaaaatagtggcaaaagaacttgacacatctgatgaaatacatctacaaagctcaacaaactccaagtagaacagactaataaagtacacacctaaatgcatcacaatcaaactaccaaaagctaaaggcaaagaatgaatcttgaaagcagcacgacaagcaagtcattacaaacaagtgatcctcaataagattaacagttgattccttatcagaaaccatggaggtcagaagacagtacgatgacatattcataatgctgaaagaattacatgtcaaccaagaattctgtatcctgccaacactatccttcaaaaatgaaggataaattaacacattcccagataacaaaaactgtgagagtccatcattagcatatctccaacacatgctaaaaggagtctttcaggttgaaacaaaaggacactcacaataaccctactttgcctttagaaatacaacatcaggaaagggaattacataagtaaacatacaagacagtaaaaatgcatcttttgtttatatctccttttctccgtatcggattctaaagacaactactaagcaatatttttaaatctacattgataaacacacagtgtagaaagatgaaaatctatgacaataacagcacagagtggaagcagaagaggtatacagaggcaaagtttttatacactgttgaagttgagttgatattaatctaaattagattttttttttccttcatttctttgggctagttttgccctggtacccaggctggagtgcagtggtgtgatcaaagttcactgcagcctcaacctcctgggctcaagctatcctcccaactcagcctctcaagcatctgggactacaggcacacaccaccatgcctggctaatttttgtatttttttgtagagacagtatctcagtaagttgcccaggctggtcttgaactcctggactcaagctatcctcctgcctcagtctcccaaagtgctgggattacaggcatgagccactgtgcccaacctaggctgttaaaatgacaataaaatctccgtggcaaccactaagaaaataactaaaaacatacaacaaaagaaatgacaaagaaattaaaatcgttacactagaaaatatgtaatacaaaagaaagaaggtagtaatggaagaatttaagaacaagagacacaaaataaaggaaacaaatggcaaaatatcagaagtaatcttcctcatcaataattacattaaatgtcaatggtttaaactccccaaataaaaagcaaagattggcagatccaattgctatctacagagattcaccttagactcaagaacacaaatagaaagtaaaagaagaaaatattccatgcaaacagtaaacaaaagaaagctgaagtggctatactaatatagacaaatagacttaagataaaaattgttcttatagggcactgtataatgataaaagaatcaatctatcaagaagatataataatcataaacttacttgtacctaacaatagaatttcaaaatatataaagcaaaaagtgacagaactgaagaaaacaataaacaattcagcaatattagttggagatttcaatatcctacttccaatagacagaacaactagatagaaatctgcaaggaaacagatttgaacagaactatgtaccaacacacctgtcaaacactctacccaacaaaagcagaatacacattcttctcaagtgtacatgaaacatcctccaggatagacaatgtattaggtcataagacaagccaaataaattttaaaagatagaaatcatacaaagtatgttctcggaccagaatggaatgacactgagaattaacaaagaaggaaatctggaaagttcacaggtatgtggaaatcaacaagttcctaaataataaacgggttagagggggaagaaatcacaatggaaatcagaagactataccttgagacaaatgaaaacaaaaatacaacataccaaatcttaagggatgcagtgaaagcatatacatttctgagaaggaaattcatagcagtacatgaccaccttacaaagaagtaagaattcaaatcaggaacttaattatccaccttaagagactagaaaaagaagaactaagtccaaagcaagcataaggaagaaaataataaagaccagtgtagaaataagtgaaatagagaagagaaaaacaatagagtaggtcaacaaaaataaccaaagctgggttgggcacggtagctcacacctgtaatcccagcactttgggaggccaaggcaggcagatcacctgaggtcaggagttcgagaccagcctgcccaacatggtgaaaccccgtctctactaaaaatataaaaaattagccaggcgtggtggtgggcgcttgtaatcccagctacttggcaagctgaggcaggagaatctcttgaacccgggaagcggaggctgcaatgagccgagattgcaccactgcactctagactgggtgacaagatggaaattctgcctcaaaaaaaaaaaaaaagctgttcccctgaaaacggacaaaactttactttagctagactgaccaagaaaaaaaaggagagaagactcttaaattaccagaatccgaaatgaaagagtgaacattatgactgaccttacagcaaaaaaataagattataaaggaatactatgaataattatacactaaccaattagataactacatgaaatgaacaaattcctcaaccaactgtcaaaaatgactcaaggagaaaaaaatctgaatggacttataacaaacaagtaaagacattaagttagtaatcaaaaaacttccaaagaagaccccagatggcttcactagtgaattttaccaaatgtttaaagaacaattaccaacaatccttcttctcaaagtctcccccaaaacagagggaacacttagtaaactatacagcttactatacttactggtcagctacaacagaccaatatcccttataaatataaatgcaagcatcctcaacaaaatactggcaaactgaatctacaagtatataaaaaggattataaaccataaccaagtgagatgaaacccaagaacacagggtttgtttgacatatgaaaatcaattaatgtgataaaccataaaagaccagaaaaacacacaaaaatctcaatagctgcagaaaaagcatttgacaaaatctaatgccctttcctgattaaaacaatcaaaaagaaaacactcaacaaactaggaacagaaaggaacattctcaatctgataaaggacaactatgaaaaccccacaacaacacacttaaactgaaaggtttccccacaagatgaagaccaacacaaagatgctcattctcaccactgctattcaacactgcactggaggttctagctagggcaactaggcaagaaaaagaagtaaaaaatgtccagattgaaagggaagaagtaaaattatctctaattgcagatgacatgatcttatatatagaaatcctaaatctattaaatactctattatgctaatcaatgatttcagctaggttgcaggatacaaaaatcaacacacaaaaatcagttgcattactaatcagtagcaatgaacaatcttaaagtgaaattaagaaaacaaattcataaaagcatcaaaacccaaaatattcaagaataaatttaatcgaagtacaagacttttatattgaaaactacaaaatattaatgaaagaaactaaatatctacagaaatggaaagaagtcttgtattcatgggttggaagacctactaattgttatgatggcaatattccccaaactgatctacaggttcaatgcaatccctatctgaacttcaattgcctctttttttcttccagaaatggagagttgatttaaaattcatatgagtttgcaacgaacacggaatataggcaaagtaatcttaaaaaagaacaaagttggaagactcacatttcccaatttcaaaactttgtacaaagatgtaataatcaaaacagtgtggtactggcataagattagacatacagactcatagaattgtgagtccaggaataagcctatatatttatggtcagttgatttcaacaaggtatcaagaccattcaatggggaaagaataatcttttcaacaaatggtgctgggacaactaggtatcattacacaaaagaataagttagagccctacttcacaccatatacacaaattaattcaaaatggatcaaaggcctaaatgtaagagctaaaactataattcttagatgaaaacataggtgaaaatcagtttgaccttagatcaggcaactttttaaagatacagtgccaaaaacaaagaattaaaaaataaattggacttcataaaaattaaaaacttgtgagtcaaatgacactatcaagaagtgaaaagatggccttttaaatgggagaaattgtcctcaaattatatatttcataagggtctagtgtttagaatatatctgcatatatacatacacatatattctagatacacacacacacacacacacacacacacacacaccgacaactcaacaataaaaagacaacctaattttaaaatgggcaaagaatgttaaagacatttcttcaaagaaaatacacaaatgtccaaaaagcagatgaaaagatgttcaacatcgttagtcatttgggagacacaaataaaaaacacaatgagatacccatacccaataggatggtgtcttagtctgtgttctgttggtataactgaatacgtgagactgtgtaatttattaaaaaaaagaaatggatttcttacatttctggaggctgggaagtccaaggtcaaggggccacagctgatgaagaacttcttgctgctggaggactctctgcagagtcccaaggtgacacagggcagcaatcacatagtgagaaggctgagcttactagattagttctcttcctcttcttataaagccactagtcccaatccagtgataacccattagtacattaactcatgaatggattagcctattcatgagggcagacctctgatgacccaagcacttcttaaaggcctcacatctcaatactgccacattggggattatgttccaacatgagttttggaggggacaaacattcgaaccacagcagttggctaataagaaaagacagttaataaatataggcaaggacagagaaattggaattcttatacattgctgatgggagtgtaaaatgatacagccactgtagaaaaatgtttggcagttcctcaaaaggtaacacatagagttatcatatgatccagtaattctactcctaggtatccacacaagagaaataaagatatatgtctacacagaaacttgtatatgaatgttcttaacagcattatttataatagccaaagaatggacacaacctaaaagaccatcagctaaggagtggatagacaaaatatggtagtatatccacataacagaatattactcagccataaaaagaaaatgaagtgctgttacatgctacaatatggatgaaccttgaaaacatgttaagtgaaataagccaggtacaagaagccacatatatatgattctatttatacgaaatgtccagaataggcaaatccatagagacagaaagtaacatttgtgattgtcagggatgttgctaactatcctgcaacacacagaacagccctgacagcaaagaattatccaatcaaaaatgtcaatagtccagaggttgagaaactgttctacggtgaagtttaatctattaaaaagcaaaaaagaatcaatcatgagaaaataaattaatatcattctgttccaaacttactagagcactaagtcctcattcattttgacaatatcagatcaaaaggtgaaggagtattcagttatcagtctcaagtttaaagtgcaccttggagttcacctattttaagatgtcttcaaaatcttgcaatcttcaagttttttctttttaaatgaacccagctaagaattcatagaagagcagattaaattggaatctggctctttccagtcctttagtttaagatattatgatactgaagcagttcagtggatctttataataatagtccctccaatccctttgcccatgctgccctgcaaagatggtttcctgctacctattcaaaaataagattctcaagtagctcagaaacacattgagggatgctatcaatgtattatgattgctctctttagctgactttatagcaccttggaatagcagccaggaaccaaggacaagatggtaccccttgcatacactccagacagaagtaacctactttttgtttatttaggacctgaaaaatgttaacttcaaagaataatgcatatcgtcagcattcttctcaaattcattaattataaatatgtccttattgtttagccaactttacttagaggggatacatcaattttgcaaatgtatcttctacagcagaataacttgtattttttaaactgcatatttacagaagagagtcatgagacatgaagccaacatattaagggcaccggctacagacttgtacattgtagaataccacaccggtcctcccagactttagcaaggtcggcatttagctgaagctgtattggtctggcttcagcctattactgtttctactcctattcaaacacctacttatttgagcagcttcatgatagatgaagaaacacaaaaattcccacttggaaatttttaatgactcaatatttcaatcaaatagcaactgaggaaaagaaagtttaaaggaagagaaattaggtctgtataaaagcaagatatcaggaacctataagtggttggaagcttcgcatctgagagtgatggcaatctgatcctagagatctatcaatttagcataaagttgttaaaatctgtcctttaaattttcatggattatctagaccatagccaagtcaagtatctgtgtaaggtatggaggacattaataaaagtatagaaatatactaaatgttttctatgtgtctttctttgatatttaaataagtccttaattaaccaaagaccagaaaagggggaaattttgttttagattagattgtggtccttaaaaataaaatgtttgcttttgtcattatatgtacatcttctataatattaggtggctccctgaaggttatcaaattagtaataccataattaccaaaataaaacatgtttatcttgaaaaaaattcacaactttgaaaattcctttaattccaacatttctattccattctgaaaagactgctcttgcttttgacttacagctaaagcagatttttactacatagtctagcaccttattataaatcattttggtctcttcatatttcatatcattcttttctgttgctccagcagactgtaaactcctggctttttctttccagtccttgctaagacgtaagagtgctgaaggcaggggatcaatgcttgctgacagacattgtccacagtagaaactgcagccatggtgatcaggaggcaaaaaagtataaagcaaaaaaaccgtgggcttggcgagaagagccttggggtcccaccccatccctgtctcttaccagatgggtatcattggccaatatgtttcatctctcttaccttttatatctttatcaataaagcagtggtagatgatacctttctttcagagttattgttaaatgggatcacaaatgtgaacgttctgtaaatactaagagttctgtgtgactataatttatcattatctatgccactattgctaaggtaaaatactaatcacatttttcttctttctcaaacaactgtttacctatactcaaactgctgaactaatcttctccaacctcttccccatctctgttccttagtgttcatttaacactaaaagagtagtctccccttatactcaggagacccccaatggatgcctgaaatcacaggtagtaccaaacactatatatacttaccttaaatgcctttttccttttaactaagcacttatcatacacattggctgcaaacttttgcagtctgagatatgacagcaaaaccagcacgcatttctttttcattcttcacaatttcatgtataaaagattcattcttatcatagatcttagcagtctcagcatatgatttcttttctttatatataagtctagaattttcatctttcacttaagggaagcaatttacagcttctctttgacatatctgaattgccaggatcaccactcctgcactttggggccactatgaagtaaaataaggattacttgaagccaagtgttgtaatactagaagagtcaatctgataacctggatggctaccaagtgactaaggggcaggcagcacctacagcatggagatgctgaacaaaggaatgattcacatcccaggtgggatgggtgggaagcataaaatttaaaactcttcgattctttatttctgtaatttttcacttaatattttcagaacacagttgactgcgggtaactgaaaccttggaaagcaaaactgcagataaggcggactactgcataaattttgaaatcctttgcaagggttccctgtgttttatcacagctggtcaccatctggcctatcaaacataagcccttaaaccttgttgcaacttttaacataaaagttggggaggctaaaactgacccacaacaagtgtcccttgtacagtacaatcgtttagaaactttttactgccattctgttcaacaatcacaattattgctctgacttctaaactacacatgcataatttaacatacttattttattcagtaccagaaaagctccagaataccaaaaaaagttttccttttaggaactttgcaaccaatgtttattccaagtcgtaatctcaatgtctgcattaaaacaaaacaagcaaaaaataaaaacaaaaacaaaaaactgccttgacttctaaatattttttataaaaattattaaatggcaccaagaaaaactaaacataaatatttcacacccaccatactgccacaaatgtaaaagactagcactagtaaaagttgatgagaacacttctaacgctccttggaaacaatttggcattacctagcagaagttgtagatgtgtatgccttgtgatctagttattcaatttctaggtataattcccttggggaaaaaaaaactcttataaatgtgtttcaggagacattttcacagcagcgttgttcaaaacagcaaaactctggaaacaatccaagtgtccactaacaggggaacagagaaatgtatgtactgtattcattaaaaggcttaacaaagatctctataaaaaagcttcagcttacatggatgaatcttacaaacaatgttgagttaaaaaaacaagttataaagactacatttatcggggggtggggggctaggggagggatagcattaggagaaatacccagtgtaaatgacgagttgatgggtgcagcaaaccaacatggcgcatgtatacctacgtaacaaacctgcacgttgtgcacatgtaccctagaacttaaagtataatataaaaaaaaaagactacatttaatgtgattccacaacataaagttaaaacatatgaaactaaataatgtattatttagggatatgtagataggtagtaaaatcataaaacaaagcaaaataatgcaaaaaatacaaaatttactagtatagtcctgcagatgggaagggagggggatgtgactgggaaagggcatccagcgagcaccaaagggaatagcaatgagctgttccttaagttgggtggtaggtacaaagaggtgtttattatttcttacacacatatattttcctatgtgtatgaaataaaaaaaatttaaaaaatatgatgcctatggtatgacacaaaaaatgtgttaagataagctcctaacttcagttactctttctgtccttcaacaactgtcttattttgccattttattgatatataaagtattatgctactaccttcattgttttttcaggatgatcattatccaatatttatattccccagattttaaattgttaaaaatttgcctcagctccagattggcttggggaatgttttacagtggagcaaatgaaaacaagggcttaaaaacatagtgagtaaagggccgggtgtggtggctcacgcctgtaatcccagcactttgggaggccgaggcgggtggatcacgaggtcaggagatcgggaccatcctggctaacacagtgaaaccccgactctactaaaaatacaaaaaattagccgggcgcggtggcaggccctgtagtcccagctacatgggaggctgaggcaggagaatggcgtgaaccagggaggcggagcttgcagtgagccaagatcatgccactgcactccagcctgggcgacagagcgagactctgtctcaaaaaaaaaaaaaacatagtgagtaaaaaagacatgatcaggtgggtgatcatccaaattttctagagagtttttagtaactctgattcttgggttctgccactatacttttaaatgggggcgagggcagggaggagagacagtatacagaaatctattttatgagcccaaatgacaagggcttcaaagcacagtgagtcaaaaaaaacagtgagtcaaaaagacactagattcaacacttcaccttgccaggctccaggctgacatacgctcagcagctgtacttgaacacagcttccacaaaatccttcggaggtcctcattctttaaatgcccaggatacgtttttaagagaagtaatttgtatgcacacatacatgcactcacatgtattttacttgggccttcatactctactgattttctagagactccatcttataacttgggatgattaccatgaagtgatgaaaaccacaaatctcatcagtaaagggatgctggcatgcaggcagacactagattcaacacatcaccttgccagactctaggcagacatcaggtcagcagctatatttgaacacagcttctccaaaatccttcctgggacctcactctttcggctgagaaagtctagtcatgccacctatttttaaatggaagttttcgggaattttatgcagaacaaattactgaaagctactcatagagatgacataaaacttctaaaagaaaaatgtaaaaaaaccatgatttaatgcttctgaaaatacttaagacaatttcaaaacctttcctaagatttaaacctaaaaaaaaatctgaaatagccaaggggaaaatatatgtacactcgtacaaagatacacacacaaagatacatacacagatacacactgcaacactatagtagctacaaaagagtcaaaattcttttaataggggcctagttaaatatattatggtatacccatatggctattagaaagaatgaggtagatttgtttggacacggaaagatgtctgtgatacatttttaagagacataattcgtatgtacgcatatcacacacattcatgctgctcacatctattttacaaattagattgttactaaaaatttttaatacaaattatgcacttttatttacaagtaagttgtccacttccagaaagtataaaaaatatgaaaagtaaccaaaagattagtaaccatgctaacagcagagagccacttgacaatttctgtaagaaatctacttccctgaagactgtttacactactggaaaaattgatcaaagaggaacataagggttaatgtataaagtaacttttttaaaaactaggggaaaatctttatttcaaaataatcatgttacattctgaacagtatctggatgagtatttgggagaatacaaaacacaggacagggtctggcatttcaaaaattttcatgaaccacttctatttaaactaatatgctaacaggcataatgctctacattatattttcatgaattctcaatgttatttagctttcaagggaggctccctgaaattagatctatgccaatgagaatttttctaaagcaaaataaggaaaatttttacccatcagaaagctgaaagatgtggagaaaaaaaaaaagttggcatacaccttgcataatcacaataagccaaaaaagtttgtatttcacacaagggtagtgggagaaatacattgatgagatgatacaatggaaggagactggaccatagctttttgctgtctcacaaatgcagttggaaccaaagattgttacagcgggaaagaactgtggataaattctcatgtgaggacacagacacctaagcagggctaggacattcagagcacctctttacttcttgcacatgattctttccatgacacctagtgcccttctccatctagagctacctctatatgtccacgttccttctctctaagctcatgatagacctcaggagaaagtcaggtaggcctgctgcttttggctttattataatgtaactagtacatggactatttggctattgtgggattctcctcatgttatcagggttccagcttgcataatcacctccttggcaacagaatttattggcatatttgttgtccttcttagtgcagtggttctaaatgtaggtgatcatccaaaatttttagggactttcaaaaactcagactcttgggttctgaccctgtaactcttaaatgggggtaagagcagggagggaagatgatgtacagaaatccgtatttttcttactgcattccaggtgtagctgtgtaccactagtttttaatactacttttgactgattcaccatctgtgacttaagggtatcagggtttggataaggtgcggtggaggactggagatttagaatgaatgatggaggagggaggaaaaacaaggcagctactgctctatgggagagacagataggactggtttcctgtgtatgtgaagtaggtgctgtgatctcggttacactgggaaggctcttttgtctcaaagtatctctcatcagctttttattaatgcctgaaattccatccttatgatttcattccttcaagttatgtcatttgttaaatagaaataccccttactcctcagtattccactgtaacctttccctaatgaagcataaattcattcacttctttttaacaatccactaaaacaaagcaggtttaggagggcactgtattccttgatttggcagacaggaaggggatgccattcccctccccccacacaaaaaaaggccatgactcaatatgatggcttttgcaacttgcctcaggctagccttagggcattacctatggagctgctgcatgccaggatgatacttgacccagaggagatgtgaatttgcataaggaagaatcatctgatgatgctctgggctataccttcgcccacactagctctaccattctctgacctcctggtatattcttcagcacctgctacagttaattgtttcttaattatttcatgtgtctgcatcatgtctctctagccagatacaggctcctttgaggtcagaaaaaacacatgatttatctttcctccctatgagcacgcagtgcagcgctgaaaaggtacaaggtccttagtaagaccttcactgatacaccctatcagcaggcaatatagggagaaacatttttatggctatctctttatgatcctctcatttctgaacactgaactcgacctgcctcttaagtttctcttctctccaagtaactgtctttcccaaattaagagtctttctttactagtccatttttgtaggttttgcaaaaatgtattgatatgaaattagcattaatcatttgggaaaatatccttggatcccaaatatgtctgagggagctgaagtttccgttgatttatggttgaaagtagtctttgtaaaggatgaaattgggggccaggtgcagtggctcacacttgtaatcccagcattttggaaggctgagaccagagcatcaactgaggccaggaatgtgagaccagcctgggcaacagagcactaccctgtctctacaaaagatttaaaaaattagccaaggatggtggtgcacacctatagtccaagctacttgggaggctgaggtgggaggattgcttgagcccaggagttcaaggctgcagtgatccaagtttgccccattgcactccagcctgggtaacagagtgagaccctgtctcttaaaaaaataaataatacaaaatgaattgggaaatgtcaatcaaaacagcgaagactgcaatccataaaggctggcagttcaacttaaaaacaaaaaaaactaagggcttctatgccaaatgcctttactctctacactaaatttcacccttaataaaaaattacacccaaatgttaccttcttttcttctaagaaaagaagcttacatgaaaggtagctatggtgcggaaaaattcagacttgcttgtgttcacaaatagataatgccagaggtggtggtctcagtttccagttctttgagaacacttacctggtacctctcctaaaagaggcattaactctagtcaacatctctgactgtctgaattctgagatatctggccctttgtataaattaaattaatctagttttactgtgtgtgtgtttcatcttttctattactactagttggatgaatttaggtgtttagtcctcatccaatatgacaactatgtttaacacaagaaatttatgtgattttatttctatatggcccttttaattttttaaaagcagtcatctttcaattgttaatgtggaatgatactgttctttttcctatcttatgtaaaacctgatttataggagtgataattgccacatatagtattaaggcacccagtgtgtataggatggactacaattctttaaaaaaaaaatctagactgggactgtgtctaatgttacacctctcaacccatgaatcacagggaatcctaccccaaggagacttttggatttgtatctcttaactctgagcctcaaccattcttttcttacaggaaaatacccccagtgagtggtcactttattggggccacaattagtcaaatatttctcttcctttccctaacacactttctcttcctttttaattcaaggaagacactgagtcttacaccttgaatggagtgtgggagccaggtttgcaataataaaagcagttacataagtgctttgcatttacctagccctttctttaaaatacataaagaatctgaggttcaggtgaatcaatcattactgaatgcctatcaggaagattaacttctgcaggattgcagaaataagtgatggagctggaatctgaacctttgttagtctctaaattccaagattttatccttctgtcacaatgattctgcctttccaccagaggcaaggttcatgaacaattcggatatcacagaaggatcagaattttaaatacacctgattcctacaactactgtgacaaatcgcaaaaaaataaaaataaaaaaacacctctccctacagtcacactcctttgcagtgtaattgcagctcctccacccacttgaatctagactagccccgtgatttgctttgaccaatagaatgtggtagaaatatagttgttccaagcctaggtcttaaagagttttgcatggttctgctggttcttttgtaactctaatgctactgtgtgaaaaagttaagggcagcctactttcaccattcattgctacagccaaccagccaactgacagcagatacgctgaatgtgcccagctgagataagttcagcttggccagatcagcagaactgcccacctcatttgtagactcatgaagaataataaatggttgttattttaaagccactaaattttaaaagcagtcagctctaaactgttaatatggaaggatactattcttcttggaaagatactgttctttttcctatcttatgtaatatctcatttacaggagtgataattgccaaatctaagtgggaaggcacccagtatgtttgttatagagcaaatactaacagatacaacaaacatagctactttgagcaagcagagaaaacaaaagattgcttataaagcttataaaagagggccccgatatgcaaaagcttgatattaagacaaatatttaacaaatccttaattatttgacttaaatttgcaaagtaagactgaaaaataagacctgatccattcaagaatttgctaggtgctttggtgtaataaatctacttataaacatcagtaattgtgtatttgaaaatctacattaagaaagtaaagtcctttacactgtgggatttaattcacactgaatcatacaaaaaccatttttttttaaagtctttatttgaagaggcagaaccttagtattatgacgttcaaagtgttagtattctctttaagaagaagccaaagtaactggagaaaaaaagcaatgaagttatttctaaaaccccaagaatttctcaagacatgaaaggcttgctcttcttcagacagttttattctaatttaccttaaccccaagttcctcagaggttcaagtagttgatgagtgactgagagaggaacttgtgtggattatagggcaggggggtgggagaagagagccaaataggaagcatatgcatcacatatgcatttttcagctcctcttcaagcttatggccgaaatataaatctgataatggtaccacaagttaaagtatccacttcctaactataatcaattagtttgaaagttatgccatctgcaacaaactgacagctagtatcatactgaatggggaaaaactgaaagcctttcttctaagatctacaacaagacaagagtgcccactgttattcaactggaagtactggaagacctacctagagtaatcagacaagagaaagatataaagggaatccaaaatggaatggaagaagtcaaattattcttgtttgcagactgtatgatcttattggaaaagcctaaagactccaccaaaaaaatattagaacagataaattcagtacagttacaggatacaaaatcaacatacaaaaatctgtggcatttctagatgccaacagaggacaatctaaaaaagaaatcagaaagtaatctcatttacaatagctacagataaaataaaacacctaggaataaactcaacgaaagaagtgaaagagctctacaatgaaaacaataaaacactgaggaaaaatattgaagaggacacacaaaaaaagaaagatagtccatgctcatggattggaagaatcaatattgttaaaatgtccatactacccaaagcaatctacagattcaatgcaatctttattaataaatatcaatgacattcttcacagaaatagaaaaaaaaaatcataggatttatatggaaccacaaaagccccggaatagccaaagccatcctgaacaaaaaaaataaaactggaggaattacattatctgacttcaaattatgctacaaaactataataacccaaacaacatagttctagcataaaaacagatacacagacctagagaacccagaaacaaattcatacacctacagtgaactcattttcagcaaaggtgccaagaacatacactagggaaaggacagtctcttcaataaatggtgctgggaaaactggatatccataggcagaatgaaactagacccctatctctcaccacatataaaaatcaaataaaaatggactaaagccctaaatctaagacctgaaactaggatactaaaagaaaacatttgggaagctctccaggacactggtatgggcaaagatttctttagtaatacctcaaatgcacaggcaaccaatgcaaaaatggacaaatgggatcacatcaagctaaaaaacttctgcacagcaacggaaacaacaaagaagcaacccacaaaatggaagaaaatatttgcaagctacccatctgagaagggattaataactagaatatataaagagttcagacaacaggaaaaaatcaaacaatccaacttaaaaaatggacaaaagatctgaatagacatttctcaaaagacatacaaatggccaacaggtgtatgaagaaatgttcaacatccttaatcatcagagaaatgcaaatcaaaactacaatgagatatctcaccccagtcaattatatatcacccccacaattgcatgcttgcattaaaacatgacctgtaccccataaatatatatgcctactatatacccataaaaattaaaaataaattttaaaaataaaactgaaataaagttaagatcataatgaagccagtttgagatcaattaatgaaaaaggcttatcttatgaacagcgtgtagtatggcacaacagacagagttctcaagtaaaaacctttggcattaaggagttgtctaatcttaaaacacatcactaaaaataacttcaggagtgctttttaagtgccagacactgtgctatgcagtttacatgcatcactttgttgtgcccattttaaaagtgaggaaacagagtttacagggttatgaatttggtcaagttcacacagttgttagtcagattcatacccagggaatctgaagagtcctaattcttactcacaatactggacctagtttcctcatatgaagtgagatctggatatcaaaactagctccatttggaattctatgattctttgacaatgacgggagcatacttcttcgtggtttgtgtactgggtacagggatgaagactggcacctttcactaaaaacaaatgtccctggggtgtatgctgacatgaatccctatatctaatcctttcctcgtatatgcaaatacagaaatggtgaggctagtttgggaaacaagtctactgcccacagtcatcctggtcagttcactacctctcaggtaaggtctgcctgtctttgggctttctcttcaattcctggcagagcaggcactaagtaaatgctgaatgaacggaaaaatattccacagtttctgctggaaagagcctgaaattggatggcattttagaatgtgtcctacaaatgtcttgaatgtaacacccataaaccataagcttcagaaaggcagaaacaactaaagctttgtccactgttgtatcctctgcagtttgaactgtgcctcacatatagtaactgctcaataaaagtgctgttcttattattgttactagattcttacagttccagttttccctaagagaaagtaaaatatatgtattaaaggcaaggccatgctatttgcttcctctgtggttctttgttcaaacagccctacctaaattgagtaccttaagtgctaggtgttatagtgaaaacgttccttgtccttaaggagactggatttacttggagataaattagaaatatataaacagtattaattcaacaaacatttactgggtacctactatgtgctaatgactaatttaggtagaaagaactgtgtggtctgtggctgccagaggataccatcagatgaggtggggggctatggcctggactacataaaggaaagcatacaaaataagtggcactaaattggtcttgaacattacacatattgttaaaagcagagagaaggagcctgaattctagactgcaacagtcctcagctatgttatatggcacactggtatgttgttatcaatttaggactcatggcaaggaatttgttagtaataatgatttatgtatttttattataaagaaaagtataaacactgccagggggaactgtgacttgccataatcctcgaaaaaagtaatttggaaatatctgttaaaattttaaatacacatacccctgactcaggaacccaactttggggaaatctattgtattattccgttttcacactgcaataaagaactacctgtgtctggataatttatgaagaacagagacttaattgacttacagttccacaggcttcaaaggaagcatgactgagaggcctcaggaaacttagaatcctggtggaagttgaaggagaagcaagcacatgttcacatggcagaggaggagacagagagagaagggggaagtgccacacactttcaaacaaccaggtctcatgagaactcacgatcatgagaacaacaagagggaagtccacccttgtgattcagtcacctcccactaggcccctcccctgacatgtggggattacaagtgattgagatttgggtggggacacacagccaagccatattattctgcccccggcccctcctaaatctcatgttcttacatttcaaaacacaatcttgcattctcaatagtccccggaagtcttaactccttccagcattaactcaaaagtccaagtacaaagtcttcttgggtcaaggcaagtccactctgcttatgagactgtaaaatcaaaaactagttacttccaagaaaaaattgggatacaggcattgggtaaattcccccattccaaactagagaaattggttaagacaaagaggctacaggccccatgcatgtccaaaaacctgcaggacagtcattaaatcttaaaaatccaaaatgatctcctttgactccacgtctcatgtccaagccacgctgacacaaggggtgagctcccaaggccttggacagctctgccctggtggctctgctgggtacagaccctgcagctgctttcacaggctagcattgagtgcctacagcttttccaggcacatggtgaaagctgtcagtggatctaccactctggagtctggaggatggtatccctcttctcacggctccactaggcagtgccccagtggggtctctgtgtgggggctctaaccccatgtatctcctctgcactgccctagcagaggatctccatgagggctctgcccctgcagaatgcatggacatccaggcatttccatacatcctgaaatcaaggcagaggctttcaagcctcaactcttgccttctgcacacccataggcccaacaccacatgaaggctgccaaggtttgaggcttaccccctctgaagcaacagcccaagattatctcctggccccttttagccacagctggagctagagcagctgggatgcagggcaccatgtcctgaggctgcagagagcagcgcaaccctgggcctggcccacgaaaccattttttcctcctagacctccaggcctgtgataggaagggctgccatgaaggtctctgacatgccctggaaacattttccctattctactggctattaacattaggctactcttcatctatgcatatttctgcagctcacttgaattgctccccagaaaataggtttttcttttctaccacaaggtcaggctgcaaattttccaaacttttatgctctgcttctcttttaaacctaagttccaacttcagaccatctctttgtgaacacatatgactgtatgttgttaggagcagccaggccacatattgaatgctttgctacttagaaatttcttctgccacgaactctaaatcatctctctcaagttcaaagatccacagatctctagggcaggggcaaaatgctgtcagtctatttgctaaagcaaagcaaaagtgaactttgctccagttcccaataagtgcctcatctccacctgagaccacctcagcctggactttattgtccatataactatcagcattttggtcaaaaccattcaacatgtctctaggaagttccaaacattccctcatcttcctgtcttcttctgagtcctccaaactgttgcaacctctgcccattatccagttacaaagttgcttccgcattttcatgtatctttatagcaatgccccactgtcctggtaccaagtttctgtactagtccattttcacagtgctataaagaactaactgagactgggtaacttacaaagaaaagaggttcaactgactcatagttccacaggcttaacaggaagcattactgggaggcctcaggaaacttacactcacagtggaaggcaaagaaaccatgttttcacatggcagagcaggagagacagtgagtgaagagggaagtgccatacattttcaagcaaccagatctcatgagaactcactatcatgagaacagcagaggagaagtctgcctccaggattcaatcacctttcaccaggcccctcccctgatatgtgaggattataattcaagatgagatttgggtggggatacagagccaaaccatagcatttatatttagaaaaaaagttgctatttgtaaagggtacatagaaaagggtgtttattagaaacttgcttgtagtggcaaaaatcacgaaaccacatgaatagaatattgtctatttaaaagaatgggatccgcatctgttaacctggaaggatgttcagggtgtacttgttaggtgagaaaagcaagctgcagacaaaggggtataagataatcccattcttttatttaaaggcaagcaacccagaaaatctcatatgtgtctgtttatgcttatgtaattacagagaaatgtggaggataaggggagatgtgcaggaagaaagaggaaagaaagaaataggaaaggagacgtgatggaaataagcttattaacattttggggtataattttactgatggaatgaacacactatttctgtaaattctgaaggggcatttgcaaaaagaagaacaaattttaaaaggagtcaattataagactatccctataatgctcacttacactcagatatgctttcttggataacagactgtgtataacccaaatcctccaaaggttatggagagttcatgtggctacccaccatctatcatcgtgcatatgggctgtggtacaaagaaggagaaccactatgctatgagcaacaaaaccacagacattttttgatcaggggaataatactgaaagtggtgttctaggaagattaatctggcagtagactgcagaatgaattaagaagggagaggagaaaactagagaaacaattaggagactattgataagagtaataagagtttgaactagggtgtggccagttttttcctgttgtgttggcttctcagggaacagaaacttaattcccttctggcttccagcctttctaccttactcttaactgaatctcagggtctttgtggtctcagaagtatgtttcttattatctgctttaattacatctaaatttcaaatttaagtctcctttttaaaaaaattataaacgaaatcactagttatattgtgccatttaagatttccctaatttatctggctttgatttttgggaatgttcccatgttttaaagactggtttcaagaacaataatcactcatatatttatgttattctattctgtctcttctatgctagttaatgtgacaactaccctctccctgccacattttaagattgttgtctcctaattcttcagctattcatttattttgtggctgctctctttggttgccttctagagccctgtccttgtccctcccctcttttttcctgaacattagagcagttcattcttaaatgacctcatctgattttcttgctatggctaacacctacttaacttgcattttctcttttctgcgactgtcattgccatattaggttgaactctcctataactcttagtagaagagatgaacttatcctaccaacctcctgactgttatatactatagacagaataagtcaaatctaaaatataaataagctgaagaaagatattttgaaaattcaggcaaaaataaaacacccctcctctcttaaggtactcagtgattacacacacacttatctgaaaaatgaggaaaccgatttcttgcctgaccttctaggtaagtcagtacaaacatatacattagactcatctgcttaaataatctcaattcttataaaagtgaaaagcataaagcttctgctacaaaagttcctatattgacaatttactatgttactgccttgagcaagcttttaacaaaccaccaaaggaaaaaaccctctaacccttcatttacaaacattggctactctaatttttcaatggtaaacagaccagagttattctaagaaattatgaaaagcaatccatttcgaagtcttaaagcaaatttagagactgtcaattgaaaatacatcttctttatgtatactctctgtattcatatacacctgtcagtcttaaggcttatttctatctggggaagataacctgggctatcatctctctctcagtgatattcactatctgctgacattttcctcactcgagaaagattagaaatataatccattcctatatatctttttggtttatatgttaaattttgtttatttaggtattcaacatgtatttgtagaggtcttactatgtgctagacactattctagacgctggcatacaggagtaagcaaggcagacagtatcactgctctcatggagcttacattgtagcaggtgagcagataagacacaaatagatgatgtcaagaagaaggaaagactgtgaaagattctactatttcagatagagcagtcagagatctcttttacagagctgacatttaaatgagagagtaaaccatgtgggtatctggggaaagaacatttcaggtaaattttcctcagatttgggcttatacactggggagcccagaaagaggattatttctcctagacaataaggatattcttaagtgactagaagaaaaaaatatcttgcaactagggtacacaaactgaggttatggtgaaagtcatgttttctccttgtcttgtatcatgtgatatttgatgacaacatgcatgcacataatactttcatccattagttgctgaagtctcctgttggctcattcctatgtactcagtcctcatctagtcaactaattctttccatcttttctttcatttgtttcagactccttgttgccccttttcttattccaaatagttgaatcaaatcttgtttcccattcattcatgcactttcctccatgaagtttcagttatgtcttcccaggaaggagtttgagatctttcaagctcacatttcaaaaagcaaactgagggagggggaggcagggatgactatcatcagagtgctctccatgctgctggggatattcatcttcttcatctccatatgcccagtgtctagcttgataaatgcttgctgctgccaagtgcaattagaaggaccttggagatcatctagttaacctcccactctacctaccaccagaattcttggcctagaacatgtctttgtagttctttagttcttccacttacgaacataataacgtagctaggttgcttattgatttcccagtgtccatagagaaacactgaggcatacaaaaatcaaatttagccaggcaccagaattgaagtttagaattttcattttctttcttaatagttttataacttttccttctggcttccttatttactgttttcttgtttaaacatgtctgtgggacccccaaagcactgtacagctctgttaaatatcattatcaattaaaaggtcactcatccctaaaatactgaattagaaattacttcaccaatttgtctttcctttaaaaacatttcttgattaaaaatgtagtgcccatccacagactgcactaacaccagcccatgatatgtgtttagtgatgagaagcatttgctacctaatagaaaatctaccagcctcccagctgacagaacaaagtaagaggttcaaggcaaataaagcagtgcagagaaaacctgttagcagtaaaacattacctgccatgctaggatggctcttccttcccatttcttagctctgaaaacttataaatcatcttttggggagaaagaacaaatatccaagaaaacagtttgcttttagtacaattctaaaaaatctaaagttcttaagcaggctgttgtcacaaagaaattctaagaacttcggcactaacagaatagttacaaaatgaatatcctatttttgacaccactacacatgtcttcatcatttcaaagattaggatccattttaacctagcattttttgaacagtaaacatgactaaatttagcaaatagtagtaacaaaattcatttagtttttaaaagtactatcagtaatcgcagaggtttttttcaggttgtgaggaataaaagtcaaaaatatattaattttatattgtagctataactcaaactattttatgagtataaataacttcagtatacttgagttgttcttgctatactgataatcagatacttaattccctgatacactaagggaaatgtgtatgaatgagaaattaaactgtttgggagactgttgtaggaattcacattatgtttactttatatctgctattgccaaattcaagtccaagccaaaagcagacctaccttacttaaacataaaataaacacttatttaaaaaatcaggcttagaggtgaatagtctctattacttcattactatgccaagaagagggaatatataaactgttatcataaagttccttaataacttcaagaaaacacaaatcagaacttaaccactaagcatcacccatttcagaatagtcaccctgggaagctattcacttattccaggcatattcaaaacagaattaaacattttctgtagaaatatctatgtgggctcttttaaaaaccctcaaagaaaataaatgttatcattcgagagaggattaaatttctaaatatctggcaatactcatatgatttggagtcacacaaataaagctaagggataaatacattttctttgagcaagaacagttaggtgttactatagtgcaatgagtccgattttcttttatggcttacaaggtggttctgaaggcagtttcaaagaggagcaatatacatagcctcctaaggtggaaacttagaacatttattttgggttttctgttttaaaaaaaaaactcaatctattttatagccatacactttgtccttaataaacccagctgaattccagatgacaaatttcacataatgttctgattaaaatttttttaagtttccatctaagaaagctgcctacaaacttaggttctacatcggtatgtttaccaatttaaactgccgtttaataattctatgctttcctctgcttttataactttggtttaatagatcaaatttgtttaactgaagtttttttcaaccatttgatcaataaagaaaacaagtcagtgcagtcaagtttcacaatcctcccaactttatgcagttaggataaattttggtattcaatatactcaagagctttttcagacagcttcaataaatgtaataaatgtaaaaaaattttaaacctgaaaatttcattcccattttcaggcaaattaaggtttccaatgacaaagaatctttgcatacttgattatataaaaatatcagaataggaaataccagaaagagaatactctagcatttattaataaaaatataacaatgtggttggagttatcactatggctattatgtagatggcatacttaatatccctcaacaaaatccactgaaaactttgtcgaaggcgctttcaaaaaataataaaactgaaaaaaaaaatcattgtgaagatactacgttggcatttgaaggctttaaaatacagcagtctttatgaaactgcgatccatgacccttcagggattgcacatagcagaccctaaaagattcttgattataggcaatacctacaccacagtcacagatgtcataacgtacttagccaatgagagtcatgctggtttaagctaagtggacttggcagagctttaaaaattccaccttgcatttttataatgctttttaattttcttttcttttttttttcttttttttgagacggagactcgctctgtcgcccaggctggagtgcagtggtgcaacctcggctcactgcaagctccgcctcccaggttcacaccattctcctgcctcaggctcccgagtagctgggactacaggcaccagccaccatgcccggctaattttctgtatttttagtagagacagggtttcaccgtgttagccaggatggtctcaatctcctgacctcatgatctgcccgcctcggcctcccaaagtgctgggattacaggcgtgagccaccgcgcctggcctaatgctttttaattttcaaagtaaacgtacatgcacaaatcctgtcaggtaaaaaccctctcactattttacagaaattgaaactgtgacaaaaagcagtaagtgactttacaaatatatgcaggagagcagaggcctgatcctttatattttatttaaagattcgctgttgacaaaaattattaaagatacatgaggaactaacatacccaatattaaatatttcccttcagataagtgttaaggtttcctggttttttttttctttttctctttaaatgcctttagttttcacatctgtaaaattaaggtaaataacagctgccttctgtgcttcatggatattgacagaattgagacttaatacagtaactagaataaaaactttcacagagttgagatttaaatgagatgaatgcatgcaaagtgcttagcatagtgctgtcacataattggtgcttaatcattattaggtaaaaaaaaattaacaaaatgaatagagaagaatacagacactgtatattttaaaaatctaaatgagtcaaaagtaactcttataaaatatgtggctagtctgtattatgtcaatcaactatttgttccagatgtctagaagagacccagataattaaagaagcctaccagggaacttagataactaagaattgagatattcaaactggcaacaccgctcattaagtgttttgtgatctttacctcaacactttctatggatctcaatttctcattcgaaaaaattagggggtagaattagggaaactctcaagttcttttaagttctaatctaaaataactgtaacgaacatagaaaacaagctctgagaacccaagagccccacctctcgggtgctaacagcagcaatagtttatttttatatatcaccaactacattattttaaatccttatcttataaaaacaccaaatctgcattcacatctatttgtcttacattcgataatctataaagaaaatgtcaaagaaccaactttgttataccattccctaccctaattacttccctcatcaaattgacgggttaaaaggattgtggaattttagaaacacacacacaggtgttttgaaaacaattcaaacacagttgtaaagaaagtatttttgactccaaagtacctagttggaggccatggactgtctcccttagcattagaaactaggtctttggacttttagttgagtatttttcttctgtttctactactgaatatctaaatcaaattctttggaagggatggttaaaaaaataaaaaagcaaaatctgcaatttaaatagtcttaaaattaaggaagctcttatcctcaataattataaaagaaaacattaaaacgataacataaagtaaaacagtgtccataacaaactggtagagctttagtgttcagcatgtgacaatcataaggtcataagtcacagcactgccccaaccagcatgaaataataaatcatgtagtgaattgtatcatttcataatagctttcaaaatttggctatcaaatatactttcataatagccacagctaaatattatggacagttatgaaatcaactagaataaaggctaattttattgtaaaaagaaatagtaagttaacactttttgcaacaaactatgtcttaaacactgcatacttattgaactctcaaattattagttacaaaaataaaaattcaaggtaagataatgcgtaaacatttacaactaatcatatcattaaaacttttttccccttatatatatttttggtgccctacagtgagaatgaaaaaaaaattataaaacaacaggtactttcactgaacttgctgcattatagacaggattaatgttgttgaaacttgctaaaaagaaaaaatatttaaaagcactcgaaattaatacttgggttactctgaaaaagcatgtttaagcatgcagctctattgggatgtaattaatatttaaattggacaagtgataaaattcggggataacacactttcattcaaaatactgaatttaaggaatgtattgcaatataaatggtttaagtgactgtctagcacttgcagaaccccataatttattctgcatattatgaaaaattaattttctcaatattccagcagaaaaatacataacccatagaaatatattaccaaagaaaagggttgctctccagtcagttgacaatggctgtaaaagggcactatgatatatgaaatgattatatcaacattaagacattaggtcgactacattcaagtcattagattttcatttattaaacagcagcttaaataaaaatgagaaaaatatgaacttaatcttagctaaaataatcttcaagtaaaatgtgcattttatccttttttgataataaagcatagtaagaaacaacataactcaaaaattagtattatatagccatggtcagttttagatttctacctgaaataaaagaaattaaattgtaattctgattgatgcattcccttgtacctatagtcctaaatttttcttttcttaaacctctaattcatgacagttgatccaaactgttagttttcagaactgatctggatattcctaaacttatctatagcatcccacatctctgttgctcctccctcttcaccctccacccccaattaattcatgaactccactggaaattctgtatttagagacatttacaacagtattgagcactaaggaaagcaacctgtcacaattaggtgtctgggggttaaaaccactgtctacaaataattttgaactgcaataaaattctatttctttcttaatatgtaaaatgaacaaaaatcaccatcacaagtcacaccctaatctagtttagcatagaaatgatcacacataattcaacagggaaaggaacacttagtagaccttttcttttttaaaattgaaattctcaataggaatattttatttacttgaaaaatacaaaacccaagtattaatagaatatgccagaagaaaataagagcagtcggctctctgaagctgcagaaataaggacagcatgggcttttaaaaatcctttctaaaggtcaatatgtaatggatttttttttgtagttatagcttaattcaacaaaattttcttgaaaactctttatgcaacaggaatcatcaatgtatattttccatgactcagaaatatgaaaacaagtgcccattaatctggcaaatacctgtaaatattgcattacacaattactcttgatgaaaatattaccaggatgtcctcagaagggtaaatgctattcagcacaaacctattttgcttatttaatttgcccacctaagtactagtacacaatgagaacccactgctcattaaaattaggaataatcattaaagtaaaaaagaatgtgctttaagaactaagcctaagcctcagaccttgtctaagcttaatgtaaattaagatttcctgggctgtttcagtcacctgcaggccagagtagactaagatttatgtaactaaccaattaatgcagatgttccgactttcacattaggcagtcacattaaagtaaacccttttgatccaatctttccttcactaaatctcaaaaggcccctaaagtgatctctacccacatatccatttcactattaatacaatttgcatttaacctacatttatgcaaggtatatttcagaataagtctttcataaaatgtataaacattaaataagtagcaaaagtggtcagactaaaatacatgtaacacaaatagacaagaccaaaataacatatgaattatgttaccaattataaaaatacaaggggactagccatagaaacatcgtaagtaatttcaataaaatctgaccacatgctagtcacatatttctgcattagtcatttcacactaaaatgacacacctgaatacacagtgtgttttaaaaactttttttactaatcatgtagccataacaagttacagatttaaaaaataagattctcatcataaagctaaaaataagtgaaaatatatttaaaaagaaatctcctttaacattcagaaatcactttacataaatgagtaccagaaatattaagcttaaaaaacactgaaacacccattgccagaatctttagaaggaaaagaaaaagaaaaaaggtaggaagtaaagaaagtatccatgggggtgagggtaaatcacagtcaaaacaaatctcttctcttcgtatttcctctttttctgagaaaacattcaacatgatgttagcagaatttgcttcattcattctgtatttgtacaggtcttcaatttcattacttttataaaaccagatacagatgcgattactaatgagacattaaaatctacataaattttagtagcttcattaagtgccaatcatcacttaattttagactctgccgaaaactgaatttacaagttcatcctacatcattcattctctccaataatccctcccttcaggatacgaacaattttttaacactaaaatttcaacataatcccaataaaagctctaataccacctaaaaccatttctgttctctacctctgtcattaatgcttaaatgaaacaaggctgaaaatcaaataatgcagaaatgtgccttcgtcaataagtttatgctaaatgtactgaacttcagtatttttaaaagcatattaagttagaatgactagtttgttttacttaaagaatagattttgagaataaggtttctcttgttttactataaatgaacttagaaaatgctttactaagctcaatcataatattcataattttacaattttatgtgataattcaatgttgtggtggaaggaaggaattgcctcttcccacccccagagaataaagtgaggatttttttttaagtattctgataaaaacaattttaggtggcattttaaaaagtcaaattgcaatttataactttttttaatttaaaaggaattcaagttattagtggcatttaatatttttcttcgtaaagtcagaaggtcagtattcaagttgtggtctcaatgtgttgattatttgctgatcactcagggtcactggtcatagcaaatgtttggctacagtcatgtaacatatagagaagagaaagcaactaattttagctatatcagggctgttgtttggaaacaatagactaattcaatgatggtttaaaagaaacactgtttcaatttatttggatgaagctttgttttgggtaatcatagttcccagtgctaagttaatgccataaggtataaaatcttcaaatattaacaaaataccctgtataaagtattataccttcttgttaggacacagactactgattatatttcccaatcacagattggcataaaaataataatttcatttgatattaaagaacttctaaagagccgcatcatcattgccttgcctactacctccataaggttatgggacccaaattaaaaatacgtaaagatactttatgtcatgaagtactataaaagttaaagcattaaaatcacctttagtgatttaagagtaactatgttcatctacttatactctatatcccagattttatagggtttaaaagttcatagcaaatggaaaataagttttgtcccttgccttttctttatagtaaggaaaatgaaaaccatgccatgatgattatcagggcaaaatccattaataatccccaagagtttcctaagatgttttatttttctttgtataattacatgttttataaatcaatttaagagtttcctacagatagcttagtcaaatcaaccgtacttaactcttttaagaaaaccaagtatgcgaattctattgccaaaaatttgcaattgaaaattttaaaacacagcatgtcttttagcatttaaaacacaacagcttatgcaataataaagatctcaaatctccttactgaaaagattttaaaccttcaactcaggttgaagtagtgttcttctaaataaaggataattatttaaacaatagattaggaggtagttcacattaagacatgtaagaaccaaggttttttggtttttttttttttttttttgacaactaagccttttagaagaacagaacatagcctaaatctaattctaaattatttccctaacaagaaaagcttcttaagtacagaggaaagaaaagagacatcctccaggttaggatagctttcacagaaaaaggattttcaaaaatctgaataactagttaatgggaacgatgaatatcactaacatttaagaaaaaacttcaatagttacatacaaataaatcactgtctaccatgtcttcttttaaaaaaacccgctgattaatcaatcttgtgtcactacaatccacatttttatattttccttcacaactaaaatggatataaaacctagcatttatctgaattggggatgaggttacggggtagagaaattcacccctaccaacacgtatatctacatttagaacttttttctgataattccattttctgacctttttgggtcagacaaaaatatcagtatgcttataaacgactgagtaaaaaaaagagaaaaatcaaacgaaagctgaaaattgaagcttaacaattttggccatcagttatctacttgagaacttgcaggaacatttgaacgtaaaattttgttttgcaccatgttgacaccaattcctctcttaaagagattgatcagcagacataacttgtctactttatggcaagaaccctgtgagcaagacctgtgtctaatactatggtctggtacactgttcactgcattgctttagcaacttcaaaactcaaattctttaacagaagattcagtttgaagaatagggctctttgttagtacttctgcttttaactctttaatctcaagctaacacttaacgaatttacaaataaggcagcacaacttttgactatgtaagtaagggtatcatttattgtaatataagaacatattctaaaacagctgaatgaccatgcacaacacaatatgatattatgagacattatactctcctgaatttatataatttttcgttaagatatctgttaatgagcaacattattttaaaaatgttaaataaaatcctcaccgttggccaatgggatactgaaaaccactatttaaggaaaaaacctgaaatggttacgtacagatgtcacttaggttgtctacctttcctactttcaaaaggccacttaaacttattcatataaaaaagcacatgaatctttagagaacacatataaatcaatgaagatttacatctattaatctaccttaaatgtaccattcttaagaaacagaaaaacactgatcttaccttgaatagccattagaaaaaactgttcgaccagggaagttcagagtccccagagaagtcaagttgtcatctccagatccttggcacctattccaattttcggaaccaacgggaattggtggaatgacattaaaaataggcttctgatcctgctgttgagaaagggatgctgtattcatgtcatagtggtacatctgtcctccagaggtactcacaccatgaacagaaatggcagacattttattaccaattatatttgctccaggaaagcttgcctgacagtaaactgtgcccagtttctcttgcttaattaccccaggggtgcagagttcgatgaaatcttctttttctgttttcacttggggcagtgttacattactggggcttgacaaaaccagatctccattatccttaattttgggtttagtgtccggtaaaatgagaggcttgcagtcctcattcgagtttccttccaaaaggaatgaatcgtcttctcccgccagaggagaaagcaaacagttttcatctatcaacaggtctgatctccaaggactctcattcgtctctttacctggggacccagaagaaaactccaaatcctgcaaaatgtcaaaggtgctttggtctgtggtatacaatttcacattgccaccgttggtgccagtctggcccttcaaatgttgctgttctgaagatacatcagagtgagtttttggaaactccttctctgtgggggcagcagacacagcagtggatgctgaactcttggggttctctggaacactggtcgacctattgaggtttgcaatgctttcttccaaaagctttaagtctgtttcccccgaggaaaggctgatttggccctgctgtgggaatcccaggtcatttcccatcacttttgtttctgtctctcccatatacagtcccattgagagtgaaactgctttggacagatctggctgctgcgcattgcttactgagccttttggaaaatcaaccaaaagtcttcgctgcttggagtctgattgagaagcgacagccagtgagggtgaagacgcagaaaccttcacagtagctcctcctcttagggttttatagaagtccatcacatctcccctctcctgagcaagcacactgctggggttttcttctctaccaggagttaatgattctttggagtccatcagtgaatatcaactacaaaacaaaaaacaaaaacggggggaaaacatcataagctctaaagtcacattatcttcctgatccgattagtaagaggcagcttgttaaatgaaccttttagttaactccgaatcaaattctttgttaccagaagagtagtttctatcttccagaataaaaagccatgtcccctgctcccattcagcatgccacatttaaaagtacaatgcaatccatttgcacagctgagggcaaaagtgtatcgaactaagcttggctattcatcctgccgctcactgaacgtgtagctttgttaatcacagacattataattcattacatctgattattctgaaggttcaagttgatgtcaaagtatttaatttcaaaaaaaggaagtgtgatcattaaaattcctacctcttttcaatcacggctgtttgcttttctgagaaccaatacatataacatttgataaatactatgctagaattctcaatccctaattacttccaaatttccctcctaccagctagtcacacatccaaacctttgagtacaaccaactggtgaaccatgcacgttttctttgaaaaataaacaatgctgatctgcttatcttccgacaggctgggaaaaggctttttaacccatacttctgactggatgtgcctacctccaaattttggatatatgaaatgagatacactttatataggccaactaaaatttagattttaaagagcagaagagaaggtgtagtagtttctcactacgttgttagcttacataacttaaatatagctgacccttatcataactcacaaaaacatctagattaagctacatttgtttacattgcttgagatcctcaatatgaaatgctattacatctctaagttctttcctttccaaacaaatatcgaagtactgaaaaatggaaaaacacagaaccgtaaaatcacattcatataaattcaggtacaactgtatccagtaaaatgttcaaaataattttctctgccttcacctatccaaaccttcacctatcccaattctcagcctattctcaagagagtaagactgttagtatatcgttaatcagggtgttttaagagatgggctaagacggagaagcgcatttgggacactatagtcaaatcccgtccaataaaaggtaacttttcctatgcgatgacgttaggcagcataaatgtcactggccctcactgaaaagtgaatatgaaggtagagagaggggtgtggacttgccactacaaatcttgagggtaaactgcttatctccccacctctctgccccgtttatctgaggcgataacgatctctaaacacgaggtatcgaatggagcccaatgaatttccatgccgcttttttgacagctgccttcaaacccgaaaccaaaacaatatttcctaaaacgaaaacgctccctcaagcgacattatcccccagtttaagttgcaaataacccagccacattaattggccctaatgaaccatgccagagggtcttaagtggtattacaaggttgcaattatcaagtctgcaaccccaaacgtcaaactagcacttgtaaaaatcgcagcacaaaaccattacggttacagggggtctttttctaaaaggggccacttagaaacctcaggcgcgaattaacaacaaacgctaaagagcaagcccttgcggggcgggggtggagaagagaaaaaagtgcgaggttaaaagagaagtacgtccagacctgttgagttctctctccgacacgcccacttctaacagataacgccggccccggccgcagtctccaagttgcgggctgtcagccccccgcgtgtgcaccctcacgcgccccgcacgccctcctcaagccaggcgccgccggggcctccccggagcccgggctcgcgctcgggcgcgccggggtggcgtgcaaatattcgggcgagtaaaattcagacgcggcttagcgttcaccacgaaaacgggtgtcgggcgacccccttggagggaaaggggacactagggggagaaaagaggccaggattcccgcgaggaatgagaggctcgaagcccccggcagttcgacagggctccgctcgccgtccgaggtcaggttcctccccctcggcccggccaggggacgcctgcggagggagaggaagaggccagcgctgtcacccgcgcgctgccctttcgtcaccgtcgcccggcccttgccagccccccacccccactccccgaggctaataaaagtttgtaggctcccgcggcggcccccgagttgtctccggtcccagcggcacctcgggggagcgagcgcgccccggccccctcccgcctcgcttcttacctctggcagaggagccgctcgcccgccaccgtccgcagttcccgccgcagccgagataaacaacttagcttgtgaacgcagaaggagcaggagggaaatatattttttttttctaaaaaaaggaagtaaacagccgcccctttctccatgggtggggggagagcccctatttaagaaagtctcccattgcccagctgacaagccagccctccgccccgcgccgggctccgcgggtcgaggttccgggcgcgcgtgccccgtcccggtcccagctgcttcggccgctccggctgcggcgtctccttccacccacagaatccgtccccgacgggcaggcggtgactcgggctcccgtcacagacacgagctcgcaaaatggaggaggcggcggcggagggaagagagcgcggacacgcgaaagggcagcccggcctgggcgagcgagcgggaccgagcggggagcgggtggaggcggcgccacggcgcgcacacactcgcacacacgcgctcccactccacccccggccgctccccgcccgaggggccgcgcggcggccgcggggaacgatgcaacctgttggtgacgcttggcaactgcaggggcgcccgcggtccctgcccccacgccctccgcgcgggccccgccaccccggccccgacggcgcctgcacgcccgcgtcccctggcgtggccgccccgcccggtgcgccgcgcttcgccccccgcccccaactccccaggaaaaagggtggcggcggcagcggcgggggccgacctggtctctctggggcggcgttaagagggccaccgagtttctccagtttcttttctcgctacctccttcccgcccccgcccagctccgcggctccagacccactcgggagctcgctctgccccttggcggcaagcgccgccagtgcccctgcgggtgacagcgggcgggccacaagagccggggcgcctcccgcggctgagctgcgtgagtggcccgcgccgccgccgccgggccgagttgcgtgaagtgtgtcacttcgaaaggggctacggggttgcacggaaacggtgccgcagcgtctcggccgcgctcggggccgggcggcctgacacgccctctggggaggcttcagggaagggacgggatagcgggggtcggcgcatacgtactttgggcccggggggagtcgcgtgccggcaggtcccccaccaccgcatcatctgggcggccgggtcttcagctgccgccgccgcgctctcgcactgggagagaagttgcaaagcagaacccaccctcccccgcgccccgaccgtcccccaccctcttccccgagtctgcgaggcggcggcggcggcagaaggaggcgccgcctgccaagttcaacccccacccctcccgcccaatgtgctcacactcgaaggaagttgcacgccaaatgcaaaacctccagcgagctggatttctttgcactttttttttattattatgattaaggaaagcagggggcggcaggcttaaaagcaagttgcaggcgaaatagtaagttgctggcgaaatatagccccccttccgaaactcctgacctcttcttccaccccggccagggcccgcgtccaagttcccggtgcaggccccacccccgaatcttgacatttgctgccctcgactctgtgcgttgctcaccctatcacgttcataggacccctgcccctacaaataaaacaaaatacaggcagctttaaaatgccagcgttcaactccctacagatgttcctgttaggagcttccccctcagtccaaggggaagggaactcgtggtccgtcctgagaaaggagagggccgtggggcgaggggtgcccgtgcgggaagcccccgccccagctcccttccccagctcgccgcgtcgggaaggcttggacgatgccgggaccgagcctcctaccttgtgcggcacagattatgatttttgtgactctgggaaaggttgtgctgtgtgggtttagggtttggggaggtaacttttgcgcccccacaggtgacatcgcttgccagctcctgacacgggcgggggctgccgcagctccacctaatcctgctcgggcgctcggccacagccactctctcacctcccgccgcgctcagactgacggcggctccccctgctctgacatcttgaagacgattggggaagcgcgtcccggaagccgcccgccgccatcttggtagggtacagtgtcgccagcccgtccccgcggccaccatcttggcaaaggttcgcgatcgcgggtagcctaagccgtccttccttggttctcaagggtaaacggttccctgtgcattgtctgatgtgaaaggaaagaagtaggctttcagcaagcctcttgtccggagacgatctacgggggccgcctccagaggattctggagccgccatcttggcaaaggaagagatactcgccacctcggaaaagaagagggaaccaaccgtatgccaacgtagaaccctcagccagaagaatttttatgaagggcgctgagcaactccatgttaacaaaacccccttctggacccagaaggcagactccgcttctcctgtcccttggcacaagtcaactagaaggaggcccttgctttggatgctcatctgtgaggctatgagaacactgcttgacctagttgcccgtttttccaatttctgagcctcaagcactagaatgagatgtctttcgttaatttggcccctaaactaccaacagtttcatgggaaacaaatcaagacccaaccctacaataatgttttacacgttttaaaagtgagttaaatagcccatgctaataattatccttgtacactgcttaaaatgattaagaattctatttatatatacatgtatgtatacatatgtatacacatatatattatatacatatatatgtatataattaaggggacaatacagttgtctaatagaacacatctccccatgccattagcctgtctcactgctgaatctctgctctaagaatccacctcatcgctcatacatgctcaaatccttagtggtaggtactctgcttaaataatttatgatttcacaagagttcccaattattctcccttcatttttttttctctgcagatcttaatggggaagaatacgtagttttaaatatgccattgaaaacgtttttaattgagcaaaaaaaaaaaaaaacttatcctaatttctctcttcagcaatctaaatgtgcctgttaattttttaatttgatagcaaaaaaattctcattctttagtctttcacattcatttggaagcatgcatgaactataagttaacccctctttttcagagtaatacaaatagttatgatttgtggctaacatttattgatccccactcttctgctgcccacttttgctgacaacaattaaatgagataggtattgttattcgatttttcaatatgaggacaacaggcttacagaggttgatgcttgtctaagttcacatggctcctatgcattaagagaggaattagacaatattaaagtggttttcctcactgatctcaatcattaacatgaagtagtatatcaattctgatagactacttacaatatgtgcttacggaatttaattgaagagatgaactccagtgtgccagaaaggacgtgagatttagcattataataataacacaattctaacgaaagtcaacatttattgcgcatctgctgtctgacagacactattgaaagtgttttatgcacagtatcctaagtctttaggtatggcatttactaatctgtaaccctgggaacttataattactacaagaaataggatgaatccctatctgagtgggaaggtatttgattgtcttagaagcagaggtggaaatgaaggtgatgtattcagactcagtcaaggcaaggacctgatctatcttgtcatagctttatgtcccactcctggaacacagcccactacatagcaggcacccaacaaatacattacagggttataataacattgagtcaactagttaactagatgtaaaatcacttttactgggttattgttgtggccaaatgggttaataaaaagtgtacagataaccctcaagatcctcatttttattgttttgtgtttaaacatctgagtgctccccccacttttttttaaaataaactagattagattcttgattgtatgttcttatagtattctgcatactttgttagcacattacaatgatagttcattatttgtgccctcatttgttatttctctgtatcacccaccagaacataagttctgcaaaggcagggactgtgtctgtttgttcacccctgtatcactagtgcatagttggtgctcagtgggtgttggttaaatgaatgaatgaagataatatatggtcttagagactatgtcctaaggccaataaaaccttaagcctgactaataaccaaaccacttgatacattgatttcagaaactgatatattacccaagtgagttctcccattctcttcatgttttgtcatctccattcccactaaaataatccaagctgtactgccagattacccctccaaaacatcaactaaatcaggctgtgctccttctcaagtatatacaataactcttgattctagtgctacacagatcccaactcccagtatggtatttaagatcatcacctttacctacccctttgtagaaagtgaagccttctagtggatgtgattgaactggagtttaatttaaaaattagttaaaagaaggaaataattttaagaaagataacttgcaaactttaaacttttgaaacttttgaaacctaaaacctgtgattgaacatttattttctaatcttttgatgaaggtctaaagcttttatgagcccactgactggagttccatgtcttctttagtgtgtgtataaactatacctgtaatgcattgatatagtgtagcagttaaaagccagactataaaggccaaatacagtctccaccactaaaaggaatgtaaccttgggcaggctaactctctgtgcctttttccatcatctgtaaaatggggataataatagtactgatttataaagattaaaccagtttgatatatgtgaagtgcttagacgaattcctgggtcataggaagtatttgctcatcattagcaattattattcatctgtagaattactattttcccccttttttttaaacaaagtagaacaagaaattaaagatacacattcagtatccatgacctgaaatgcttaatactgaaagtgttttagattttggatttttttttttctgattttggaatatttgcattataatgagatatctcggccatgggacccaagtctaaataggaaattcattttttgtttcatatacaccttatagcctgaagataattttatacaatatttaaaataatttggggcatgaagcaaagtttgtggtaagtacttccatgtaggatttttcatttgtggtatcataacaatgctcaaaaagttttggattttggagcacttcaaaattcagattttcaagttagggatgttcaatgtgtacttttagaataattttcgtgcagatttctaaatttttatgattcctcactcctgcccccacaccagtcttttaaaattgtcttacatccaccttacttgacgcaactgtaagtcaaggaaggctatagggcatctttccatttagattttatagaacaattttttacactcatttcatcattttacttaatatttaatcaaattaagtaagtacagtaataagcaacaaatggcataaacatgtttgggaagcaaaagcaccaggaactgttggtagctcaactggtgggagcagaatcgtgtgaagtgcagaagtgaccatggttccagtgttcagcgcaccctgggcatcaatccattgttttccagggagactggagaactggatcagttgagatcgatattgagtagtgtctgttacacgattctgttaaagaaaggacataagacaccacattcattcccatgtctcctgttgtttatcacatatatttcctcttacataagcatacttctttgtgacttattttcctatagtccgtgattctttgtcatggcttcagtttccatttattctttttttctgtactctctcactttaaatgtgtgatgttaaatataaatgggaaccatgtatacgtgtattgtgtacatgtgtattgtgtattttgaacatgttaagcccacacaaacagcttttattggtggttagaacttactttaaaaaattattcctgcagctatcatagctattatttgtctctttaaaataatatcttgactttggaaaatacttctattcctatttaactttataaggtaagaggttcaagggaacccagctgagctttgaatgagccatctctgtctgcttcaatatttgtattttatgccagacatgcctattataaacaattcacactagtacagcaagttcttaatcataatgaactccactttggtattcctcgttgtaattagaattaacattcccgcctggactgggaaatgctaaattattactagctttcctgctgttttgctgtctttcatgatgctttcaatgatttcatcataagcaacctaaaatatcacaatttgtgctcatatgcgtgaaatgcccaatgggtgtcctggttgactttattctttatgctggcagaacttagtttaagcaatacctgattcaaggatgaggcagctatcagcagataaatgagataaatgttgccataagcaggaactcaatgtttttaatgtttggaggcattagagcaagcacactgaataattgcaacaagtattacgtactttgttttttcatttgtggcatttgtggctcctcatatgtcattagctttcttcctttcttgatttaatctccttttctctcccatgttcctttggtaaagagtgtttcaatctgccccgctgctatgtggaatctttcagctcatttgagaacctgcatttccattttggttcttatatcttcttattagagcacacagggttttgttttgtttttaagctaacttagaaatagtggggttgagatgaaaacattcttggtatagggatcccttaacaagataagaagatacttcatatcaaactccaaagtgctacaaaggacatttgtcaccattgaaaaaaaaattgttttgagatcagtatttgtcaattaaattttctctatcctcttgttgaattttcaatacaagacctggtttttagaccctattctgccatttacttacttgaatgagcctggggtaggcatttgatttttctcagccttgtttttcaatctgtaaaggaaggataatgatatctaccccacctatcacacaggaagtaatgtaggccttacatgggatcatgtgttcaaacgtttttaaacactaagctttatttggaaaacttagaggagcttatggaatttttgcactatcacttcaccacaacaaaaatgaaaattatcattgtctcttttcacttatttcccagggaatcagtgcaatgggcagtctggaattttaggcaggggagtgataattcagtagtgcaccggaaacaattgtaccagcttgcaagcactgactgttaaattttcagagattttgtaagttggttgttaatcacagtcattattaaaaaccaaattatttataaactcacaatcaaatattttaacaacaaaaataaatgctgaagactttactgcctaattattttactccattttactattatctatgttcttaaagttatttctgtctgttctgtataagaacataccatacgatggtatgatgcagcgtatcccttcctaacgctgcattcagaaatgttattttggtagtttgaaatcaaccatggtggagtacctatactatagaaattgggaaacatgacaaaccagagcttgatttgttttgttgattgtctagactgacagagtagaagaaattttaataatgaagattgaacttaaaagtgccttagtttgtgaacacaaaaacttgaggaaatatttttctagtacttgaaagctattatcagcaaaagaagtcacttctgtcattaatgaacgagtttagttccaacatccatttttgttgcttcacttttatctcgctcattaatgtaaaaatatcaaccaacattcatgttgggacttcagtaccatgaatgacttctttgctgattggatattaatcagatatttatttgtggtctgattttgccaaacgtgtttgaattttagctgtaggttggctatggacacaaatattctgcaaaaatcactgaaatggttctgtgaaaatcacatggccatatagaatttactattaagagtgttatattttttcttgctttttgtaaattatgtgatacatatatgtaaaaattataaaacacatagatactctgttcccctcaggagctgttaaacatttactaacacactaatggacataatctaatttactatttgaaaagctcgttctgcttgcgatgtggagtatgagttgtaggggctaagggagaaagcagggagagcagtgaggagacaggcacattggcccaaggaaagatgacgaagtttgtattggttgcaatggcaggggagctggggagctatggttggacaggagaggtattttgaaggccaaaggtaagcaaagcagtcatccagcagctctatgaaagagatggacttccaggaactttttatgctaagagaagaccttctggtgaagagtaagcaggcttagttgaatggggtgagtgcatagaaagctgtgccagagaaaaggagtcagggagggttgtagtaggaagtaggagatgttggcagttctaggatttcaaggtaaatatctttatatcagatggagaaagttaggctggattgttagtcaaatgtcgaattgcctcaaagtgcagggggggaggggggaggggaagccccaaataccagtaacatgttgcaactggaactcacatactaagctactcatctagtaatttcattgatttttgcccacatggaggggttatttgttcatctccatgccttgagcctatcccaatttatagtagatttttttttctcacatttggcaattttaattataaaactctcacactgaatcaccctgtgttacacatatattgctgtcccctttcatgcttctcacttcttcattcctatttttctttgctatgccataaagaaggaccctaccaaaagccaccctattgtcttgcctattagttatcagaaaacttctggcaaccacagttttccccactttccctgcttcctccattataacctacaatctatattccacattacaggtttttttgtttgggttttaacatttttcaagagaagttattacattttatggagtttaaaaaatagtaaatgttttgcaaaagaaagaatcatgtctccacattcacccaccctttcaaccctaatgaccagaagaaggaaagattctcagctatacagctaccaatgactaacactttgaggattcagtttggatatgttgtttactttggtcttctgatgattagctattttaggcatggtttcaatcaatcagggaatgtttattaatagaagagactttcttaattaatattctctccattcattccttcaacaaaagagaattccttcaacaaaatacaattccttcaacaaaatagcaactattatatgttaggccccagtataaggctgcagggatatcaaaatgataacaatctcttctctggaggaaatggagacagatacggttacaagtcattatagaacaatgcagacttacagaaatgtgttagatgcatagggcacttcataagcttcaagaagtcatctggtgtttaaggttaggaaaatgggtgtggatatggagatggtggtcacggagggtttcctagaggttagcaggactgacttgaattatgaagggttttcttcaagttatttgttttttttttctcttgaagataatacttctaatggaagcttgtagacaacattcattaggtcattttttggtgcatttataagaaaccccactgttaaaaacagagttttttgattcactgaaaagtccaggggaagtttaatttcaggaggcatgactggattcaggggctcaaatgaagtccaaagggcttaaattttatcccttagcttcattttcctgttttgttttgttttgttttctggaaagattatctccacctctccacctggtggcctgtggcacctggatttaacacatcctgccaggttagtaacttcagtggaaagagttcttttcccataattttagtagttgttcctgggaggggtttcactggtctagttggttcaaatgcttatccctggaccaataactatgaccaagggatgtcaggaatgtgtactatgatgggcaaagcctagctcaagtgcccaccactgacacctaagaatggggtacaaatgaaagagagagaagaggaggtgcttctccaaataattggagattttaaatttaaataggagaaaagggatttctgggcatgcagaaaaaaacccagatgtccatgacaatagctttttatcaaaatattaacagtgacataaacatcatattttacattttaagagaatagacatgacttaaaatgtttgtcagcaatggaaagaaccctgaaaattaagtatagttgttacaagttttattggtttcacttcctgcctttaatagaatgtgggtttgtactttgaaatttcaaatgttacacaaatgaattgatgattgctttgcagaaatagtatctccacttaattgggccttttttgggtgatgaagtgatgtttacaacttttaagctagttttatcgtcttccactgaaggagtttgtctcacttgaatatgattccaacaatatgatgggtataggcggctgcagtgagcctctgtctgcttattttgctccttctgtcttgacaagctgaatgtcacgcaaatgtctcaagcctctgcactgggcaggcaggaagccagaaccagtaatagaagcagtaggcactctgtgaatacttgctgattaattttagctccataggcctgatgggttttccatccctataattaccatcagcaaatagttattgaatgatgtccagcatatttttatttcccttttcttgatcctgattttcattttctattttacctctctgtgattttatcacgtgtgtttctgttcatcagactaacagagcctcctgtgattagtttataatcactcagttttatttctacctatgagatatctttatctgtctgtctaaatttgtctttgttatgacccagttcaagttctttctggaattagggaaaggatgaagtgtgaaaaaaaaggaattaaatagttcggttattgaatggctattttgtgcttgatgctatattagtacatttccacatttgctttacaagttagtctttcttattagaagtaatgcttaacaagcctacaagtactgactgggctcactttatagagaaaatggagagcagtgaagggtgaggaggttatgagttatggatatgacaaatggggaaagatcttacagaagagagattggggccatccaagaaaaatcgttatctttgtgtagacggcattagaaggatgaaaaataactttagatattacttatgcctttaagaaaaaaacttcaaaagatgctagaaaataacacatacttattgtaaaaatccaaacatacagaaggtagaaatgtataaaggtaaaaacttcctcacacaatcccattttgcagatgtaactatttttttctttttatattttgatggcaacaaatttgtaattatttttgagtttttatgtatattccagatcccccaccccattattcccctctttaaaaacttttattatgtgaaatagaaagtagaattgtgactatcagaggctgggaagggcagggggaaggggaggatggggagagattagttaacgattacaaaattacagctagataagaggaatgagttctgatgttctgcagtaccataaggtaaatgtgattaactataatttattgtatattttcaaatcctttttgtctatacatggatgcatgcatgcatatatgttttttaaaaacaaaaatgagattttactacatgtatttttcaacctttattcatcaaatgttattggacatcttttcatcttttcaatattttcaggtaatagtagcatagtataccattgttttaacctttccttattgaagtatatgtaaattgttttcaatttttcactattgcaagccatgctgcaatgaatatttttgtatctagatctttctgctattgtacaattattatagaattgaaatttctcaggcaaatgtgatttgcaacaattatcaagcacccaaaagtgctacattattgggctcattttaaaaatgcttgtccactacagctcattttctactttcatcttcctttagacattctagaaaaaatcaattagagcagtagtcatggatggctatgcaggacaggctactagctggagacccctcatgttttgctattgatacagttttgctgaatccatccttatgttaaatgcattaacaatttaagaggattggtttacatatgaactgggaagggattattcagggataccataatgcttgatggctgcctccatcctaccagggaccctgatctgccctgttgtggccacatggtagataggtactgttttacttgccaagtatcccctctccacatatgatactaggacctaacatttcctttggaaaactatcctttccctaactttggtccatgcgcttatggtggtattaacccatctgtaactctgcatgggccaggtctggtaatatcagagataggcacatgacagggacagatacaccttaattcttggctttctgggactacttggaaacttgtcttgtttctcaacaggaatagctaagctgatacgatgcaagcttggagcagctgtggtctaccacttagagactccattggattgaggtttgcaaaaaaaaaaagcaaagagatctggaaatagattcccaattatataatatgaatgtctagatcctaaggtgagggctgctcctagacttgactattacacacttcaatacattattccccctccttctcttcctcctccttcctcttcagccagctggagttagctaacacttgcatcagaaagggtcctgacatcagaagtaaaggtctaaaacatgggggtgttgctccttctggaagagacagggaggttaaggttaccagacatggaggatgaccccaaaagaaaaggggagcccaaaagagaagccagttgaatgtctaaaaataaactttacctgcttcacaagtttggctcgagtttccttttaatgattaactagatgagatggtcaaactccttctttatttaaaatacacaaacataaataagaatatcagtcttcagttaattcacctattctggttacatctgcctcaggtttctattttttttattaatacataaattgcttttctattttaggctgtgtttaaaaagagagagagagagaaacctggtaatcctctaagaaatgtcttacgtagtttttctttagggcctaaattattactctactttccatattgatccagccttttgttttattgttttgtttatagtagatttggtaatatattaacagtacctataaatatgatctagtggaattatgtattaaaatattttaatatcttcttagcatttgcgatcttgaaactgaaacttgatagctgaagaaaaagttccattaagatgaaaaatcaatcccttagtggaattaaatccacaatgcttatataaaacattgcttctgtcttatttacataaactttatacttctctctctcatcagtggcaggggaatatggagtgggatgtcattagttggattcaatagacatttatttacttattaggagcttgaaatagacttgagactctacctcctagtagacacatgtctttagcaagttacttaacttttctgaatgttagtttccttatctgaaaagtaaggttaataatattatctgcctcaggaggttcttatacagattaaaaaagatattctctgtaaagcatttagcatggtctctgacatttaattaatgcatggtaaagtaacttattattacgctttcagaaagtgagatagccctgtaggcacaccccaagcagaaagtacacgcccatacacaatacactaacttccttcaaacgaagccccttttctccttacatcatggattgtgaagggagcacctgtccaataaaagaaagattctgtaaaagaaatccaggcactggctggaaattttcactatatgatttatcaggcctctcccagctttgaggtcctataattctataaaccacacaagtttacatatcactgtgggatttgatccttatgaaacccaagagaaccataggttttccacatccagctgagcatgctcaaataaagacagacatttaaaagcatagacattgatcacgtgctctttaaccagcaaaatactacagccaaaagaaacagaagcacagagaaataaaatgatttgtttgaagtctcattgatttgccaagaaaccagactgaatgtgcaagctttcctaattcctagttgggttctccacacactaaacatagtgatatataatcttcagttgtcaatatttaccttttatgagtttattgcttgtcatgtgttaactcataaagccatttatttacttatatcagtgccatcaaaaaccctttaatttcacaatcacagtttgtgtaacgtagcagacaaagcactgggctgggacaagggactgggttttggttttggctttgtccccctttcttcctgccctcaactgcatgatttgggcaagttacttttccccttttggactgtttgcctttttctgcttaagtatctggactttcccttcccttctttctcaacccacacagaagtaattatgtttctttcattatctctaactgcaaagtttttactagacagcccatatttactggtcatctgctgaatgcctctgtgcagtgagctggagatagaggtaaataaggtatggcccctgccctcagggctttcccagttaagagggcacagggtgtgaaggggcacaggtcagaaggtgaaggcaggggtcagggaaggctcctggaggaggcagaatgagacttaaagggtaaacagttggtgctgggtggcaggcaggtagacataagctccagtgatgacacagattatgctgaaaggaagaatagtgttaacagaactggcttggacgagggcagaactagaaagaatccagactctgacactccaagttgtgtgaccttgacctagttacctctgtttcctcatctactaagtaggcataatgatcgggtttcctcttaaggctgttgtcacaattcaatgagattacatttgctaattttagtgcagtatttggcattactataggtcaaatatccctaatcccaaattctgaaatcggaaatgctccaaaatccaaagctttttgagtgctatcatgatgctcaaaggaaatgctcattggaacatttcagattttggatttttggattagggatgctctacctgtatgtattctgcaaatatttcaaaatctgaaaatatctgaaatccaaaacccttcctgtcggaagcattttggataagggatattcaatctatattactaccaatttattttcaccaacaacatgctgttatacctgttctcttgtcccctctttctcttccaaggacacgggcatattcataccctgctatcaaatatattttgtttataaatattttcagtaacacactgaaatacttatttgaagcactatgataaaagaaatgtggcattccatgcaatactttggggagtatcggggaacctgccccgatagtcacataggttcttttctattttccctaagcgtcagccagtttgagaaataaagggacagagttcaaaagagagaaattttaaagctgggcgtctgggggagacatcacatgttggtaggttccgtgatgccccacaagccgcaaaaccagcaagtttttattagggactttcaaaaggggagggaatgtacgaataggtgtgggtcacagagatcacgcgcttcacaaggtaatagaatatcacaaggcaaatggaggcagggcgaaatcacaggaccacaggacgggggcgaaattaaaattgctaacaaagttttgggcaccattgtctttgataacatcttatcaggagacagggtttgagagcaactggtctgaccaaaatatattaggcaggaatttcctcttcctaataagcctgggagcgctatgggagactggggtttatttcatccctacagtttcaaccatagaagacagccacacccaagggggccatttcagagacccaccctcaggggcatattctctttctcagggatgttccttgctgagaaaaagaattcagcaatatttctcccatttgcttttgaaagaagagaaatatggctctgttccccctggctcaccggcggtcagagtttaaggttatctctcttattacctgaacaattgctgttatcctgttcttttttcaaggtgcccagatttcatattgttcaaacacacatgctctacaatttgtgcagttaacacaattatcacagggtcctgaggcaacatacatcctcctcagtttaggagatgacaggattaagagattaaagtaaagacaggtataggaaatcacaagggtattgattggggaagtgataagtgtccatgaaatcttcacaatttgtgtttagagattgcagtgaagacaggcataggaaattatagaagtattaatttggggaactaataaatgtccatgaaatcttcacaatccacgttcttctgccatggcttcagctggtccctccgtttggggtccctgacttcccgcaacaggggagatcatagacatgctattaattataatggttttccctagaacactagttttcaactgggtgattttggccctaggggatatttggaaattcctggagacatttttggttgtcacagatggaaagggagaatcttattggcatctagtgggtagaagccagggatcctgctaaacatcctgcaatgcatagcacagccccccacaacaaagaattacccggcccaaaatgtcaatagtgccgaggctgagaaaccctgccctagatgtaacccagtcactgcttcttttcaacaatcattgggaaacacggtaaaaccatgtttcttaagatcctaaattcagctgcaaaagtgtatcctttggatattttacacattttaacatctcctttgaaaacaaagtccttcagagaacctggtggaatcattccaactttttttgctacaaagataatggaaattattttattttatcatttttctcctatatgtataattcaggacaaattcttctttttttatgtggtaattttaatgaaattcaccaaaaaagatacttgattaaccctagtttgggagtcttttccagagcagagaaaattctggaaacttgcaacagtgtgggcttttctccaccatcacgggggatacaaatggctagctaccaatgatggctcctgtagcctctggaggagagtgctaagtgtcacctttgagttcccatagtcttcctaacactcctgccaaagtggggccaacaacagggggctcagaagggcttgcatgtttttactatccttcatcccttattttctttcttctagaagcaacatagtgattaagagtgtgggctccgggtttgaatctggttctgctgcttgttagctacagtgaccttgataaactccttaacctctgtgtgcttcagagtccttccctgtaaaatggggggaaacaatagtacctacctcacaggattgttatgaggactaagtgagttctcatgggtagagcacttaaaacatagcctggcacatgggtgtggaggctcacacctgtaatcccagcactttgtgaggctgaggtgggcacatcacttgaggtctggaattgaagatcagcctggccaacatagcaaaaccccatctctactaaacgtgcctgtaatttcagccacttgggaggctgaggcaggagaatcacttgaccccaggaggcagaagttgcagtgagccaagctcacaccactgcactccagcctgggtgacagagtgagactctatctcaaaaaaaaaaggacatagcctggcacataataagcagcaaataaatgtgagttgtttctcttactttttattcttacttgcttttgtggacacactgaagtaggctttaggtatgatatggacgtggtggaagttacatgtcattgcagagtatggaacacagtcacagccagggccagctggggccaaggtagggagtggctgaagtggtgttcactgcttcatcaggtctgcctcttttttagcctagcaatatcttgtgttttcccttctccatgatctttactaatacccagttttctcttactttccctggcttttcctcccaagtatgacatctcaccaagctctccccatctttaccttccatagagttttatttggctatttcttgaagcattgattttcatctgagttgcccatcagatcatttgggaatttgtttaaagtatagatatctgggctctgcctcccaacgatcatcccaagtatcttgattttagtgtttatttgagagacagtatggcatagtatttaagaacatgaccaaagagccaggctgcctaggctacgggttcgttgtatgaccttgagaaaattatttaactctctgtttctcactgttcttatctgtaaaatgggggtgctatgttctgaatgtctgtgtcctttccaaattcctgttgaaatcctaaccccatggtgatggcattaggaggtggaacctttgggaggtgatttggtcatgagggcagagccctcatgaatgggattagtgcccatataaaagaggcctcagggagcttctttaccccttcccaccatgtgaggacaaagcaagaagagaagatggctgtccatttgtaaaccaggaagcaggtcctcaccagataacagttctgtcagtgccttgatcatggacttcccagtcactagaactaagagaaataaatttctattgtttataacccacgcagtctatgggattctgttatagcatcctgaacaaactgaaagtaagagtgcttatctcataaggttgtaagaataaatgagatgccccttaaaacagtgcctggaatgacttttgtctttcttgttcattttcccttctctcttactttctcacctggcctttctttcttcattactttcttctctccctccaacacatatatattgttttattctagtggtttcatacttgcaggccttcgatttaggtttttaatccaatttgatttgatttttgtatatggcaagagatgacattggtctggccaaatattttttgaataagacatcaaaagcacagtcaaccagtgcaaaagtggacaaatgagatcacctcaagctaaaaggcttctgcacagcaaaggaaaccatcaacaaagtgaagagacaactcacagaatggaataaaatatctggaagctacctatctgataagggattaataaacagaatatataagttgtgtaaacaactcaataggaaaaaataatttgatttaaaaatggtcaaaagatctgaatagatgacatacgaatggccaaaaatactcaacatccttaatcatcagagaaatataagtctaaactacaatgagatatcatctcatcccagtgaaaattgcttctatcaaaaagacagggaattacggatgctctcaaaagtgtggagaaaggggaaccctcatacactgttggtgggaacgtaaattagtacagccactatggagaacagtatgaaggttcctaaaaacaacaacaacaacaaaatagagctaccatattacccagcaatcccactgctggacatatacccaaaagaaagaaaatcagtatatcgaagagatatctgcactcccatgtttaccgcagcactattcacaatagccaaggtatggaatcaacctaagtgtccaccaacagatgaataaagaaaatgttgtacatatacacaatgaaatgttattcagccataaaaaagaatgaaattatgtctctttcatcaacatggatggaactggaggacattatgcaagagaaataagccaggcacagaaagacaaatatcacatttcttgctcatatgtgggaactcagagagagaaagaatagaatgatggttactagggtctgggaagggtagtggggaggggggataaagagggggtgtttaaccgcatattctcactcgtaggtgggaattgaacaatgagaacacatggacacaggaaggggaacatcacactctggggactgttgtggggtgtggggaggggggagggatagcattgggagatatacctaatgctagatgacgagttaatgggtgcagcgcaccaccatggcacatgtatacatatgtaactaacctgcacattgtgcacatgtaccctaaaacttatagtataataataataaataaaataaaaaataaaaaagaggggtgtttaatggatacgaaaatgcagtcagatatgaggaataagatctagtgttcagtagacaacagggtgactacagttaacaaaaatttattgtatatttcaaaataactaagagtggaattgcaatgcttctaacacaaatacattacaaatgcttgaggtgacggatatcccagttaccctgatttgatcattatatggtgtatgcttgtatcaaaatgtcacatgtaccctttacatatctgtaactcttatgtatccataataattaaaaataaaaactttttaaaagaaaaaaaacccctatatacttatggtcttaagcatggctttgggacccagcaatgaattagatgtaattctagccttatatggcattatagtctaattagtggaaaatagacacataaacaaataaagatatgtatgtgtacaatgtatgaatgagagagttactgattttcttagaaaagagaagggagagatgaaaggctccaaaggggaaatgaacatggcattgagtgttagaatagagatgaaatcaatccattccatgcaacaaacattttcaaaagcacctactacataccaagcacaggtctcagtgcctttctgaaattgtcctcctttagagagtggcagcttcatttttaacttgatgttttaaaaaaatacttaactcaaaatagcaaaacaatctataaaaaaaggcaaagttcgaggactcacaaaacgtactactacttacatactacaaagctgcagtaatcaagacagtgtagtactggcatgaggataggcattcagatcagtcgggtagaattgagagtccagaaacccatatgcctacagtcaactgattttttacaagaataccaagaccattcaatgaggaaagaatcacctattcaacaaatagcattgggacaactggatagctacatgcaaaagaatatttaaaaaattaactcaaaatggattaaaaacttaaatgtaaaagctaaaattataaaacttagaagaaagcatgtatgtacatcagaatctcggattagtcaatggtttgttagttacaataccaaaagcacaagaaaaaaatagtcaaactggacttcatcacaatgaaaaactattctgcttcaaaagacgttgtgaagaaaataaaaagacaacccacagaatggttgaaattgtagacaacgtacagaaatggtagaatttgcaagtcatatatccagtaaaggtctagatctagaatatataaagaacttttatatttcaacaataaaaagacaaccaacatttcaaaaaaaggcaaatgacctgatagttctctaaagaagatgtgcaactagccaataagcacataaaagatgcacaatatcattattcattacagaaatgcaaattgaaaatacaggagatatcacttcatacccactaggacagcaataattgttttttaaaaaaaggaaaataaatgttggtgaagatgtggagaaagtggaactctcatacattgccagcgaaattataaaatggttcagacactgtggaaaacatattggcagttttctcaaaaaggtaaacatagagttactatatgacccagcaattcaactcctaggaatttacccaggagaaataacatgtctgcccaaaaacttgtacatgaacgttcataacaacattattcataatagctaataagtggcaacagcctaagtgatcagctcatgagtggataaacaaatatggtagattcagaggacaaaatgttattcagccataacaggaaatgaagtgtggatcgatgcatgctataacatggagaaacctttaatacagtatgttgagtggaaggtgccagacacaaaagactacatattgtgtgattccatttatatgcaatgttcatggtaggcaaatccatagagacagagaaataattaattagtggtcgccagggggctagggaaaagggaattgggagtgactactaatagaaccagagtttattgttggtgtgatggatatgctttgaaatttgatagcggggatggttgtacaaaattaagaacatactcaaactcactgaattgtactttttaaaatggtaaagtttatgtcatgtgaattacatgtcaatagtcataacaaaaattattaaccaacatatgctccctattttctttggaatgttgatacattgatacaaatcagctaaaataataaagcacgagttatgccattaatattcgttttacaaaaacacgtgttttgcattctagtcgaaaagttaaagtttattcagattatgatcaggagtaggcagaggccaagggaaggccaagcttaaaggacttagttgtcaagactcctttgactaatttttaaactcccacatgataattcatctgctcagcaaagcttcgctttgaaaaaacaatttttattaaaacgttacggtacaaaaattagtgggtcaaatcctgtctcataggtacaaattagtcattttgaaatatgtacgaattcttgtgatgcacagaacagctgtttggctgatgctgacctgtgaggctctgatgtgctactgcagcctttcagtgtgtctcctggtgaagagggcaccaacagtatctgctccctttttcttaaatgtgcttttacgaagtttatcccttgggaggaccacccatgtgagtggatgtcagatttgctcataagtccataaatcatacagacttaaccttgtttattaaagcaggtctttttcttcatttctgttccttttgaagagttcaaaagctaaaacactagccccaatgaactccccatcacatcttagcaagcctaatatttctaattctagaggaagaaccccagtctgcactataagtaagaaatagcattttcattattttgtgtgacaaactgtgttcttactgaccatttcactccagatatagcttagtatttttttttcatagagatttcaggaaacgatagcatagttttttaatagtgaaaatataaatacagattctgaagcagtctgtggtcttagtatgtgggaatgattagtcatattggggactgccctgatagtagggtgggctgggggaattaccctgagaggttaattatgaaattcatataaaatggatgaaaagtcaccttaatggatagaatgacaaataaggcaagaagaagaggggaaagatagttggcaaaacaaacctcagcagtgcctcttccagcaccatctaggaaattataggatttgggaattcccatcctagtgggaaggccgtagccagtgttgtaaacaaacatggaggacctgctagcaataccgttcttctgcaagatggctgcatcaggccccattaacctgataacattaaaatcagatttttctgccttcttttcccccatggattcaatgtccactagcaaccttctgaacatgtctcctatgagacactatgttgtagtggctaggtatccacactctggtttacactgtgtgggttcaaatctcatctctaccactcactagcattgtgatcttataagtttagaacctctgactttatctataagagggttttaaccacaattcctaccgatagacttgtgaggtcatcatggaaaatgcttgacactgtgcctggcacaatgttattgttaataaatgctaaccattatggtcattgttattctaatataagtatgtctatgaaaatagaatgggcttctcacatgtggcaattatgtttttcattaaaaattactaaaatgggctttttgacttaatatgttaatcacctgaacttagtgtaagtcttataggacttacaagaaaagaggacttacaggcgaatagattcaggtttctgatcctgccaagccaaggtcatggcaaatccaccaaggccacaaaaatgccatcttgtgaagccccttggggtctgcctcctggtctttccctgaaaatgccatctcattcaggagcttgctttcaatttccttaagaggagattctacagaggaagtaacaaaatgggatcaatggttcacatggtgagtgaatgttgaaatactgatctgctgaggactgagcttctgtaattcaggtcatacccttttctaaaacccttcaaaggcttcccttctgcttttaggataaaatccaaactttgtgctagagttccacaaggtctttcctccctgactccttctgcctttccaaccacgttctacaattctctcttgccttaccatgctctagttcaggggctggcaaactataggaaagtttggtaacattttattggaacacagcacatccctttgtttaagtattgcctatggctgctttcacactgcaatggcaggcttgggtggttgagacagacacatatggctccactgtaattgtatggtaacatttaactgtacaggacttgggaagttaggtctagctgtgagtccaagaaaaggaaatgattttgttcatcagccaacaatttttgctataaaagcaaagcaatgtgagtgggggccctaaaaatccccactgttttcgccattctgactaccacccactccccaccaaaggtccctggggcacaccctgcagaccttattactttagggcacacattttgaaaagggctgactttgctaatttgacttggcattttgattaaagttactttcatattttgattaaagttataactgcatgatacaggcatactcttatcaccagtgctttaagaacatgaaacgggaagctgatgacttctaaaccatttcacattgagtctaaattcactgcttaataataaataacaatgataataatagtaacagatgtgtaccactcacatataccaccatcttatctcatcctcacttatggtaagtgcttctgttattcattttatagatgaggaaactaaggagaagagaagttaagtaacttgcccaggttacacaataggaagtaatgaataatggatccaggatttaaagccagtagtctgaccactgagcacaattaattaattttaactacaaaatctcaccatatggttaaatgaatacctcattcttgtgtagtagtttacagttacaaattggtgagtatcttcattttccatattagaaacaaaggcatgaaaatgttaagagatttggcaaggttatgtagccatttttcaggcaaaagaatattaggaacttggtctttggattctcccgctcacaaacaaaatctaaacttgaactgtatgcaactatctctgctatggcagtcatgcacctagaacctggtgggcactaaatcagaataaactatctggatggcattttagctacaacatatccaaaataaaaagagccaaatatttataaagaaaatgagaggcaatgtaacaacaataaaagttggaaatgaccttaatattaactagtagaagaatggttaaattaattatattgcatccataagatgatgccatcaaaaatcatggtttttggtctggtgcggtggcttatgcctgtaattccagcactttgggaggccgaggtgggcagatcacctgaggtcaggagttcaagaccagcctggccaacatggtgaaaccccatctctactaaaaatacaaaaaaattagatgggcatggtggcaggggcctgtaatccctgttactcgggaggctgaggcaggagaattgcttgagcctgggaggtggaggttgcagtaagccaagattgcaccactgcactccagcctgggtgagagagtgagactccatctccaaaaaaaaaaaagaaaagaaaagaaaaagaaaaagaacaaaaaatcatggttttctaataatatgggggaatgctcacaataaaaataataagcatatatgtttgtgtatatataaaaatacatatacacacatacatattaactttattttaaaatatctttatgaatttcatgcttttatattagattatgttttcaaactctattaatgtgtactgaataacttcacaggaattgtattaaaatatttaccatggatatctctggatgtgagatgatggtagattttcttctacatatttttctgtacttttttactttctccagtgaagatatattacttttatgagtaggaaagtttcacggtacgtgttgttatatagactgaatgtttgtgtctccccaaaattcatacgttgaaatcctaacccccaatatgatggtattaggaggtagggcctttgtaagtaattaggtcatgaaggtggagccctatgaatgggattagtgcccttatgaaagagtctcggaagagctctctcaccctttcagcctcttgaggacagtgagaagacagcgggctatgaactaggatgcaggcctttaccagacactggatctgtcagtgccttgatcttggacttcacagcctccagactgtgagaaataaatgtttgttgtttaagccaccaaatctatggtatttttactgtagcatcctgagcacactaagacacatgttattttaaggaaagatgctaataccctgcccttcacagcctgcctcctcagcaagttcccaccgtgtttaggggtgttgagccttcactgcaaccactaaaaacacagtcccacattataagtaattctgcttaggaacttccagttgaccatcagtaccaaataaacgtatcttgaattcagtcatctatataaatgttgtttatgtagagatgtgggaggagagaggagaaggttatgatctctttgtggtttcatgggatgtactgtttggtccctttctggggccacaggggtacaggttcagacatggtttaggataccagggttccgggactgggtaagaaatgtggctcaggagcttctggggagagagatgggccacacccttccccagtgcattcatttttcaatagggcttaggaactttcagagaaaggactgaaatcctgcccaccaatgcactgcaaacctatgtctgagaaagtagggtgttcccagatggagaacagattatagagaagaacaagtgcttccactgaagaactaaactggcactacaattccaataagaaaaattggtgttatgcatgttctcactcataagtgggagttgaacaatgagaacatgtggacacagggaggggaacatcacatacccgggcctgtcagggggtggggggtaaggggagggagagcatcaggacaaatacctaatgcatgcgaggcttaaaacctaggtggtgggttgataggtgcagcaagccaccatggcacatgcatacctgtgtaacaaaccggcacgttctgcacatgtatcccagaacttaaagtaaaataaaataaaataaaatagaaaaagaaaagttggtgttagcagagagtgggggttataggtagtttcccagctgacatcaaaacttgcctgtacacagccaccctaggggcacttttgtagccttggagaaaggtgcagtgggttgatttggaagaataataactctgtaaaaggtagtaacactatggtttaatcagctttgcagtggggcccctggatgagtggactataacaattactacagcaattacatcctctggctttgaatgacatttatatgggtttgggaacagagatgactctccctgagggggtggtggtagctgcaaagctgacaggagcggagtttcaaccttggtgggggtggaggagcagaatatgtgtacgactatcagggttggtggtaaaaactgccttgcttggctcagcatgtctccagtgaggaagccctgtcatgagccactagaatacctgggactgggtgcatctacagtgccagcctagctgaatgtagcaccaagtgtgttcatctcactttgctgagtgggaggtgacactggaccagtgatctggatcgctgaattatacatttaaaatatgtaatgcgctaggttaaaagtgctataaagaaataaggtcataacaaggtagtaaggcatctagcatatattccaaattcacaaacattggtcctgcaggatttccaggtgatggtgactgtggtggcaacggggatggggacagatttctagtcctgaggggcatctttgtggaaacatcagagccttggtccatggattcctgccatagtggggacagaagtgaactatttctggctgcacgtcagcacccttaggcatttccagaaatatttaggggaaagacactctttaaaaggctgaggtaaagcagggacactcaaaattggtgaagtgtgagatgctcgggatgagtttgtttaaacaaagtaagccaaaggggctattaaagcgtacggttccccatgaattcaatgtttttctttaagcaactcaacttctgtggctacttgttacagctatttcaaggagctgcccttggaagccttcatttttatgaggtgtaagaaaaaccatgactcaggtaaatctgtcaacattttcccatagaaagtttatctttagaggctcctcccaccgggatcctctccatctgtccacagcctactgagtaacccaccgactattgcgttctctgccccacgttcattcgttccttttccctattcaaacttcaactagctctaatggcagaaaagtgatctgatatataacgtcacctaaaaggacaaatgactgacagtagctcgatttagtttccattttaaaggaggatgtttggagtccacaatgccttaatggaaaggaattgggctaattgtgtaattctttcaacaaggcaggccattggtgggaggcttttgggcaggggagcttcctggaatctgttaatgatataccccaaaggcaactcaactgactcatgaagttaactctgatggtgctgatgatgttactaagaagccctaagcctgtgctgcctaaagttcacagagttttatttaacatattcttttgagctaggcagagaagaaatgaccatctctcattaacagcaaggatactgaggactggagatcaccctcatttgcccaagtgtctcagctagtagctgatggaaacagcactaaatatatatatatataatttatttatttaaattatatatatatataatttatttatttaaattatatatatatatatatatttaatttcatcttgtgtgggcaaataaaggcagaatgtccaagacaaggttgtttaccttggctgttattggcaccttggaataatattaagctgtaaggggcttaagatcagctaaattacctgatctgtaagcctctctctttttctcatcccccatgtccaatcctccagcaactcctgcaggcttaacattcaaaataaacactttccaccattccactgctcccctccatctgaggccttacctctctcatgtagatggttatggcagcttcctgactgctctccttccttccacacttgcccatctacagttaattcttcacacaccagccagagggatcctgttcaaacctaaggcaggtcagggcggtcctttgcttggaaccttcagcagttcctccctgcaggcagagtcaaagcccagtctgcacctggctcctggctgccttgatggcctcagctccagttctctttgctccagtcagactgtctttccttttcctcaaacttgccacacaccttcctacctcagggcctttctactggctatttccgccctgccccttgagtcttccagatattcacataactggcctctttactttattcagacccctgatcaaatgtcatctcctcagagaagcccctccgccactatcactcttctagcctctcattgtgttttagctctccttatagcactttttacctaacacattatatatattttaaaacgcgttgtctcgttctcctttctagttggaagctccatgtcagttttgttttgttccctgctgtatcttcattgcctacaatagcacttggcacatacttgctgaataaatgaaactgagaaactcagagcaaactatttctttttagataaagcccacaaaaatgttttcttcctgttcagtttaaactatccagcacacaacatcagccttgtgattgtctttttttctgatgctctgacctctgagtgacctttaacaagtaactttgttagaactcactttacccagctatagaatgggaataaaaatataacctaccttccttctcagacactttaatgaagcaaagtcttctttgttctttgaggaaaggagccaggcagatgaaaattcctgttattaaggtacaactaaagcccgaggagggtaggagctgcattttgttcctccccattctcgcacagagaaggcactcattaagtgcttatcaaagttaatatctgtggcacacaaactgcacctgcctctgcagcagtcgtcacagaagctggcccctttcctgggctaactgctctgagagcaccagaatgaaatctgacttagatatgacgcagattccttttttcagaagaagccagctacacaactcttgatgaacaaatagctaccaacgatgagcacaaaccagagaatttcagaagtgaagaaaatttcagatcagaagatcctgtctctcgggtataacttttttttttttggagagaaatacagtgactctcctaattatggtgaatttcctagttcagctcagagccactgattcagcagatattcccccaggcagatcctaatggaaaccaacatgtgaggtctgatgctgggaattttatcatgctcaacaaggatttgaaaactaaatgaatgcgtgcatattcacactaagcaattttcctccctgccttcaccactttcccttttttcttctcttaccctctttctgtttctattccttccccactcatgccccagtgcttccgttggacacatgcgcattttacggtcctgcagggcttgaaagatttctgaccttctaaggtccagtgatttggtatcagaagatctaagttttctccttctctctgccatttaaagaagcgtgttgcaatttccccagcagaagtgaaagtgattcgcctctactcaaatgtctgcataggcacaagaatgagggcgagagggagcaagagaagaggaagaggtaccttttgaatggggtgaaagcaaacccttacataacctgaccacacaataggaggaaatgaaaacttgggttcaagggcaattttgtcattggttattagtctgtgtcatcaagcaggtgccagaaaaacaaattttattttgattttaggcattcattttaacaactggattttcctaatttctcattcccaaggaggatctatgcaagaatgcacaatttatagttaatttggagatgaataaaatattaacataccttttgttccccctaaaacataatacctaaattagtgtgatgccttggttaccatcctacatatgtatttggattgtaaatgagctcagttttaagcacatttgtaacagtggaacaagtgaggcttgtattacatggccaaattgatattaatgatggtggcctcgagaacggattccatcccaagacatctgatctgcagacagttgagcattcacagcagttttgactttattgacttcattggccccagtcagaaggttttcatctagtgcattcagttaccctgatttctaattacaatagaatctttcaaatagatttgtttccagagagcttgcttgagatagattaaatggcagaagttgcaaaggatgtcattgttttacataaaagatctgtggaaattacgcctagaaacttgttgcctttttattttaaaagctgctatatacaaaataacagtcagggtcaaatagttaccactgtgacaacaatcatttatggtacgtttgcaattgttctaaaaagttaatatggaaaagttaccagaattaagtggtgatgttttacttaagaagtagaaaagatttacaattcattatggatgtaaaaagaaatggactctaagaaacttgttactgtagttgttgaaagaatattgtcaaagtgtttatccatattaagtggctccatagaacgtagttcctttagattttagtgttagcttctataaaactgctggtttgttttaatcttttggaaaccataggtgtttttttttaataccagtgatcatattttcctttgtgcttttgttggtaggaagctcagagcccaatttacaatctctaatgactcctattgaactttatatttgcacttcttttagtttcttttttttagggtgggaatagggttttattaatttttccctggatttatttgcttcacaatatttctcttcactttgattcaactgtttcttttctctttttctatgatatatgttcttaaaagctggcatgaagtgaaatggagcatatctggtctcaaagtgacaaatttaacacatccaaaatcatcaccctagtgtgactatttatcccatcttactatcgttttagaacaatgcatttagaatgctgtcctccttcttgaagttttaaaaatcatttaattcttctctgaattagtgtacactaacgtttacatcttaatcttttatattttgtttgtttttatcctttgcttcaaaagaaattaatgtgcactgtgaccttagtttccattagtcatcaacttggggactaacatgactgcctcactgtcagtgagtatctttttctgatagttccaggaggggtgattaatctcacctgattcatcatgttcttttactctgtctgcccagtgactatggccttgcatttccttgcatttatttctttaccatctaattcaacttaattatttattgtttgaccattttgcattctctttcttcctgtctcttgcacagaactcgccattccttctctgtttccattcagcctcctttgctggttcctcatctcccctacatcataatgctggagtgccttagggctaagtccttgggtctcttctcttacctgcaaatactcttaccttggttggtttgtttaacccaatggctttaaatcaaatttctacactgaagaccgaaatttatgtcagcaacttggatgtctcttccgaactccagactcacatacgcaacagcctactcatcatgtccaggtggatatttagtaggcatctcaaagttattcaaaactgaacttctggtccctactcataacaaacaactgtgtttttcctgcagccttctcctattcactttagagcaattccaactctatcctttcaattgcttaggacttcgaaagtctaggaatcatcctgagtcctcatgttctcgcacacctcatatccaggccattgatccaatcctgtgatttctagcttcaagatatatccatctctatcctatatttgcttggctgctagcagcatgaccccagccactgtcatctcttgcctgggttagcaacagcctcttttagtcctggccctgttcctgcccttgccctggaatgcgctcttctccacccagcagccaatggggtcatgtgaaaatgcatccccagtagaaaagaaaaaccttttcacctcactcacacttaaagccacagtccttacaacggccttcccagccctacaagatctggaccccagcctctctgagcctcctcctcactcatcatgcttcagccactgtcctctccctggcctctcccagccacatgcctctccccaggcagggtcactctgtttgcacacatccctcagctgcccttactccttatctctttcaggtttttgctcaagccttctctcatcagagactcttctggtcaaatatctgatcatcctactgaaaattaaggctccttttctagccccaccctgtctatccccgttcttgttttatttttctctgtagcacttattaccatttcagataccatatattattatacttatttgttgtctatctccaccctcttcttccagagtataaactccatgtggctagggttttttgtttgtttgtttttgttttttagacagagtctcaccctgtcacccacgctggagtgcaatggcacgatctcagcgcatcgcacctcctgcctcccgggttcaagcgattctcctgcctcagcctcccgagtagctgggactacaggtgtccaccaccatgcctggccaagttttgtatttttagtagagacggggtttcaccatgttggccaggttggtctcaaactcctgacctcatgatctgcccaccttggcctcccaaagtgttaggattacaggtgtaagccactgtgcccggccgacggcagggtttttatttgtgttgtttatgtggtctgctgaacacctagaacagtccctgatgtgtaggtagctcaaacaatatttattgaatgaatggatgaaaccaaatactctggcctcgttggcactaattctaaaccattaagctaatgaaacagagtgccatccaaaataaattaatagaataaagcaagtccccattatcaaagcaaaatagataattaaaaattaaagcaataactagttaattagggcaaagggatttttttataactgtgttataggatcatataggaccgtgggactgagagaaaacctgagctctcactcagtcctgcctcctaactgcaagaccgagagggcacactccaaccatgtcaaagaggatcttttccgtgttaagggtatttggagaaatactctggtttttcagttattcatatattttctttttaatgttcaaccactcaccatctgcttcccttcttagaaaagtcatatctctaccttaaataacaccgaaaagaaaggccaactgcgagtacatgcaaactcctacttctctttgactatctggccccagataggaatggaaaaaataccatgttcctcaggtgtctaatatcaaaacaatggcaactctattaaaggtactgaaaactttagcattttcctaagttatcctgagtaatttccttttaaatacattttttctattataagttaaaacttttacttttttaaaaaagtagagggctggggccgggcgcagtggctcacgcctgtaatcccagcactttgggaggccgaggcagtcagatcacgaggtcaggagatcgagaccatcctggctaacatgatgaaaccccgtctctactaaaaatacaaaaaattagcccggcctggtggcgggcgcctgtagtcccagctacttaggaggctgagggaggagaatggcgtgaacccgggaggtggagcttgcagtgagccgagaacccgctactgccctccagcctgggcaacagagcgagactctgtcccaaaaacaaaacgaaacaaaacaaaacaaaaacagtagagggctgggtgtggtggctcacgcctgtaatctcagcactttgggaggttgaggcaggcagatcacttgaggtcaggagttcaagaccagcctagccaacatggtgaaaacctgtccctagtaaagatacaaaaagtgagccaggtgtggtggctataatcccagatactcaggaggctgaggcacaagaatcgcttgaacctgggaggcagaggttgcagtgagccaagattgcatcactgcacttcagcctgagcgacagaacaagactctgtatcaaaaaataaaataaaataaaataaaataaggaagaaactgctagctcatcttttaaaagtatgtatactgtaagtcaaattctgttatgggaatgtgctacagttttttaaaatctcatagggtaagattttctggtcaaggggaaggtctattttttgctaatatatttttatgttagatattgcttgaaatcgatttaaaacactggcaagtttccaatgaaacaaaaaacttgcagcatgagagaaggtaggctagactggaagttaagagacctggctggaatctggttcccattatgtgatgaaactgctgtgtgagcttcaggcaagttccatctttctggccttgaattgagctgtagaacgagagccttagatgtaaaggaactatgtattctctttcatccctaggatttatgattctttgtatagttgaaatgaatttagtctgaagttttaaattttgattttctctcttcttctttccctttttccttcttccttatctccttccttccatccttccatcattatttatattttgcttctctatttctttttcctttctattctttctccttttctcctcacctttcctttgtctttcaattactttcttacctacttctttatctttttacttgtcccttttccttccttttccttttatttttttctttccttttctcttcatttttcctttctaccttctttccagctttctttctttcttctctgtcattctttttctcagcagcaaatcacttgacatttcaacaaatccacaaagtagcagtagttttatgggctggtattaacacctattatgaccagccaggcattgcaaactgatgtgagtgccgataggcccgcttttaggccatgcatggaaagtagccaaatctgcacatggctattatttaatgatgcccagagtcaaacaggaagccttctgcaaattgcctcacaaattatacagtggctccctgcctgcttgttattggcatgaaatagatttgtaaaaccagcttctgacatccaaattatttccctgtcttttacacacacacacacacacacacacacacactcaaagctacccttctaacataaaaattaaaaatatatttagataggaaatgtcatagtcaaagaaagcataagcaaaaaacttgagaaaatatttacaatataatgacaatcacaaggtctgatttccaaaatatgcaaaatgttattataaattattaatgcatataatttcaatataaagtgggcaaaatttatgaatagataattcacacagaaggaaataaaaatgtccagcaaacataatattctcaacctcaataatgaaagaaactcagtttgaaagggtcatttttttgaaagaaaaatttgttgttttaacaaagtataatgcttcaaactggcctgaagaataatattggtgtatattttctcttccgtagcttttaatcttaccatgcacactttcaaagtgactaaaaatactttctcccaataaacaattttgcccaataatatccatcccctccctgagcccagttctcttaaaactctaggttgtaaagaaattggggagtattttttctgagtaatagcctatgcaagccaaattctttttttttcttttaagagacaaggtctcattctgttgctcaggctggagtgcagtagtgctatcacagctcattgcagcctcaaactcctgggctcaagggatgctctcatctcaccctcctgagtaactgggactacaggcacatgccaccatgcctggtgaatttattttgttttatcttttgtagagatggggccttacttgttgcctaggctggtctgaaattcctggcctgaagtgatcccctcagcttgccctcccaaagccctgtgattataggcatgagccactacacctagccttgtaagccaaattctgtcagactgggtcaccaattattcttctttttccctcatccctactaaaatgctcagagtattagatatcatcatccttatttaaatatttgttataaaactggaaagggttggaccaccttggaaacttttttcacttttatctcttgcttaatcagtataatagaaagctaagagaacaggatttggagtcaaactgaacctagccttaatcttagctctggtatttagtattgtgtttccttgggtaagttccttattctcttggagctcaattttctcatgtatccgcaaaacaggactaaccatagcatctctttcatagggttgtggtgaatctttaagtgctattatgaacgtgaagcatatagcagagtacctaacacaggacaaaataaataaactgctgagataatgatgtcaatgacgatgaaagcttacaaaagtaagagaactggtcagaacgctgataagaactccatatagaatctgcaaatttagaaagaagagactgaatctcacttaaatctcaagcaaagaactttgcaacttattcagggtttgaatctatgtctgttgaaatcccactgagtcagtacaatgctgaatgatgtctcattctggtgaatagccaggctgtaaaatccttcacaaatttaaatacagtatagtgggggaaacagatcagaaaagagtgacaacagtcagaacagtaggggaggcaaacacacaccaaggtctatgtctaattttgatacaatatgggtcaacatctaataatattcctaagatgatgagaagtaaccttgacaacccagctgatgcaggcactgaaagaataagagattcacagggagaaataggagaaaatctgggccattttcttggttcagtgctggctcataccttttgctctgtagaaaatttcttattacttgtaaaccaaagtcttctaatatttaattaacaaacatctattaaacacctgtaatatgccaagacaataggttaggcctttggggatatagaggtcccctgctcacaaaggttgtcagggaggacattactattcacaagcgagtaggatacagcttaacccacacagtcctgcaagctcaatactcctagcgaaagcaacaaaagtcactgattaattttgacttgggatatgctaataatagcgataacaaatataatactggtaataataaataggctaggttttgctgcagcagcaaacagatctcagtggccctatacaacagaattttatttcttgatcatgctccacagccatgtattaggttggtgcaaaagtaactgcggttttgccattattttcaatggtaggcaggggacctgtctcacatagccatagaatgccaccattgagaacaggcaacctcctcagctgctgtggcagggcaagagagcatggagaattgagtgctggctcttaagagcgacttgctattgcagctcactggccagaccttgtcacatgggcttacctatcctgtgactagagtgaggagtgaggtgtgaggtacccagaatatagtcttaggaggctcttgctcttgggatcatgcaggtatagggttggtccctgtgtggctctgtgtaaaagccagtggctccttgtatttttcaccttagagatctcactggtcttatcccagtcccagcctaattgaaagggggttaggaaatgtcatgttccttatgttgagctaggggaggtcagttttggggagtactagaaacgtctagtaacctagccttgaaacctcgacctcatctgtggcacttccttttctctccacctttctgatccaggcagtcaccaaatcttgggatttgaatcaaacataacaaaagaactaatatgtcagttacttaactatttgccaagaatcgtcctatgcacacttatgctcactgattcatttattcattcctcagacagccctatgaggaagttcctatcactatttcaatttttaaaatgagaaacttgaggcttggagaaattgagtaacttgcccaaggtcttcatctgtaagaggcaaagttgagatttgaacacatatctgactataatgccactaatcattgtgggagctcacacttattcaatattccaaaaattttaaatgagagtgtggctagatcagcccaactcataagatagctggagcaaggaatactgactggcaatttgtgagaagtgtatatagatatcatcatcaatgatttcaagcttatgccattgataaaaagggatggttttgttttgttttgggttttcacatgagaatgcagtgcgatctgttattagaagatgtaggatatagaatagggatcaaaaaatctttactaatcagatgtgtgattagggcaactctcttcctctcagttttgccaatgatcaagaaaggagctgaatcagatcttttaaggccatcgccagtattgatattacaaaattttgtgatgatggcagaaatacagaagacagggaagaaatatatatatatgatagaaatatatataaatatatatattaaaaaatatataggatagaaatatacataaaaatatattaaaaatataaaaatatataaatatatataaaatatataaatatataaaaaatataaaaaatatataaatatataaatatataaatatatataaatatacatataaatatatataaaatatatgaatatataatatatataaatatataaaaatatacataaatatagaaatatatataaaaatatacataaatatataaaaatataaaaatatataaatatataaatatatataaatatataaatatacaaaaatatataaatatataaatatataaatatataaatatacaaaaatatataaatatataaatatataaaaatatataaatataaaaatatataaatatatataaatatataaatatatataaatctatacaaatatataaatatatataatatataaatatataaatatatataaaatatataaaaatatataaatatataaatatataaaaaatatataaatatataaaaaagaatatataaatatataaaaatataaaaaaatatataaaaatatataaaagtatatataaatatatataaatatatttgttttgttttgtttgtttgtttattattatcatttttttttgagacagagtcttgctctgtacccccagctggaatgcagtgacatgatctcggctcactgcaatctctgctcccaggttcacgccattctcctgcctcagcctcccgtgtagctgggactacaggcacccgccaccacgcccggctaattgttctgtatgtttagtagagacggggtttcaccgtgttagccaggatggtctcgatctcctgaccttgtgatccgcccacctcagcctcccaaagtgttggaattacaggcgtgagccactgtgcccggccagaaaaatattttaaa

SEQ ID NO: 454 - DNA, 20957 bp, Homo sapiens
aatatctccaacaccaagaaatgatgaatgtttgtcatgatgaatatgttatttatcctgatttaatcattatatattgtgtacatatatcaacatgtcacactatactccatatatatgaacaactattatgtgtcaatcaaaataataatttttaaaataaaataaacataaacacagaaaaaaagattaaagatacctggatccctgatgccatggagtgcctctgtggctctggactgaccaactgcaaactttttgaacattaaatgtaaataaacttctatattatttccaaaaacaacaacaaaaggaaaccaaaaaagaatgtctcaccaaagagaaagtatatataaagagatagaaattataaaaaggaaccaaatggaaatcttcaaaaatgcacccacacaaaataaaacaaactcttgcaattaataaatgaatagagctaataaaccagcaaagtttcagcatagaacatgaacatcaataatcaactgtatttccatatactagcaatgaataaccttcaaaagaaataaaatttaatttataatagtatcaaaaagaatgaaacaggaaaaaatttagccatggatatgcaatacttgtatactgaaaactacaaaacattgctgaaagaaatttaagagacctaaataaatagaaagacatccatataatggactggaagacttaatattcttaaaaaggcaataatccataaattgatctacagattcaatgcaattcctataaaatctttattattttgtagaaatggaaaagccaatcctgaaattcagatgaaattgccagaaacaatgagtagccaaaactatctggaaaaaaaatgaacaaatttgtagaacctacactttcctatttccagaattattacaaagttatgaaataaaagaggatacaaacaaatggaagaacattccatgcgcgcacgtaggaagaatcaatatcgtgaaacacaggtaggacgtttatcagtaatttgattcacccaataagctgctttgctttatttgtgcttccaaatcctcctgtttaatttcacttttccccatttccacatatggcacaatcaggagctgtcctatatgctctcctggctctgctttccagggaagagaagtagataaaacaatttgaatttccgcattgtaatctgaatcaatgactcccgtttgtacttgtaccccttttaaatttaaacttgaccttcctagaagtaatcctatcatcctagctggcaagggtccacagacccctgttggaactttttgcgggagttccccaggcataaggctcacagcttttgtgcaacatgaatctactgtggcactactggctgtggcagggcacagacattatacaggggtgagggaatggcctgagccagaaatgccctggtttggaacggggcctgggatgggcccctcatggcatttcctgaaatcgggttcccatctttatcaaatttagagtgacactgattagcccagtgttttcctcaggctcagtagttttcctttttcgcctatctggcagcctgactcgctgattttttctacattcttttttactatgaccatgcttcccacagttaaaacaaactccaggaaacggagtatttcctttatccactctcagtcccgccattgcttgggctagcagagtagccttatgcacattacctccgataccatcacaggccttgatatgatcaactaaatgtgctttcctgaatttaaaaggaaaaggctcaaatgtagctataatatttcccagttgatcttggggggtgtattctaacagggaactgccaagcctctaaatcaccctctcttctagcttgctgaactcctgcctgaatagaactgagagcggtcactcaagacgctgctcgaacagtcactggggcaactacttttctcccagtgtcctccagaaaagaaagatctagagggtcaggccactctttttttcttcaaaataaggagggtatgcagaagggtagggatgaacctcttcctcctttgccgctttagctttagctggcaaacaaacctgctctgtcacctcttctgttacttcattatactctcctttttccttatcattagtgtgaaaaggttccaaggtggaacgaaccagagcccacacttgtcccactgttaccctgatgcttccaagctccccttcttactcatgacagggattgctttaagagtactcgggtgtcctccagcttagttccacattctccaactgttgctccagcgacacttcgacctcagtttgagcctccatgttgggcactgcttgccgagaccagctcggtcgtggagaccctaacccagtggcactagaggaattaaagacacacacacagaaatatcttgtgtggagtgggaaatcaggggactcacagccttcagagctgagagcctcaaacagagatttacctacatatttattaacagcaagccagtgataaacattgtttctatagattatagattaactaaaagtatttgtaactggaaacaaagggatgggccaaaacaaaaggatgggtctggctagttatctgcagcaggaacatgtccttaaggcacagatcgcttatgctatttttgtggtttaagaaagcctttaagcggttttccaccctgggtgggccaggtgttccttgccctcattctggtaaacccacaaccttccagcgtgggtgtcgtggccatcatgaacatgtcacagtgctgcagagattttgtttatggccagtttcgaggccagtttatgtccagatttgggggcctgttcccaacaataaaagccatgtcgtactggcaaaagtatagaaatataggtcactgaaatagaattgagagtctagaaataagtccatctatctaaaatcaatcgattttttttacaagggtcaaagaacattcaaggaggaaagaacactctcttcaacaaatagtgctggaataactggttatttatatgtaaaagaaagaatgaagttagactcattctttcctcataccatatacaaaaattaactcaaaattgaccaaagacctaagtgcaagagctaaaactagggaaaccttgttcactgttggtgggactataaattggtacagccattatggaaaacagtatggaggttcctcaaaaactcatacacagaacgactacataatctgcttctaggttagggggaaggaagagatgaataggggagcacagagaatctttaaggcagtcaaactgttctgtatgattctgtatgattctttaatgccactacgcatttgtccagactcacagaatgtgctaaaccaagagtgaatcctaatgtaaagtatggattcagggagacagtatgtcaatgtagggtcatcaatgttaagaaatataccactactctggtgtggaatgttgatagtggaatagactatgtacatgagagaaagaagtatatggcagctctctgtgttttttgctcaattttgctgtgaacctaaagctactttatttattattattttttgagacagggtctcactcagtcacccaggctggagtacagtggcacaatcatagctcactgcagcctcaatctcccaggtcaagccatcctcatacctcagtttcccaagtagctgggcccacagaggcccaccaccatgcatggctaattttttttttattattatagagatgaggtctcactatgttgcccaggctgatcttgaactcctggcctcaagtgattctcctgttttgggctccaaaagtgctggaattacaggaatgaaccaccatgcccagccctaaagctacattaaaatattaatcttattttaaaaaaataaaataaaaaccaaatgcatttgcagcaatagcagaaaaatcatggtaaatctcacagtatgtgtcagaaggcatccaaagatatgtttttgaaaaatgtaaatatgaccagcagttaaataaaagtaagatgtataagcttctagatatctagtgggggtaaagataacaaaaaatgtgaaatgcaatacaaattatgagaaaaaatgagctaaaataagatcatatactgtctgagtaaccccacatctggaagtaatccaaactatggaggaagtgtatatattaattgcaacacaaaggagacaacattaatttacagaagaaaacaaatagtggtgtacccactcagtgtttattgtaggaagttaagagatcacatccctgttccgctcagcttctaaccaacggagcagacaaaaagggtcacatcaggatcaaagctttattataacagtaaatctgtcagttagggctgctataacaaattaacatagactaggtggcttaaacaatatttattccttgcagttctggaagctggaaggtccaagatcaaggtgcgggcagatctagtgtctggtgagggcaggcttccttgttttcagatggccatcttctcattgtatcctcacacagtggagcgccagagagacaggataaagaagccctctctgacctcttcttgtaagggcactaattccattcatgaagcctccaccctcacaacctgattatctcccaaggctcccacctcctaacactatcacctaggaggttaaagtttcaacatatggatctttgggggacccaaacattcagttcataacagagtgactcttctcttcctcctcccaattgaggatagtttccccttaacctttcctgtacctggacagagagagcagaagcgtgactacttacagtcacattagttcatacagccatggttcccaatcctggctttgcacctggagagaatcaaaaatatccctgtctgggcccacctctactgattctgtattaattggtctgtagtatgacctgggcatcagtatacttttagagctatcacatgtttctgatatgctgtgggattgttctgtgccactcacacagaagattgaagctcagggctagccagaataaatgtaaagattactaattagaaaaattcctcctcttcctgtgtataagtggtaggtgagggttagactagaaattttcctgccagtttgtttacttctgcactgtgaggtaagattggttctctttatggacacttgagggtgaagaattaaatggttcctaccaccaggtatttagcagccatgaaaattcttataacagtgacactgtaacaccatggaaaattattttgacattattttaaacatttttgcaaaactgtatgtaaattgttattatgaaaatatgcatatgaataaaatttttatattctagtggtaggataattttttaatcaaataaagcacactaagaccctgctacttactcaatgtgtggtccactgagcagcaacattggaattacatgaaaaattattattagaaataaaagttccatgtaaagtttgaaaagcactgtgctaggaaattgtcaaaagaagcagaagcagaagaaacagaagagggagaggaagaaaaggaaagacagagaagagaagagaatagagggggcaggggcaggattccaggaaaatgtataatttgttaagaaattaaaaaggtatctttttcaccagtgctgtacaaactgtgagcttttccagcaaaaaagaacatagttgtcaatgggtgcttatgaatatttgcacatgctttgtgaccagctgctttgggaaataattaataaatatataacatagccttttctctcttcaacagtataatccagtttcaaaaatgatgctgatggacttgaaaaatggaccataatcataacaacttttctctgttacttaacagtttacaaagcaaaattgcatgcacaatgttagaagcataattaacttgtgaagaaagtaatgcaggtattatcatctctgggaaaacccaggctcacagatgcaagacctcaatcaaaatgacacaatgaggaagtgatgggattgagttgaacaaaagtggatgaagcctgatgacttcaaatccaatgcacatgggctgcatatgtgctgattcatgcagtacactctgtaagattaacaccatgaacaatggaagagattgacagcaaggaggcccatttgtaatttgcataggaagtgataaagatctagatgaggtaaaagttatgagaattgaatatagttcaatttggaggggaaatatggaatacaagccacaggttagttggagacagatgatctgatcaagggttaactccaagcaagtaaattattctttctgtgcctcatgggggtaataacagcaattacttcatcaggttgctgagagacatagtgagttaatatgtggagagatcctcaaacagtgtctgacacatagtaaatgctatataaaagctattactactactcagatgcaagagattttaggaggattaattgataagcttcaaaacacatcacattaagccaatggtcttgactgtagctacgtattagaatcatttggggaatatttaaaaatactgacacctaagctttacctcatagcaagtggatccaaatctctagagtggaggcccaggaaactgaattttttaaaactcccaggtgattctaacgcacagtgaaagttgaaaagcaccgatatagacagaggaagaattaggcttgacttattggaaccttagatatcagtggtgataatggcaataaatgaagagctgtggaaatgaatctactgtgaggatttaatttcctagattttcactgtaaggtgatattaatttgaaaagagaagtgatatattaagagtggatgagttctgtgacaggatgagacaagcataggcaaggtgccgaagacttgaagtagaaggaagagatgtcacacaaggtacagaaaagatggagagacattagaggacagcaatggtacaatgtcatgggagccatgcatatgggtgaggtgatggttcccaacaaactatgtcaaaactcacaggcagacaatgtacattaagcattgagataagaccactggatgttgccaatggtttgagaaaggtagaatgtattgagtgaacagaagatgctggtgagaggacagtgtggaagtagtcaggggaatatagaaattatacctgaaatggggagatcccagggattgaagtagtaccttgggatgtgggtggaggggcttatagaggaataaagacagaagtcagcaaactcagtaaggagaagtagcagagaagaccagattttggctggaccaataatgctgaaggtgtcccaagaagagtgttgtgtgattgtcaaggtgccttctagagttcttacaactctagaagccatagatgatgtcctggaaatcctcagcacaggaaaccctgcttacaattacattacaatctatttgagtgaagctgcatctcaagtggggtgaagggcaaaagtcaatgcataaaagtgaaaatcgagtaccctcaaaattaccattttaatattttaagaagcaccgaagtggagagcaattttccagctgccaaaaagctaagcaaagtaccaatgttttaatcagtgttaagatagttcattgttccttcttttatgcaacaaagtagttagcttgcatttttctgtctatattttatttttaatgcacattaaaaattaatttaattttgttgattctttcacaaaaccagctcctggattcattaattttttgaagggttttttttttgtctctatttccttcagttctgctctgattttagttatttcttgccttctgctagcttttgaatgtgtttgctcttccttttctagttcttttaattgtgatgttagggtgtcaattttggatctttcctgctttctcttgtgggcatttagtgctataaatttccctctacacactgctttgaatgtgtcccagagattctggtatgttgtgtctttgttttcattggtttcaaagaacatctttatttctgctttcatttcgttatgtacccagtagttattcaggagcaggttgttcagtttccatgtagttgagcggttttgagtgagtttcttaatcctgagttctagtttgattgcactgtggactgagagacagtttgttataatttctgttcttttacatttgctgaggagagctttacttccaactatgtggtcaattttggaagaaaacctaggcattaccattcaggacataggcatgggcaaggacttcatgtctaaaacaccaaaagcaatggcaacaaaagccaaaattgacaaatggcatctaattaaactaaagagcttctgcacagcaaaagaaactaccaccatcagagtgaacaggcaacctacaaaatgggagaaaattttcgcaacctactcatctgacaaagggctaatatccagaatctacaatgaactcaaacaaatttacaagaaaacaaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctagagaggatgtggagaaataggaacacttttacactgttggtgggactgtaaactagttcaaccattgtggaagtcagtgtggcgattcctcagggatctagaactagaaataccatttcacccagccatcccattactgggtatatacccaaatgactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatgttctcactcataggtgggaattgaacaatgagaacacatggacacaggtaggggaacatcagactctggggactgttgtggggtggggggaggcgggagggatagcattaggagatatacctaatgctaaatgacgagttaatgggtgcagcacaccagcatggcacatgtatacatatgtaactaacctgcacattgtgcacatgtaccctaaaacttaaagtataataataattaaaagaaaaaaaattaatttaaaatatataaaatagaattcaaatgcatcagagttagatgctcacactataagaaacccatggaacttaatcctaactcatggaacagtagaatcatgattatcatttcatactcactctgggacatatttttgctcattgaatggaacaggtagcgaacttagccctatttgtctaaactgtcatcttcccttactttctgatatacacaaacacactcccacaagaacacacaccaacctaaatgtgatgatgatgattaactctactgctcttcgtttagttcatagtttcacaatcctatcctcatattccctcagaactctaaaattaaaactacccagacttggtaattctttttcatccactttgataaaataaaaggcctgatggagggtgcccagaggtatgctgataagggagccctgatcttatgtgtctatgaatgtggaatgttcatggctccatcaaagcacaacattgacaagagccaaatctggagttccttaagttatctaggccctccacccctctgatctccccaaaaccaactctgctcagaatatgcccatgacttttctcacctattcaatatggcccacagcaggctaatcaggggtctaccttcacccattcaagcagcctgcagagtgcacccttgacatccttattgtggaggctatacacaaatgggttggccaaaggtgtaatggcagtatacattactgaagccaccatgtcctgatactgagagttctggaagggaggctggaagtagacacaaatgatggtgccgtagaggaaaccaaccatggtgaggtgggatccacaggtggagactgctcggcggcgaccagcagctgaaggcaaacgtagaatagcggccccaattcggacataagagagtacaatgagggcacaggggcccagcataaggaagccaccctcaaagaatatggccagctcattagaatgtatgtcagaacaagaggctcgcagaagtggccggtggtcacaaaagaagtgaggaaggttaacgttgcccccagcatccccagtccagcaaagaggcaggacgagtcccacacgcaacatggtgtgcagtatggacaccacccagctcaaggctagtaagcaggcacaccgttggtgattcattaccaaagcatagtgcagggggtcacagatggccacatagcgatccagagccatgacagcaatgacaagtgtatctgtaaccccaaatgcatagaagaaaaagaactgagccaagcagcgggcagcaggaatggttgggtaatgagagaccaaatgggccagcaactggggcagtgtaactgtggatagccccatgtctatcacagagaggccacgaagcagataatacatgggtgagtgcagtctggagtcccaggagatgagcagcaccagtgtcacattccccagtatggtggtcaggtaaatagccaggaacaggaagaagaggagagtgtaggagatgttagctctcgagaacccaaggagcaaaaaaaccggagagtgtgaagcattaggggcaaagctcatcatgagtgacagtcagcctgcctgaaagacagtttaagtcaaaaagaaagtcatgggtctgatgttagggatcatagcatttctagttaattatattacgttactaaagatcgttaaagacctagattcgaacttgaccatctactctccctccctaaggtctaggatttcgcttccttaatatgtatttattttctcctttatttcttccttttcacccaccctagtgacttgttccatctaattcacaagccctactaaagtccctcccacagtgaaaaactcttcattcattcttgtcttttcatccaactatttcttatctttttccagtggccgacttcatgaaagaattatctatattcactgtctccagttccttaccttccattcacacctcacccaactgcaatcctcatgatgtcttctctctgaacctgtatggaaaataacataccattaaaacacataccatacaaagaaacaattctttcgacatagctgacttttttacattttcctctaaggtctggaacaagacaaggatgtccacttttaccactcctattcaacatagtaatagaagttctagccagagcaattagaccaatgaaagaaaagccacccaaattggaaaagaggaagccaaattatccatgtttgctgataacgtgatcttatatttagaaaaacctaaagaccccaccaaaaaactcttagatgagatactgctttagaatgtcatgaaattactttttctttctctttattccctgtgttagttaatagcattatcattatcatcagcctgatgcacaaacaaaaaactgaaggaattactccatcatctcccacatccaatcattccttaacgtctatgttttcccttatatccattctttgctgttagtccactatgactatttaagttttagcatctctaaccaatactaatttctacaacctcattactggtttctctacttgactctcctgataggtcttccatactgatactggaataaaactttcaatatgtgactccttgtttaaatagtcagggacttcagaataaaatccaaatgcttaatctgtcttgtatggaactttcattattagtacctaacttctcttagaattatactgagtcacctatccagggtttttttgtttttgtttttgtttttgtttttttaagacagtctcactctatcacccaggctgaagtgcagtggcttgatcttggctcactgcaacctctgcctcccagggtcaagtgattctcctgcttcagcctcccaagtagctgggactgcaggcacacatcaccacacccagttcatttttgtatttttagcagagacagggtttcaccatgttggccaggctagtctcgaactcctgatctcgtgatccaaccatctcggcctcccaaagtgctgggattacaggcatgagccaccgtgcctggtcccagtgttttaaactagacattttttcttaattctcaaacatggtaagctctcacacccctgcacatcttcccattattttgagaatttgggctttctgaaatatgaggtatgtaatacaatcatccacacatgcccactcaacacagaaacttagagaaaatataataatcatactttttttttttttgagacggaatctcgttctgtcgcccaggctggagtgcagtggcacgatctcggctcactgcaagctctgccttccaagttcatgccattctcctgcctcagcctccagagtagctgggaccacaggcgcccgccaccatgccaggctaatttttttgtatttttagtagagacggggtttcaccgtgttagccaggatggtctcgatctcctgacctcgtgatccgcccacctcggcctcccaaagtgctgggattacaggtgtgagccaccatgcccagccaataacatacttttaaaatcataactaagctttcaagaacataagggaaatacaagagtctgtaatcaaagaggaatatgaaaaattaatatctaaaaactatctgtgattatggaggtagtgatggcaggtgacaggtggcaggtaggttcaagggcatcacatcagtcttcatagtccacaggtttgattattaacatccgtgtggaacaggagataagagcttaaacctgtatgaggcaggaggtagagaccaccacataaattgaggacactcaaaaggctaaactttcagcaaaagggtatacacgaacaggaaaacacacacacacacctacacccacacagggtatgtgagaacaaatgaaaattcagatcgctcagtctggactacatggaaggaaaagtgctttccatgggaatgcagttatggatctgtaccacataagaagtgcataatgctaatttacaaaatacatacaattctagaactctcaaaataaaaaatcaacataaaaattatcttcatacaggtaaaagcattggagtaccttttagaagtgaacataaaacttctcagtgacttatagactctagacaggaatcccacaaacagaaatccaccaaagatgagctcacaattcaaaattacaaaacacacataaagtctattcattatgaagatactcatcaatcaacaaataatgtgataacctcctccaaatgtcataaaattaaccaatctgttaaggaatatacattatatttaaagtacttagtgtctaagagagaaaataaagattataagaaagaagttatcaaaaaaaaaacatatttttaaaggcccaaaaagaattactagaaaacaaaaacattcacattgaaatgaaaaactcaatggatgggttagacagtggctgaagagagaagttagttcttttaaaaatttttctctatttccataggttttggaagaacaggtggtatttggttacaagagtaagttctttagtggtgatttctgagattttggtgcacccatcacccaagcagtatacacagcacccaatttgtagtcttttatccctcaccccccttccaccgcttcccccaagtccccaaagtccattgtatcattcttttccctttgcatcctcatagcttagctcctacttatgagtgagaacattcaatgtttggttttccattcctcagttacttcacctagaataatggaaagcagctaattctaagaaaaatacccaggagacagtacaaagtgacccagataatatgaagggggtttgtattagtttgttttcaccctgctgataaagataatatgaaggggggttgtattagtttgttttcaccctgctgataaaggcatacccaagactgggcaatttagaaaataaagaggttaaaaggacttacagttccacatggctggggagacctcacaatcatggcagaagttgaaaggcacatctcacatggcggcagacaagagagcttctgcagggaaactcccctttataaaaccatcagatctcatgagacttatttacaatcatgagaacagcacaggacagacctgcacccatgattcaattacctcccaccaagtccctccctgaacacataggaattcaagatgagatttgggtggggacacagccaaaccatatcaagagttaagaatttcaggaaacaaaataagaagacccattatatatcaaataagtccaagaaaaaaactggatactacatacaaaagaatggaattggacccttatctcacaccattcactaaatcaactcaaaatggactgaagacctaaacacaagacctgaaaccacaaaattccaagaagaaaatacaagggggagactccttgacattagttttggcaatcattttctggatattacaccaaatgctcaggcaacaaaagcaaacataaacaagtgagactacatcaaactaaaaagcttttgcacagcaaaggaaataatcaacagaatgaaaaggcagccaacagactgggagaaaatatttgcaaacaatatatctgataaggggttaatattcaaaatatgcttaaaaacttatactcaatagcaaaataataataataataataaccaagtttcaaaatgggcaaagaggccaggcatggtggctcatgcctgtaatcccagaattttgggaagccaaggcaggcagatcacttgaggtcaggagtttgagaccagcctggccaacatggaaaaacctcgtctctactaaaaatacaaaaattagcccggcatggtgggacatgcctgtggtcccagctacttgggaggctgaagcaggagaatttcttgaacccagacgcagaagttgctgtgagctgagatcacaccactgcactccagcttgggtgacagggtgagactatgtctcaaaaaaagggtggggtgggggggtgcaaaaagaacgtgtattagtctattttcacactgctataaagaaatacactatagcctgaccaacatggagaaacctcgtccctactaaaaatacaaaattagccaggcatggtggcacatgcctgtaatcccagcacattgggaggctgaggcaggtgaatcacctgaagtcgggagtttgagaccaacctgaccaacgtggagaaaccccgtccttactgaaagtacaaaattagccaggcgtggtggcacatacctgtaataccagctactcaggaggctgaggcaggagaatcgcttgaacccgggatgtggaggttgtggtgagcagagatcatgccattgcactccagcctaggcaacaagagcgaactccatctcaaaaaaaaaaaaaagaaaagaaaaaacagaagaaaaaagaaacaaaaaagaaatacccgagactgggtgatttataaaggaaagaggtgtaattgactcacagttccacacacagctggggagccctcaggaagcttgcaatcatggtggagggcaaaggagaagcaagtaccttcttcacaaggcaacaggagagagaaaatgcagggggaactgccccttataaaaccataagatctcgtgagaatgcactatcacgagaacagcatgggggaaaccacccccatgatccaatcacctcccaccaggtccctcccttgacatgtggtgattacaattggagatgagatttgggtggggacacagggccaaaccataccagaacctgaataaatatgcatccaaagatatacaaatggccataggtatatgaaagtgtgcttaacatcactaatcgtcagggaaatgaaaatcaaaatcacaatgagatagcacctcacacctgctaggatggttattatgcggaataacaagaagaaataacaagtgttggcaaggatatgaaggaaagggaacacttgcacattgttggaaggaatgtaaattggtgcatccattatggaaaacagtacagagggtctttaaaaacttaaaaatagaacaaccaggtgacccagcaatccctctcctgggtatacacccgaaggaaaataaatcagcacctcatagagatatctgcactcccatgttcactgcagcattattcacaatagctaaaatatggaaacaacctaagtgtcttttaatgaatgaatggctaaagaaattgtggaatattatttagcctttaaaaaggaagaggttctgctcttttttgtgataacataaatgaacctggaggatattatgttaagtgagataagccaggcacagaaaaaaatactgcataattttacttttatgtagaaccttacgttttaaaaactaaatacatagaaacagtgactagaagggtgattagcaggagtcggggaagggaaaaaatgagtagttagagctcaaaagatacaaagttacagttttgtaggatggatgtctagaggtatactgtacagcaagaagacatattaataatattgcattgtatacttctatcatggaaatttgccaagagagtagatttaaggtgttcttaccacaaaaaaataggtaactatgtgagataatggatatgttaatttgcttgactgttgtaaccatttcactatgtatgtgtacattaaaaccttatgttgtacacattaaatatacacaataaaaaataagtccaagattaagtatatgagaaaatagaggagaggcaatattgaagagacacaaactaagaatttgccagacttaatgaaggaaatgaatcctcagattgaagaatcacagtaactcccaaacaagataaattttttaaattccatacatagacactatgttagggaaaccactgaatagaaattcgaagaggttatattaaaagcaacaagaaagacaaatagactgacaaaagatttatcagcaacaagagattctagaaaatcaggaaataatatttccaaagtgctgagagaaaataatgaccaaactcaaattctatatccctttaaactattgaaaaaataaaaaagcatttttacggatactgttttctctttcatggaatgtcctcccatcctgttagggcccaaacttaggaccacatgctaacaagtaaaaagctgctcatgttgaaggtctcagtcaggcttcgtttctacttggagacttcaccaagtccctgcacggtcattttagtggagcattttttgcttttcaagtaacttcgtaaatactgacttgcctatctcccaatgtacactgttaccatgtgtgtatacacacacatatacacatatgaacccatgtagatacacacatgcatgcacgcatacatacacatatatactggccaggagcagtggctcacgcctgtaatcccaacaatttgggaggccaaggcgggtggatcacctgaggtcaggagttcaagacccacctgggcaacacggtgaaacccagtctctaccaaaaatacaaaaaattagccgagcctggtggcaggtgcctgtaatcccagctacttgggaggctgaggcaggagaaatgcttgaacccagaaggcagaggttgcagtgatccaagatcatgccattgcactccagcctgggcaacaagaatgaaactctgtctcaaaaataaataaataaataaataaacaaacaaacacacacatgtacattcatcactgacttcctaatacctaacacagagctggggaatgagtgggtgctcgttaaacatttgttaaccaaacaaaaaagattttctactaaagggcagtggtctagaagttaatacaaaggtttcggagtcagacttacctggagtttcactccatatctgccatttattaactatgtgatcttaagcaagttatgctttctcatctgtcaaatagtgacaaaatttctcataaggtagagaagattaaaggagaacatattccgttaagagagtatttttggaagaaaatgaactttgcagaggtaaagtaggaagtaacttttttcacacgactgctttttgaaaagtctcatttttaggtactaaaattccaacacattagaatataaaaattttaattctcaagcaatttaaactgtgctttcttccccagcagggtttatattttcatccagaaacctgcattagggaaagagggatgcgactgtcttcatctttgcaccatcttatccatccttttctgtctctggctattgcagtgttgatttgaagaagggaaacggaaaggtaaggtctctttgaaagatagagctggtagaagttacaaatactgactctcttctcttgcggaacatcatattggcccatttgagaccacctataggtaactattactgcattcttcccagatgagactaattcaaaccctgtctgatcccttagagccccctcccttacattggacatctgactgcacccttctaagcttcttctaggattgccttactctagcaagaaattctcttaggtggaatgattttcaagatgacacagctcatgtaccatccttgggtccaaggaaagttagtctaaggaaaactcatacatttttatcccaacaaatttggtaaatgcagtcttctctttctcaatgcactggcagaagttgcacttggcccttccctcaagctttctttaaggccttaagtaatattttacactgcattcttagtttgcaaacattttcttaaactatctttttgttaccagtttctaatttaatagcattctggccagagaatttaatctctgtgaggttacttctttgaagttttttaagattcattttgtagcccaatatgtggctaaaaaatggatatacagatacagaaatggacagtcccaaaaacaaaatcacgatttgtagaaattgtggtatataacagtgatggcattcttcagtgatgaagaataggtaattcagttaaatatagtgctataactctacataaatattttaacttgtgtttcattcacactatacagcatttgaaatcaaaacaacatgcatggagtgtaaaactccaagacataatgttaactgggaaaggcccgttgcaaaatgatagaaaagtataacaacagatataaagttgtaaaacatgcaagagaattctgtcatttttataaaacatacatagtgaaattctagaaatatgcaggaaaataatgaatagcttatttgggatagtagttttctttaggaaaagaggaaagagaagcagtttgggctttaattgtatctatagcagtcaattttttcaaggtaagaactgaaacaaaaaagggcaaatttaagttttgttgaagttgggtgtttagtatatgtagttcattgttttggttcctatgtatttttctatactgtgaagcttttcctattaaaatataaacaataaagccaagggtagcaatggagatataagacttttattttctagtggtttttattattgatgccttctaaggttaagcatacctttctaactcaaaataatatccacatcacacattcagcaccaggatactcaagctagtacattatggagaacccagaattaggtaatatctatccgagaactaagataatcagagatttatctccaaaacaatttgccaagaccttatggaaaaagaaaaggtcacaatacttgtgaattataatcatcaggcctgtgcattgagccatgaagttcccctagatggtctttccctgaccccaggcaggacccatgtttccaattatcatttctggttctctgtctcactatagcaagttctacagtgagcttctcatagcagcttttagtttgtgctgattgaagggatctagagcaggagaaaagtttacacagagctccggaatagaagggagaaatcttcagcaagactgagagatggaaggctcataacggactatatttccccagcctcagaagcccaaaatttaactaatcataagctttggtttatgctacactacagtggttcgattataacctgcttgcctgcttactcacttggttttaaatattattataaacacacatcaacgtactgtccaacaaagaaacaacaacattgatgataattcatatctacttagatagacgtttttcatcacctccccgttacctcctgcttagggtaaccaacctttagaatcttgagttaatcatcttcttactcttcttaacatgtttatatattatatacgtctatgattttgatacatctatagatattccaaaaagaatattgtcaagtttgagacgatcttaaatgtattaaaggataacaagctttaagtaacttgaggtggacatatctttagatctcagcatcatattacttcactgatattattggatatagctttggttcatttatttttcactgctatataatagccctttgcatgaacatatcacaatgtatttatacattctctgtgatatatatttgggttgtttactgatttccgttatacaaagcatgggtctaagcttatataagtgtatgtttc

SEQ ID NO: 455 - DNA, 20933 bp, Homo sapiens
tttcatctccttggttaagtttatatctgcaaattttattcttggctgagcatggtggtgcattcctgtaatcctagcactatgggagatggaagcaggatgatcctttaacctcgggagtttgaggcaagcctgggcaatatagtgagatcttgtctccacacacaaaaaataataattaagaatttaaaaaaatagctgggtaggtggtgcatgcatgtagtctcagctatttgggatgctgaggctggaggatgggttgaatccaggagattgaggctgcagcgagccatgattgcaccactgcactctaaccctaggcaacagagtgagaccctgtcttacaaaaataataataaaaataaaataaaataaaataattttattatttttgatgctatactaaatgggattgttttcttaatatcttttccagtgattttgtcattagtgtacagaaattcaactaaattttgtatattgacttgtgttcagcaactttacggtattttttgaggtctagcatgtttgtatttgtttttgtattttgttatgtcatctttaaacaggcataattgtgcttctcttttcccatttggatgtcttttatttctttatcttgcctaattgatctggctaatactttcagtactaatttaaatataaaaataaattttgagaatggacatccttgtcttgtttcagtggacctgttcatttttaaacatgaggtgctattattttatgtcagactctctcccttcagaacactaaataatggatttttaaaattatttatttttatttttttcaatattcaatattatccaaattatttatttttatttttattttttgagacaggactggagtccaggttgaagtctagtgatgctatcatagctcactgcagcctcgaactcctggactcagtgatacttctgccttatcctgcagagtagctgggactataggtatgagtcaccacacctggctaacaatttctttatgtatttagatgctctgctgttcaattgggtgcagtcatagttaattgttatgtctcttggtgaatttatccttttatcattatattaatagaattatcttctttgtctcttttcacagtttttggctaaaggcttattttgagatataaatatagccacctctgctttcttttggtttccatttgcatggaatattttcttccatcccttcacttttaatttatgtgtgttcttactagtaaaatgagtctcttataggcagcatattgttgtatattgttttttaatccaatcagttgctgtaaatgtttttattggagaatataactcatttatatttaaggtaactatcaataggtaagaacttactactgccatttacaatttgtgttctgatttttttacttttttcatttttttcagatcttttgattcttcctgtcttgtcttcttttgtagtttgaaggttttatgtggtggtgtgctttgagtccttttcatgttaggtgcaaatactacaggtttttgcttcatggtaaacatggagcttacataaaatatcttaatcttataacagtatactttgagctgataacaactttcctttcattgcatagaaaaactctatactttcatcccattcactttttaggattttgatgtcaacatttatatttgtttttgtaatttttatgccttaacaatttattgtagctacagttgttttcaatagttttgtcttttaaaacttacgtagtgatacaactttttttacacactaaccttacagtattagagaactctgagtatgaattacttatgccgttgacatatttttagtttcatatgtgtcatgtcataaattttagacttttggtaattcctctgaagacctcctggtgatgaactcccttaacttttgtttgtctgggaacgtttttatttctcctttttttctgaagaacagatttgccaggtaaagtattcttagttgactgtttgtttgtttgtttgttttcagcacgttggatatgtaaccccaatttcttcttgcctaaagagtttgtgctgaaaaatcttctgaaagctgtatttgggcttctttcagtgtgcatttctttttatactttaagttttagggtacatgtgcacaatgtgcaggttatttacatatgtatacatgtgccatggtggtgtgctgcacccagtaacttgtcatttaacattagatatatttcctaatgctatccctctcccctccccccaccccacaacaggccctggtgtgtgatgttccccttcctgtgtccatgtgttctcattgttcaattcccacctatgagcgacaacaggcggtgtttggttttttgtccttgcgatagtttgctgagaatgattgtttccagcttcatctatttctctacaaaggacatgaactcatcattttttatggctgcatagtattctatggtgtatatgtgccacattttcttaatccagtctatcattgttggacacttggcttggttccaagtctttgttattgtgaatagtgctgcaataaacataggtgtgcatgtgtctttatagcagcatgatttataatcctttggatatatatccagtaatgggatggctgggtcaaatggtatttctagttctagatccctgaggaatcgccacactgacttccacaatggttgaactagtttacagtcccaccaacagtgtaaaagatttcctaattctccacatcctctccagcacctgttgttccctgactttttaatgattaccattctaaatggtgtgagatggtatctcattgtggttttgatttgcatttctctgatggccagtgatgatgagcactttttcatgtgtcttttggctgcataaatatcttcttttgagaagtatctgttcatatctttgcccacttgttgatggggttttgtttttttcttgtaaatttgtttgagttcattgtagattctggatattagccctttgtcagatgagtaggttgcgaaaattttctcccattctgttggttgcctgtgtactctgatggtagtatcttttgctgtgcagaagctcttgagtttaattaaattccatttgtcaattttggcttttgttgccattgcttttgttgttttagacatgaagagcttgtccatgcctatgtactgaatgatattgcctaggtttcctctagggtttttatgtttttaggtctaacatttaagtctttaatccatcttgaattaatttttgtatacggtgtaaggaagagatctagtttcagctttctacatatggctagccagttttcccagcaccatttattaaatagggaatcctttccccatttcttgcttttgtcaggtttgtccaagatcagatggttgtagatatgcagcattatttctgagggctctgttctgtttcattgatatatatctctgtttcggtaccagtaccatgctgttttggttacagtagccttgtattatagtttgaagtcaggtagcatggggcctccagctttgttcttttggcttcagattgacttggcaatgtgggctagtttttggttacatatgaactttaaagtagttttttccagttctgtgaagaaagtcattggtagcttgacggggatggcatttaatctataaattaccttgggcagtatggccattttcacgatattgattcttcctacctatgagcatagaatgctcttccctttgcttgtatcttcttttatttcattaagcagtggtttgtaggtctccttgaagaggtccttcacatcccttgtaagttggatccctaggtattttattctctttgaagcaattgtgaatgggagttcactcatgatttggctctctgtttgtctgttattggtgtataagaatgtttgtgatttttacacattgattttgtatcctgacactttgctcaagttgcctatcagctgaaggagattttgggctgagatgatggtgttttctggatatacaatcatgtcatctgcaaacaaggacaatttgacttcctcttttcctaattgaataccctttatttccttctcctgcctgattgccctggccagaacttccaacactatgttcaataggagttgtgagagagggcatccctgtcttgtgccagttttcaaagggaatgcttccagtttttgcccattcagtatgatattggctgtgggtttgtcatagatagctcttattattttgagatatgtcccatcaatacctaatttattgacagtttttagcatgaagcattgttgaattttgtcaaaggccttttctgcatctattgagataatcatgtggtttttgtctttggttctgtttatatgctggattaggtttattgatttgtgtctgttgaacgggccttgcatcctagggatgaagcccacttgatcatggtggataagctttttgatgtgctgctggattttgtttgccagtagtttattgagtatttctgcatcgatgttcatcagggatattggtctaaaattctctttttttgttgtatctctgccaggctttggtatcagcagtatgctggcctcacaaaatgagttagggaggattccctctttttctattgattggaatagcttcagaaggaatggtaccagctcctccttgtaccactggtagaattcggctgtgaatccatcttgtcctggactttttttggttggtaggctattaattattgctgcaatttcagagcctgttattggtctatcctagccagttgcgggatagaatctggtgtgaagtttgctaagcctgttggaaaagcggagtactagggtgagagtaacccaattttccaggtgccatctgtcacctctttctttgcctaggaaagggaatttccagaccccttgtgcttcccaggtgaggcgatgcttcaccctgcttcggctcatgctcagtgtgctgcacccactgtcctgcacccactttccaacattccccagtgagatgaacccagtacctcagttggaaatgcagaaatcacacatcttctgcatcgctcatgcttggagctgtagactggagctgttcctattcggccatcttggctccaccccccgtgaatgtttttttaattcttgctgtcttcagtattctttgtctttgataatttgatgatgattgtcttggtgaattcctctttcagttgaatttgattggtgacaactaaccttcctgcacgtggatgatgttggctttccccagatttacaaagttttatctattattttcttaaatacgttttctgggtcttttgctgtctctgcttcataaactttttaaagtataaataatagtttgtcagatgatgtcccatgattcctgtagtccttctttatttttttcattcattttttatttttgctcttctaactggatagtttcagatgtcttatctttgagttcactgatttttttcttttttttcaagactgcttttgtagctttccattgaatttttttaatgtagttattctttatctctaggattttgattttcttttaaaattgtttctatttctttgtaaaatctttcattttgttcattgttttccaaattttatttaattttgtatttatattttcttaaagttctctgaacctctttaaaaggattattttgaattcttttgtcagttgtttcacagatctgcacttcttctgagtctattattggaactttattagatcttttcatgatgttatgtttacttgacttttcataatctttgtgttcttagatagataccagtgcatttgagaagataacctcctcttctacctttggtggtgacaaacctttattatttgtctattctgggttctggatgagctggctggtagcaactccagacaggcagaccatggtgttgggttatctagttgtgctggataatgttttgtcttctgaggttaaatgatactgatggctatgcttcatggactgatgagatcactctgacacaaaatggagctgctggttggcaatacaaacatctctgattaggcagggtgacaggatgtctctcctagctgcaccattgttgtttggaatctgcagttttgcagagctgtgtgctggaatctgaaacagggtgaggtctatgggcttgctgctaggccacacaggtatggcagggcctaagactacgcttgatatgtttttacttgggcttgcctcccagcctagggtagtcttaagcagagtactgaggcttggtccacttatgatgcagctgctggggtttaatgggggcagacgctccctccatggataacactgacttgcagttggctcctgggatgaggaagatgtgaaaatgtggctttcctcagttctctggtccaaaagggtttctcagactcactctcaagttctggaatgctcattatagtatttttttgcctctggttagttgctagttgaatttctgtcagcatcaggggagtgaagctggagaactcctattctgccatgctgctaacattactttccatgatcaacctctttgtcttttcattctaatattttatttacaatgtgtctttataatgatatttttaggttcaacctatttggaaaactttaagcttcttcaatgtcaattttcatttccctttctatgcaatgtataagagttcctgttgtcccacatccttgtcaacatttggtgttgttattattttgaattctggtcattataataggggtgtagttgtatctcattgttttaattcacaattccttaataacacatagtgttaagcatatttttatatgcttatctacccatatatgttcctctctaattttactttgtttttacaacactgcttctcaatggtgtcttctaaaagtgtgtgtataaccatggtagaaaatagatgggaagacaagggaaaaggaggttaaagaggaaagaaaatttcattaagtattcagtagtccaatcaattaaccaaaaattgttcttgtgggacctcaatataaatagattttcaatcatctgtctcttgcaccttgtgtcagcattcaggtgaaatgaagaatagagaaggaatcagaagagtgaaaagtagaatacactattccagcttatgtgctaataactatatgtaaatgataatctagagtttgttcacctcttatctctcctattttaaacctcagttacatgccagaaaccaatttaaattgatatccctttgccctactttatgattaccctcttatatgttcatatcagaaggatactcctctctttcctttacatacggactatttaaagttgaagatgcaaatgtgcagataccggagcatgttccataaagactccctccttttattttaaagtgataccaatatgcttaaaattctgttatgtttttatttaatcctattaaaacaaaacttgacggtattattttcagttaaattttatttcaaattataaatgacattctttgaaaataaaagaaaaacgttaataaatatggatggtttatagtaataaaaacatagatttaaattaattttttgaaaaatctattttattgtgaaaacggttcatattaaatttgttatttttaagctctttatgaatatcattttctttaattctgatgacaagccaattaaatataaactattttaacttttgatttacagataaaaattaggcctaagatttcatatatttttcttaaagttacaaggctttaaattggtaaagccaggatttggatttatgtagtgtgactctagagtgcttactactttaatcattatattccaccacccatcttaaagttaaaataagtgcaattcataatcactgcatcaacttccttatactttttatatttttggccatttgaaaagatgtttgaattaagatttttttttaccaacataggagacatatagaactgagttaaaaccttaatgctgttacttctcagcaagacaatctcaagggactaatttgttcagttctctcacctttagatttttcaccttgaaatttaatttttcaatagaaataccaaactttgtattattttagtagacacaagtataataaaaacaaagaatttggacacatttaaacgctacttgttcctgaaatgaagagataatcagaattcatactttttcttttaggtcaatcacttttgagggaggatggtcactccaaagttacccattgaatggatatggtgttgcagaacatttaaaatattttatctttattttccatttcgatttaactaatagtacttctacaatacacaaaacatttcaatattcttccccatatagcttcctcttattatattttccaatcttgatttatttatttatattttagtttattcgttttcttttttttcctgtgcctgtgcttacccatatacctttttcctaacttttaatgttcaattatttatctgcaatgcaaatcaacataaaagattttatatggtatgtgtgtgcatatgtgtgtgtgtgtgtgtgtgtatgtacatttgttgttgtagtgaaggatattagataagttaataatggaatcattacatttccattgtctattaaatatatggcctttctcgtgtatgacatgtcaactttgggacactagtgtgaacactggaaacattacatcacagaaaacaaaatgaagtgagcacattaaaaaacatgttatttaattgaatttattttaaatttatatttgacaggagaaaataatttcaattggtaatatttttcattaaataatgataaataaggttaaaaatgaaattgaatctgtcaacagttattaaagatgtggtacacttattacactgaaacagatgaatattaaaagtccataatatgaatatctaaagtgccgctttttatctgctgtcctcactctgggcatgaaaattccattgccaattctaacttgtgattctatgcagccccaattattaggacagaataaatagagatgtaacttcctatagcagtagtgggttccctgtttagggagaacccactagagacaagtgtcctgagtgttttctgaattcctgtgataattttatttatttcattgacatcacccaactttaaacacaatagatcataccatttttggtttcaaccatgttctacccttctgcacttcaggctcaggaaatatgttgtatctccagtatattagcctctgactcaaaaatacagaactttttaaatacaaagtagtgataaaatgtaaatgggcatcttgatatactgagttagttccttttccctagaagtgttcaggaggaagcttgataccttattgcaaatgcattagggaaggaatttgacatttctttgttggtgctcacaaatttgaacacttgtgattgtataaatgtctttctttttattaaaccagagtgtagacagagttgtgatgtgtagttcacaaccagcaatggcagaattgggctcttaggaaaaggaagagccaaattgaagatttcagggagtttatcagtctgtggtcaaaagcacaggaaagaagtaagaaaatcagatgcattagattagagtgcatagagatagtcaggcttacactttagaaaatgcatggctggaaaggaagataatctgaaaagaaaagactactggtaggtaatcacctgaattaatctatattctacctagttctggcacaaaagacaatgtcttggtagtcacaactcctgttaactagaaaacataggaacccacaaacttagatacgatgatatattattcccacagcattcaggtactttcctatttgctgtctatacttactctgttaaatcatgatttgactgaaaaagtaatcaggtcaggccctcaatttatcctttgttttctgaaataattttgccatgccataactttctcatggcatttttcacttctgcattcctcagtgtgtagatgagtggattgagaaagggtgttccaatagtataaaatactgccaccatcttgtccatggggaaagtggtcggggggcgtgtatatatgaatatacatgggccaaagaataagatgactacaattatgtgagacgtgcaagcggagagagcctttttcttccctttggcactgtggtttctcagtgaatgcaagatgacaatatatgaaattatcaaaatcatgaaactacttgagcaaattgccccactgttagacaccaacagcaggttgatcatgtaagtgtccatgcaggcaagtttcaacaagggctgcaaatcacagcaataatgatcaatcaaatagggtccacagaaaggcaatcttaaggccaggataatctgagctgtagagtgtattaaagaccctatccaggcaagaacaatcaggatgatgcagacctgctggctcatgatggttgggtaacgcaagggcttacagatggccacatagcgatcaacagccatgagaatgaggacaaagatctccatgcagccaaataaatgtagtgcaaagacttgtgtcatgcactcattgtaggttataattttcttttcagagagagcatccacaattaatctaggggctgtggaagttgaaaagcaagaatctgcaaaggacaaataaaatagaaagaagtacatggggcttcctagtgtccggctggacttgatggtcacaataatgagcatattccccaccacagttcccatatagaaaattaagaagattacaaacactattttctgcctcaagggatcctgtgttaatcctaacagtatgaattcaggcacactgttattttgctgcattgtttcagttgatgtgaagaaaccacagattagaactagttaatctgcaaaagaaaaaaagaaatagattctaaatttagaggtcaaatacatattcttgcaatgaaattgcaactttccaatggcttattattgacaattctttgtatttttttctgagtgaaatggaattcatagtaactattcaatatatttaccaaaatattattattattatttttgaaacagaatgtcgctctgtcctctaggctggactgcagtggcatgacaaaattacacatgaaaataatacaattagaaatagaaaaataacttaaaagcaaatgatttttcaaacaaagtaaacattaatttaggggtttggtatgagtaggtgtcttctgagctgaatgtgttcctttagcttatagccaagaataataaatattttgtactgtgttgcggtaacagatgaaaatgtacatgacttactacaataggctttcacattatttgaacctgacagtaccattataatatatttacttcctaaatatacagatcattctaatgatgttgtttaaatacttgagaataccttccttaataaaatttacatgtatgtgggtgtgtgtgcacacacacacacatacacagagaaagagacaataaacataaaatttttgcaatgagcaaaaagtcaatcattacagtccaacatgagaattattttaacctcttgccttgactatctttatttccttttaatttacctctgaaaattttctaattattttcagttccaaattcatcctttattattcaactttgtactgctttgttatactgtgttgtccaaagttaaattcgtccatctttccttatttttctgggttcttcataaagttttcttaagagacaagtagacactgaggctaaaatgaggaaaaaagtggaagaataattgacacataaatcaggacattctttcaaatttcaggtttgcaggtaagcatcagtgatttagaaaatgagatctatgcgctccaagtcaggactgaaactttcaatagaatttttagtttgtatgttcttatgaatcccatatcctgacttcaagaaagagaagttaaatatataatgggaattaatatttatttgcatatttcaaatattgaacaaatttttccatatactttttcacatatatattccaaatagcaacacagtaaaaaattaaaagggaagtgtcaatatgataaaatacatttacaacacatttgccagacaaaagcatagctttttaaaatgtaaattgatttcacagataagtttctgaaaaatatgacacaaatgaacattggaaaaataacccatcttaaaagagactgttctccttattataaagattatgcctctggaaagatgctcaatttctttcatagttaaatacattcaagttaaaattccagttagataattttcacctatcaggttaataaagtaatccttttgataaatgtcttaacaaatagtcttgacaaaggtgtgggaaaccgtcaaccctacaaacttttggtgggaatgtaagtgggtgcaaccttctagaaagtgacttcagtatctattatatgacaaccggatatagatattgatccagttattccgtttcctatagacgcactcattcacagaaacaaggacaatcattttgcctttttagatggtagcaagagataggaaacaactttagtgcccatcagaagggacattaatgaatcaaggatgatatttttacgcaaacattaataagaatgaagcagatacagatagctgtgtgtttatatgcacacgcacgcacacacacacacacacaaaattgtccctgacatatggtgtaaattgaaatgtaagagattaatattgcatgcttagaattgtaacattttccttaacatcagtacaatatatactacacacacctgcatatttctatacatgaattatagtagaagagtatgaaaaaactataatgactctgagcggggaaattgcattcttggcattagacatgggagaaataactacattaaaaaatattcactttggtagtatttgacaatgtgtcataataatgctacatcgaaaataatgttttaaaagctttaccttgggagatgggttgttattcaccttgtgatggcatatccctgagccatcacaactgtcttgttgtagacaggaattctagtggtattcttagggctacattaagcctcacaaatttgagtaagtcagatatagcagtagtgttgaaactcagggctctgtaaatacaacatatgcagacacactgtcactaactggagattcacttcctgtattgaaggtttgtgaaagctctttagcaaacagaaataaaaaattgtatttgtcttctctgaattaagtattataaaaagacacacacacatgcatgtatctccagaatagacatgaataagcaggaataaatagatacaaatagacatcattacacatttttatagtactatacattagaatgaagcaacataagaaagggtatttttatctgttcactgctgaattacagcacttataaaaaagtaggtttttgatatctgttgaatgaatcaaagaattaagagaaattcttatagatccaaatcattaatgttttatactattttatatttagctgcattaaggagaaggaagccagcatcctaccgtgggcgacatcatcaccttcatggagcacttcctggaacaccccaatagattttatttctgtttgtttattatttattttattactgctccttgcagagcagagctacccttaggcagtttgcccagagtaggctgtttctgtttaattatctcctacccacttctaccaacagctcttacctggtagtgcccatttccatcaagaaattctgtgcatgatttttatttccatcttttcactttagattgtaaagcacttctagaaaagtccttgaatttccccacctcccaccagtgtcttgtatatgttagttcctggctgttgtattgatcagatccaccttctctgaatgttagatacgactaagttattctcctatacagaccttaccagctttgataagagagtatgctatattaggatgttcaattgccctcttttcttcccaatataatttggaggctacttattcaaatgagaattttaaaagtgcttataaattaatatataactattctgatacgaggctctctttggtctcacaaagaagtttacatccccatcttaatggtagaaggcaaactaaattggttccagattcatccaacactttctgaaatctaccctcacgcaggatttttgactgggaaaattttctcttttgccttcccaggagaagtgcttaatatgaattatgcaaaatttaagagtctggggaatgtcatcccctcaagtgtcccttttggaacatgagccagatgtgatagataacttaatcttcaatttgtcttggattatggaaaaaagaggtagcccactcttgcaattagaggtgttaatttgagtgataaatgacgtttttgactagaattaaaaatggtcttctatcaaccaaatctttgtttctcataccattctccaataaagtgatcaaggcttcttgaagaaatgtttgattctagatttttaactgagagtgtacaaaataaatgagcgtttcacagcggtggaaatacagaagtgctaaaacatgcacacaaacggtgatggggacacaggagtcaactgaaacagcctacaacggccaaagctgtaaaaatttttagcaacaaaataaataacacagttttgaaatataaccgtaattgtaaaatatataccgaaaagttcatctttataaataattgaatacatagttaaataaaatagaattagaggttaactacctttcatttattttttagttgatatgtaataattatatttattggatatgaagtgatatttccatatttctttacaatgtttagtaataaaatcagggtaattagtatgtccatcacctcagatatttattttatttttaatttttaaaattttaatttttacttatttttatttttgtgggtacatagtaggtatgttatatggtttgtctgtgttctcacctaaatctcatcttccattgtagctcccataatccccatgtgtcgtgggagggacccagtgagaggtaattgaatcatgcaggtgggtttttcctgtgctgttctcatagtagtgaataagtctcacaagatcttatggttttataaagggcagtttccctgcacaagctctctcttacctgccaccatgtaagacattctgttgctactgcctccccttccaccatgactgtgaggtctcaccagccatgtggaattgtgagtccattaaacttctttttcttcaataaactacctagtcttgggtatgtctttattagcagtgtgagaatggactaacactatatatatatatatatatatatatatatatatatatggagtatatgagacattttgatgcaagcatgcaatgtgaaataagcacataagggaaaatgggatattcatcccctcaagtatttgttctttgagatgcaaataatccagttatactctttaagttattttgaaatatacaattaaattattattgactataatcaacctgttgtgctatcaaatagtaagtcttattcattataactctttttttgtacccaatggccttcctcacctccagtttctggtaattgtccttctacccaaatgtccatgagttcaattcttttgacttttagatcccacaaataagtgagaacatgtggtgtttgtctttctgtgtctggcttatttcacttaacataatgatctcccattccattcatgttgttgcaaatgactggatctcatttatttttatggctgaatagtatatacaccacattttctttatctattcatgtgttgatggacatttcagttgctttcaaatcttaactgttggaaacagtgccacaacaaacataggagtccagatacttctttgatacactaatttcctttctttggggtatatgcccagcagtaggatttctggttcacatattagctcaatttttagtttttgaataactctaaactttttcatgtggttgtactaatgtacattcacatctacagcatacaaggtttcccttttctccacatcctcaccagcatttgttattgcctgtcttctgtatataagccattctaacttgggtgagatgatgatatctcattgtagttttgatttgcatttttctgatgatcagtgatgttgggcatttttgtttttttgagatggagtttcactcttgttgcccaggctggagtccaatggtgcaatcttggctcactgcaacctccacgtcatgggttcaagtgattctaccattaaagtgaaaataaggtaattataagggcaactttcacttaatataaaacttctgaatattccactgattttgtactttacaattttactacttcctttactcatttatgatttgaactataagacaaattgagaaaatatgttcagcaaaacatgtttttgttttgttttcattttctgcttattatcccctaagcagaatcataaaatatgtggttttttttttgttttttttttttttttgagacggagtttcgctctgtcgcccaggctggagtgcagtggcgtgatctcgactcactgcaagctccgcctcccgggttcacgccattctcctgcctcagcctcccgtgtagctgggactacaggtgcgcgccaccatgcccggctaatttttgtatttttagcagagacggggtttcaccgtgttagccaggatggtctcgatctcctgaccttgtgatccgcccatctcggcctcctaaagtgctgggattacaggtgtgagccaccgcgcccggccaaaatatgtgttttaatggcaacaattgtccccacctgactgtgtttacatgtctcttttacctctgctaacagtagtgaccatttgtagcatgttccctcagaatacaggatggggtttttaaaatgtattatggattaagcgtctatgatgatctggaaaacaagccagaatcctaacttaaggaatgcacattttgctaaaacagaagaaaaactgcaaaatgatttgacatcaaggatgctaaatgattagcattagaccaatagaaatattatacatttctattaactataagaaatatccacataaatattcagtaatgcaatttgggtcttctggtaatctgtcacttttcattttcttttcttttctgtagagctgaggactcaaaatacttcctcttatggctgtcctacatgacaccccattttgctttgctctcaagcctgggatacacctcagactaagtgagagtcaggatatggataccaaacggaattacttttttatccagagaaaaactgaattttctggatctaagacttctttattgaaaattagaagtttggatatattgagcaattcccagattaatttgttcaccaatccacttctctgatggttatctttaaatcagtttgttttaggtaaataaatctatctgtaaaataaacaatatggtatcttgtaaacaaggacagcatcagttgtaataaagtaaggagaccaacaacttcttgatccccaccccaaatgccccaatgtattgtaactgtcattttactgtctacttttatgaaatcatctcttttagattccatatatgagtgagatcacgcagtacttatctttcctgttttatttcacttaacataatgtcttccaggttcatccatgttgtcacaaatgataggattctgagagggtgaatgttcagtgctctccccacatgataactacatgaggtaatgcatatgttaattagccagagttatcgttccactttgtatgtatactacaaaacatcatgttgtatgctataaatacagcagttcctctgtatctgtggggtatcggttccagaacctcccatggaagaccaaaatcagacaatgcttgagttcttgtcataaaatggcatagtatttgacataacagctgcatattctcccttatactttaaatcatctttagattacttataatacctaataaaatgtaaatgctgtgtaaataattgttatattatactggttagagaagagcaagacaaaagtctataacgtgttcagtacagatgcaaatttttttggagtattttccatccatggttggattgagtccatggatgcagaacccatgaatgtgggaggcttactacacatatagatgtatctgccaacttaaaaaataataataaatttgaaaaaaaaacagtaagaagaaaattggtcaatgacccccaaattgctaaaatctttttaggtacagttaactgctaagcattagaagtctgataattattattttgaagtgtgtgtgcacgtgtgtgcatgtgtgtgtgtgtgtgttaggcttatggcaatactaaagttatagtgggaagaaatcgagatttttctccttggtgaaattagacttgaattataattgaaaatagaattggtttctcacagtgtggacaatatttaaatgccatatcaatgacctatttaccatctaaaatggttgtaaagacacagtttttaaattcctgaagtgctgcatttgatgatttctaaataagtttgctacaaaagcactctgagttttctagatggtaatatgggatgcctagatgtggtggcaacatctgatacagaataaggtagaagtactgctggtttgttttcatccccatggggtgtcagttaattcctcatcattgggtaaaacagctcctggaagtgtctctctctattctgcactctttttcccctgcataaaatatgccttctcaaataaagtaaacctgttactattagcatgtgccaggagctgggaaatttgttaaataattttatttacttctgaaaaccattctagaagcctttaccatgttttacagatgaggaaactgaggattgtagagattatgtagatctccatgtccttatatctggtgaagagtggtcagaagttaaatctagtgccctttccactaccacagagtagatccccaggttaacctttctacccggcctttgttttcatgtaaaaaatttgttataaaaatacagtttcaggttgaagaataaactgaatgtataagactactatgagtgaaagggtctaaaacacaaaactcttatgtttctaaatattatgatttcaaaaacagacataaaatccaattcaagaaatgaaataataaccttagaattgcaagtgtcaggctgagccatacacagcaccacctcagtttccctgtctgcactacctcaccctcctctagacaaaataatataacaataagtccagttaccaatgtgagtctcagcctaaaggtttcctaataaaaacaatacccaaacactaaattcccagcatttgttccagcactgagaatccccttccagaaaacaggccaatactcgtgagttaatcttagaagggaggggctcaggcaggtcccatcagtctacttttaaaagaattactctcagaacataggccaatactccttgtcaagtaatagggggaaaatggagagacaaaacccaggtgttagaaaaagctgagtctaggccaggagtggtggctcacatctataatcccagcacttggagaggccaaggtgggcagattgcttgagctcagcagtttgagaccagcctggacaacatggcgaaacccatctctgcaaaatctacaaaaattagccggccatggtggcacatgactgtaatcccagctaccctgctacttgagaggctgaggcaggagagttgcttaaacccaggaggcagaggttgcagtgagccgagatcatgccactgcactccagcctgggcaacaatgggatactctgtctcaaaaaataattaaaaaaaaaaagataaacaaaaaaaaattgctgagcctaaacagtttactgtttttgattgggaaagaaaaaagaaaaagtcctgatgtaaaaattatctgcaaaggctatcaattttggataaatcagaacatggctgtaatctacttacatttctctctgtgttctaattcgcacccaaaagagactacaatgagctgtcatggataaatatttacatgctgtttaatagtcgatgtaataaataattcacattttaaactcaattggctattatccctgttggctaggttgagacattgttaattatcaaaaacaggaagcaaactaaatataattcatacttagttgtagagtgcactcagcccatcagcgatgtgtctggacacagaaagtgtgacaccttccctgtctccctctgcctcctttctgttgcagaattatagaaattgaaatatgtggctgtgagactgagggcttaagaacatagactctggcctttttcctgaatgagacagagagacttggtccaaagccttgttttcccattactacctgtgtggtcttggaaaaatcagcaaatcactctgtgcttcatttttctcatcagcaaaatgaattctgctacctacttcataaggttgttgtgatgattaaattaaatataatgttcctaaagacagtactttgcaaacagtaggtgagtaatagatggttgtggaagtggctagttaggatcactgattcccttccccctagagttagagatgtgatgcctactgacagaaaaaagggaaggtcctgtggataaaataacttactgggtagaacattattatgttgactctttgttctcactcagttcagctgcatgttcaggtagactaat

SEQ ID NO: 456 - DNA, 21166 bp, Homo sapiens
cgggcagatcacggggtcaggcaatcgagaccatcctggctaacacggtgaaaccccatgtctactaaaaatacaaaaaattatcggggcgtggtggtgggcgcctgtggtcccagctactcgggaggctgaggcaggagaatggcgtgaacccaggaggcagagcttgcagtgagccgagatcgcgccactgcactccagcctgggcaacagagcgagactccatctcaaaaaacaaacaaacaaatttttaaattctctagtgtgcactgtgaacccaagtgaatattcaaatccttccccttgcttactttcttcctacatttcttttctctctcctcctgttccctccattttcttttctttttttctttttctttttctttttttcgagatggagtcttgctctgtcacccaggttagaatacagtggcgcgatctcggctccctgcaacctccgcctcccgggttcaagctattttcctgcctcgtcctccaaagtagctgggattacaggcgccagccaccgcacccggctaatttttgtatttttagtagagacgggtttcactatcttagccagactggtctggaactcctgaccttgtgatccacctgcctcggcctcccaaagtgctgggattacaggtgtgagccactgcgcctggcctctccattttctttattgaaacaaattattataagacactaactcaatttcatttcttcttctacgtgctgagaataaaacaaggtataaaacatgattatccacatcaaaaaacttatccaccactatcaaatagactttaatccctctgatgcaagattggttcaacatacagaaatcaataaatgtgattcatcacataaaaagaactaaacccaaaaaccacattattatctcaatagatgcaaaaaaggcttttaataaaattcaacattgctttatgttaaaaaccctcaacaggctgtgcgtggtggttcacgcctgtaatcccagcactttgggaggctaaggcaggcggatcatgaggtcaggagttcgagaccagcctagccaacatggtgaaaccccatgtctattaaaattacaaatattagccaggcatggtggcatgcacctgcaatcccagctacttgggaggctgaggcaggagaatctcttgaacccaggaaatggaggttgcagtgtgccaagattgtgccattgcactccagcctgggtgacagagtgacactctgtcttaaaaaaaaaaaaagtttagcttgttttttaacaactgatgtatgattcacaaaaaaaagagagaagggaagagaaagagagagaaaaagaaaaggagaaagaaaggaagaaaggaagaaaatttttgtatgataaacagtgtacagtgtgagaaaaattctaaacgtttttgaacctgcacagatatattcatttttattatagattattcatgtgtgaattattcagaaagtacggagaataatgaagggctggctacccatcagtcaacgatataagattcacacaaggccaggcgtggtggctcaagcctataatcccagcactttgggaggctgaggcaggtggatcacctgagatcaagagtttgagatcagcctggccaatatggcgaaaccccgtctttactacaaatacaaaaaaattagctgggtgtggtggtgtggtgcacgcctgtaaccccagctacttgggaggctgaggcaggagaatcgcttgcacctgagaggcagaggttgcagtaagccgagatcgtgccactgcactccagcctgggtgacagagggagactgtgtctcaaaaaaaaaaaaaaaaattcacacaattcaccatccttgattagatatttttattgcaaaaagtaaaaaatatttttattgcaataaagtgtgtatttgaggctgggcatggtggctcatgcctgtaatcccagcattttgggaggctgaggcaggtggatcatctgaggtcaggagttcaagaccagctgaccaatatggtgaaactccgtctctacaggagaatcgcttgaacctgggaggcggaggttgcagtgagccgagatcatgccactgcactccagcctgggtgacagagcaagattccatctcaaaaaaaaaaaaaaaaaagtgcatatttcaaaaccaccgcttcatgtttttgattttttttcccttccctaggggaaccagtacacacacttgatctatattattcttctatacctttcattatatttgatattattcttccaaataataacaatggcattgtgttgcattttaaaagctttatatagccaggcactgtggctcacatctataatccgggtcctttgggaggctgaggcgggagtacaagaggccaggagtgtaagaccagcctgggcaacgtagtgagaacctgtgtctacaaaaaaaatttaaaaatttgcaaagtgtaatggcatgcacctgtagtcccagttactcagtaggctgaggctgaaggattggttgatccaggaattcaagactgcagtgagctatgatcgagtcaccacactccttccaggcaacagagtgagaccttgtctctaaaaaaaccccaaaaaacaaaaccacctgccctcatttccaaagcattaattaactaaaggactttgggttaactgattggcttcaacaaaaatgatgctcaacaactcacatggatattgcagaggatgatctatcctcaggaagtgcagacagactcgagtcctggtcaaaaatatcatgtctggaaggaggttctgatgcagcttccgagctgggtaagagatgttcagtgaggtgcttacagcctgacttgttgcactgtctatatccctgggacctcaatatccaacgctcctcattacactggctattttaccatcgttctgatcccaggagtgcacatccttaaagaccaagactagaggagtgaggaattcgggatggctgagtccctgtcccctgaggccacgtgtacaccatccatatctctccattgtttctgctcacctccacttcacgaatcttgctcccagaacacataccattcgtctagtaaaaaaaaggattttgatctgaagaatgtgagttctcttcattgtcagacccggaaagacattaaaatgagacagaaaccacacccctcctcccctcctttgaactatgcattcatctcataaaactgcttgctgttgccacaagtagctataaattaacctaataatagcatatgaattaaaaagaaattatttaggcagttagtgagggtacagaagtcctgggtaaggtttttctttttaataaaaagcagcccccaaatcatttcttttcaggcaaaaagtagcctgaaaaatcaagctgcaagcataggtaagcaagctgaaagcctgcgtaggtgaatgccagcagctgtgccagaagacaggtataaccaacatgaaggttttcttttttcttctttctttctttcttattcttttttttttttttttttttttttttttgagacagtctcactctatcacccaggccggaatgcagtggcgccatctcagctcactgcaacctctgcctctgggttcaagtgattcttgtgcctcagcctccagagtagctgggattacaggcgagtgccaccacacctggctaatttttgtatttttagtagagatgagatttgatgctgggcgtggtggcttatgcatgtaatcccagcactttgggaggctgaggtgggtggataacctgaggtcaggagtttgagaccagcctggccaatatggtgaaaccttgtctgtactaaaaatacaaaaattagccaggcgtggtgacaggcacctgtagtcccagctactcgggaggctgaggcaggagaatcgcttgaacccaggaggtggaggttgcagtgagctgagatcgtgtccctacactccagcctgggtgacagagcaagactccatctcaaaaaaaaaaacaaaaacaaaaacaaaaaacccttaacctgtaagccatctgcaagtttgggtcttacatgtaaactagctgggcacagtggctcacgcctgtaatcccagcactttgggaggctgaggcaggcggatcacgaggtcaagagttcaagaccacaatgaccaacatggtgaaactccgtctctactaaaaatacaaaaattagccagccgaggtggcgcacacctgtaatcccagctattcaggaggctgagacaggagaatcgcttgaacccagaaggcagaggttgcagtgagctcagattgtgccactacactccagcctgggcgacagagcaagactccatcttaaaaaaaaaaaatgtgtaagctgccccaattttccttgcttcgttacctgtcttttaaggttcttcaatctctgaccacacaggtagtatctggcaagcaacagtattcaacctgagatttcaagatgttatgtccattatgccagtaataataatctgtgttcccccagttgatctgtcaatctaaaataatcaaaagggtcagaatctagtttgttttattatttttagagacaggatctggctctgttgccccggctggagtgcagtggtgcaatcatagctcactgcagcctcaacttcttgagcccaagcgatcctcccacttcagcctcccatgtagctgggactacagatgtgcaccaacacgtctgagtaattttttattttttttttcagagagatgggggtctctctatgttgcccaagctggctttgaactcctgggctcaagcgattttcccacctcggcctctcaaagtgctggtattacaagagccaccacacccagccagaatctagtctaaagacagtttattcaagcacgatgtctgagacaagtcaccagggaagcacagcttccaaagaagggaagtgagtgtttcaaggtgcaaaagtttgagattgtttatgtaggcaaaattcagggaagtttaacagaatttcttttttctattttttttttttttttttttgagacacagtcttgctctgttgcccagggctggagtgcagtggtgtgatctcagctcactgcagcctccgccttccaggttcaagtgattctcgtgcctcagcctcctgagtagctgggattacaggcacctgccaccacgtccggctaatttttgtatttttagtagagatggggttttgccatgttggtcaggctggtctcaaactcctgacctcaagtgatccacctgcctctgcctcctaaagccctgggattacaggtgtgaactactgcatgaagcccagtttaacagaatttcaacatctttaaggcttaatgcatagttacaatatttggtattattcttctaaacagtaacaattgcattgtgttgcattttaatgcaactgattagtctgggtggttttttcttttagggaaggtgtatttaacattttacaatgatgacataacagtcgtggggtcctgtgtaccatctggtctgagttaggtacaggacagtaaaggaggcagttaatctataacaaaggtcagtgactggaagcagggagatctggtctctggtctctcccagtgctttatagaacaagaaccacaaagaagagccattatggaaaacagtatagaggttcctcagaaaactaaaaatggaattacgatgtgatccactaatcccaccatggagaatgtctccaaatgactgaaactaggattcacgacagaaaaatcaactggacacagaacaaggcagtaatcgaggaaacagaaaactgaaacgtataaaacacatagaacacagcaatggcagaattaagtctctcctaatcagcaatcatgttaaaaaataaaaggattggccgggtgcggttgctcacacctgcaatcccagcactttgggagattgaagtgggtgaatcataaggtcaggagatcgagaccaatctggctaacatgatgaaaccccgtctctactaaaaatacaaaaattagccaggcgtggtggcatgcacctgtaatcccagctactcgggaagctgaggcaggagaattgcttgaaccctggaggccgaggttgcagtgagctgagatcacaccactgcactccagcctgggtgatagaatgagactaaaaaaaaaaaaaaaaagataaaggattaaactatccaaacaaaaggcagtatttgtcagcataaatactaaaaattgattcaactatatttagaagagacttgttttagactcgagacaaaacagggtaacagtaagagtatggatagacagatgtatttcatgcaaatagtatgcagatgacagctgcggaggctgcactaatatcagaagacagaataaagtcaaaaccattaaatcagtcaaaggaggacatatatatacatatactcttcctgcttttttgtggttatgaaataagcgatgtcactaccttgctaacttttcttttctcctgtcttatttcacactcaatatcttcttctctaactaaagtacttctccatggtagaactgtccttgtaaagaaacattcgaaaggttttcatgacagccccaaggcagcagtgagtcctctaacacggcaatgatagaattacttttattcaatgatgattctttttctttctttctttctttctttctttctttctttctttctttcttcctttctttccttctttctttccttctttctttcttcctttctttctttccttttctttctttctctctctctttctttctttcttgtctttttttttttttaatttattttttgagacggagtctcgctctgttgccaggttggagtgcagtggcactatcttggctcaccacaacctcagcttcccgagcagctgggaccacaaggtgcccgctaccatgcccagctaatttttaaatttttagtagagatggggtttcaccatgttggccaggctgatctcgatctcctgacctcaggtgatccccctgccttggcctctcaaagtgctgggattacaggcgtgagtcaccgtgcccagccaagtaagatttttcttttggtctccaaaggagatgggttagaatcatagcaagggaagatgactgagggggaaagcgagaacttagataacattcttacaaataaatcaatgggactgttctaaaccaagtaagatgtcaaaaaaagatgatcaacctttgtccttcctacctaataattatttattttattctacaattcaggtttaataagtggatgataaatgcaacaaggggaacaattctaatttctaaaacaagagggaaaaatatgtgagaacaatagcattataggatttatgattatagactggttatggaacacaatgattccacattattatactgaatacttaggaggtgctgggcattgaattaagtgtttgtagtgcttatcagagtggagttcccagccgggtgtggtggctcacgcctgtaatcccagcactttgggaagcagaggtgggcagatcacctgtggccaggagttcgagaccagcttggccaacttggggaaaccccatctctactaaaaaaaaaaaaaagaacaaaaattagctgggcatggtggcgcatgcctgtaatcccagctactcaggaggctgaagcaggagaatctcttgaaccagggaggcggaagttgcagtgagcctagattgcacctttgcactcctgcccaggtgacaggctccatctcaaaaacaaacaaaaaaacaaacaaccaaaaaaaccaccaaaaaacaccagagtggacttcccaataggaattatactttatatggtcagtctaaggctctcatactaatcatttccccctcaccaggaattagattaagaaaaaatatatgatctatctctctgtggtgagattaaaggtgatatcttttggattactctatgcaatcccatttatcaatagatctgggaagaagagtcagatttctgtctctgggcatcatgtctgggtattacgtctgtatttgctacagccatctgggtccatgaggggaaccagccctaaaagaaagccacagccgggcacggtggctcacgcctgtaatcccagcactttaggaggctgaggtgggcaaatcacttgaggtccggagttcaagagcaccctggccaacacggtgaaaccccatctctactgaaaatgcaaaacttagccaggtgtggtggtgtgcacctgtaatcccagctacttgggaggctgaggcaggagaatcacttgaacccaggaggcagaggttgcagtgagctgagattgtgccactgcacttcagcctgggtgacagagccaggctgtctaaaaaaaaaagaaagccaaaagaagaaggagtaagtgaattattctctacattccctacctctgatatatttgcaaagaaatgtagctctctttattatttgagtatattataatcaacatttctttcactaaagccgacttcttcactgatcaagatagaatatctcaccactaggccgggcacagtggctcacacctgtaatcctagcacttttgggaggctgaggtgggcggatccaaaggtcaggagtttgagactagcctcgctaatacggcaaaaccccatctctactaaaaatacaaagattagccaggtgtggtggcagctgtctgtagtcccagctactgaggaggctgaggcaggagaatagcttgaatctgggaggtggagtttgcagtgagctaagattgcaccgctgcactccagcctgggtgacaagagcgagactctgtctctcaaaaaaaaaaaaaaaaaaagaaagaaagaaagaaagaaaatctcaccactgaaataatctaatgatagcaattttattgatgataaaactgagggtagtaagtagacgttgatgttgacctgcacagacagtttagcagtgaccgggctctaaaattacagaattctggtatcaacaatcagctcccattttgcacaataggtttcactctggcatgcatttcatatggccctaaatattcaatcaggcagtatcaattctgtgttgcgaacacagccttctttggattcttgccctgacctgtgagacgcctcctgcttttcttcctctgagaatatttaccaaccaaatcactgtaacacttgccacaggttaactttttaaacaccgcatgcaaagaaactgagctttgagaatagaattcatttttgacacatgacagagctccaaaagaggcaagatttcaacaacaacaacaaaaaacacacacacacatccatgatgcagactagtcactttaagaaaatcttgaaaggtcgggcgcggtgactcacgcctgtaatcccagcactttgggaggccaaggtgggcagatcactaggtcaggagattgagaccatcctggccaacacggtgaaaccccatctctactaaaaaaatacaaaaaattagcctggcatggtggcgggcgcctgtagtcccagctactcaggaggctgaggcaggggaatggcgtgaacccaggaggcggaggttgcagtgagcggagatcgtgccactgcactccagcctgggtgacagagcgagactctgtcacaaaaaaaaaaaaaaagaaagaaagaaaaagaaaatcttcatgatgcaagagtcaggcactctggcttaccaaggaatcctgtcatgttgattccttttagaagcttcagttcaaagcagagcacaaagatcacaaaaaagaaagtaggtcaggcatagtggctcatgcctgtaatcccagcactttgggaggccgaggtgggtggattacctgaagtcaggagttcgagaccaccctggccaacctggtgaaaccccatctctactaaaaatacaaaaaaaatccaggtgtggtggtgtgtgcctgtaatcccagctactcgggaggccgaggcaggagaattgcatgaacccgggaggcggagtttgcagtgagccgagatcgtgccactgtactccagcctgggcgacagagcgagattctgcctcgaaaaaaaaaaaaaaaagtaaatctcgatgcaagagtcaggcactctggcttaccaaggaatcctgttatgatgatttattttagaagctccaattcaaagcagaggacaaagatcgctaaaaaggaaacagcctaccaataagtttcctcaaagctttcttcatctccttatttctcaggctgtagatgaaggggttcatcatttgagggaccacagtgtacatcactgaagccacagcagtaattcgggaagactcagcaacagcagaactaatgtacaccccaaaagctgtcccatagaacaaggaaaaaacagagaggtgacagccacaggtggaaaacgctttatactttcctcttgctgatggcattctcagaacagaggtgactatttgagaataagagaaaattattccagagagaggaattgcaccaaatacactacttgcaaaatatatgaggatgttgttgatgagggtgtcagaacaggcgagcttgatgacctgaacgacttcacagaagaacaaagggatttcaacgtttttgcagaaggacagctgcaataccatcagactctgaaccagggcatccatagtgctcatgaacatggagagaagaatcagcaagccccagaaatggacattcatgaggactgtgtacctcagtgggtggcaaatggccacatagcggtcgtaggccatgactgcaagaaagcaactttccaagccagcaaaaaccaagacaagacagatctgggtgaggcagcctgtgtaagtgatactctgattctgagcttggatgttcactaggatctttgggactgtggttgtggttaaacagatgtcagtaaaggagagattaaagagaaggaagtacatgggggtgtggaggtgggagtcagagatgacagccaggagaatgagcaggttccccaggatggtgaccaggtacatggacaggaacaggctgaaagggattaacttcagttctgggtcctctgtcactttcatgagaagaaattctgaaacagctgtttggtttctgggtcccatgtttttgatgatcaaaaaatgggataattagacaatcaaatgtgttttctagactgcgggagcaacgtcaacagaggcaaacaccatcttgaaaaggggtagattctaagggaagaaaataaataagtgttgccttttgtattgatattactttactgcttttacaaaacttgaagctaatacagcacagcatcaataattgttaattctggaaatggttaaggggtcatcattttttatttttatttatttattttttaaatttatttatttatttttgagacagagtcttgctctgtggccaggctggagtgcagtggcttgatcctggctcactgcaacctctgcctcctggtttcaagcaattctcctgcctgagcctcccaagtagctgggattaaagatgcttgccacaacacctggctaatttttgtatttttagtagagacggggttttgccatgttggccaggctgctctcaaatgcctggcctcaagtgatctgcccaacttggcttcccaaaatgctgggtttacaggcgtgagccaccacgcccagcctcatctttttttttttgagatggagtttcgctcttgttgcccaggctggagtgcagtggcacaaacttggttcactgcaacctccgcctcccaggttcaagcgattctccttcctcagcctcctgagtagctgggattacaggcatgtgccaccactctgctgttctgattattaaaaatatttggtaatgaaaaaacaaaaaataaataaaataaaacaaagtacataccaggaaaacggctggaagactctgtctggacccccagagacttcacgccagccaacagaaataatacaaagctgtgtcaagaaccaggaaaggagaatcgcttgaacccagggggcggaggttgcagtgagctgagatcatgccattatactccagcctgggcaacggagcaaaactccattaaaaaaaaaaaaaacaccacaggaaagtgaagataaggtgaagtttagcaagctgctcacctcctctcccccacaagactgcaagtaaattacagagaattttataacagtcatcctgttttcaaagaaaatggtaactacagaattcaggatagtgtatttgttgctggaagaaaacaaggtgatttgagtagaaaatcctacaggtaggttctatggtgatgacattaacttatttttaatgccagataggtatatgcggttttatcatgttactattctctcagaattacagatagatttttttttttttcctgagacagtgtctcgttctgtcgcccaggttggagtgcagtggcacgatctcggctcacagcaagctccgcctcccaggttcacgccattctcctgcctcagcctcctgagtagctgggactacagacgcccgccaccacggccggctaattttttgtatttttagtagagacgggtatcactgcgttagccaggatggtctccatatcctgaccttgtgatctgcccacctccgcctcccaaagtgctgggattacaggcgtgagccactgtgctctacactacctacagatagatagattttatgcattactttgtatatgataatgtaacaagtatgattaaagaaagacccttcatattctaaccctaaatatgttttctcatgttctcctaatattaaagttaggagtgtcaggcttcagaggttatcagcatctctccaagtgcttattaaaaattctcatacctcacacatttctcagagatttaacaccagtagttctcgggcaaggccaagaaccttctctatgaggaaaggtctcgggtggttcctctctgtgtctgttctgtggacaccaacagaggaatctcagtcctaggagactctatgagtgctagaataggagctgcgttccagatatgtaagagctttttgttttgttttgggggttttttagagacaggatcttgccatgttgcccaggctggtctcaaactcctggcctcaagcaatcctcacgcttcagcctcccaagtagctgggactacagccacgagccaccatgcctggcttcccagatattttggtgaaaataaagccagctcctcaagctccaaagacagctgcaacagaagactctccacccactcctttgattctcttttgacacctccattgtttgctcctcacacttagagagataattctgactgatgatcctgcgtgtgtgtgtgtgtgtgtgtgtgtgtgtgcttatagaaaaaaattatgccccaaaatcttgccaacttccattttctcctgtcttgtcttacactcgacatctccttctcaaatgaaagtatttctctacagagtaatcttcctagtgaagacacagtaaacagttttgcacgggagcactgagactacagctaatcctaaaattatacaattagaatatatttgtgtaatatacatataattatacatatagaggattatatatatatgtatatctccaggtgtggtggcactcactcatttgtagttccagctactcagggtcgctgaggcccaggagttcaaggctgcagtgagccatgatcgtggcactgcactccagcctgagtgacagagtgagaccctgtctctaataaacaagtaaataaaaataaaatttaaaaagaaaatttctattacaaatagactctcttcacagcagacctacagaaagaccgtcggttttctctgagcaccatgtctgaatatgatgcctacatttctgcagacatctgtttgcaagaggaaaatcagcacagacatggagccatcttcccgaggcttgcatgaatccccacactactgctcccatgcatttcttacccctgaagttcttgtcataaaaaataactctgtttcttattcatgtaaattatagtcagagtttctttctcttataagaaataaaagcttctggctgggcacagtggctcatgaatgcggtggtcactggtacattgtagtctctgcctccctagcggctcaattgccaaagctcctcattagccaaggaatttgtgttggcactgtaatcccagggtgcttaaatccttgcagaacaagggagaaattcaggatggctgctgtcctgaccctagaggccaagtgtacatcatccacttttctttttttctttctttttttttttttttgagatggagtcttgctctttcacccagcctggagtgcagtggcgcaatctcggctcactgcaacctctgcctcctgggttcaagcgattctcctgcctcagcctcccaagtagctgggattacaggcgcctgccaccactcccagctaatttttgtatttttagtagagatgggatttcaccatgtttgttaggctggtctggaactcctgacctcaggggatccacccacctctgcctcccaaagtgttgggattataggcatgagccaccatgcccagtctattttatttttttaatttttattttaattcaggggcacatatgcaagtttgtacataggcaaacttgtgtcatgggagtttgttgtaccaattatttcattacccaggtattgagcctggtacccattagttatttttcctgatccctgcctcctccagcccttcacccttcaataggccacagtgtatgtttttcccctctatgtgtccatatgttctcatcatttagctcccacttataagtgagaacacgtggtctttggttttctgttcctacactagtttgctaaggataatggcatccagctccatccattttcctgcaaagaacatgatctcattcttttttatggctgcatagtattctatggtgtgtatgtaccacattttctttatccattctatcagtgatgggcatttagattgattccatgtctttgctattgtgaatagtgctgcaatgaacataatgtgtgcttgtgtctttatagtacaatgattcatattcctttgggtacatacccagtaatgggattgctgggtctaatggtattctgtctttaggtctctgaggaattcccacactgccttccacaatggttgaactaatttacactcccactgacagtgtataagtgttcctttttctccacagccttgccagcatctgttattttttggctttttagtaatagccattctgattgatgtgagatgatatctcactgtggttttgatttgcatttccctaatgatcagtgatattgagcttttttttatatgattgttggccgcctatatgtcttcttttgaaaaatgtctgttcatgttctttgctcactttttaaatggtttttttttcttgtaaattggtttaagttccttaaagatgctggatattagaccttcatcagatggatagattgcaaaaattttctcccattctgtaggttgtttgttcactgtgatgatagtttctttcgctgtttagaagctctctagtttaattagatcccatttgccaatttttgcttttgttgcagttgcttttggtgtcttcatcatgaaatctttgctcgtgcctatgttctaaatggtattacctaggttgtcttctggggtatttatagttttgggttttacatttaagtctttaatctgtcttaagttaatttttgtatataatttaaggaaggggtacagtttcaatcttctgcatatggctagccagttatcccagcaccattgattgagtagggaatccttttcccattgcttgtttttgtcaggtttgtcaaagatcagatagttgaaggtgtgcggtcttatttctgggttctctattccgttccattggtctatttgtctgttcttgtacaagaaccatgctgttttgattactgtagccctgtagtgtagtttggagtcagatagtgtgatgcctccagctttgttccttttgcatagggttatcttggctattcaggatttttaaaaaacagttatttctagaaatcattttaaaagagagtaaaatctttttctggaggtgtgtaagctacttcagttgcttcttggatgtgagcctttggttgtagctattttttgataaattttctctgtttttttcttggttgttactggcactactattacatgaatatttatgattatgtcacactaaaatatgtctttgaaccagaaattaataaaagttttctcatcttattgctttatcacattgaaagtcacaaaaattagttttatttctatttctggttctccagcctgggcaacacagcaagattgtgtctctaaaaccaaaataaagaaaaaattgaaatgttcagagactcagaaagggaaaagtcatgaggcaagtgttcagataccaccttggggaaagtttgctgactctgtggaaagtgagcaggaaatgaagtagcgttaagggtagaatgtgttgtcccagggttgataagaaatgtggtggtggtcggcctggtgactcaggcctgtaatcccagcacgttgggaggccgaggcgggagaatctcttgatcccaggagttcgagatcaccctggccaacatggcgaaaccccgtctctactaaaaatagaaaaaaattagctgggcgtggtgatgcttgcctgtaatccttgttactccggagactgaagcatgagaattgcttgaacctaggaggcggaggctacagtgagccgagactgcaccactgcactccagcctgggtgacagaacagactctgtctcaaaaaaaaaaaaaaaagaaagaaagaaaaagaaaaagaaaaagagaaaaactgagcttggagaatggaactaatttttttttattatttatttttaatttttatttatttatttatttattttgagacggagtctcgctctgtcgcccaggctggagtgcagtgcggcatctcaggtcactgcaagctccgcctcctgggttcacgccattcacccgcttcagcctcccaagtagctgggactacgggtgcccgccaccacgcccggctaattttttgtattcttattcgagacggggtttcaccgtgttagccaggatggtctcgatctcctgacctcgtgatcctcccgcctcggcctcccaaagtgctgggattacagacgtgagccaccgcgcccggccgtggaactcgttttcgtacaatcacagagctacacacaaagaacaagtgatgtttcaaccccaagttaaaatgtacttacccactatgttatctaatcattttagaaaactcagtgatagatcagtcaggcattctggctcaccagtatttctgtgtctttgacccactttgaatcccaagtccaaagtggacaacataatcaggaagagaagttatcctaccaatgagtttccccgaggctctcttcatatctctgttcctcaggctgtagataaaggggttcataataggtgtgaccactgtgtacatcactgaagccaccgcagccctccttgaagagtcagaaacggcagagctaatgtacaccccccaacccgccctgtagaatcgggaaacaaatgggaggtgagactcacagctgaaaaaagctttattacttgctgacggcattctcaaaacagacaaggctatttgagaataagaaaacatgaccccagagagaagaatatcaccaaatatgcaagttgcaaaatagaccagaaagttatttttatttatttatttttattgtttttttttttttttttttgagtcggagtctccctctgtcacccaagctggagtgcagtggcatgatctcggctcactgcaacctccgcctcccaggttcaagtgattctcctgcctcagcctcctgagtagctgggactacaagcaagcgtcaccacacccggataatttttgtatttttagtagagacagtgtttcaccatgttgggcaggctggtcttgaactcctaacctcgtgatccacccgcctcggcctcccaaagtgctgggattacaggcatcagccaccgtgcctgactgcagtagccattattttattctgattttatgagatcagctcttttggattctacacatggttgagatcatgcagtatttgtctttctgtacctggcttatttcacttagcataatgttctccaggttcctccatgttgtggcgaatgacagaatttccttctttttaaagggtgcatagtactctatcatataccacattttctttttcttttccagacaaagtctcactctgttgcccaggctagagtgcagtggtgcgatctcggctcactgcaacctccgcctcctgggttcaagtgattctcctgcctcagcctcctgagtagctgggattacaggcatacgtcatcatgcctggctaatttttgtatttttagtggagacacggtttcaccatgttggccaggctagtcttgaactcctgacctcaagtaatctacctacctcaggctcccaaagtgctgggattacaggcgtgagccaccgtgcctgccataccacattttctttatccacttatatgttgatggacattcaggttgattacatttcctggctattgtgactaatactgcaatgaacatgagagtgcagatatctcttcagcatattgatttcaattcctttgaaattcaacagcacaaacataaatcaatataactatagatagtcaacctaaataacagaaagaggctatctaaaagaaaatgatgtttattgccaaagaaagcattgcaatagcgatacgcgtgccatcataaactatgtatgcattcaaggaggtaaaggaagacaaagttttttaatggaaaaatgaggaaggttacataattgttttgaaataattatccttcacagtaataactaataacaagggtgatgccagtctgaagctggacaggcagttgctgggcagatgtacttgcagaaatattttttgtgtaaggttgcaacagccttttgtgcaaggttgtggtttttgtcgtctcgtgatagtttttgtcgtctcgtgatagtttttgtagtcttgtgatagtttttgttattaggcatgcaagtgaaataaatctcttcatggccttccctagctttacttgtcaggatgtttttgtttttttcatttttgtttgtttgtttgtttttcatgagatggagtcttgctctgtcgcccaggctggaatgcagtggtgcgatcttggctcactgcaacctccgcctcccaggttcaagcgattctcatgcctcagcctcctgagtagctgggattacagatatgcgccacaacgtctggctaatttttgtatttttcatagagatggggtttcaccatgttggccaggctggtctcgaactcctgaccttgtgatccgcccacttcagcctatcaaagtgcagacttttttgatagccgctacacccagccttttttttttttaataagtgactccattttgattctgacaattttaacaatatatataccaagtacagtcagccttccatatctgccagtaccacattcatggactcaaccaactgtggatcaaaaatattaaaaatattaaagaaaattttaaaaatattaaataagaatattacaaaaatacaatattaagtaatacaactatttacataggattaacattatgctaggtaatataagtaatctagaaatgatttaaagtataggcgacctgggcacagtggctcacactgcttaatcccagcactttggaaggctgaggcagaaggattgtttgaggccaggagtttgaggctgcagtgagttataatcacaccactgtagttcaacctcggcaacagagcaaggctctctctaaaaaagaaattaatcatttaatattaaaattaaaaattaattacttgatttttaaattgtaaataaattacttaatttttaaattaaaaataaattagctagctgggcatggtggctcatgcctgtaatcccagcactttgggaggctgaggcgggcagattacctgaggtcaggagttcaaggcccgcctggccaacatggtgaaactctgtctctactaaaaatacaaaaatgagccaggcacagtagcaggcgcctgtaatcccagctattcaggaggctgaggcaggagaatcgcttgagccccagaggtggaggttgcagtaagccgaaattgagccactgcactctagactgggcgacagagcaagactctgtctcaataaataaataaataaataaataaataaataagtttttaaatttttaattaaatttaattttttttaaaaaaagacttagtattggatagaccagtagggtgactatagttcaaaataatccattgtatatttcaaaatacctagaagagaacaattggaatggttggagcataaagataagacaaatatttaaggtgatggatatctaaagtaacaaatccttgcagattatacaaatgtattacactatcacatgcatcctgaaacaatgtacatctcttatgcattgatacaaaaatttaaaaaaagccaggtgtggtggcatgcacctgcagtctcagctactcgtcaggctgagtccagaggatcgctttagcccaggaattcgaggcagcagtgagctgtgatcacaccactgcactccagcctgggcaacaaagtgagagactgtctcaaaaatcaattagtcagtcaatcaatccaaaaagaactcaagtccacgtggtccgattccaaaactatcaccctgaaccatctgatctctggtctcatgtattcaaagacattggtcaggtggggcacagtggctcatgcctgtaatcccagcactttgggaggctgagacgggcagatcacctgaggtcaggagttcgagaccatcctggccaatgtggtgaaaccccgtctctattaaaaatagaaaaattagctgggcttggtggcacgtgcctgtaatccc

SEQ ID NO: 457 - DNA, 118572 bp, Homo sapiens
ttcccttccttccaaacatgttcttcatttccctgtggaacccagaaccatgtcatgcacacaagcgcacggtgcccagtggcgtccgttgatgaaacgtgaactctatttgctctagtctagagccttctttctgacctgttggcccaggcctgggtcaccacctttccactggtcctcagcacatatattctgggtctgcctccccttagttcacttccaattcatcacaaaaaagtaggtcccagcgactccatctatccacaatggacagctttcctcctctcatctgaatcctgccttcatttcagatgaggcccaagtcccctcttctagagtctggagcctcctcacctgcctcccagcctgagtctctttctgtctggctcacttatcccagccagcctctccctactgactgtccactgcctgaggaactttacgtgtattatctttaatatcctaacaaccctctgaggtgaacgttatcatccccactttacagatgaggaaacagaggctcagagaagtgacagaattgagaccccaacctatgcctactggctccaaaacctctgctttttttcaatctaccacatggtatccacttatgaaatataactcctttgttgtccacttgtccattacacatctattgaacacctactgtgggaaagacaccagtcttctttctccgactagatttagaaagcctttccttttcttggatccctcttgatattaagcacagaagccctaaaggagcccaccatctacaaatagctgttggggatctctattatcatccctgctaccccctgcccctgctgccagccctgcctagattagcatttgctgactgatgtttctctggcactgtgctattggtctgtgtgggagggaggaggggacagggagcatctccaccctcacaatcttcaggccccttgtctagggtattggaggcaaaagctgggtttggccatgtggtaccctccagtctcatccctctgtattcccccatatggactggcccttcaggatagctacacaggggaaccatgggacagtcaactcaggaagattcaactttaggtgtgcacccagccaaacagggagaaagagagccagaacaaattaaataatgcatgttgttctgcttgatgaagtctctttgggctgttgcggggattaaatgagtgagtatgtgtaaagcacgtatgacaatgcctgggacatttcaaggtctccaaaatgtgtgctagatcttttcctttcatgcctccagccttctccaccctgccctttgtccagagggctctgcctgggctcctctcccctctggctttctgctgtgttcagccatcgggaggcacaagcaggagatgagaggcgtggggagacaggaactgaggctcctagtccctgggggctggctgctgggccacagttaggcaggttcctccacccaaggctgcagctgctgtctgggcctctttggcagccctggttctcacctgttctggtaaccttccctctactggccccttcagggatgctggcctcctgcatctggccccagggtgcagcttgttgggtcatttaatcctgcccttttctgtagaacctgttcataaagctttcttggcttcccccttggacgagccacctgctccctgctgccaccctggttagccattagcaatggtggtaccagcagtatttcctctctgtggactcctcctctatctttaagactcacttcaaatgtcgcctcttcttggccaagtctttccttaggctcccacacaaagctggccacatctttctctgtgcacacaacagcactttgtccccaactctgccatgggactcaccaagctgtgctgaactttctccctttaccctcctgtctccccacaagcctgtgtgtggcccagacacaggcctggcttgtgagtgtggtggtagagccaaagaaccccttccccaactgggtctgctcctctctgtgcctcagtttccttatctgtaaaatgaggactaacatctctttttaaaatgggatttaatcactatgagagattaatcattgttttttagtattaatttaatgagttaataattatgaagagttcagaacagtgcctggcaggtagtaagtcctgtgtttgttacataaaactaagtgacaataagtggacataaattctatatccacagcagtgggcagcgagtggccctctgtagatgttagtgggatgaatagatccagccacacttcttcccaggcctttagagtgtgcatcccagtggtaccaggctttatttgactctcattttcttatcatccatcttttctttttcttttgctttctttctttcttgtctagggttctctctgtctctgtctctgtctctctctctttcttttctttctgtttctgtttctttctttttctttttttttttttttttgagaccaggtcttactctgtcacccaagctggagtgcagtggtgtgaccacagctcactgcagcctcaacctccaggctcaattgattctcctgcctcaacctctcaagtagctgggactacaggtgcacaacaccacacctggctaatttttgtattttttgtagagatggggtctcgctatgttgcccaggctggtctcaaactcatggactcaagtgattctcccacctcagcctcccaaaatgctgggatttcaggcgtgagccgccacacctgacttcttttctttttctggaaccactttattgaggtatgcctgacatgtaaagcgctgtatatatttagtgtatacaacctgatgagtttggggataaatgtgcacgtgtgaaagcatcaccaccatcaaggacatagacagtgcccttcatcttttcagaggctcttgacatgtcagctagtttgtagtatttcaccctgtgcctggcacagcaatcacgccctgcttctccttgctttccttcctcgcttgctgctccttctcctccaaaagttgaggtaccccgggctctgtcctaggtctcctctccatctgcactgtctctctaagtgacctcattcatctcaggggtttaaataccactcacacccccaaggacctaccgatgcttatctccaggccagacctacagccttctcagtcacctctagcaggcgtctcaaacttacagcattcgaagtggaacgctaggtttccaccacctcctgctccgtctccaccaacctgctccgtctccaccaaatgtggattcacccttgatgcctctctttctacgctcgcagccaatccatcagcaaagcctgtcagtttttcctttaacatgtatcctgaatccgacccattctcacccgagtccgagcccctgcctctggcctgggctcctgcaggagcctcctgactgaggtccccttctactcttgggcccctcagtggattctctacagagcagccagaacaattccttttaaatgtaaatcattcacacttacaagaaaatcctgacctgaccatggcctaccaggcccctaccacccctccgacccatttctcaccattctccactcacgattcctctgggacacactgtcctacttgctgttccatacaggcgggcatctgcttgcctcagggccttcacacttgttgcttccactttagggaatgctcttctacatgtatctctgtggctccttctcctcacttcttctaggtctctgctcagatgtcacctcttcagagaggccttcgtgactgcctaccttgtcacttactatctctctctccccatcttagtttattttttcatagaatttatcactatctggcattgtatgatacttttgttgatttccttttaactacctgtcttccctactggaatgtactgtctaagacagcaagggctttattttgttttttgatgcttagagtactgcctggcatatattaagggctcagtcaatatttattgcctatgtgaataaatgaatgattaacaaattcctagagagtggtggctctttctgatcttattcatcccaaccggttgtcagatgcctggcctcaggcagaatacacagctatgctcataaatgcatgattgctgaagaggcaataaatacttttaagccaatgagtaaccaagttcctaccctgtgctggtgctgcgaacagaagagcagtctccctttgaaagctggttctctgagggagaaaacagtctctgaccaagccctgctcccccacatcctggcccaaggttgctactagttactggaagggtatgcaagtgctcctggcggccttggggtaacttcacaaatcaaagggagtcgatgcctggagcctgttggctcccactggacactctgcaggtatcagctggaaacagtgtggttactgtgggcccagagcagccagtactttaattgctagttagttttgactgtcttgtgaggtaagttctacaaactccatctcatagctgaagaaactaaaactcagggagagtgggtggcttggtcaaggtcttcctgacagtgacagggctaagatttggtcccagttctgctaactccagataataatcaacatggacatttcttgagagctccctaagtgccagggtctatttaagctccccacacacatgtaggtctcattcagcattcatggtaaccttattcgttaaatattgttatctcttttcacaagtaagagcactgaggcacagagagattaagtaacttgctcaaggtcacagagcactttccattataacacactaccttaaatattacttccaacaactaaggatttagatcacaaaccatttcttccaaaacactaaggaagggacccctacaaagcaaacaacagcaagctgtaaatttctcccagcatgtctgtgtgcctcctttctatcctctgtgcttcatcctctctccccagttcctggatgatccccaacctgggaggggaaggctgtggctgtctccaaggcagcagggcacaaagtccagcctgggccttgcctagcgcatggcgcctgccctgcctgcacacagggatattaataagtaatgactgttgcgatgaggaagagtagggcagaggaaacgtggaggtctgaggccctttggagcctgtgggacctggggaagaggaacagggcaaacccaggatctgcatcagacaccagggaccctggagatgattctcacaaaaaagagagagcaggtaccccacagagtgaaggcagaagacctgatgttatttcaggccaggggcaggaaactgaaattcaaccctgagtcttgggttgggggatggaaggctgagctccttcaaactgggttgcctgaaatctacactcacaaaatgtccttagtggctgaaatttcttccgacatgtctctttgcaacaggatgtaacagtgaatgctctctcaagctccccttggtattcgccagcccctaaattcctgctgaacttccagctatcacccacccctgggagcaggaccagaaatgcccaagaccttgttttcaggagccttctgccagtttgagctgtccctttgtgcccctacaaaagcttggcctcaacacgcagcactcagacatgggtaattaccagggtagggtctgcctcccacctacaccaccagcaaagggcacagactgggtatggctgagaggatgctcaaaacatgcttattaaatgaataactgaccccgggcccttggccccaagcccctgtggcccctacactggctagctccttgggctcctatgggcctctttatgggaaggaaggagttaagcaccctgacctgccctacctgagctcagctctcaaaccaggaagaggtttggcttggtctaaagacactgcccctggggtctttgggagagccttgggtcacacagttatcaatagttaagttatcaatagttacctgcccctcaggcagggcctgtggggagctccagataccacccaccccccccaagcggcttcatccccagactcagaggcatcctaagacttggtggggaagtaggctggatctctttgatggccctctctggtctcagggcctcagcagattctgcacagctttgtgaatcattctcgaaatgccctgtgtgaaacctggccacttccagagatggtccttgagaatcccagaccaccagtgaggcccctcactgggacacaccagggtggacccggctctgcctgaaggatctggccggccagagcccagctccgacgccctcagtacctcctcccttcctccccaccgcacccgggtcagcaccagctcctcagctacttctcagaccctaagaaacgcccttaggcaggcagggctgaaatgcttctaactcatgttctgaggtcaaaaggcagagagagagacgtctagtttcccttctcccaaccctcacctctcagatactgccccagactgtctccacatgcctcaacagccctgagctgggggcactaggaaggagaggggcttgcccacaaagggggcacctcagaaaagcggccaagactggaaggaattcaaaccccagagacgtccctgcccctggaaggcagagggagaaaggctggcagaagatcgactcgtttagcagtccttgagccgggagtccccgcattccctccctcactttactggggatccctgctgccagccagacgaccctcgggtgtcccagcccaaccagagccatcaggtggggccggaaaagggaggggcagtgccggggtgtccaccccctacccaccgcgcccaggactccggagtcccagaagcctggggcgccctgcagctctgaccttatgccggaattctcgggccacttttcggtccatggctgggccaggtccagctgcgtcgttgcacgacccgttccttcgggtgcccggctgccaggagctggaaagagccgcgaccgcgaccgggccagccgccctcggagctgggggcggggcctgagcgcggaggggcggggccaggcctctgtggggcggggccgctgcgaggctggagtcgaaggtgctgagtcgtcgcctcccactgaagcctgggagcaaatgggccccagtgtgcctatgggcctgaggtggcagtagctgggcttcaagctggtatttctctggaagtggtacctgaacacatgcgtttgaggaagaagatcgtggagacgtagggaggaggtttgggacttttttgtggggaccggaatagagagatacggaaactatttacacgggcggggggcggggcaatctagtccgttttctctggatattctttttttttcccccccgagacggagtctcgctctgtcgcccaggctacagtgcagtggcatgatcttggctcactgcaagctccgcctcccgggttcacgccattctcctgcctcagcctcccgagtagctgggactacaggcgcccgccaccacgcccggctaattttttttttttgtatttttagtagagacggggtttcaccgtgttcgccaggaaggtctcgatctcctgacctcgtgatctgcccacctcggcctcccaaagtgctgggattacaggcgcgggccaccgcgcccggccttctctggatactcttgtcgaggttcatggccctcctggactgtcagcccttgctacgccctcacctccagcgtaccttcagtcctggcttcctcctgcacttttccaccagggagaaatcaatccttgttctgtgaattccttggggacagggctgggttttactgtgggccgcaggggtctgaatcagtgtgtgtgagagtgcccccctcaactgatttcccctcccaccttccctaacacctccacccccaacaaaacaagacaaaacaaaacccaaacccaacacactcacatatccatcgaagcctggcagagcctggcagtgacattttgatctatggctgaccttcacccagggcccagaccctctggttcatttaattcaatttggtcagcatttgcttaactcctaggtctagtgcttggtgcaaagacaatgatgaaccaggcctggaaaggaatgaaaggaaagattcatcaaagacaatgatgaaccaggcctggaaagagatgaaaggaaagaggggctaggagaggggtgataaaaatgtgtaaatcagaggctaagtatggggcttgtgcctgaacttaacccagggaggcacctgagccctttgtgccctgtcaagggcaggggcaaggagatggacagcagcttacatcaggtaaccacttacaattgtaactctggggcacctaaacacccctctgcgtccctctccccaatagctgaagttttacaagcacactatttttgttgcctagtttaagatgtaaatccctcttggagaagaaccttaaaatatgatctgttttctcaccttagcattaactattaagtcagcgataaaatggaaagacttgtgggatttttgaatggtccagaaaaggccacacaaaatgcattcccctccgacttacttcattgattctctacattggaaaagaatgtcatatggctgtttattttgtatttagaatcctggcagaggtgaatgaatgtccttatccaggggaatgctgttcacctgccacaccaatccttattttacattggccattacccccacagactccctccaccttaaaatgccccctgctttgttttgagaatagcattgagacctggttctcctctctcatgaatttttgtttcaagcttccttggagacaatcagtctttgcctgttccttaaccagcattccttaaggctccatccttagctctttcctcttcatcttcctatctgtgcccccagcttcctcctgtgtgaagatagctgtgtttgctttatttaccactatatgcctagaacagtgcatggcatggaatcaatgccaaacaaatttgttgagtgaatgaatgaatgaatgaatgaatgaatgcatctcaaatctatacccttgcctagaagtctactggggccaataccaccacgaccaccaccaccaccatcatcatcatcctctgtaagacctagcatctagttggtgttccctaagtgatgacgaagtgaatgatgtacagattccccaggtgctcagtcccatgtttttgccattttaaaattcctcctgggcagacagtggacctcgttcacacatataaagttgttttgtcaaagtttggccttgatggtggcaataacataggagtatgaaacacttttattattcaatcgtcatttcctgagctcgggcaggagctggtgctgggcattcagaggactaaggcatgatccattccctagaggtgctcaaaactggtcataggatacggatgtggagacccaggtggaagctgaggtggggcatggtgagaacataggctaggactctgcaggctctgttattgaccactgatccctgagtggcatgtcccagggcctcagcatggccctctgtaaaaggagaggatagggccagactcatacctgcatcttgcgtctctggtattgggcttccaggacccaggtaaggggagctggaggttgcataggctgcctctatgcttccctagacaatttagggctgagtaatctgaatccagcctcccctggggaggtgtggccacaggccaagaaaagcagaggctaggctatggacaggcgcctaaattatggtaataagctgggtactcctgtcactctagttcggggaggagctgagagcctgggaggaggggctgagggagccctggggcatgagaacaagagggacctcggctgcggagtggaggtgtgaccctgccttagcccggggaggcacctcgggaggctggccctgcgctcaagtcctccggtcccctcgtgtccctatgggagtcctggcgtctgcgctctgctggctgctttgtgtctggctgccctggggtgagcaggcagccgagtccctgcgggtgcagcgcctcggtgagagggttgtggactcagggaggtcgggggctcgaggaatgagaaacgttaaaggaatgaggaatgggcccgcgcaggttggagagagggaggaaagagaggtttgagggagagcagagggacacccaggaggagcagtcaggggaggagggaccccgaagccaacagaggcaggcctatgaccgcgggggaaagagtccaaagttaggctgggtggaagagacccgaggtggggaactagagagagctgggggccaaagactgagagtaaacagggagatcctggctggagaagggtcatcaggaagggagagaaaggatttgagaaggctgcagggagggagaatgggggaatgctcagtggcgtgggagaggctttctagcagtgggggccaggtggtgggaggccccagtaaagacaagcacaatttgagtggagaataatccccctccccagccgcagcacccgttctgtggggcagtgcagagccacagccagagccagccgggcaacccaggtgagtaggtgtgagctgtggcggccccacccacagctcccatccgtatttctggcatcagcgaccccagggctttagcacttagggtgggataggccaggggactgcggggaggcataacccatcctagccccccatccatgccagactcgtgtttcctccagcagcagccaccaggaggcgacccttgccatgggggacaaggctacagtcgtgggaggccaggtaagggaggtcttgggagggggcttcattgagcaggagctcatgtctatctggatctgaggctggcagggagctctgtaggttacaggaggggtctctggagttgttcagaaaggaacaagcagattcctggtatgtgtctgaggtgtgcaagttcataaaacccttctattctttttaatctcttgggggtctatagtccactcttttttttttttttttttttttttttttttttttttttaggagaggtgggcaccagggctctttcaggagagagctgagctctcccttctggcaggtaaaagtagaaagatggacgtttagaagaatggagttctcttttccctgactggcctgcgaaggccctcaaccctgtcagaggctcctctccataccctgagcggagcctcaagaatgcaggcaagacaaaaactaggccacctggtggaagttgcaaggaaggtttggttgagaagcagagccctgaactcatcctttgagcctttttttttctttttttgagtcggggtcttgctctgtgacacaggctggagtgcagtcgcataatcatagttcactgcagcctcaacttcctgggctcaagtgatcctggtgcctccgttacctgagtagctaggactataggtgtgtgccaccatgcctggttgaatttcaatttttttggtagagacagagtctcactatgttgcccaggctggtcttgaactcctggcctcaagtgatccttctgtgtcagcctcccaaagtgctgggattaggcatgagccactgagcccggcctctatcctttgagtcttgaccattccactgcccatcttcccacggtcctctgtgtttgtgggagaggtggcagttttgttttctccctttgccaaacttctttggtctctggatcaggtgactcaggtctactttctaatcctggcccgcatttgtctccctctttctataactacagatgagctataagttccacccacctgcagctaggtcccccaaagcagctgagcctcagctcaagtgcccctgccccagccccagcggtcagctctggggagccccttgagccagcagattggggagaatcgtttatgacagcaatgagtcccaactcctgccctttggaaatagacatgaagaccccaaggtggagtgaggggggatggtgtgggcgtgcttcttctctgatgtggatttcctggatcttttacttcttctttgcccacacttccaggccctaagatttagaatcacagtcaaatactgcttgagttggaaggtattggagtcatttttttgtaggtagggaaattgaggtgggtggatgacttgtgggggccctgcaatgagcaggtggagcaaagtctactggcagagccaggccgtgcatacaggacttcaggaatccccatgttttagtgggggagatgacccttctccaaacacttcatttccctgtgggtatcctcccgtgctggtttccagggtaggcatcccgccttttccttggggaagggtcataagtgagtggaccaggcaacctggggaggtttctcacgctgctcctcagagcaacgaggaattagaatggcctccctctaaggtgacaggagttggggggtgggggactgaggctcatgtaccagggatacttcaagggctcctgtttggaatgccctcttcatgaagtgggggtgtgccccagaccagtaggcaaccaatcttcatttcaatgctgtcccgcttctacagagctcaaccattttctagagaattgttgtagacaggggtccatggatgggggaaaataaaaacacattgttatttacagaaacctcaatccaactgaaattcagcatccttttcaattattattatagtctacaaaccacaagagtatttgcagtgtttttgactgtcaccaatagacatgacagatattttcctaccacttatagatgttgctgtctcaagatatcatttatgttcatcactacttcaaaattttggcagtgataaggcccactgctagatcttttatttattgagttattaaagaagcacaaatattactaaattacacatttttataaaatattttcataaaatgatattgtgatataagtgatttcctttgtaaccttatcctttattttatgtttttaaaaacattattctgagaaggtgtccacatagggtcactaaattatctaaggggttcgtggcataaaaatgattaagagcgcctgattgattagcccctgaagactaatcatttggacaagatttaagaaatcctttagaaaatggctttgactctttgcatcacaggttgtctcatcctcatgactcatttatctcagaggccacatctgaagtgggagtgaagagtgaggacacgaagactgagtttaattacagctctctggtggctaaaggatgcgagttgtttcctgtgaccctgccctctcctatttcctgtggtctctgagggccccatgagatagattagtacccgggtgggaaacctgactcctggggctggggctgggtcgactgggtaaggattgctcgggagaacccaggaaccaggggccaaagtaggtgaggacaccaaaatctggctaagatgtcaggaagaccatgaagatgaaaggtgtgagcgtaagggacaaggtggccaggctgtgcctgccagggcagggccaagagctggggttggctccagggaccaagggcctgaatatttcctatgttcaagtcctttgctggatgacaatgagggaggctgacatgtgaggtaaatacccacagtgcagtttgtggcttgttggccctatgaacaagcacataagctccaagagggcagggactctgccctgttcactgcatccagcacaatgcttggcacagggttctggggacattgtacaaatgaggaggctgaacctctaagggaggaggagccaactgtgcccaggatgccggttccaggtgacattagacgtctcggactggagttctgagagggctggtgtataagtcatctagtcctgtggtgactgaacacccctgttgttatatagtcctgatttcaggcggtttatgtctggagagaccatgctctgggagttctgtctggaaaatagggtttctaagccacacacttggcctgtctcctccttagacctgaggtatcagggcaggagtcctgactgggagctgagttgtgaggacagtgggtgttgatctgtgggctgctggttttgctgttcttggaagaaccccaaaggaaggttggggtgggggtggctgtgggggtgagatgttcccctgacctggggtgaggggctgcctttgttccttagctctgcctcatgctcgtaatccagacaagggattgtgtgtaaggctgtggaggacataagggtttactgggagagagggaagaaaaggaggctggcaggtattggggcatggaggggaggggctgtgttccagccatgggcctcatggtctgccgcagagatgccacttgggaaggtgagagctaagcctttgttcctctgagcccagggcaggcctaaacattctcctctgcctctcgagggggccaggcgaggaggagtggctggggcactgaggggcaggggctcctccctctgggagatgaacaaagagggctgtggccaccaggaagcctgcctgggaacccgtcctgaggtcagccctcgatgtgttctcttcctcctgtcttcacaagcaggctgaagccccagactccgtggccatgtcttcctgggaaaggcggctccatcgggccaagtgtgcaccatcctgtaagtggcaccttcactgtggtccatgggttgtgcatgggagagccctggcagaggcctgaaagggcagagggcaggtggggcttccctcaggcctccatgacccctttttcctgcttggcatctccttccacccactctggccccggccaccatgccatttggcattctcctccctgcctgaggagagcttcctctctagagtcctgttcctatgaccatggcccgggactgccccctcacaggctgactccagtgagactgtgcttcattatttagtggttgtttccccctccatcccacctggttctgtggcttctttctactttctgtggtattgcccttcatcttgtgttgtctgtagcccccactccctgtcctgtgtccatggtccccctcacctgtcctaggtctgtggcctctcctcccacctgtcctgtgtctgttcctacctcccccacctgtcctgtgtcccccacctgtcctgtgtcccccacctgtcctgtgtctcccacctgtcctgtgtcccccacctgtcctctcacatcatggctcctttcctcgctgccctctgctctgctttgtcttcccttcgtctatggttgttcttgctacaggcctctcctccatcgcctggttacccccgtggcttcttccctgagtgtgtggagcagtgaggaggagcagcagctgcagatctctgggcagtccccctgctcaccccacatgctccccattctcagttctgcctgccttgcttgctagccaggaacagctctagcaactgaaggcccaggtggggctggcctgggggccacttgatgcacatcaaaggcagatgccctgcgaccccaccccaccggcttgccagggagggggcagggctgtggtctgaggcaccagcttgtgctagctgctgaggaatgttggggctggggctgcctgttatgggggtctggatcctgtgaagcctgagagggctgcctccctgggttctgccaatctcagcttgatggggcaatgactctgtgtctcccatgcagacttgttctcctgcttcaatggaggcgagtgtgtgcacccagccttctgtgactgcagacgcttcaatgccactggaccgcgctgccagatgggtgggtctgggctccaccccacccccaggaagggacctgggtgcagggaaagctagggagaaagggagcagcacttccagggctggaacccaccagcctctggcttggtgcccactgtagctacacagagaggttctcttttctctccctcagtgtacaatgccggccctgagagggacagcatttgccgggcgtgggggcagcaccacgtggagacatttgatgggctctactactacctctccggaaagggcagctacaccctggtgggtcgccatgagcccgagggacagagcttctccatccaggtgaggcctcccctgccttgcctgtccaggaatgcttctctaggccctggaggctgcactggcctgggctctacttgtcatagttagagagactggcaccttcctccttgcatcgccccccagctcccacccaggcagtctgcacctggaaggagctggggactccacagctctcgctcacccactcaccctggccattcatttattgagccactcattcatcaagtatttactaagtgcatactgtactcttttctggcataaggtctggtggcgggaggccctgtagacaacaacacaggtataatctttgtcttctcagaacttatagtctaatgaagaaggacatcaaatcagaggactcatttcaggtgcaaatgagtgctatggaggagaaatgccaaatgctaaacgaacatgtcctgaaaacctaatcctgtttattcggaaggatggtgacctgggaaagcttcctggagaaagtcacatttaagttgaggtttaaggaataaattggagttagccaagtgaagagtaggagagtgtgggcagacttgagaacattctggggaaaaagatcattgggtgctaagaaagagactagggcctcagagaaatgatggaggtcctgggtgactcagtttagagtcacctcctctaagaagccaccctggatctcctgaccttccaagctggctgaagagctcctcactgggtaactcaaagttccatattatgacgctgtcattgtatttctcttacaaaggtctggttttgggttggttttctctaccagctgtgagcttcctaggccaggggtcatgtctctctctttgacagtgcctggattggtgctcagtaaaggtttgtgaaatataggaacacgtgtgaaagccactgtcatgcaggcctgattttcatgcctaacctgtgtgctaaactgggagtcaccttcagccacagctcaatacccctccacctggaggaaagtctctttggagaaccagctctgttggagggcaccttggtcagtactgagttagggtcaaggggttgggggtgtggggagaccccagtgttcagtgtctcccctctgctagccatttgtgatccttctgtctcagtcatggacctatgagactgctctaggggccatgccctggatgggcggggaactgcaaccaattttcctctctctgcctcggcctatcacatagcagagattttcatgacctatcatttcatgatggatatgttacaattacttagactaatgcattgccatacactcgtgggttacaaaatcaacttaacgaatcacaaccatcattaaaaaatgagacaaataaaatagaaaatattgtaagagtgtattacgcatgatagagataagtattattttgtaaaatttttagttatatatatttcttattgtaggtcatggtcacaaaagcttgaaaaccctttagttagaccatggggtagctttcacagttcccacttgtagttgaagtggctccagcctgcttaatcacattgaacagtaatctgatggaaggtgccttcctgggaagggtttccacacttggcagggataagctctgggaagctctcccctctaccccaccccgtcctttgggtctatggcctttgaagtctgggttctgtctgaatggcgggggcagagatgtgtgtgtgtgtgtgtgtgtgtgtgtgacagcagcacaggagtgagatgtgtgccgatgggtgtaggggaaagttacaatctgtacctgccaggggcatgggggaaggggagtgtgtgtatagtgtgtgcactgagagtgtcatgggagaaatttatggggtgtgtatagatgtgtgtgtttgtgttctgtatgagtgtgagatggtggagtatgtctgttggccttcaatctgatggtatttcctgggtaggataaagagaaaagttcagaaatacggagatggcatgattgactgggaagagccctggaatctgagccatccagaccggggctagaatcccagctctgggatttcctagttttctgtgtgtggccttagtcacttcacctctctgtgaatccattgcctcccctctgtgatgtatggggactgagcgagatcacagaggaaaggcagttggtatgcaggggacagccatcggcattagtgaaaactcaataaggtgtgaagctcagggtcaggcctgtggcaggagcctgcaaaccagcctctgaactccctactcaggtacacaatgacccgcagtgtggctcttcaccctacacctgctccagggctgtcagcctcttctttgtgggtgagcaggagatccatctggccaaggaggtcacccatggaggcatgaggtaactctaacaccttccacatcgagctgtcctatccctgacactggtggtggtggatgggtgagcatccgctcttctcaagcccaaaggaaattgttttctggggacaaacagcaatttccactatctgggcggaagcatactggcagatcactgggtttcttgccagtggggtttgcagaatgattttttttttcctggaactctcagatattgcagatttccagacagcaggctttcaggaaaatagagttttccagtgagttgagagtttatcatgataagcatgcttacttttccctcccaaaatcttcccaaatggatcatacacagtttctacctcctctcagcagattcggagtacacttccatttctgatgacacagggtcattgtgaatgtcagttatcttgctgggccaacagggatgcttggaggaccaccagaggagtggggaccccttgctcccatactaaaatgccccagactgtggtcctttgtgaaatctttcctgcatctcttcctcactgttctttcctttccttgctgtccactgtcacttcttgttgctgtcatggggtcttcctgtaatgacacttctccctgtcctcatctcctgcttcagatctggaaactgggtgaccaagcaattgttctggggctgagtgtaaaattgatggcctataggtttctcctgtgaatgaagagttggtaaatgggtcttgtggctagttagacagtacttttgtttccctttcctgaaattttgctgggttcaaggttgccaaattccaggttggctaggggtccctgtaccaggaaaactgggaaagtggtcaaggctgctggagcccgccatcttttcttgcactcccagttttcctcctctcttggcttctgtttccacttggttcctgctccccaccaaaaaaataaagcagatgtttgtttatattctatcctgtctgggagaaaggaacttggagtcactcactctaagatttattcctgcccaggaaattgccgtcttaaaaaatttctaaagacaaaagaatccatctctaatggtatacttccaggcacctgggaattctgggaattcatggggaggggaagtgggggccttggatcatggggtagggactggctgttccttcggtgaagagactgggctagtggaggtgttgtggataccctgaagctctgggatgtgccctgcagggtccaactgccacatgtcatggggagcgcgcgtctgcagcagcttgccggctatgtcatcgtgcggcatcagtcagccttcacactggcctgggatggtgcctcggctgtctacatcaagatgagtccagagcttctgggctggacccatgggctgtgtgggaacaacaatgctgaccccaaggatgatctggtgaccagctctggtgagggtcagacaggtggcctctgaggggtgttggtggggatgggggacaggtcaggctgggaggggttggaggggacttggaacagagccctggggtcgtggtcatggtattaaagacccaatggaaggccaaggaccccttcctaacaaatgtgtgtccttgggcatgttcttaaactactgtcaaccccaggttcctaatctgcaaaaatagtcatgataagaattcccactagggttgtgggggatctaatagacactttgcaggtgggattgaccctgcaatgtggggcatggggtaggcagggagcagagggctagagacagccaggaagagaaatggcccagctaaagacacctatggaggagtggtaggaagtgagtgaagcgttcagggccaaatcatggtggctctggccagaagggtcgtgaccccttttgagcacctacaccatactaaacactttacatgcatcatctcaagtagtccttgcaacaatctcactgggagattatgttccctatggcaaatatggggaaactgaggctcagagagacacaggagcttgttcaggctcacacaccagttctctttccggtgcatggtgctgcatcccctgagtttggagccatagggagctactacaggttcctgagcattcttggctattactatcaaacagctttttcaggagaatggctcagttgggaaaccctgattgggatgggagctcaggagaccggattcttcaaaactccttacccatcccttgggatccgctttccctcagagccttctgtccctcccatccacccaaccccatcgctgccccatcatgatgtcagctccctcctccagggaagctgactgacgacgtggttgagtttgtgcacagctggcaggagcaggcccctaaccagcctccagggcccacaacttcctccctgcctcgcccaccgtgcctacagcagaacccaggaaccatgcaggtctggagcttggggagaaactcccctaccctagagcctgacttgctatccaactcttcgaaagccactggctgtggcaccccagaatgtctggtgcccttgaccccatccctctcttctctgccttcctctccctctccccacagctcaagttggggttctgtgtggggctgtgtgtggctttgccagcccctagccctggctcctggtcccttgctctagggcgtgtacgagcagtgtgaggctctactgcggcccccctttgacgcctgccacgcctacgtcagccctctgcccttcacagccagttgtaccagtgatctctgccagtgagtaggggtggtgtgggctatggggaaccctctagtattggggtgagtgctcagcacacgggccatcaaactgggtgatcccaggcactgccagatctgcttcccaaggctctgaaattcttatctgcctaggtgggacagagctgccccattcaactgaggcttggaaatggggccggaccccgttagggtcacataacaagttagtggcaatgctgggactagaatccaggatttatagctcaagtctagggatctgttcacctagatgccttcctgggcagcctttcccagctgggtggagaggagagatgccctgaagccctggcagtgtctatgggatgctggtgggctggtggcactttgggttttgttccagtgtgacccttggtttctctgcacagatcaatgggtgatgtagccacctggtgccgggcactggcggagtatgcccgggcgtgtgcccaggcagggcggcccttgcaaggctggaggacccagctccggcaatgcagtaggtgcagcccagtagtggggcagggaggccttcaggctgtgggtggcattctcaggcctcagctcaatgtcttgtcctgctcagaatcacagttatcagaactctcagccccgaggttttatcgccatgagaaagacgaaaaaactgaggctcagagtgggaggagctagcctgggtgattctcagagcctccccttgcaattccttctccttgtcaatttcctgggcacccaatgctccctctgggactaggaaatcatgaaaatcaaagccctccctcccatcctcactccacggcctggggtaggagctgggtcctggcagagctggggccagtagctgagagaccatggatccctccttcccaagctgtgcactgcaaggagaaggcctttacctacaatgagtgcatcgcctgctgccctgcctcctgccatccccgggcatcctgtgtggacagtgagatcgcctgtgtggacggctgctattgccccaatggtatgctaggggcagacgtaggtgcctggcaccatcttcctggcctggcacagatggccacgaaacaggagttcagaagatacctgtttgtggaaggaaggaaggaaaggagggagggagggagggaggaaggaaaaaaagaaggaaagaaggaagggaagaaggaaggaggaaggaaaaaaggaggaaagaaggaagggaagaaggaaggaaggaaggaagggagagagggagggagggaggaaggaaggaaagaaggaagggagggaaggaaggaaggaaggagcaaacaattaacaaatgaataaatggtttaagggaagtgagggtgaggacagaactgcagcctctcgagagattcatcaggacatttgatttcatagggatatttaaattaatcaggactgcgcttcttaaggtgtgtatgagaacagatcattggtttatgtatacacatacatttgtttaagcattggtccatgtatggggactggttttcagtgtataaatttgcagcacatctatagtgtgcttggctaggaggatggttgagataaaaaatataaaaataaagccattgactttgggaatcagaatctggtttcagagatatcacgctcatatgaccagtctaaggtatgatgtggtgaaagccagctcaggggagttcagataagaaaaaatacaggaattcagaatggggagaggttgtcagggaagtcattcctggaggaggtggtgcctggcacctaagctgtttttgatgcggtgacaggcttttgagaggtggtgaggagaagctcgtgtgcaggttggggatggggttgtgggcagttctctgagcaaaggtctaggggtgggattctttcatcagaaggtgttcacttctggcctgagccaaggatttatagaggagaaagtttggaagtcggttcagagatgaaagaagttagataaggggatctttatcagaggccctggggagccacgaatggtttgtgaacaggggcaaaggtgagttaattggccctttgctgtcactctagggctcatcttcgaggatgggggctgcgtggcaccagctgagtgtccctgtgagtttcacgggactctgtacccacctggctctgtggtgaaggaagactgcaatacttggtctgtgtctgctgccgggaagcagggtgtggggcatggccgctgaggctttccacgagggctgcccatctgggagcactaatggctggcgtcggggcactcacttagtacctttgagtcccaggggagtctcattagatccaatccatgggggaaatctctaccacccattttagagatgggaagactgagggctgtgggccctgcagtttcccagcatctagctcaggcctggaggggtgacctcttgcctccttggtctctgtgttttagcacatgcacctcaggcaagtgggagtgcagcacagctgtctgcccaggtatgtctgccccccaccttgcactaggatcccttctaccagtctgataggttttggggcaaggaatctctgggggccaggcttgctgcgggtggggatgtcactcagttccattggctacgccccgacccctgtttcctcagaatcactttgcctgattaaggtctggctccagcccctgccaggaagggttttccatgaggagaaggggtttccatgggttctgtatatctaaagaccttcccgagctaggggtacttggcctgaggctggtcctcaaggctaggccctggtctcccctccaagggagatccccagggcagggctgtacctctcttcaaggagttctctggggacaagcctgtgtctcccactgcccagggctctcaggggccaggcctcattccttatactgctcttattctggagggcagggtgctgtgtcctcctcatacttggagcttgcagggcagagttcccctggggcggctcccatgggtcagtggcctttttctacctctcagctgagtgctcagtgactggtgacattcacttcacaacctttgatggccgccggtacacgttccccgccacatgtcagtacatcctggccaagagccgctcttcgggcaccttcaccgtgacattgcagaatgccccatgtggcctggtaagagctggggatccccaggcccgatccacccagctactcctgcctactgcccccaagagagactgggacttaggacagggctcaggtcttcccatggcccccacctgctgcctcttctctctggggagaagactggactccagcccaagcacctctgctctctgctgactgagtcacttcccttttctggacctcagtgggtttttggttttaggattttactacctaaaaaaaaaatatatatatatatatatatatatatgtatgtatatgaaagtgtaacactggcacctacttttaaatccattaatttatgaaacaaatctcttgtagaatatgttggcattgaaacagtaggtggagcttgcagtgagccgagatcgtgccactgcactccagcctgggcaacagagcgagactccgtctcaaaaaaaaaaaaaaaaaaaaagaaatgtaatggctatctacaaaaagttagttttgattgttggtttcctcccatattttatgtgtcttcacacttaaagaaaattaaaattttcaaacattttatattccacaatttttgaaaaagtacaccgtttttcactgctatggtctttataaaggacatgacttaaaatttcaaataaaaaagaatgaatgttctaggataactctgtcttttaagagcatctttatacggaacaatttgaactggcattcaggcaacttcttttgttgttgcacacctgtattaggaaaattacacccattttacaaaaaaaaaattccaaactatttactgaaataagctcaaaacaatgttagaaagaccagtgtgaatggcacacaaaaatctcttccttataaattattaactggaattcctgatcatggagtgggcctcagtgtttaaaaaaaaatctctaaaattggtttaatttaactttatcgtctctgcttcattggattgcaccttcaacattcgtccctcccttccttccttctttccttccatccttttgtccttccttctgcaaacattgaatacctatttgtgccagaggctgagctgggtcttggagactgggatgaattagacatggctccacctccctgggccctatagtttggtgggcaaggcaggcaagtgaactgttgtaactgggctacagcagctgtgagaacatggagggcacagggtggatctctacgggggaacttcttgttgttgttgttttacttgggcactgggtgacagaagtgtgaagtggatcaggaagggcttcctggaagacatgacccttgaactgtgtcaatcacctgtgaacataactgagaaaatggccaatgtgcaagtctggggtagatgggggtttgtttgtctctcagcggagactccgttgtccctgggttgatcatgctcagccaaccctggaagccccagtctgggctgtgccaaagctcttccttgtgcatcagagcaggagctcacacccacagccagggcagctgccccacagtcctgcctccctgctggccttgctccagcccccagcactgagggccctgaatgtgagcaggcatcagctgaaggtgtcactccatggccctggggacacaggctgaactgtggatgaggcagaggactggtctttcttctccttttggcctgagtgtgcccctcccttctttctgctagagaatggcccagccctggcttggctgctctctgagtcaggagactgctcttcctcaaaagtggggtcattcccatcacatcctgagggtggcataagacagacaagacacacagacacagcccagctgctccttcccacttacagaatcctgggggctattgggtctcagggtcccttactcagaatccccccctttttttttggagacaggatctcactctgttacccaggctggagtgcagtggcgcaatctcagctcactgcagcctcaacctcccaggctcagtcgctcttcccacctcagcctcccaagtagttggtaccacagacacgtgccaccacacctggctagtttttggtttttttttttttttttttttttggtattgttgaggcttcatcatgtggcccagactagtctcaaactcctgggctcatgtgatttactctcttcagcctcccagtgttggggttataggtgtgagccaccacacctggccatcagcccttctctctaccatgtctctgataggctgtgggtcagccttggcctgagtcaaccctcttctttgtgggacagtgcctcttgacagcaggttctttttaccttgggccagctctcctccttgtgacttcacccacatgatggacccatggagggccagccctgtgccagctctgtgctgggcatggtgaggttacacagagtaatcagaccctgatcctatcttcaggctcttgtggcctgtagggaggtcagcgtgtcctcagacagcttccatacagctacaacatgatcagtgccatcacaggggagttctgtggaagaaatagtcctataggtcagaaaaaaggatcagggaaaacctcatgacagaagtggcatttgggctgagtgacctaaaaagtgagcctaaaaatattcatagaaatcagtatgcctgggtaaggagagggagggagggcactccaagggttgattagattatatgagaaaaacaacgaggttggaatattccaggatccattaaagcagatgcagaaggacttggcaactgactgactgtgtctggtgaagcggggagtgtgtgggagagaagtcaaagatgaagctgcgactgcactcctgggtgcccagcaatggagtggagtggggacattcacagagaggatgataatgacaatgataaaatatttgcacagtgccttgaactttgactaactactttgcaaaaaacatgtactttaagtcttaacataccccatgtggtagttatcattctccccattttaaatatgatgagacaggcctacagaggcttggggcatttttgagaatccacagccagcaggaggcagagctgagcccgacctagggttggatgttatcacagcatctgaacacatccaccccagaatctgtgtagtgtttgcagccctcaaagtgtttttttaaagtagactttatgttttagaacatctttagctttacagaaatattgcaaagatagtacctagagttcctgtctatcttacgcccagtttcccttgacatctttgttaaaaataatgaaccgatgttaatagattatcattagccaaagtgcataccttatttagattctatagttttttacctaatgtcattttctgatccagggtaccagattacatatagtcatcatgtctccttaggcccttcatggatgttacagttcctcagatttcccttgtttatgataatcttcaaagtttgaagagtgctggtcagctgttttggataatgcctctctattggaatttgtctgattctttttctcatggtttgactggggttatggttttttttgggaggaagatcacagaggtaaagtgccatgttcatcacatcttatccgtggtatatactatcaacattgtttatcactgttgattatgaccttgatcatctggtggaggtagtgtttttcaggtttctccactgtaaacttactcctttttccccctttccatactgttctttttggaaggaagtcactatgggcaacccacacttacagagtgggaagttattctccccctccttgaaggcagagaatctacatgcattatttagaacttttctgccagggagatttgtctcttttctcccatttacttatttatatcagcatagactcatggctgtttattttatactttgagttataatccactacacctttatgttcttacttgaattgttccagctttgggcactgggagatcatacagttgactcctgtgtccctttgacataccttcattattgcgtgtgtatatgctagtggtggtggggcttgagtgtgtgtgtgtgctttcatgtctttactttctgggcctattagatgcaccaggcttatcttgtatagttcctgtcccagtgctagtatcattcatttctccaaaaatattaccaggttctcctgattccttttattggacgatggtattagaatcaagatcaggggatgaggtgtgctcattgctactggggtatgacttcctttaggccttctcagctgacagagaaaggaaatacccttattatctgtggggtatttccacagataatgtgggtattatctgtgttccagcaccccactccccacagataccaaaatctgcagatgctcaaattccttatgtaacatggtatatagtatttgcatataacctatgctcatcctcctgtgtaccttaaatccttgctagattacttataatacctaatacaatgtaaatgcttatataaatagttgttatgctatattgtttagggaataatggtaagaaaagtctgtacatgttcagtacagaagcaagcatccatatttttttccaaatattttcaatccatggttggttgaatccatggatgcagaacccctggatatggagagccgactgtatatgcatatccatgtttatcttagtatatacacataagtataaatatttctctataaaaccatctgtatctacatgtgctaaacatgacttcatactgatggtccaattctaatccattccacatggatcattctagcttcctcctcttgcttatctgtaaacactcactctaacagtaagaaacctggccttcaccatacaccatccatttacctaattgttcaattccagcatacatgtatattcctattattaacgcatacctctataggaaataactttatcaactaaagtacaggttttgttctcagtttcttttgcctttagtcttataaattctacttatttacaaagctacttatgtcaacacctttcctcccactctcttcactgagattgtttcatacatttgtaatgcagttagattcttttgttatcatctacatttcatcctgggatcccctcctacgtgatttttagaatttgcctacatcaagtttcactcttagtgaagttctgtgggcttttggaggtaaatgcaacctctaaaatattttatgcacatttaaaaatctgtacccaactgggtaggattgggtacaaccaaatgttgttttatctctgttttgcagaggagagaactgagatatggagaatttaagtgacttctttaaggtctcatagctttcagttacattaggatttgaacctgagacttttgactaaagggtgtgggctttattcccacacaggtgacatgtccagaggggactagaggatgagtgggttgaacaaagaagatgatgttttagatacaatgattttgagctgtttcagggattttctgtactcctgggcaggaactcagaaggatggttgtggctggttgcacaatgtatttctttaaagtttcaagccctgatcattctgtcatttcactgtgtcactctcctggttcactttctcaggttggctgttggacttaagataaagtctaaaaatatttcaaggctctgcctaagctggcctttacctacctcttgaactttttaaaaaattatttttattttttatttttgtagagacagggtctctgtatgttgagcaggctggtcttgaactcctgggcttaagcgatcctcctgcctcagctgccaaaggactggagttacaggcgtaagccactgtgcccagccttgaaccttatcttaaaccactttgcctgatgggttctggtccctctagtcttctttatgcccttgaatgcattaaacgacttcctgtaacagagcttttgtacaagttgttccttttgcctggatgtctccttcttcttcttctctctttgcccaactagcttccatgcatccttcagatttcaacttatatgtcaactttttgtgtgccttggttttctaatctgcaaaatggggatgttagtaacactttcttttcttttcttttcttttcttttttttgagacagagtcccgctttgtcacccaggctggagtgcagtggcgagatctcggctcactgcaagctccgcctcccgggttcacgccattctcctgcctcagcctcccgagtaactgggactacaggcacccgccaccatgcctggctaattttttgtattttcagtggagatggggtttcaccgtgtcagccaggatggtctcgatctcctgacctcgtgatccgcccaccttggcctcccagagtgctgagattacaggcgtgagccaccgcacccggccagtaacactttcttaatcagattgctatgagagttaggcaagtgaatatatatagagagatttgaacagcacctgaacatactaattccacatgaaagttagttgttggttgtaatatcataataatattgtggtattattatgataattttatgttattatcattccctaggaaggcctttcctacctctgcagactaagtctggttcagtcatatgcttttctaacactctacacctgcttacagcactgatcacaattataattgagtaatcaactttgtaattacttatttaatgtctgtgtcccacacaagtatgtaatttccttgaggacagaaactttgtcttatcactgaatccataaagtctgatacagtatgccttgcacatagttggtgctcagttaagtgtttaaatgaatgattgtgtggatgttttcctgtggagggaggtataaaaggggcccagtgtgtgaccatttgagagatagagaacctgaggcccagagaatattacctcatttcctgcctgcctgtcagtggagtgcaggatgtgaacatgaaatgaattataaaaacacccacaaagggatgaaattaaagttctgggttgtgatgaggtgggggaggccagtgtttctcaggctggactctgggccatctgggttccatctctgctctgtgtctttagataacctgagagttgactaccatttttattagtgttatcgcattctgctactaaccttctccaacctgagcctctgcctgcccattcccagacgagggtatttggttggatgatccctgatatctttggggctctgtctgtcattctgaggaaactgtctctcaagctgggctggggtctctgtccctagagggctctgttgtatccagcaggagggtcagaccaacactgccccattgacctttctatctctccagaaccaagatggagcctgtgtccagtcagtgtcagtgattctgcaccaggaccctcggaggcaggtgaccctgacccaggcaggggatgtccttctgtttgaccagtacaagatcatcccgccatacacagatggtacggtttggggtggacaacagacctagttgggaactgagggtttggacctctcttcccaggatcctctggctaaaagcactgctaccctggcaaaaactcatattctagtactgggtagatcaggataggggacactttggttgcaaaaatgtggactccaaaaatgtgtctttgtcccacctcaacaggacagtggacttcctagtagcatgatggcttctcctaacatgaacatatacatgggtgtttcccatcctgactctcataacttgtttattaactacttgttatactgtctgattccacaaggaacttatgtgtagctcataagaaacacatgtaacaaaaatggcaaaacgattaagaaataaaaacctagcaccagaaagaaagaaaaacaacaacaggggctcaaggttgggaggagtggggatgcactgggtgtcaacaggctgcagaaataaatataaaccataaagggtataaaatgttctacaataaaatctaaaatttaaatttgttacacttgaatctaaaattgtatcatgagcttccataataaaactgtgttgtggccactgtgaagagaatgggtagttacagaatcctccttctgctagaggaggaaacgtgtaccagttccttagtgggagcaaagctttaattggcacttgatgctaaaaaaaatttcttagcccaggctgcagtgggaagttatctctgggtcctgatttcatcactgaacagggtttcctcaagcctccccataccagcttcatggcaggcacgcaggcaggcaggcaggcagggggcgaagactgggccgggcgtgggagtctgagcgggccaggcaggtggtggtggtgggcggggtgtgtactggctgccctcccactctctccttttggattctgtgcccagatgcctttgagatccgtaggctgtcctccgtgttcctgcgggtgaggacgaacgtgggcgtgcgggtgctctacgaccgtgaagggctccgactgtacctgcaagtggaccagcgatgggtggaggataccgtgggcctctgcggcaccttcaatggcaacacgcaggatgacttcctgtacgtagccctgccacggaacccgaagaagaggggaaatgggccccttagggctgggtatctagaggcactgcctaaatgtctctcccgtgagccttcactgtgcccagcatgcaccattagttattgatttctctacatttaaatttaattatgtttctttaaagcagcggttcacagtcctctatgtgtggaatcacctcaggagcttgttaaaacactgattcctgagtcccgctccccaggatttagggtggactcaggaatcctatttttgataagcacctctaagattccagtatgggaggtctatgggccacaccttgagaaatgctgttttagaatgaggtcttaaaaccggggacctcagactgactgatttggctcatggttttgtttgttttaattgaggtggacaccacctttaggtgagtgtaagcccctagtgagccaagaacactaacattcccactttctaacccaccaggccagtctaacccttgtgcctttcctacctggtacttgaaggctcttgagtttgcacgccgtgagcctccccatattcagggaaaggctgttttctgtgagctgacatatttgggcacagacgtaggttaggaacttaggaaggttgattttaaaggctggagatcctggccagtccttggagttccacacattaggggatgcagaaggaaacagggaaggcattctttagccaaaacggagaattcagatttgctgtgaagaacaagaacaaaataaagctcagagcttttcaatgcatatatatttaaaactgtggcattctactatgctttgcctagtagggcagatgttagggtagctggccaaatagtagggggagaccttggtttagtgtgtaagctgtttgccactttcctaaatgtaacctttgggtaggaatattgccctacataatatgagtgtactcattgccccagaacaatagttgggcatggtgggtgccaggcagaacctgccccccagagagaccatgacctccctccgctcaacacctacacctgggtttggtgactcttggagacttgtgatgcctaggaaacatgctcatcccccttcctcccttcactgccccttgtatgacggtttcctactgagagagccaaagggcgagccaaggagttttcaggaattgcccatggagaaagggggaggaaaagtcttacccccatggtgtttgatactcttcatgatgtccctgtttctttttctgacctgaagagctgggggtggggaatgaagccatattcattccccgccccaagtggacaatcctagcccattttgagcccttttgggacctgttaaatgttgtgtgtctgcgtgtgtgtgtgtgtgtgcgtgcgcgcacgcatgcatgtgtacatccatgattctatgtgtttgaatgtggctgtgtggaccactttggctatatgcatgtctggcatatatttgtgctctgtgtgtgtgttgagagtgtgtgcgtatacatgttacatatttgggtgagtacacgtgctcctctgagtgtgtgtatatggatgtgtagattatgactatgtgtgtgtatatgagcaagtaggtgttacctggatctatgctatttgtgccccctgagtccacaggggcaagtgtgtgaatatggctgtgacatggctgcaggtctccagtgggtgtacctgagagcaccccacaactttttggcaattcctggaaaacactttctgcttgctccccgctggtctctggctcccctctggacccctgcgatgtgcacctgcaagccggtgagttggtgggggaagaggagaggcatggttgagtggggtggggaggactgctttgagagagatgaaaagggaactccgggcaggagagtgctggccaaatttgtaggagtgataagagaaggaggagcagcagggaggggaaaggagagacagtgagggccaggcaggcaggaagcctcatattcttccactatcagatatacacacacacctttatactggcttctccatctcagggcaaaagcggaagtcggccccatggccccaccaggccccaccctctctgcccatgccccccttctcacctcctactctcaccgccctctgctctgccccagctgccctggcctccttgttctttctacacagtcaggactgctctcctctccaggcctttgcacttggcagttgcctggaatgctgtttctgcagacacacacatgcctcagttcctcacttctttcagatttgtgctcaaacctcattccctcactgaggccttcctgactgcctgaattcaaattgcagttgcccctcctgcctcacctcatacacccatgctgcttcttagctttctctcgcttcttaccttcttcacctttgaagtttctatatgaattttttagtgactgtctcctttgaccagaatgtaagctccagggatttttgtcaagccacgtattcacacccagatgtactaaaccacacccataccttcccagccagctgtacactgaagtagctgcctacatccgtacagcgtgtgcacacacacacacccctgagccatggggagggagagaggctgatcctgggacaccaggtagaccgactcccctgactgcctggctcctgttcttccttccccagcctcctactcagtgcaggcctgcagcgtgctcacgggggagatgtttgcgccctgctctgcgttcctgagccccgtgccctactttgagcagtgccgcagggatgcctgccgctgcgggcagccctgcctgtgcgccacactggcccactacgcccacctgtgccggcgccatgggctccccgttgatttccgcgcccgcctgccagcctgtggtgagtgccccacccatgtgaggctgagctggaggagccagagctccagacctgagtgtcccctgcccctgaaagtctccactgggatgccctccagtctcctccagcctgactgcacccagagcctgcttctcctcctgcaccctccatctctgccaatggcccccatcccctccatcactcaggcataacacctgggacctgtgactcaggactgcttctgtcacgcttacttccagtccatctcaagtcctgtcagtcctgttaatcccaaattcacccacttcttaccacctccgccaccctactcagagccaccttgcgttgcacctttcaaaagaccactggctgttgccctggggtttgagtacacacacaacttcaatatcatgagccagcccctacccgtccctaccctgaccctgggctatgctccttcccatgtcttcatcacctctgtgtccccagctctggcacaaggcctgactctcagtaagcttttagcaaatgtttgttgaataaatgaaaaaggcactgtactgggagtcaggaggcctgagttctattccagccctgcaggtgacttgctgtgtgtccctaggcagggccctgattctctctgagctagtttccccaaaagggattggacaggcccactggttcttaaccctggctgcatattagagttaccataggagctttcaaaagattcacacatctgggccacatcgagtatcaacgaaggcaacatatctggcagtggggcccaggcatcagcattttcagaagctccccaggtggctttgatgtgcagcctgggttgagaacagctgaactggatggtctcagtggatctactggatcccacagagtgtaggagactctggggggagtgggatgctggccacacaaggagagggcagtcttgagtcttgggacaaagggagcaaaacaggctgctagagggagcacagttgatatccacaacctgtgtgtgacacagccaggggagtgagggggtaggagtgtgtgtgtgtgtgtgtccacacacttgggctcatgcatgtgtctatgtgtgagttacggggtgggtgcagggccttagcaggtggtgatctctaccccttccccaatgtcactgcctcagaggaatgccttttggaggaaaggacctgccagtggttttccaggctgaacttggtagaaggacccacctgctgctttgccgttccagtgtattggtaggcagtgggactctggagtcagacctgggttcaaatcctgcctctgaccttgacctgctgtgtgacctcagacaaatgtctgaacttctctggatctccattctcctcatcagaatgacagccccactccacataactgtggggatgagggagacaaagcatgcaccactcccccctcactgcagcactgtcctgtgaggcctccaaggagtatagcccctgcgtggccccgtgtggacgtacctgccaggacctggccagccctgaggcctgtggggttgatggtggcgatgacctgagcagagacgagtgtgtggagggctgtgcctgcccaccggacacctatctggacacccaggctgacctctgtgtcccccggtgagtgggtcagcttgatctctgagttgggtgggaaggtgaggccaggggtctccagggcatctgagactggggaacctggctgggcctcttgtgtccctccttcccctcacagttgcaggccagaccttggtgggtaaggtgggtgggctccctccttggggcctccctcccagatctctcctcagccttggcctttgggccattatagcagcttcctcacaagacacaacaaccccacagagcccaggggccctctctctcctcattcccctctccttccacataatttattgactttctggtatgttccagacatttctagggcttgggaattcagcaatgaacaaagcagagtttagccctcagggagctcacattctagggttgcaagacagacacataaatgaacagacacttaatggacaggtggcaacaagagctgttgagccaagtaaggcagagtgagagcagggagtcccattcctggtgtgttacttgaggtgggcctggaagtaaagcctttctgcggaggtgaggtctgagcagagacctgagggagtgaggaagggggctccaggaagagggggtggctcaaggcccagcttgttctcagtgtagctggagggcagagcagcaggaggatagtgggaggcagcgaccccacgtgatcttggggcgactggcaaggtccttggtcccttccaggcctctgtttctccgtctgtaaaatgatacacatttgattggtggtcttcaaatggtggcagggctggagagaggcccctttagggtaaataggaatcactcataggccttcccaaactacagaatcctcccttgagatccagatgtgtgcctggaggctctcaccccttgatgttgagtgttgccaacgaaaggggtctgtgtggcttatatatagagagggaggtggttgttaagcagcactggagctggaagagtttcggcgtccggtccataactcactgcgctgctccaagacctgcacgtgcctataatcggcaggttctgtgggagctgtgtgaggaggaaacatagcctttgcccttagatgacctgcacaaaagaagaaagacagcataagaatccctaccttacagaacccctgcgaagaatcaatgagattatgtatgcagagggcctggctgggtgtccctggccagaggtcaatgtacttaacaaccagtgcagcacaggcactgagcaattggaatagatgctgggcgtgagtgaccaggacacctgtgtcaggatgcagcaccagctgaatatctgccctgttcctgacatggcatgggctcaggagctgtgctcctgttcttactgcccctcccttccccggtccaaatgaggctggctgcaggagtgtgtggagaccagtgactccttgtctaagcttggtgcatggccctgaatctgggacccagccgtgacctctatccctggtgtcaggctggcttttctgctcactggagatgtgtcacatgtcactgtagataccattacttttccctgtgtccttatgcacctggttggctgagggtggggtccctgtccttggcagtctctgccctagctcctgagcctgctcacctttctttgctcccatttttttataggaaccagtgctcctgccacttccagggagtggactatccccccggagacagtgacatcccatccctgggccactggtgagctccgtaggtagcagccttcttgtcctctctttaaagggaggctgctgactgaagacagtgcagctgatggaactttctgtgaagggacacccagccctgctctgtgcagggagggggaagtgagtgagggtgtctttctgaactctgcagtgacccgagtgcagcaacatggggtgtctgggtcctgcagtgactgggtcggctaaccccagggcccgtctctctctgcagccactgcaaagatggagtcatgagctgtgatagcagagccccaggtaagggtgggtggaggggtggagcccttctgggggctccacatggtaaaggagagtggggagtggagcactgatcaggctgtggcaagcccactccaggttttgccctacattgggccttccgtattccttgccctcttggcaaagactccagcttggagggtggcacctgaagccctgtcccagcctcagccccaccctagtggctgtctctgctgcctgcagaggagaggctgagactttgtcttccttcagggcaatgatctggggcaaccacgttgggtgtctgggcagtttcctgacttcctttgggtcctgatgttttctgtctgagctgtcatgtatctactgaggcggactctgcccaggacaatgctaggtgtggggtcacagaggtaggcaggacagcctgggcttttgagaccctcctaggcaacagagatagggatggggtggaacagtggtcgtgggatgggggtcaacctttgagaggctgtgaggtggagtagggcctgggggctggagcattcagggagggcttcctggggtggaggaagggattggagaataatcatacagtaggtggttaggagcagggcctgcagaatcatccagcctgggttcaaatcttccctggcactcactagctgtgcagccctgggcaacccactttacctctctgggccttcatttcctctttggcatataacctagtttcctgcatcctccccatgttttgtgtataatcctggaagcgcttttcctttggtcacttctggctttggatttctggctctttgggacttttatctcacctcctgtgcctatgcctttctctctggttcatcccagcctgggcatggaactcagctcctttttattaattttcctaaaaaagatcactcacgcagtgtgaatgtgcggggcagaccttatggaaggctgagggagagggggtgcattcatgtcacagaaatagtggtaacaggaccgtgactctccttgtcattcagagtcctctggccccctgccacactgattggtcatcctctttctagccctgctcctggtccctctggggcacttctcactttatggtgactttggggaggaggagaagtggcttcactccattatttgggaaaatgggggacaataatacttcctagagttgttgcaggattcaatatgatgatgcaggggaagcacctggagtagtctggtatggaggacgtgcagagatgggtcctggtggccgcagtcttattgtgtgacagacagcacacatctacccctccctctgtgaggcgtatctgggaaaccaagcaatgcccaggagcgaccagggagggaggagacttccgagcccgtctctccctccatcctccagctgctgcccctgtagcccaggagcccatactgaggccccagggcctccgctcccatcttcttctcttccagctgctgcctgcccagcaggccaggtcttcgtgaactgcagcgacctgcacacggacctggagctgagcagggagaggacgtgtgagcagcaactgctgaacctgagcgtgtcagcccgtggcccctgcctctcgggctgcgcctgtccccaggggtaagtacccatggtgtcgtgggcccgtgatcctgaaggctggcagaaccaagggccacagggtggagtgggggcagggaaaacatcacatggccttgtaggaaggcactggcccaggctggccagccacagctgtaatggccagagaggagtctgggaaagaggagaggctggggatccagcctggagtgtgggctggaggagggagagccctggccgctcatctgtgaaatggaaccatcatcaggcctaccaccttaacaggctactgtgaggaatcagtgagctcactcagtggaagcactgagtggggtgtctggcacgctgggcactgcagtgcgttggaggccactggagagaaaactcaagttcagctctcaacctcttcctctgcactgttctgaccagagccctcaggaggagggctagtgcccctaaaatattaaaaaaagaagaccccacccagagaaaactgtctcattcccaggtccccagaaccctgccattaaagccgtgagagctgcgtgagtcaggctctgtgggcatgccttgtgtgggctctgtacaccgacgtggcccagggcctgacacccagctctgcccattctcattcccaggtctgggctgagaagacagctggcaccttatcccatggcttggcaacagccggctgtgcccttcagcttatgcagagattagtggtcacccgggagtcgtggcccaggcgtgaaagcctagggaaatgacatgggggtcagggcttctagggtaggaaggggaggggacagtcagttggagctttactgcttctaagacactttcatgttattacctccttcagtctcagagcatccatggcagagaggaggggaggaccatgattcccattttgcaggtgaagaaactgaggccaggggaagggtggagggaagtggtgcccaaagagccaggactcaaacccaagtctccttactccaagcccagccgctggcccagagcacatgaggtccgtgatggtcacctatatagatatcataatgtgggttgtaagcctgccccttccaggcaagtgtctgaaagagaacctgcaagcaaccctaggcctgaccacctgctgccacttgggccccggagtggcatttgaagagtatctttgtcactgaaggccgcttgtgacaccatcctgggtgcacagcctgcctctcagcctgaggtcaggaaaagccagggtgtctggggtcaggaaccgagggtcactcactgccaagagtagtagcaaggccacagagacacagtggaaggggcgctggactggagaccgggagaccgggctctgggctcagtttggccaatgacccattgcgtgctgtatcaaaggccctctaaggagcttacacacatgcctcaggggcttgtcaaagtgaaattggtacagtctcaatttgtaagggaagggcaggcatttcctaccatcctggaacatcctcttgctgggatagggctcccaaagatgcccaaccatccttaacaacccctgcctaggacccttgggacccatgatcacctctgtgcatgagagttccgactgtctggccaccatgcccttctcaatgatgtatctaagaatctccaaagaacggtctgtggctgtctgtgtgcctccatatttctttgaatctggggtctggccaagggccctggggccactaggcagtgaggcacaatgagcacagactcaggagtcaagcttgaaccctggttcttccacttcctaactgagttaattaattaccctgaacctcagctccttcatttgtaaaatggcacagagtaaacactctatgtgagcagatagcattgtttcttctcatctggatcccatgcatttgcaaataacctccctgaggggtccctggagtgagaaggtcccctacaaggtaaagagagggtactttgcaaattgaaggcaccttgaggaccgaggccaaagccttgagtccttgcatgctcttccccatgatgggcacacagcaggtgctcagagatgcagacaggtctgctaagagcaaggagggagtaatggatggtgggcaacagagaagacccctcaagaagtggctggagacaaggcttggggctgaagaaggaaggcagtgagccagcccttcactggtgtctgatgcaattatgggggagagaggggcaagaaaccaatatttattgtgtttctactaggtgataggcagtgtgcccaggcctgtaagattctcataatgaccttgggaggaaggtgtcattattcctgttttaagcacaaaaacagaggcttagaagggttaagtggcttcaggtaaaacgtagtgaattaagcatgtgcttttttttctttcctgcttcctcccacaaccacagtgaaatgataatggggtaaaaaggtataaatccccagggacaaagagagaagagtggaagatcagtagtttttgaagaaggaacgtgggtggatgtgtagaaactggccttgcagaggggaaggccaaggagaaacaaatagtacatgcattttggaaaatagtttggcagtttcttatataaacatgaatctacctgagcacccagcagttcaccctgaagtgttcatccaagaggaataaatagaagggggcgtcgggggagggagacaggaggttgggttgcaagtctgtgcaaggaggagttcagcctccagatcccctattgctcctgctggggtcacaccactgctccagccccatccagcaggagaaaggagagtttcaagagaaaccaaatcagagactttggccttgtaggcaccaggaggggtgagatgcatcgtggaaacagggagattcagtgaaaagcaagtggaatcccagcaaatggagacattcgcctcccagctcagagatgacagagatttcttcccttgaaaattggctgggccaatagaaaaatacaacagaaactgacatcttgggagtttctcaacaaaatggttggtcctccttaaatagggagcctccagtcagcttttgatgcctcactcttttttctttttttccttttaggaagtgttgcgtaatttatatacagtaaattacatggatcctaagtataccgtgtgttaggctttgacaaattgatacctgcttgtaacccacactcctgtgaagatatagaacatttctgtcactcagaaaattccctaatgttggcgccctatatattccctaatgtgaatatataatgtttatctattctagatacaagtcttctgtcagtcctttccagccggttccgcccccaccagcattgctgtgcttcacaccagcatagataggttctgcctgttctagaacttcatgtaaatagaatcatacactatatacccttttgggcctggcttctcttccttaactcttgaggttgacctaccttgttgcatctatcagtagtgtgttcctttttctatcccggtagtattccattgtatgaatatacaattatttatctgcaaaggtgttatatataataaaatgtacctacttttagtgtatggtttgatgaattttgacatctatgtatatatcatcataattaagatatataacatttctatcaccaacaaagtttccctcatactccgttgtagtcaatcctacccctgtgagtgctaggcaaacactggccggctttttgtcactatatagtagttattcctgttctagaactttacataaaaagatccatatatatacaaacacacacacatacacactcacaaaccattttgatctggattctttagctcagcaataaagctttcaagattcaaaaaagaaaacagttatttatctgctcaagcattgatggacatttgggttgttttcagtttgggactattttgactaaggttgctatttatttcccttggatgaacatttcagggtggaattgctgggtcctagggtagattcatatttatataagaaattgtcaagctgttttccaaagtgattggacaattttacacgtccagtatatgagaatctgactgttccacatcctcactaacacttggtgttttcagtcttttccatttttgttatttcagcaagtacatggtcctatctcattatggctttgatttgtatttccctaatgactgtgagtaatttttcatatacttattggccattcgtgtatctttctttgtgaagtgtctgttctggtcttttgcccatttttaaatttggtctttttttatttgattgagttgtaaaaattttttatgtattttagatacaagtcctttgtcaggcatatgtattgcaaatattttctcccaatgtgtgtttacctatttatttacttaacatgccttgaagtatctaaaaacttctgatgagaagtttttaattttgataatgtctaatttttttcttttaaaaatctccttcatttctgatgaggtctaatttatcatttttttctttatagttagtcctcaaggttgcaaagatattctcctatgtttttttctaggagctttacaattaaatgtaatggattaaataattaatttattattattatttttttttacagacaaggtcttgctctgctgctcaggcaggagtgcagtggtgccatcacggctcacagcagccttgaactccttagctcaagcgattctcccgcctcagcctcctgagtagctaagactacaggtgtgcaccactatacctggcaaattttttaaattttttgtagagatgggggctttgctatgttgcccaggctgatcttgaactcctggcctcaagaaatcctcccaaaatgctaggattacaggtgggagccactgcaactggccagctttacaattttagcttttacatttaagcctatgacctatttaaaattattatattttacacatgtttcaaaatggagtcaaggtatgttttattttattttatttttgatggacatccagtgattgtagccctattttttaaaaaacactttcttctccccatgtaattgctttggcatttttgtgaaaaattaattgactgtatacacgtgggtatatttcaggactcttttctgttccattgatctatttgtctgtcttcatgccaatatccactctcttgatttatggagctttatagtaagccttgaaatcaggaagtgagagttcttcaacttttatcttttctttcaaaaagttgttctaggtctttgcatttccgagtaaatttaggatcagcttatcaatttctaccaaaaaaaaagcccctgagattttgaatgaaactgtgttgaatttatagatcaatttggggagaattggcatcttaacaccagtaagtcctccaaaccacaaatatggtattattttcttatttattggtcttcattaatttctcttagcaatatttcatagttttcatgtgaaggtttacacatttttcattgaatttttcataggtatttgctgtttttgttgatgttataaacggtattattttattaattttccattttttaattgccacaatatagaaatacagtcgattttcacatactgaccttgtattctgcaatcttgctaaattcatttatgagttctagtggcttttctttgggtagattctttagaatttcagtaagtgatcatgtcatctgtgaataaagatagttttacttctttattttaaatttttacatctcccatgtttcttgccttattgtgctgtattggacttacagtatacttttgaatagaagtgatggaagtaaaaatcattgccttcgtcttgttttggataaagcagtcaatcttctaccattaattctaacatttgctgtagttttttttgcaaatgatctttatcagattggggaagtttctttttatttctattatgctgcaaatttttttataataaatgggtattgaattgtcatttgatttttttttttttgaaacagagtctcaatctgtcgcccaggctggagtgcagtgcctcaatcttgactcactgcaacctccacctcccaggtctaactgacttttatgcctaaatctccagagtagctgggattacaggcatgggccatcacgtctggctaattttcatatttttagtagagaagggggtttgccatgttggccaggatggtcttgaactcatggcctcaggtgattctcccaccttggccttccaaagtgctgggattataaacatgagccaccgcaccaagcctgtcaattgattttatttattggagtatcatatgatattttccctttattttataaatgttgcaaattacattggttgatttttaaaatcttaaaccagtcttacattcctgggataaaccccagttgtgactgacgtattatttaatattctgtggtctgtggttttccatacttgcaacgtttttgtctggttttggtatcagattaatgctggtcttataaaatgagttgggaagtatgatttccttttcaatttttggaagagtttgtttaaaacttgtattatttcttccttaagtgcctggtagaatttaccaatcttggaagaattttaacttcaaatttaatttctttaaagatattgggctaattcagtttacctattccttcttggctaaatatttatagtttgtgtcttttaagaaatttgtccattccatctaagttgtcaaatttattcacttaacatcgtacatcatatttccttattttccttttactatcagtagagtctgtagcaatatctcctctttgttccagatattggtaatttgagtattcctgtccccctttttatcattcagtttagacaggggtttgtcaattttattggtcttttcaaagaaccagcatctggtttcactgatttttctctattgttctgttttttatttcactaatttctcctcttatattcatttctttcctactacttactttggatttagtttgctcttgtatttctaatttagaactttgactttaatcccttctatttcacatcctgacctggatatgctggccacttcagaagccctcaaccccattttctgtctgctcccctcagtgatgcatcgtgccatgcttgggttccatcatcctgtactatagtccagaaagtgcttccaggcagaaaatctggatacaggagcaactaacaagggactcctttgagtataatgcctgtagcaccctttcttttcacctctttaacccatgtgcttgtattcttttgaaaaataaaataggaaggttaagtaacttgtttcaggtagatcctggatttgaacaaaaaattatttattgccaaagtttgtattcttagccctgccccaggctgtatcctgttgatgcctgatctagcgtgatgctatggcctgagatctttaataagtgccctgagacatccttggctccggcctgggagtgctcagatttcatggaaaccagactagaagacagcagcactgctgctttggggcctgtggtctgagagctccatgaacaacctgggtaggagggtcatcgcccatatccatgacctgttcattagtatacaactagtgcctgaggagcaactggcatccacctggtcagtagggctgtggctggtagagataagccttgcttcttgatggatgacagagactcaggctgggcctagtctgttactggtttttccagttaccaaggtccctctgaacctcactgagcagcagcaggatggggagtgaatacacagtcagtctcttctagggtaaatgctgggagccacctccgagcatccagattgaggcagggtcctccacagatggcagctatgggaagagtgctctcctgaccgcctgcttgctgtgtctctacagtctgctcagacacggggatgcatgtttcctgccagaggagtgcccctgcacttggaaggggaaggagtatttccctggggaccaggtgatgtctccttgccatacctggtaagtgagggtcccaagcaggctttgcttttttgctgggagggggcatggatatgggtgcataatcaagagtatagtctagcattcccatttcattatgtttgtattcatgttgtgcgtttgtgtgttgtgtgtggtataggggtttgtgtacacataggagtatatgcatacaaaggaatatttttgtttttacatgagtatgtttgttcagtcatgtatatgaatgtgtatacatgcatatttgtaaccatggcaatttgtttgcatatttatatgaacatatgagtgtgagtgcaaatccaaaatgcacatgtgcatatgtgaacatgcatgtacatggatgtatataaaaaggcaggcattcacaaatctcaatatgtcagtgaatatgtacaattagaaatttgtttatgtagacaggtgtgtttatatatatttttgtgcatatggatccatttaaaatgtgtgcacatgtatgtgcaaagtgtgtggatgtatgtttttaatggctatacatatttgtattcacatgtgagtgtaaatgtctgtgtaaatgtgcattgtgtttgcctgtgaataggtacattcttgtgtatgaaagtacgtgtgagggtatttgtttagtaatgtaagtgtgcatatgtgggagtgtgtgcccctggattggattctgtggaaacagactcggggttagttctgcagggcctgttctgggccacacagaggtgggtaggcagtgggtagactcagctttctgatagagagaatgctgggggacggggtgaggaacgatgaatgtgccctgatgctggagagcaaacccagtcactgttccaatttggagaaccagctaggggtggcctgaggtgagcaggaagcccctggcactggaacttcagggcccagcagagaagctcagagaggttctatctcagagacccatctggctagctggagcatggcccccagtccctgtcccatgctgggactgaaaccaccctgtttctctggcctagaggaaggccatagtgtttctttctgtgttagaagcagggtcacggtcaagcccatctgctccaaggccggtttctccagatacatcagagtgtacttgtagggtcagagccctggctgtctgaccccagaagtccctgggtataatgttaagacacagacctctgcacaggctgtgtgctcattttttttcttgagattttgtgactgtggtgagccagagctcaccagggatgccaggcacatgaggtgggagactggggatggctggcctggatttgcccaggggtgctcaggccctgagatggattcacttccatcacttccctggactccagcccctgtagcagcaccctcaccctcaggcaggggatagctgagttacattgaatcctctcctgtgagtgcattgtgctcagaaatcagatccaaggcagaggtggtaaggagtctggagccaaggccgaagagctgggattatttaggatttggaaccctgacatgaggaggcatctgccttcataggagaggctgactggccatagggtggatgtcctctcttccatagaaaactaggagatagatgggcaagtttttactttttaactcagttgtaaaaattctacctcctaatacagggacaaaccttaacatttgccctcgaaggacctgccactgtggcccagattccagctgctctcccgtggggaggcaggtgctggagatgtgttgcgctggtgtgactcgagcatttgctgggatctctttaccaggatggagcctggctacccatcccttcccagctctgtgttccgtgtcaccatggtcggcagcatggtcggcagcatggtcaggcacagtgggagtatttccagcagttatgcatttatggctgagttgtaggtcatgtaggtgggtgaatgacaggatggatacataggcttaggaagccacgtggagtcagtgcatgactgagcctgtccctcattgttgctgtcagacacagagccctgggtcatgcccctttacttctaaagattttggcactgagctctgtgactcttgccaaccctactccttccctaattcttggagattttagtatctgtttagaggtgcttctagtatctcccgacatctcagattcttcatcctctctcttccaaagatctttctccaccctagtggagtgaggagtcatcttgtagatcttgccgttcccaacaactcacccagcccatatcccaatgcgtctcacctcaccttctgtctttctactccactccctctcataccctgactccctcaatcctgcaaccccacagggatttctcatccatgatccctaccacctctctgctgcctctcaccccctcgatgtctccccttcccttttacctcaacctgtggtccagaaccataatcacttccttgagtttagccccacttctgttcctcctcctgctttgccctacttgtttggcaaaaccacaaccctggtgacatccacacctttacttcctttgtacctgcacccatgcagctgaatgtgactggagggatgtgcaaaacccggcttccagctctcgttttaaattcatgggctcagaagggtcgaaaaggcccttagagctgatgggctctcggattgtatttcccgggtctcctttgctctttcatcccactagataactattccactctttctcctctctcctcaaagccctgacacctcctcccctcttattctcagctgatgatactgcttcctgtttccctgaggaaattaaagccatgagaagagaactttccaggctctgtacccatgtattttgcccgtacaacagatgaactaagtgtccgtgttcctatctaaagtgaagttccttcacttgtcctttgggtcctagctcctcacttgtccacctaagggaaccactgcagcatctctccctcttttctcccatataaacaatttgcattctctactggctcatccctattgcataaaaatatatcgtttgaaaaacttccaacctcctaggaactgctccatttctctgctcgccttttattgcaaaactccctgaacactttttctatacttgctgtttcaactttctgttctcccgttcccctttaagccctttcggtcaggcattttccccatcattccttcgaaactattcctactaaggtcaccagtaacttcatattgccatatccagttagcctttctcagtcctcaccttcctagacctgtgggcagcatttgacacagttgatcacttttccattattccctccttcttgatactttcattcatgtggcttttgggacaccacctcctcttgcttttcctccgacctctcttcctgttccttctccgcttccttcattggttcttcctcttctccaacctcttgatattggagcaacccaagagacctctcctcctctctatttatacttactcccttggtgaactctcccaatctcatggctacaaggcccatccataggcagaggactaccagatttctacctgtagtccaatccatgcttctcaactctaggctcacacatccaactgcctacttgacatcaccatacgtatgtctaatggaggtctcaaattcaacatgtccagaacagcacatctgatcttccccctcaaacttgcttctccctcagccttccccatctgagttgatgaagacttcattctcccagttgctcaggccaaaaaacctggagtcaacctcgagtcttgtctttcactacctatatccaacctctctgcaaatccctttggttctaccttcaaaatacatccagaatctgacaacttctcactctttccactgctgttaccctgctccaggctgccatgatctcttccctgatgtgctgcagtagccactcagctggtctttctgcttccccttgaccgccttgagcttaggctcggtgcggcagccagagtggaacataaatcacacagtgtcattcccatgatcaagtcttccaatgcccaccaccccccattcctagcaggagctaaccttcctacagtggccttattggacccatgtcacctgaccgtccgtcgcccctctgaattcctcttctactctcttgcccttgccctctccattctagccatgttgtctcccgagtgttccccacagactttggagagactgtaccctttatttgaaatacccttcttacagatgcccatggagttaactctgtcacctcctttatgtctctactcacacatgccccaaccaccctatttaaaattgtaacccactccacccacattcccagtgacctgtatcctgctcccccataacactcattgccttctaatgcactatagtacatacttgcactgccttattattttttatttagtgtatctcttctccctctagaataaacattcccagaggcagacggttttctttttgttttattcactgatgtatcacaaaattttggaagaatgcctgagatatggtaggcacctaatatttgtagaatgaatgggtaagtgaatgaatggagtggtaaagggagtgtagactttggagttaaatagatctgggttaaatgtcaggcccattatttattggctgtgtttcataacctctctgagcccctgtgtctcctgcatgaaatcacaatcctgccctccaggctcctgttagaggttggtgtttgttgacctctttgccgagggacacagtgcacatgcattcgataagccatggctctgtcatgagtattcaggtatggggtgggtgtgccctgtgatctggtctgggcatgtgtttttcagtgtgtgccagcggggctcattccagtgcaccctgcacccttgcgcctccacctgcactgcctatggggaccggcattaccgcacgtttgatgggctcccgtttgacttcgtgggggcatgcaaagtgcacctggtcaaggtgagttcccggatgtttctgcccagttggctccatgcacagctgtcagggcactctggtgctctggactccagtttgatgcagaattgggtgatcggggatctaagccctgaggtggggctatctagagactggaagaagtgctgaggcacaagctcagggctggatggagctcaccagtcctgagataccacactgcctgtctgctcaccattataatcttgctctgttgggtcccagtgcttttttctgtctataatagcaagagctaatgctttttgagctttattatgtacctaggggcatattgagccatattttgtggattatttcacttaaatatcacagcagctttacaaggtaaagtttatggatcctatgttatagatgtaacaattcaggctaagggaagttaggtaacttgcccaaggtcacacagcagtcagtggtagagctggggtcaagtttgaccaagaaatctgactggagagttggtgtgcttaaaggagtcacaggttataattttcggctcacctggaggaagaaaactggtgatgtggggggcacagtgaaggcaggatccctaccccaggaggaatgggcactgatgtggtggaggagtgtcacccaggggaccttgggtttgctaatagcctatctcatcttataagagtaacatcaataataaaaataacatgtaataataacaatgacaaaaccttttatggaaggaatcctacctatagggcaggcactgtactggggtctttcacataattgcagtaactctacaagatgaagataattgacctcattttatttaaaaagttttaaaggttaatgcagtgtatattaaaaacagatattccccttcccaattcttctgttcctatctcctgttaaataaccactccagtcagggatgaatcctgcaagaacttttttctgtgagacatggacacacacacacacacactttgtttagtttatgtgaataagattctacaatgtgctttttttacttaagaggatacctcggacttgatttcatatagttggtacacacttttttcttttgaacagctgtgtagaattctacagaaataatgccctcgagtttgctttattttttccccatcgatggacatttaggttgtctccaatatttaaatgcagcagtgaatacctgtgtggatgtatccccaggttcttagaagtagaattgctgtataaaaagctacatacatttaaaatattcaatgccagcaaattcccctgcaaaaagcttacactagcatcaaggatgtatgtgagacagtgcctcttccccataccctatcaacacaatcatccctattatatatttattaatacattcattcatcagatattttggggagtcactacatgttaaacaccgcactaggcatccaaaaccagaacagcttcagagaacagaagtcgcccaaagtcacacagctcagctaacacaaagtagaagtggactgaaagccactccagagagcgtgttcctccacctctgtacctcttggcaggatctcctttctcccttgttttattggactcacttattctctcctcagagcacatcagatgtcagcttctctgtgattgtagagaatgtgaactgctacagctctggcatgatctgcaggaaatttatttccatcaacgttgggaactcactcattgtctttgatgatgactccggaaatcctgtaaggctcagtgcctgtgaaggttgtgtagacaatttacaggttaccagggttggggcagaagagggctgaggactggcttccttaccatagcagtttctcttggagagccactgagttaggagcccagactgaattcctcttggccagggtcaggaacacagaggccaatgtcagggtatgagggaggcagaggcattggtgagggcctggctgcaggcatagctgacctgggcgctagggggcacttgggctcaggactgaccatctctgtccctctagagtccagagagcttcctggatgacaagcaggaggtccacacatggcgagtgggatttttcacactggtgcatttcccacaggagcacatcaccctcttgtgggaccagagaaccacagtgcacgtccaggctgggcctcagtggcaggtacttacatgagcagtgacattctgctcctgcctggggctaagccaagccctgggtgtccttgggtgagctgtaccctccctgaggagccaagaagagcatgcctctgttctctcctccgccctgctctgggccccttctcctctgacattgctccatccctcttcaaactgtgacctcagcagtggcttctaggtctatgatagactcctgggctcatggtgacccctctgcccgtggctcacctctggcaggcctgcaactgaccatggtgtcctctctcctttcagggccagctggcgggcctctgtgggaactttgacttaaaaaccatcaatgagatgaggaccccggagaacctagagctaactaacccccaggagtttggcagcagttgggctgcagttgaggtaaagcctctcttccaggctggcttatgcccctcactcagatgggcgctgccagcactgaacccggcccaaggtcagggaagagggatgctggtgtgaggtttctcctgcaatgttctctcagcctctgactgcatccctagccctagactctgtcctatggcccaaagatcatgcatagtcttgtctcacaaatccagctgcccaccctaccctggaccaagccctggtagggtggtggagggttgggaaggtgacaaagtctgtcccaggagagatggtcactcatgatgatgcttcccagtgcctggcactaggtctggcacagagaagagaccaagagagactgaggtgggttgaggcaatcagggaaggcttcctgaaggagatgagagtggtgctggcacttaaaggctgggccatgcttaaatagatgaatatatcagagataaggtctctgagaggaagggcaacactagcagagatagaaatgagggggtctgcccaaaggacagtctgcgagatgtctaactgaggctgccaatctgtgagctgtgggggaaacagcactgagttgagagcagtagacctgggttcttgtcttgggtcatccattgactttctgggtgaccttgagtaagtcccattcctctgcagagaggggactgggccaagagagggctgatgaatagatttcacttcatgtgacaactctgattggtcaaaacagactgcttgggagctatgttgagaaacatccaagatctgtgtcaagctcagctggaaggaggactgtgatcgattatttatgtctgccataggagcagcagtggagagtggtgatatgagcgttacatatttgcctctcctggacttagtgatcttaatgccctgctgggaagtacacggagatgagcctatgtagactggggtaagggaagcagtcgtgcatggcctggagttcaactgctccaggtggggcagggctgttcccacagcctctgaaatcctgaggtgggacaagggttcccacagcctctgaaaagtgcgccctaacacacccccattttagagaagctcagtgggtgactaacccttgttctccccacacccccatgtacatcatatttctctcttgctaatcccattcggcataccatggggttccccagtgaaaatgtagtctaaggaaggagattcagcagacatcggaaacatctgtattagttatctactgctatataaaaattttatgagacttagtggcattaaacaacacacatgtattatttcagtttctgtgggccaggagtcaggacacggcctgacttggttccctgcttagtgtctcacaaggctgcaatcaaggtgtcagctagggctgggctctcatctggaggctctactggggaaggaactgcatcctcatctgctcacatggttgttgattacattcagctccttgcaactgtagggctgggagcttccatattttgggctggcttttggccagagaccaccctcagctccaagagaccactgacacttccatccatgtggggtcccccagcatggctgcttgcttcctcacagccagcaagggagagactccagcaagatgggctctgggatctcatgttgggaatcatgtgatcacatacacatggccacgtccatcccatcacctgggccatattctgttggtttgaggcaaggtataggtcccttctacactcaaggggaggagattttacaaggacctgaatatcagggggcaaggatcatggcggccaccctaaaatctgtctgtcatgtcaggcaacaggcatttggcaagtagggaggtcaacagccctgcctttgcccctcagtgcccagacaccctcgatcctcgggatatgtgtgtcctgaatcctctccgagaaccatttgccaagaaggagtgcagcatcctgctcagtgaggtgtttgagatctgccaccctgtggtgagtgtaccccagcctcggctcctcccgagtgccccctccactgtcctgggatcccttcagctctcagactcccccatgtctcagaggagacagctcagatctccagggaagatctgcctctgccattcccctgcctccagccagctcagatgagtccgtcctatttccccagatgaccaggcacagacagccaggaaaacagagcttgtgcccttttcaagcccatcttgatctggcccttcctccttatcatgaagttcttctaaatggtggacccaaagccctcatgctgaggcaccacctattgcctgttttgcttcagtgcacacagaggaggctggggctcagcactgcatggcaccctgcaggccttgaaggctgctgtcagattggccttggctgtctctggccctggctaggcagttcaggctctactcctgttcagccattcttggctcctggatcaaacagcccagactaaggagagaagagagcttagttctcaaaagtggacatctgcctggaccatggagttctcgcttccttgtccttctcccttcacacctcatgagacaggatagctcaccctatcccgtggtcccttcatgttggtgctggtcgtcatcagctgaaaagatgcagatctgacatttgggatctgtcctctgacctctaacttctgaccttctccaggttgatgtcacttggttttactcaaactgcctgacagacacatgtggctgcagccagggtggtgactgtgagtgcttctgtgccagcgtctccgcttatgcccaccagtgttgccagcatggggtggctgttgactggcgaaccccccgcctctgccgtgagtgtcccagacaatcacctgaggggacagagtagagtgtcacctgtgggcatgccctaggggtactggcagtctgtctagcatttactgagtacttagaatgtaccaagcaccaactgctttgggcgtgttattcattgaattcttacaactaccctttgaaacagggctatatatttcctattttacagttgaagaaacagcctagagagagagatcaagtaacatgctcaaggttagtggaggagccagggttcatccctagagagtccaatgcgaacccgagctcatagccactttgttagaagagtcaggagcctagacccagagctaccactcgcaagctatgtgacttcaaacaactcacccaacctctctagggctcaattttcttgtgtgagaagcaggaatagacctgcccccaaggttgactctgaggaccaaactgggtgatgaatatagaagtcctttgtcagctgaggtttgcaggtcccatcagaggcagcacagatgatcagtttattcagagtaatggtggtctgcagatgcttttcattgcacacacctatcaagtaaaatcattttgtgcacatacatatgcgtacatagatatgcatccatagatatactcctcaagtaaaatatgtaaacaaatttaaaaattaatatttaaaagatgaaagaaaatataaagaaggctaaattcttcattgattattttttatttattcccacgcaccaaaggattttcctcgtgcaagcacctcaccttggggtgcgatggccattacacagccttgcgctctggggtcagactgactgagtttggccccaagctccactgagttggcctgggacatattcctcacactctgagtctcttcgtctgtaatagaagggtgaagataactgcttctaccttgtagggtactgtgaggtttaaacaaggcattgcatgtacagcacttggcacagtgccctgtgctaatgtgggggttgttgtcattttttcatggacacccggtactgacatgtccagagccctgaggcctgcaggcaagacgccaaaggaagaaggtggagcagaaggacacttgctgagggtccactgtgtgccaggccttgtgcctatgtgcattacttcatttaatatgcaagactagggggaggtgattgaggtgcttacctggggtacaaagtttcagggggcaccaaaaatgcagtaatcaagagaaataatgtttcaatataatatttctgtaaaataaaaattgctgtaaaaatactgtgatgaacaaactatcaaaggatcaatagtattaatgtttccttttgtctcagtctctactctggctcagtgggagactgttaatgatcttgtctttatttttaaattgtaatattttatttatcatggatatttttgcattaattttgatgttttaaaaatattgcattaagatagtatttatcttgattactgagatttttggtagccccttaaatttcacatccaagatgagcactttgccttaccctggtccaggccctggcaggtctatggggcagatgtacgtagcggtcccaccttagaggagggcactaaatttcactgacgttaagtaatttggtccagtatgcacagctgatgagtgagggaggtgggatttgaactcaggtctgactctagagagctggctttttaatgactcttctcggctaccaccccttgactgggtataccctggaaaccagaaacttggagattttctaattttctggttcagccttctgagtctgcagatggagggagaggcaggcacgtgcccctagccacatggcgggcctgtctcctgactcctagtgttctttctggagggtgaccccagatgcattgaccttgtggtctggggtgtgcagtgagtcggtggctctcttcagaccgtgcctatgtgtgaagcatgctgctcctaagctttatcccaggtctatccgcctggctcctcatggctttgctgctggctttaggggtctcctgcaaggtcccaggcacacctcagtggactgagaatctgcagctgaggggctaggggaacagggtgtggtgctggggatgaccactagagggcaagctgagctcacgcttgcgggagcttctcacagctcggctggtggaagcgcctctgcagtgcaaggggcttgaagaagccggggatgctgggggctcccggtccccttcccaccgaaggctcttggaagaccagcctccatcttgtgcttgcattcctctgggggccttccgcaacatttctgattaaaactcccactccttggttctaatcctgctctttggcgccacacaaaatacacctgcttcttttcaacattcattcgtttgttcatttacttgacacatcgctgaggtgcctactgtgtgccagtctttgagcctcgtgctgtcggcccagagaggagccattctctttcctccacttaagacatctgcatccatgaccattcccaaatcttgacatgtgggaggcaggccaggcccagcacttggggaagaagggaggctgggatgctgggagccttggctctgtctgtctgttccaggctctgggctggctctcaggaagttcctgttctctctctttcagcgtatgactgtgacttctttaacaaaggtaagcccctcctccccacgcagagtctcaggggctcaggcactgccagccctgtcctgacgccacacagcatcagccatcccgaggcgctgctggccctggaagagccgtgacccggaatgggagggcccccatcatgcagagagagccctgacagtgaagggcccaggggtgtcctgcacctctatcctcagcagttcctgcagcccctgtccggggcccaggcaggccagctcccggggactgtgctcggcagggcagccccaccaggaaggaaaaaccccattctcacttatgtgccagctcctccgccttcataatctagctcatcaggcccacagaacatcaccttgggttccccgaagattagcttttggcaaaagcagacacaaactgccctttctgactatgggtggaacaaaacatgtggcctgccacattcatcttcaaactcagccaaggttgcagggttccgggagatgctctgacatttagattaacgagggtgaaaacacaggtcataaccaaagacccaggggaggttaatgtccagtttagagccaattcatcaatttaatcactgggattgggtgggtggggtagagaagggctgcccaggagtagtttttagcaccgaacttcatccagttgggccagggtcagaccttggtagagtgagatgctcatctggtcctcagtgctgttcgcctttgacttccaatccccgaccctcctccagggactgtgctgccaggagcaggcctatgtgggcagaggcccagactttttgtcctcagttgcctgcattatcagattttggcttgactgtggtgggtgaagtggaaaggagagactggagacaggataccatctgggggcctgcgagatgacggccggaccagggtgtagcatgagcatccgcaggactgcagttctgccaaaatgctagtccccaggggctcttgacagccccagaccttcaattggtaaaggaatgagcctgcaatgggggaactgtggtccctggggcagacaggatctgtctgacatcaggcaaggcatttcagcaagatggagctgtttcgttttctctcttccatggcattttgggtggcagtaactggcaaaggacaagctgtttctagcatcttccacctacccacccacccactcacccatccttgctccgttctactagcatttgctctggtccgggcccgccaggtgttgggaagtcagtggtccctgagtcctgccacagcggtgtgtggagcaggctcacgccgcctctctagcacctattgtgtttctaactccacattcagttggtagtttccagttgacccctggtgggagtgtttacgccatggaaatccagaagccctacaaaccacttttttttgtttgagatctcattgttagccatttgccagcacagccagcactgcttgtctcccatctagtgggggtgacagatgtgggcctcccatccagatcctcatccgaagagctgtaactggtgtgtgccatgctccaagagctggtggggcacagaggaggagggacaacatttgcatgtggcaggagagggtgcagggagagcttcacaaggaggtgacatttgagctgggccccagaggttgagtaggcgtttgtcaggcacaaaacggggaggactactctgagtgggtggaacggtgtgatgagatgtgagctgggaaataacaccactgctccttccaggaagagcaagagaagttcagcatggcaggagccagggcgtggggggagtgggggaggtgggcaggggctgagggctgaagggcttctgaattcaagctgggctctttagattctgtcctgagggccatggagagccactggtgcgtcccaccagggggcgtggctgggagggcagctcagcagccgtggggaggaggcattggggtggggggtgggcacagcagaggcaggaagatccttacaaggtgattgtccaggaagcccatgctctgtgccaacctatactgacaaccacaggaattctaaagactcaacagtgacacgtgtttgaaataattagataaacactaacaggtttattgtccctcaggcctggggtgggcagaaaccgggtctgacgtcttcttccagaggggaccttgaatagagcagtggctgtaatggtgaagtttcaggcagtgggaaggctgtggagagacaatggggggcccaggtgctccctgtgggtcgccttcttccttggctccctgtgaagtgactcaggcactgtgcagtgggtctgttcctttcaggggctggcagcctgggaatcctgtcccttccttctcagggtcatcaaggtccctgagatctgggatgaaggacaccatcaagagttcctccttggtagcttgccctcccaccccactgctgccaaggggtggggcaggaggtatgggaggtgggcaggccatggggccaggttgctgatggggcctcttctctccagtgctaggtaagggcccctatcagctatccagcttggcagccggtggtgctctggtgggcatgaaggcggtgggcgatgacatagtcctagtgaggacagaggatgtggcgccagcagacattgtgagcttcctgctgacagctgctctgtacaaggccaaggcccatggtaaggcccatcccagtcccactccagctcttctgggaggcaggagggtgctagaggaggggagggtgctgaggccctaagtatctgtagtggccggagaaataggggctccgacaagtgcccctctcccagttgagatggtgcttctgggtcagcttcttctcctctgcagagatgctctccatctgctcccctaaccgccagggcagccaaggcccaggtgtgcctctgtaccttgctgtatgcaatagctgtgttccagaaaagccaagtggcagctctccctcctcatgctcctcctcctccttcctctcttcctatctcaccctccctccctctctcccttcttccctcctctcttccctttctccctctacctctcttcttgcctcccaccctttcactgagccctaatcccatgccaagcacagagccaggtactgggaaatcagggatacaagagacaaggtccctgcccatcagaagcccacagtcccatcgaggagacagacgtgcccaaaggcggaacacgggggagggggcccccaactcagtcttagagtcaggagagccttgttaaaatagaggatgttcccctaagagtaagaaggagtcaggaagggaaacttctttcttacttagtaagctaagctcaggatttgggactttatcctgagggcaatggggagccatggaagggctttgtggaggggaagggacgtcctggctcctgcccagccccaggcacagccaacatccctagctataggtgatgttcacggtggtgtgagcctgggtgaggtaggtggtacctggcagaatcacgtagttgcacaaggaggcctgggagtgaggagtcaggcactgggccgcaggacagctagaagcaccacccccaaagacagcacttcctccctaaacatttctgatccccagatccatgcattcctgcctgacgaagggtgtctcaccaccttccagatgtggcaggccatctgcttagtgaggcttttctgttctccatccagtattttaatctagtaggtaatgtgtagtccagagggggtgttgcctttccactaggtttatgggcatgctaagcagaaccccggagtcacctggccttagagaacgtcactgggggcaggatgccagaggggctccagtccaggctccgtctcagagtcaggcctgggtctcatgggcccagtggggacccaagctcctccctctcccttcccatactgcttctcctgggctgtgcccagggtcctgggcagccaaggaaaggtgccttccaggtgggacctagggtggctgcatggaggaggtgtcccttgagttgggccttaaaggatgggaaagatggttatgcgaagaagtggagagcaggaaacatcacagaggggaggactcagcagtcactgaggcccaggcttcccgctctggggagtcaccaccacagcctgacacaggtcaccggggtgctagtgttacctgaagatttttgtggtggggaggttacttatttattaataatcatacgttgcccttctgtaggacttctcatgtgccggcactgttctaagcgcttcatgtatagcaactcatttaatcctcatgacaatcttaggaggtagggactattattttcccaatctacagatgagggaactgaggcccagagagattaagtgatttacccaagggtgcagtgcttgttagtgacaggcgccagccgtttggctccagagtctttcattcaaactcctctgccatgctgccttccaaaccgaggcattaaacaagaaatacagaggatggcaggcgaagtcactcgaatatttacagtacagccccggactctgcatctcaaggtctctgccctgttaggaggactgcagggaaaacagtggagaagccttgatccgggccaaccccgccttcttgaaggaggaagccaaggcccagggaggagaagtgacttgcctgaggtcacgcatccagtggagcgggctggggctgggactcagtgccctaccatgctgggctgcccatgcccacgcctgcatcccatgggtggggccagccatgtggtggtgaagatagctgggctctggtctcagcctgcctgcatccagccctgcctccctcatccgccgtcagtgtgactctgggcctctcttccctcctctgtaaaatgggaattgtaatatcaccaccttttaacctctcatagaaatttattctctctccaccccacagcccccaggatggtgagctccatgagggcaagaattttcatcattttgctccctattgtggcctcagtgcctagaacagggcctggcccacagcaggcactcagtaaatatttgctgctgaatgaagatatttttcacttcacagggttctcgtaggaatttcaaaacctgcaggtaaccagcttgcttagcacagtgcctggcacgtagcgagtcatgtgtaaacagcagctgtgattattaacatggatgaagccagtctctgttacctgccatcttctcgcagcttcccagggaggtgtgacagggacactatcgtccctcctggggacacaggggacacatggaaggggctgaagatgcacccacccagcaccaggctgtgccaggcgcttcacacacacctcgttgatgatccctccaacagcccaggcatgaatgcgcttgcccacatcacagccagggtggtgagctgggattcccgccccatgctcactccctgtgcctgcttgtggatttgggacttgaggagacccataaggccctgggcaggggaaactgcccaccaggcatcaagcccccatgccctagaactgggcagttatggagaccagagagagaggacagagacaagctttgggtctctgggcaagctcctttctctctctctctgggaccctctccctatctatgagttggatgaagggttgccaatgctggccctgtggaattctgtgaggagcaggaccaagctggggaccctatagcttggcaaatcaccaaccttcagcgtgccccacatgtctaatgcaatgcaaccccatcagggcagttgcctctattgtattcactgatggatcctgcgtatctagaatagtgcctggtacattgagggcactcaaacatgtttgcagaaggagggaagaatggaaagaggggtgcaaaggggagggaaggagatagttcaattaccttcccgaggcttagcagctggggggtctctaagcctccgctcgccctcaggcagagatggtgtgaggggcagctggcaggcagagtaggtgggctgggggctggtgtagggggcagggcctgctggtctgcaggcgtgctgccatccagagtcgctgagagagcagatgtgtgccaggatgctgttcccgcagccacctggacctctgcctgtactgactctccccatgtggttctctgcagacccagatgtggtgtccctggaggcagcagacagacccaacttcttccttcacgtcacagccaacgggtctctggagctggctaagtggcagggccgtgacaccttccaacagcatgcctccttcttgctgcaccgggggacacggcaggcaggcctggtggccctggagtccctggccaagcccagctccttcctctatgtgtcgggcgcggtgctggccctgcggctgtacgaacacacagaggtgttccgccggggcacactcttccgccttctgggtaggcgaccccctgccattgccctcggccctttggccctctcagtccactgctcttcccaccctgtccccacttcacccttccaattacccctaagaagcagaatcctccttctcctggcacaggggccacatgggtgccaccctgagatgagaggtggcccagcctccatgttgacagcttagggagccacggacagtgtgcttggggtccagccaatttcctgggtcctgccttctgccacaggccaattacactgtctaaaaatatagcagcctttgtggaagtgaggggaggtgtgatcctggctgcaacatgcgtagccgctggctcagttttcttgctgatgaggtcacatgtctgccccatgagttcaaagactgcacaagggggataggtctgggggccagcaacctcctctctcaatggaaggcccaagcccctggacagggatggggcaactccccgaccttccaccaacgccaaggggatccagggcctgccctgccaggtgtgtctgtccccaaaatattgttctctgcctaaaccctggagaaggcgatcataatttcttcactgttttctctgtcttgcatggggcttgggggtacctgtgtctgtgggtggatccatttgcatgtacacgtatgtaaatgtgtcttcagccagcctccttatttcatcacccaccccacccaagccagggctgggtgagctcattcttcccttcagcggtcagttatcgagtctgcccttaaacttgacatgggacagatttatcactggccatgatgacaagacttgctcatgatgggagtatttgtgtccctctccggaagacactagggcagagtggcatgagcccaggctttgaagctggacagccttgagttcaaatcctgaccctggtcctagacccttggaggagaaccctcatctccttgacttggtttcttcacctgtagaatggggatatttgtctcggaagtgtgctgtgaggactggctgtgtctcgcgggctttgccttgtgctggcacatagtaggtgctccccaaatgtaagttagacttttggaaaagcaggtttctttacagctggcagcagtgttcaggttagggcgtctggaggagctgccggtgggggatgctccctggagcctgcttcggagcctacccacacctccctgttcaggctgtgtgttcagaaactggtcacttgtgccaaggtagcctggggtctacttgtctgcctccaagccccccataggctgcagacttttccctcatttgccaaggtgctagccacagggcctcttttgagaacatctcctctgaaaacctttcactttctcagcatcatctgtgcctgggtttcctcttctctaaagtgggggtaataatagcgcctacttcctaggacgatgatgaggttgaatgagtaaatccgtgtgagatattttgggtagcgcccagtgctgtttaagagttagcccagccgccagggcagtgagggtggtgctcacacgacctgcactctcaggcccttcaggggccctctgggaacagagagggctgagtcgggggaataacacctcccttgcaagctctctggggctaggtgcccaggaacgctttgggctagaggggaagggatcccccagtgcctcccctcaccctgcaaaggagagcctcttgcctccatggaggtctgcaatagccctgctagagacaaggcaaggaggaggttactgtgtcctgggatgcagggcaagcctgagcaccagggtcccagaggggcagggtgggtggcagggcatcccaagggagagatcaggggtccaggcctcttcttcggtcacccttcgaaacctcactccaactgccggggccagagcttccctgtcctcagttcttccctgtcctcagtccttccctgtcctcagtcctgcattcagctcccagagccccgtccccaggatcccccaggcactcaccccaaccaccatgaacgcagtttctccttagtgtggttttttccccatttgctttccctgcatgggtccatttgtcccctccacaggatggggggcagggctgagctctgggactccctctgtgtcttcacctgacccagagttgctgccccatctcactttctagatgccaagccctcgggggctgcctaccccatctgcgagtggcgctacgatgcctgtgccagcccctgcttccaaacctgccgggacccacgggcagccagctgccgggacgtacccaggtgagatgccaggggctgtgggcatggagccaaggtgtgtgcactagtgtgtgtgtgcactcacatacacttgtgtatgagtgtttcatatgttgagtgtatggggatgtgtgtaccacggtaactgtgtctttccgtatatgcacatatgtcagcatatgtgactatctatttgtgcatgatgtgcatgcagcagagccttgcgtgtgtttgtgcgtgtactactacaactgtgcattcgttgtacacagctgcatgtatgcaggtgttgtgtgcagctgtgtgcatgtgtgagggtgtattcactgatttttgtgggagtctctgtggatgtgtttgcatgtatatgtaaaaattttggagtcctgcagggttggagggggtacatgaggccatgtgagaatgtgcccaggcagagacacatgtgaacatgtacatgagtgtgtgcagaagtgtaccttgctcgtgtgtgtgtttccctctcggtctgaggggtagaagtgtgcaggagtgtgccgcatacacattgggtgtgtgtgctcctgtacatgtgtgacagcatctctatggagggtcatgtgtgtgtacacgtaataagcacatgtgtgcacgcacatgtgtcataagaaaggataaggcctgtgctcaatcgagagaaaaagagatggccctgcctgtatttcaggcctttaaactgctccctgctctgtcctcagggtagaaggctgtgtccctgtgtgccccaccccccaggtcctggatgaagtcacacagagatgtgtctacttggaggactgtaagtggcccagacttctcatccttccctcagatttcctctaagtccctagggtctcactgagcagtcatgcctcaaagctcccaggtcccagagaagcaagatcagcacagggacctttggaaagaggcacaggcacaggggatgcagaggcctcatccggtctattcgccccatttcacagagaggagaaatgaggcccagagtggggtcacatggtgagaaggtggtgcagccagacttagacctgaggtctcttggttctggggtcagggtctgacgtctggggcggagtccagacctgctgacatctggccgttagaagctgccctcaccccatcaccgagagtgccagtcctcaagcctcacaccacagccctgcccagcaatgacccccggggcagcagtcaccccgccttctgaacctcttcttttgtctccgcaggtgtggagccagcagtttgggttcccacagaggcccttggcaatgagaccctccctcccagtcaagggttgcccactcccagtgatgaggagccacagctgtcacaggaaagccccaggacccccacccacaggccagccctcaccccagctgccccactcaccacagccctgaacccaccagtgacagccactgaggagccagtggtgtctccaggccccacccagaccaccctgcagcagccactggagctcactgcatctcaactccccgccggccccacggagtccccagccagcaagggagtgactgccagcctcctggccatcccccatacaccagagtcctcatccctccctgttgcactgcagacacccacacctggcatggtgtcaggtgccatggagacaacaagggtgactgtgatctttgcaggaagccctaacatcacagtctcctcccggtcgccccctgcccctcgcttcccgctcatgaccaaggctgtgacagtccgaggccatggctccttgcctgttaggacgacacccccacagccctccttgacagcaagtccctcctccagacctgtggcttcccctggagccatctccaggtcccccacctcctcgggatcccacaaggctgtgctgacacctgcagtaactaaggtcataagcaggacaggggtcccccagcccacccaggcccagagtgcttcaagtcccagcacccctctaactgtggctggaacagcagcagaacaggttcctgtcagtccccttgcaaccaggagcttggagatagtgctatccacagagaagggcgaagccgggcacagccagcccatgggctcgcctgcctccccacagccacacccactcccctctgcaccaccccgcccagcccagcataccaccatggccaccaggtctccagctctgcccccagagaccccagctgccgccagcctgtcaacagccactgatgggctggcagccacacccttcatgtcccttgagtcaactcgtccctcccagctcctctctggcctgcctcccgacaccagcctgcccctggccaaggtgggcacatctgccccagtggccacacccggccccaaagcctctgtcatcaccactccactccagccacaggccacgactctgcctgctcagacacttagcccagtactgcctttcactccagcagcaatgacccaggcgcacccacccactcacatagcacccccagcagcaggcacagctccaggcctgctgctgggagccacattgccaacctctggagtcctgcctgtggctgagggcacggcctccatggtatctgttgtcccacgaaagagcaccacagggaaggtggccatcctatccaagcaagtgtctctgcccacttccatgtatggttctgcagagggtgggcccacagagctcacgcctgctacgagccaccctctcacgcccttggtggctgagcccgagggagcccaggcaggcacagctctgccagtgcccacatcctatgccctgagccgtgtctcagccaggacggccccccaagacagcatgctggttctgttgcctcagctggctgaggcccatggaacctcggcagggcctcacctggcagcagagccggtggacgaggccaccacagaaccatctgggcgctcagccccagccctgagcatcgtagagggtttggcggaggctttggcaactaccactgaggccaatacatccaccacctgtgttgtgagtgatttgccagggttctggccacccgtatgtgacccttcccttcatcccttcctcttccctgctagatggagttttagtcgctatcctcatacctgccccatgctcctggtccctgaaaaattcttcagtctcctattggcccctgatgccatagcagggttccgcctggcccatctaggccctggggggctgattggatggcctagtgtgatgcccaggtgacaatgtgtgtgtgctagtgtgtgcctgtgtgagactgctgtgtgtgtttgtgttcacatgtgtgagaaaatatgagcgctcctgtatctgcatgtgctcttgtgtgtgtgaggaatggtgtttgagacatcctcatgtgcatctttgtgcctttgtgagaaactgtgtgtgtgtgtgtgtgtgtttgtgtgtataggcttgtgcaagtatgctagggtttctgtgagtgtgagctagtgtgtatacatgcctgtgtacccagacctctcagcgcaggccaggcagatctgcagaggtctcagggaataggtccctgacccccgagctcacactaagtgcatcgccaggccccacatggcttgtggtgggtagggggtgagggcctctttccctagaaggtcccctgccccgctaggacctacatgtgggaaggatctggtgccatcacagcttgcagggtgggctgtagctccttgatggtcactcacacttcctccactctgtacccagccaatcgccgagcaggactgcgtccgccacatctgcctggagggccagctgattcgcgtgaatcagtcccagcactgtccccagggtgctgctccccctcgctgtgggatcctgggcctcgccgtgcgggtgggtggggaccgctgctgcccactctgggagtgtgcctgtgagtcatgggatcagcggagcctcctgcatcctccctgtatccttaccccagcatgaccgccatccctgatctgtgtgtcccagactcccctcctgtgggaccccgacctggcagatttcctacgcttgtgacctctgatctgtgtgatgcgtggtctgagccaccctccagaccccaggcctctgcatccatccaggaaaagggccaggaacctgccccatcttcctaggcggccttggtcttggaggcatccacctattcttcttgtgccctgcccctcccccaggccggtgctcaatcttccctgacctgagcttcgtgaccttcgatgggagccacgtagctctgttcaaggaggccatctacatcctcagccagagcccagatgaaatgctcaccgtccatgtactggactgcaaaagtgccaacctggtgcctgccccatacctccctccctgctggggactaggaatgggactaggataagaggggagacggagcagtgagccagggtaccagaggcaaagacagatgtggaagcccccctgagctccctctgtctccaggaatgggcagggcctcccaggtgatggctcccttggaggctggggaaagaattgagtggagtgtgccacctcctggccccagcctgtcccattcccagcttgtgccagcttcctgccatgtaggagggatggcacagtagtgcagaggagctgggatgccactgcaatggtgtggcccgaggtcatgggtgctggctgcagggaatctcctactaggatgtccccataagtcaggtggaaagaggtagcttctttctcttctcttctcccttttctttctttctttctttctttcttttctttctttctttctttctttctttctttctttctttctttctttctttctttctttctttctttctttctctctctgtctgtctttctccttctttcttctctcttctttccctccctctctgccctgcccttccttccttccttccttccttccttccttccttccttccttccctccttccttccttccttccttcctttttttctgttttggtctgggcttgcatgaggtcagatggagccgcaacagttccatgcaatcctgggcaccatcagcccagcctgatgggagcccctggcatagtgcagggggtagtcaggggagactgtactcacatttgctgtgcccactcacttggagggggacagaggacagggctccaagttgatgagggctgggttctctctgcaggggcacctgaactggcccccgttctgtctggtgatgttgaacatgactcacttggcccatcaggtcactattgatcgcttcaaccgaaaggtgagtgcatcaaacagccagcctccagggcagggccacagtcagctgagggacagggcatccaggggtggaggggctgtgaggctgaatcatgattcagggcaggggtggggaggggacctttttttagaaaataatgcaaaattaggtatatttggaagtgattataattagaatgcttgtggccacaccaatgtcaggggaggaagtataccaggaggaatgggatattgttgtgacagagaaaaagtcggaaaggcaaagagacagtgggtttaaatatttatggctaaaatatctcacttttgcaattttcacaaaaacctatgaccacatgaacacattactaccaggacccctaccaggaagtgaggagccgtgaatttaagcttcactggcttcactaagttcacctctgtcaaggaggccggggtatccaacaacagcccacccccatatgggcatcctctccagagggcccacctttgctcctcccaacaggtgggcaaagggtactgatctgtctcctcctcaggtcccaaagttgtgagtctgcccccaattcctgagccttgatctgcagccttccttttggaatctgcccttgaacacagggtgcggcacatttgtggtgctcttaggagcggggtttcggacagtaggtttcctatgggatggaggcttgaacagaaaactccctgagtttcgtttcttagtttataaaatttttccattaaaaaattaacatataatctacatgcagtaaaatttaccgtatttagtatacaattctacaagttgcaacaagcacccacagtcatgtaactaccacctccaaccaggatatagaacagttttaccatcccaaacactacctcctgcctcttcattgtcaacccctcccccctcctgctgacaaccattgcccgctgcccctatagttatgccttttccagaatgtcatataaattgaccagagtatatggtgacattcatccacattgttgcacagatcagtagttcaatcctttttattgatgaatagtattccattgtatgtatgtaccatagtttatttatccattaaccagttgaaagatatttgagttgtttccagtttggtacaataacaaataaagtggctataaacagttacatacaggttttgtgtagataaagcccccaggagtagattcccgtgttgaacaggaaggatgtatttagctttacaatacttgccaaactgtattccagagcaggcatttagcattcccaccagcaatggatgagagctccaggagctttgcatccttgccagcacttggtggcacgtgtttgtttgtttgtttagtcattctaataagtgtcaaatagaacctcattttggttttaatttgcgtttttctgcttactgatgatgttgagcatctttccatgggtttattttccatggtatatgctctttggcaaagtatctgttcaagtcttttgcacattttaaagatcatgttgttctattgagttttgagaacttttcctgtgtattttggacacaagccttttatcacatataaatctaattttccagtctgtagagtgtttttccattcacctactagtgtctttcgaaagacagaagtttttttattttgatggtgtccagtttatcagttttttcttttatgaatcatgatactggtgttgtacttgatgaaccttgcccaaagtcacacagaatctctcttatgttttcttctagaagttttatagttttaggtattacttttatgtgtatgttgcattttaggttaatttttgtaaatggtacaaagtatgagttgaggtacatttttcaaatgtgaatactcaatttttccagcaccatttttcgaagagactattctgtctccattgaattgtctttgaacctttatttaaaaaccaactggccaggcacagtggctcatgcctgtaatctcagcagtttgggaggccgaggtgggcggatctcaaggtcaggagtttgagaccagcctgaccaacatggagaaaccccttctctactaaaaatacaaaataagctgggcgtggtggcacgcacctataatcccagctactcgggaggctgaggcaggaaaatcacttgaacctgggaggcggaggttgcggtgagctgagattgcaccattgcactccagcctgggcaacaagagtgaaactgtctcaaaaaaaaaaattaatgtttgggataatttatatgctttttattttgtcctattaatctatcctttcactgatgctacagtgtcttgattaccattacttattattaaaccttaaaattaggtggtattgttttgtctgttcttttttttagagacagggtctttccctatcatctagactagagtgtggtggtgcaatgatagcttactgcagcctcgatctcctgggctcagcaatccccccacctcagcctcccaagtagaggacaacaagtgtatgccaccatgcctagctaattttttaattttgtatagagatggggtctcactatgttgcccaggctggtctcaaactcctggcctcaagagatcctcttgcctcagcctcccaaagtgctagaattacaggcgtgagccaccgtgcctggcctagctattctaattcctttaacttttcatagaaatttagaatcagctttttgatttctaccaaatgtcttcctggaattttgagttgcattcaatatatagattatttgggagaagaataaatcttaacactggtgagtcttccagtgcatgaacatggttcatctctatttttttatggcttctttgatttttttatttgtgttttgtagtttttagtgtaaggatcctatacatatttgataggcttattcctaagtagtttatattttttggtgctattgtaagtaattgtgttgtttttgtttcactttccaattgcttattactaatgcaaatacagcttatttttgcatattgagcttgtatcttgcaacgttactaagctcagttattagttcttaaattctttgggtttttctacatagacaattatgtcttctccaaacagagacagttttatttcttcctttccaatgagtatgcttttaatttattttctctcacctattgcactggctaggacctctagtgtgatgctgaataagaaaggttgagagcaatcatccttgtctgatcttagggagaaggcattcagtctttcactgtaaggcatgatgttagttgtaggcttttcacagatgtcctttatcaggttaagaacattttcttttattcctagttttctgagagattttattaccaggagtagatgttgaattttgtcaaatgcttttttctgcacctatttggataatcacattgtttttctttttcacattattaatttgatgaattacattgatttttgtgtgttaacccagtcttgccttcctggaatttacttcatttgttatattatcctttttatatattgttgtatccttatgataggtattagtctaaattttcttttcttgtaatatgatagtttactattggtagcagagtaatgctggcctcacataatgagttggaaagtattctcccctttttaattttctggaaaattatatgtagacttggtaatatttattccttaaacatttggtagaattcaacagtgaagccatctgagcctggatttttctctggggagattttaaaacacacgttcaatttctttagtaggtgtagagctattttgtttatatatttcttctttggtaaatttgggtagtttgcatctttcatagaatttgtccatttcatccaagttgttaaatttataaacattaagttgttcatcatatattcttgctatacttttaatttctgtaggatctgaatctatgtgccatatctaattcctgacattagttatttgtgtcttctctcttttccctgactagcctggctagaggcttatcaaacttactgtccttctcaaagaatggctttattggttttctctattatttttatattttctatttcattgatttctgctatctttattattttctttcttctgcttactttaggtttaatttactcttctttttctagtttgttaaggaagaagcctatgtcattaatttgagaactttcttcttcttctatttttttttttttgagacagagtctcactctgtcgcccaggctggagtgtagtggtgtgatttcggctcactgcaagctctgcctccctggttcacaccattctcctgcctcagccacccgagtagctgggactacaggcaccagccaattttttttgtatttttagtagagacggggtttcaccgtgttagccaggatggtcgcgatctcctgatctcgtgatccacccgccttggcctcccaaagtgctgggattacaggcgtgagccaccatgcctggcctctttttctaatataagcatttagtgctacaattttccctgtacgtattgatttaactgcatcctacaagttttgatatgctatgttttctttttcaatcagttcaaaatacttttaaatatcccttttgatttttatttgacccatgaattaagggttttgtttaatcttcaaatattttatgattttccagatgcctttctgttacagatttctaatttaatttcattgtgttcataagacataatttgtctaacttgaattcttttacatttagtaagatttattttatgtccgagaatatgctctaagtaagtgtgtattttattattgggtggagtgttctatgaatgttaattaggtcaaattggctgatagtgttgttcaagccttctaaattcttactaattttctatctgtttattctcagttactgagagaatgttgaaatatctgactgtaattgtttatttgtctatttctctttggagttttatcagtttttttattcacatatattgaaattctgttatttaggtgcataacatgcaggattgttatgtccttttgatgaattaactcttttattcttaggaaatggccattttatcctggtaaaactctttgttctgaattccactttgtctgacttgcctgtaataacttctccagctttgttttgattggttttagcgtgtatacctaatatgtatatctaagatgtatcttttttaatccttttactttaacctgtttgtggctttttatttaaagtgggatttttggccggcatgtaggctcatgcctgtaatttcactttgggaggttgaagcaggtggactgcttgagcccaggagttcgagaccagcctgggcaatatggcaaaacacaatccctactaaaaatatatatattaaaaaattagccaagcatggtggcacatgcctgtagttccagctatgcaggaggctgaggtgggagaatcacctgggcccaggaagttgaggctgcagtgagccgtgattgcacgactgcactccagcctgggtgacaggagtgaggccctgtctcaacaaacaaacaaacaaataaaagtgggacttttgcagggggtaaatagttgagccttcagtttttaaagatccaatctgacaatctcttccttttaattggggatgtttataccatttatgtttaatttggtcctcaacatagtgatgtttatatattgttgctatttattttctatttgtgacatctgttctttgttccctccttcctttttttgccttctttggattgtttttaatgactccatttcatctccaatgttggattattgtctgtactttttttttctccttcagtggttgctttagatattacagtatgtaattttactttgtcacagactagctacaaataatattatattgcatcatatataccataagaactttataacagtatactgctatttcctttcaccaagcctttgtgttattgtcataaaatttacttctataattattataaactccacagtaaattgttattatttttccttaagcagttatcttctaaagagatttttaaaacaaggaaagtttatatttaaccacatatttaccattttgtgctttttattcctttgtgtaaatctagatttgcatctggtatcatttttcttctgctcgaaagacttcctttaacacttatgtagtacagatctactggtgataaattctttcagcttttgtttgtcagaaaaagtcttggtctttccttcatttttaagagatactttcactgggtatagaattataggctgatatttttttctttcagtactttataagacgttgctcctgtcttttttttattgaggagaaattgacaaaacataaaattaagcattttaaagtgaacaattcaatggcatttagtacattcacaatattgtgcaaccattgcctctgtatagctccaaaacattttcatcaccccaaaaggcaaccccatacccattaagcagtttcttcatagtcacctctccccacagcccctgccaactaccaatctgcctgttgcctctggatttacctattctgaatatttcatataagtggagtcagacaatatctgaccttttgtgtctggcttcttttactgagctccatgttttgggggttcatccacattgaagcatgtatcaatgcttcatttatttttatggctggaataatattccattgtatgtatataccacagtttgtttatccattcattattgatgggcatttaagctatttccatatttttggctattttgaatagtgctgttatgaagttccactatcttttatcttgcttatttctggtaagaaatctgctgtcattctttgttccttcatacataatgtagtttttttctacccctttttgctgcttttatgattttccttctatagttgtttttaagcaatttggttatgataggcctggtaattcatttctcttttggggacttcaattacatgtgttttaggatacttgaagtggacccacagatcacttatgctctctgctcatcattctcttgggtcttttttaattctgtgcttcatttcagatagtatttattgctctaagttcattaatcttttcatttatagtgtctaaacatattaattccattcagtggttttcatctcagacatgatatttttcatctgcacaagtttgatttgggtctttttatatcatgaacatctcaccttcttctgttttcctctatttcttgagcacatatagttaaaacaattttaaaaataattgtttgtatttccttgtctaccgtgtgtgtcatttctcagtcagttctgattgattttttctttcattataggttgtattttcctgcttctttgcatgcctgacaatgtttttaaattgaattccagacattgtgagttttgccttgttggatgctggatattctttcattttatttttgaaaatattcttgagctttgtagtagttatgctacttggaaacagtttgatccttctgaggcttgcctttaagctttgttaggtaaagccaaagtagcctttattctgagtgtgattttattctttatcctacataccaattccctgctactaaagcaacacccttctgcataccctaccctatactctacatattaggaggtttttctactattctcagccctgtgctagctctgtggatttttctgtctgtttctctcaggtggttctttccctagtctcaggtagttttctcacctgcatacattgatcaatattcagctgaaaattcaggacagggtcaggacagggttggagggggattctgcaaagcttcagagctctctctctctctctctctgtctgccatgcaaactctagctaccttggcctttgtgaatgtctatctcttgtcttctaaactctaggaaaccaccaggctctacctgggttcctgctccctgcactgcagcccctaaactctctaagtaataaccttggacaatcataaggcttgcctcatttgtttccattttttgttttcagggatcactctcctgcattgccaactgttcacgttggaaaactgttgttttatatattttgtcagtttgtttgatcatttaaggcaagagggtaaatccagttcctattactccaccttggttagaaatggaattctaagtccttcgtttttaaccttttattctttgtccttgcatggagtcctatgaatgcaggcgaggctcctctctgggcttcaggtatgtatgtttactcccagaactcagagactgctcatggatcatgaagcccaatcctctgtctgtacaaataggaaggctcaggctaggagagccaggggctttcctagggtcacaaagttttctttgtgactcctgggctgaggctccctctacataatagttcatgtgctgcataatttgctgcataaaacagtctaatccttttttaatttttaatttttatgggtagatagtaggtatatatatttgtggggtacataagagattttgacacaggcattcaatgtgtaataatcacatcacgtaaaatgggatatccctcccctcaaacatttatcctttgtgttacgaacaatctaattatatactcatttatttatctttaaatgtataattaaattactattgactgtagtcaccctgttgtgctatcaaacactaagtcttactcattctttttaatttttctttttactcattaatcattcccatctcttcctcaacccctccactacccttcccctgtgtccgtgagttcaattgtcttggtttttagatcccacacttgagtgagaacatgttaggtttgtctttctgtgcctgcttatttcatttaacataatgacctccattttcacccatgtttttgtaaatgacagaatctcatattattgtggctgaatagtactccattgtgtataagtaccacattttctttatccattcatctgctgatggacatttacattgcttccaaatcttagctatcgtgaacagtgctgcaacaaacatgggagtgcagatatcacttcgatatacggatttcctttcttttgggtgtatacccagattgctggatcatatggtagctctatttttagtgttttgaggaacctccaaactgttctccatagtggagaactaatttacattcccaccaaaagtgtgagggttcccttttctccacatcctcaccagcatttgttatttcctgtcttttggataaaagccattttaagtggagcgagatgatttctcattatagttttgatttgcatttctctgatgatccatgtaagaacattttcatatgcctgtttgccatttggatgtcttattttttattttattttataacttttaagttcaggggtacatgtgcaggtttcttatatagataaactcatatcgcaggagtttgttgtacagattattttgtcacccaggtattaagcctagtactcattagttattttttgatattctctttcctcccacctgacaccctccagtacaccccagtatctgttgttcccctctacctgtccatgtgctctcatcatttagctcccacttatcagtgagaacatgcagtatttggttttctgtttttgcattagtttgctaaggataatggcctccatctccatccatgtttctgcagaggacatgatctcattcttttttatggctgcatagtattccatggtgtgtatatactacattttctttatccagtctaccattgatggacatttaggttgattccatgtctttgctattgtgagtagtgctaccatgaatatatgtgtgcaggtgtgtttatgatagaataatttatattcctctgggtatatacccagtaatgggattgctgggtcaaatggtagttgtgtttttaggtctttgaggaatcatcacactgttttccacaatggttgaactaatttatactctcaccaacaatgtgtaagtgttcctttttctctacaaccttgctagcacctgttattttttggctttttagtaatagccattctgactggtgtgagatggtatctcattgctgttttgatttgcatttttctaatgatcagtgatgttgagcttttttcatatgcttattggctgaatgtatgtcttctcttgagaagtgtctgttcatgtcctttgcccagtttttaatggggtagtttgtttgttgttgttttcttataaatttgtttaagttccttatagatactggatgtaagatctttgtcagatgtatagtttgcaaaaatttttcccattctgtaggttatctgtttactctgttgatagtttcttttgctgtgtagaagctctttagtttaattagatcccatttgtcaatttttgcttttgttgcaatttcttttggtatcattgccatgaaatctttgccgtttctgtgtccagaatggtattgcctaggttatcttccatgatttttatagttttggctcttacatttaagtctttaatctatcttaagttaatatttgtatatggcgtaaggaaggggtcccatttcaatcttctgcatatggctagccatttatcccagtagcatctattgaatagagagtactttacctattgcttgtttttggtgactttgtagaagatcagacagctgtaggtgtctggccttatttctgggctctgtattctgttccattggtctatgtgcctgttcttgtaccagtactatgctgttttagttactgtagccgtgaagtatagtttgaagttgagtagcatgatgcctccagctttgttctttttgcttaggattgccttggctattcgggctcatttttggttccatatgaattttaaaatagtttttttttctagttctgtgaagaatgtcattggtagtttgataggaagagcattgaatctatcaattgctttgggcagtatggccattttaacaatattgattctccctatcaatgagcatggacagtttttccatttgtttgtgtcatctgtgatttatttgagcagtgttttgtagttctccttgtaaagatctttcacctccctggttagctgtattcctaggtattggattcttttcgtggcaattgtgaataagattgccttcctgatttggctctcggcttagctattgttggtatataggaatactagtgatttctatacattgattttgtatcttgagactttgctgaagttgtttatcagctgaaggagcttttgggttggaactatggggttttctagatataggatcatgttgtctgcaaacagggatagtttgacttcctctctccctatttggaggtcctttatttctttctcttgcctgattgctctggccaggacttccaatactatgttgaataggagtggtgagagcgggcatccttgtcttgtgccagttttcaagtggaatgcttccaggttttgtccattcagtgttgttggctgtgggtttgtcatagacggctcttattattttgaggtatgttcctttaacacgtagtttattgagagttttaaatatgaagcggtgttgagttttaccaaaagccttttctgcacctattgagataattcttggtttttgtctttagttctgtttatgtgatgaatcatatttactgatttgtatatgttgaaccaacattgcctcccagagataaagcctacttgatcgtggtgaataagctttttgatatgccactggatccagtttgccaatattttattgaggatttttgcatcactgttcatgtcttcttttgagaaatgtctatttcaaattttttgtgcatttttaaatcagattattagatttttttcctatagagttgtttgaggtccttatatattctaattattaatccctcatcagatgtatggtttgcaaatattttctcccattctatgggttgtctcttcactttgtcgattgtttcctttgctgtgcagaagctttttaacttgatgtgatcccatttgtccattttgctttggttgcctgtgcttttggggtattattcaagaaatttttgcccaaaccaatgtcctggagagtttccccagtgctttcttgtagtggttttatagtttgaggtcttagatttaagtctttaatccattttgatttgattctcatatatggtgagagataggggtctagttttattcttctgcatacagatatccagtttccccagcaccacttattgaaaagactgtcttttccccaatgtatgttcttggcacttttgtcgaaaatgagttcactgaaggtgtatgaatttgtttctgggttctctattctgttccattagtctatatgtctgtttctttgtttgtttgtttttgtttttcagacagagtctcactctgtcgcccaggctggagtgcagtggcacgatcttggctcactgctacctctgtctcccaggttcaagtgattctcctgcctcagcttgccaagtagctggggttacaggtgtacaccatcacacctggctaatttttgtgttttcagaagagacagggtttcaccatgttggccaggctggtctcaaactcctgacctcaggtgatctgcccaccttggcctcctaaagtgctgggattacaggcatgagccactgcacccagcctatatgcctatttttacgccagtaccatgctgctttggttactataactctgtagtataatttgaagtcaggtaatgtaattcttctagttttgtcctttttgctcagaatagctttggctattctgggtcttttataattccatgtatattttagggttgttttttctatttctgtgaagaatgtcattaatattttgatagggattacattgaatctgtaggtttctttgggtaatatgtacattttaacaacattgattcttctaatccatgagcatgggctatctttccatttgtgtcttgttcaatttctttcagcagtgttttatcattttcatcataaagctctttcacttctttggttaagttaattcttagataatttaattttacttgtggctattgtaaatgggattactttttaaatttatttttcagattgttcactgttggcatatagaaatgctactgatttttctatgttgattttgtaatctgcaactttactgaattttaaaatcagttctagtagttttttggtggaatctttagtttttttccaaatataagattatatcgtctgcaaacaggataatttaacttcttccattccaatttcaatgcccttcatttctttctcttgtctgattgctctaggtaggacttctaatactatgttggataacagtggtgaaagtgggcatccttgtcatgttccatatcttagaggaaaggcttttcattttcccccattcaatatgatactagctgtggttctgtcatatatggcttctattactttgaggtatgttccttttatactcatttttttttaggatttttattgtgaagggatgttgaattttattgaatgcattttcagcatcatttgaaatgatcatatggtttttttgtcctttattctgttgatatgatgtatcactttgatttgcgtatgttgaatcccacttggtcacaattaatgatctttttgatgtattgttgaattcatcttgctagtatttttttgaggatttttgcatcaatatttttcagaaataacaacttgcagtctttttttgatatgtcctggtctggtttttgtatcagagtaacactggcctcatagaatgagtttggaagtattccctccttctctaatagtgtgagtaggattggtattaactcttcttcaaatgtttggtagaagtcagcagtgaagccatcggatcccaggcttttccttactgggagactttttattacagcttcttctcattacttgttattagtgttttcagattttttatttctttgtggttcaatcttgaggttgtatgtgtctaggaatttatccatttcctctagattttctcttctactggcatatagcttctcatagtagctgctaatgatcctttgaatttctgcagtatcagttgtgatgcctcttttttcatctctgattttattagagtcttctttcttttttcttagttaggctaaaggtttgtcaattttgtttatcttttcaaacaaacttttagtttcattgatcttttgtatttttttatttcaaatttatttctgttctgatctttattatttcttttcttctactaattttggattcgatttgctcttgcttttttagttctttaagatacattgttaggttacatatttgaagtttttcttcttttttgatataggcactgatagctataaatttcccccttagtgctgcttttgctgtatcctgtaggttttggtatgttgtgtttccattatcatttgtttcaagaaaagtttcagtttttttcataatttttttattgacccacttgacattcaggagcatataaaacagtctaatcttgaagggaggaggttaattcattataaatactttaaaatcttaatctttttatattccatttttttcagtgtaaaactattgtaataacccatggtacatccaaatttaaccttgttaatacgtagaagaggttgtagccttgaatttaaagtgtttgtgagaattagagtgtgttgcatatttaacaaatattgattgagcccctatttatgttaggctcaaaggcaggtgttggggattcaaaggtaaatcaggcatagtatctgcccttaagaaactcagttcactggatatcttgatgtggaaacagatacttaatggccagcacagagatgaggaaagcccagagcaggggtatgtagccccaaggctgggaatttagggagactctcccagaagaaatgatctgaacagaatcaggaaagactcccagaagaagtgatctgaacagaatcaggaaagaagagagtgattggaagggctcaggatttgtgtttatttgggcattaagatgcagcttgcctcctgttgttgcatttcttgtttcattgtatttttccaataaagatattttcagaaacctcacatgccactttcgacggtgatttggctgcatgtgcctgaaacagagcctggcacatagcagatgcctaataaatgtttgtcagatgatgggtggatggatggatggatgaatggatggacggacagatggatggatggatggatgaatgaatggatggacaagctgtgctcacactgaattccctcccaaggtgactgtggacttgcagcctgtgtggccaccggtgagcaggtatggattcagaattgaggacacaggccacatgtacatgatcctgactccctcagacatccagatccagtggctccacagctcaggactcatgatcgtggaggccagcaaaaccagcaaggcccagggccatggcctgtgcggtgaggtggaacccagcttgcggggaggggatgcttcccaggtccacctctgcccccacacataattcctcctggagcaggaaaggctgggacagaataccaggccagaggttggagcagcagagctgtcagggcagggaggcctaacgtcttgtgtcctggggccaaagctgccagtagggagatagtagagggctctggactcagccagttgtcacttcagccgggattgtctgtcagcttccctgacagccttctaatgtcggataatcctttccatctgcatgagcctgggcatttcacaaagtacttccacagtctatctcacttattcctggtcatccacacaacagcactgagagatggccattagtatccccactgaactaaagaagaaagggggctcagagagattaaggggcttacccaagggcacacagcagagctgccacaatacacagaactaatgctcttcagaccatagcacaattgcagagcatgccctaaaagattgaatgtattctcataaggaaaagagatatgggacaagcctggatgtgggccgctgctcattgccggggcataagcacatggacactcatggggcactccgtgacagactaccatgattgtgacgatgggtgagataaaaacacttacacacacacacacacatacacacacacaccctccatcctccacctgcaccccggtgatcattcacacattcccattcatgcccctctgcatccaaattccctctacacatgcactaacacatgcagttcagctccatgctcattttttcctttgtgcaacacatattgccatgtaccagtcgctggggacaaaacagtgaacaaaacagacaaaatccctgttttatggtgcttccattcttaaacacttcttacacacatgccaccatccccaccaccaccaacaccatcaccatcaccatcactaccaccatctttttctcatcatttcttccttctcctctgttcattgccagcaaagagcactgtggtcagcagtagcctggtgagccaacccctccctaggatacctttgggacacccctcactgacttaaagccaagacccaaagtgtgaccatgggaaccattaataatatattaataagagtttgcctttaatcatgctttatattcacagaatcatggttagaggtgttagaacagaagtcagatcatttatatctccattttatttgaatgaacatttgacagctgggcaccctgctagacaaacttaggggagtgctgagataattgagaatctaaaagaaaatgagtctttgcactcagagagctacaatcttttgtgaaaggctgacctgcaagccaatgactgttacacagactttggaatgtcatggatagtgcatctgaggcgtccttgaaggaaggacatctgagaaagtatttcaggcagaggaagcagcttgagcaaagttgtgggcaggaaagtgtgtgtctggagcatatagatggtatgtgggagatgaaaccagaagtttaggtcacattaaaagctaggacagataaacttcacccttgcccccatctcagtgccttaacacaacagaagcttatttcctgcatacataagttcccaaatggatagcaatgattcagagacccagagtccttccatcttctggttctgccatgtcaacatgagtttccaaattcacaggagaggagacaggtgggaagtttttatgaactaggcctggaggtggtactcgtcaccttcactcatatgccattggctgggactcaatcggatgatctcacccagctgcaagggcatctgggaaaaatacactgactgcccaggaaaaagaaggaacagttgttataatcagctagcaatcactggtaaagcagacttttggggggtagctttttattttggtgtaatatagcaaagcttataaaaatttagaacttgcaaagacagtataaagtagtgtacaccttttacccagatttgccccatttgcttctctccttctctctctctctctctctctctgtgtgtgtgtgggggggggtatacatttttatatgcacatgcaatacatatatatatatatgcatttttcggaaccattagaaaataacttcaagacattgtatccttttacccctaaatacatgtgtatttcctaagtacaaagacattttcttttgtagcaggtttcctagcttcccttcacctaatttccctcacctataaaatggggataatggtattattgacctcaaagaactgtgaggaatacaaaaagtgagagctgacgacatgggagtggtagtgatgatcgtggctgttgggattgtttggcccctttcaggtatctgtgatggagatgcagccaatgaccttaccctgaaggatggctcagtggtgggtggggctgaggaccctgctccctttctggacagctggcaggtgcccagctccctgacctcagtgggccagacccgcttccgcccagacagctgcgccacaactgactgctcgccctgccttcgcatggtgtccaaccgcaccttcagtgcctgccaccgctttgtatgtgccaactgggtccagcactggggacacctcctgggctggctggggatggcagcacctacctgcagaggctcattgttccttttgggcagggaggggaggagctgggcactgggatatgtgccatccgagtaaccagcactgcctgatgcatatgtccaggtgcctccggagtcattctgtgagctgtggatccgggacaccaagtacgtgcagcagccctgcgtggccctgactgtgtacgtggccatgtgccacaaatttcatgtgtgcatcgagtggcggcgctctgactactgccgtgagtttgcggggcagggggaccctccattgtgactattgttcccatcccctgttaaagtgggaaaaggctcccggccccaagttcatgtatgctttcccagctttaatcattcatggatttatgtacattagtaaatttataaatatttcatatgtttaatttatatttaatttttatattatataaaagtacattttatactaatgaacacatttattatgattcatatgaacatattaacacatagtaattgtattgttattttagtatttgctttctttgcgtctcttctctgtaagtggagactgtaaccatcgcccccgcccagggtggttttgaggatgtgggggaatgtgttccgagtgctcacatagacctgccccacggacaccgtccagcacaccttaattccctctgcttcctttttgctcacgtttctcttcttccagagtttcccttccttcctgcaggaaggaaatgagatctgcctcctcctcccccaattaggtttgactggtagggtcgacaggggtggcctgggctagggtagcttgatttataaatgtgaacctgtccagaaaggctgggattggctcacaggaagtccacacccacaatatgacaagtaaaagaggaaaagacaaaagtcctcttgggtcgtgttcttcaaactgtggatcccaactcagcgggtatgaaatcaatttagggggtcagcaccagcattttaaaaaatacaatagaatagaaaataccagtgtgtattgctcatagaaagtttaggtatgattttgtaaaagagattttttattttatatagaagcgattttcaatcctaaataccctttgaaatcactcagacaacttgaaaatgcatgggccccacaatcagagattcaattggcctggggtgggttccccacaatgatacctcaaaaactcccaaaggattcttttgtagtcgagtttgaggaccactgttctacatgcttgtattaggccacaatgtaaaatctactttttacaatcaagaaagtttgaaaacactgatctagagcaaggggttggcaaaccttttcggtaaagagccagaaagtaagtatttgatgacttgtgtgccatatggtctcagtcataagtcctcaactctaccttttttggtacaaaaacagcctgagacagaatataaatgaacaggcatggctgtgttccaataaaactttatttgtgaaaacagacagtgggctgggtttgggctgtgggctgtactttgctgagtcctgatctaaggaaggaggtgatgtcaccaagccctttaacttatgcactctctgctgaggtgctgatgacactctgagccctctcctcatcccctcctgttctttcggccctcagtggggagccctgcctggggtctgaggtaggcctggtgcccactgtgcccctgcagccttcctgtgctccagcgactccacataccaggcatgtgtgacagcctgtgagccacccaagacatgccaggatgggatactagggcctctggacccagagcactgccaggtgctgggcgagggctgcgtctgctccgagggcaccatcttacaccggcgccactctgcactctgcatcccggaggccaagtgcggtaggttcctcccctccctgagtggggggcctccaaagccagcctcagcctcgcctcctgctgtccacagctgagtcccatctgcatcctttcaggtctgcttaggggtggccagtaaaccagggagagtctagcctgggaaggtctgggctcaccttcctcagtccctcgcaccctgccattcccctctgcagcctgcactgacagcatgggggtgccgagggccctgggggagacctggaacagctccctcagcggctgctgccagcaccagtgccaagccccagacaccattgtcccggtggatctgggctgccccagtccccgccctgagagctgcctgcgattcggggaggtggccttgctcctacccaccaaggacccctgctgcctggggactgtctgtggtgagtgtccaccttcacttccttggacgtcaactgtaaaacagttaaaaggttccagccctgcacaccaaccctgatggataggacaaggcctaggaaaagcaaagtgtcttgtagggggtgagcttggaggaggggagaaccctccctgggggcaggggcagaggctcaggagtcagtgcagggagtgctgtggagccaggcagcctggccactcttcctcccccacctgtagccttgtggcctcgggcaaattatttcacatcctctgtgccttggttcattctcctgggacatgagctgaagatcgatcgggcccatctttggggttgctgtgagatggggtgcgtgtcaatggatgttagctcttgctgatcttctgtcccagccctgaaccctcgtgtgaccctcaatgacctcatctaggagtatgggtcctgggggctggggggaggagtggggccaggcgtccaggggttgggcagttgtccagtgttctccactggagagcagtggggacatccggccccgaggtgacaggccctgtggtccccggggccagtgtgtaaccagactctgtgtgagggtctcgcccccacatgccgcccaggccaccgcctcctcacccacttccaggaggactcctgctgccccagctacagctgtggtgagaggcccggggtggggagggtgggggacggactgagggcagtggggggaggacagctctgggggcaggggcccaggggtggccaggcaggttcctctcccagcacctaaattcagccttttccccagagtgtgacccagatctctgtgaggcagagctggtccccagctgccgacaggaccagatcctgatcacgggccgcctgggggactcctgctgcacctcctacttctgcggtgggtcgccgccaccagacgccagcgcacacagcctgatcacagtccgccggcctcacccctgtgtccttgggcagctgggaggaaaggctgggggtcttcagatggggtgggcaaagggagaaggacaagctcactgtccaggaaacagtgtgggaggaagaggacaccgaccccgtgttccccctagattactaagcacgaggaaactggtgcttgttctgtgtaagcctttgggtggacatgagggagaacttccagattctgattccagaacggatcacgtgagaccatgcgatgctgccattagttagctcctgccacacctgggttgttgaggaggccccacccccagcaacgtgctgtgtgccaggcccctatgagaggactgctgtgacagcattgaccctcttccccctcagcctgtggtgactgtccagactccatccccgaatgtcaagaaggggaggcgctcactgtgcacaggaataccacggaactctgctgccctctgtaccagtgtggtgagtcctggctgggcacatggcgggctgcggcaggaaggggcccttcacagagttcccaccccggaccaatgggggttgacagggagcaacagagcgcccccaggtggtgagctctggaggggccgagcagctgaatccaggacgagtgcaggcccacctgaagaagctgggtcaggctgtcaggctggagggtgggaggtccaggcctgtcccctccatggaggcccccaagggccagacagaggctagggttgaaggacaaatacttgggtccctccatcccccacagcactgataagaagtcctcattccctgactgacccaaggctccccttcagggtccctttcgccactgtgtcgccatagtgcccgctcctggaggctgtatcacagaaggccctgtgttgcaaaacctctgaagctcttttattttgtaattataaataaaagtatgctttttccaatatttttatagggcctggtacctgtatgtatgatactgtatatacatgtagacatgtatagtatgtgcatatcatgtactgtgttcatagtaccttgatatagaatgcactatgtacatagtacctcaatagtaactgttaagcatagtgcagccagcattacggattgtaagcaaacctaatggatgaaaatgaacaaaatggttctatttaaatattattcaatttacaaaaattgctttgcacactgataataggagaagcatgaggttttttcttacacagaacagagtaggagaggggcttccaccaggacacccaagggcttctctgattggttcaatgtgaagagccacctccgaaacaatgtaggctcccatcccatgagagttgcccagatgacctggccgcacctgaccaggagcttgttggcccacttgccacagtatttgcaagactgatgtgaggacagattcactatcctttctccttctcttctgtctttctctttctatcattacccctccccctcagccctcctcctgtattcacgtttctttccatgtttctcggggggcagcctagtcctatggatggagtatgggcatagtcagttggtttctgagcctcagttgggctgtctaccagctgtgcagcccagggcaagttccttactctctgagccaaggttgctcatttgtaaaatagcgatgctagtatctgccttgaggggctgttgtggaaattagagataatttttgtgaaggaccaaatggtccttggtatgcagtaggtgctccaaaacagaggctgttgatattatcactttctcccagtcttcgtcatacttttgctattacaaaagcactgtatatgcattgtagaaagtacgaattccaagtaaatgcaagaaaatgaaaataccaccttcctacctgctagataattccactgccaatgctttagtggatacatatccttccagattctctctatggctttatatagatgtgtgtggtttaccaaaatcagctcatcctggacatactctttttttttaaactggctgttttcattgaacaatcactacctttccatgttaatacattttcaactcatctcatgcccagtctgtttcttcctgtttgtccaatccaggatccagtcctggaccatgcattataatgacatgcctcacatctctcatcctagcacaggtcccttttcctgtatgacctcccactgtagagtccatgccatgaccctgcagagagttcccgcttctggacttcaccagttgctttcttttggagctgcttaccttgttccctgggcctctgtgcttcctaaaactgaaatttccatctaaggattgatgggttcaagttaaaaatttggggctagacagtgcgtgcatgagcttcatagcacatcacttcgggtgccacacactatctggctgagtcacaagaattgatgttaacgttggcccagattagggtgatgaccgtaatcctaagatctctccatcttacatttttcctcttccaaccagaaaataacctattactttgacaccataaaaatgccctccctcataattttttggaacaccatttgataatccttgcttgtgccaataactttattagtaaatcaagtaactcttacagttttcagatcctcacctttagtgctgaccctcgcccctcccctatccaccaaaacgttgcacccagggagttccctcaccccttgccttgttctcccagcaaatgagaatggctgaggaatcctgaactgagaaaagtcagcctaaagactaggaagaaaggaagtgcgggccctgcagggtagcatcagctgaagcagggcatgctcaggtgggccccaagtggatgaagtttccacagggtgggaaaggttgtgttagacagagcgggatgttccccatcagcagaccttaccctaatggctggctctccctggaccacctcttgcagggtgactgcagattgaggaggcccaatttaatgagcttgaggttctgaccctgtcatgtcaccagtgcctcacagacacagcaccaggacctgaagtagctccctggggagacttcgggtgcccagactcttccctggggctctgaggacagtgggggtcactaaggaggagctgggggtagcctctctttagccagtgttgcccttctgaggattcacatccccaggtgcctgtgactgacgtgtcaactgcctctccttccccacagtgtgtgagaacttccgctgtccccaagtgcagtgtggcctgggcactgccctggtggaggtgtggagccccgaccgctgctgcccctacaaatcctgtggtgagtccgtggtcaggacagcctccccgctgggagatccagtggccctgctgaggagggattgagggagcccggcctaccaccgtccactcctctcagatctgtcccctgcagggtctctagaggaagccaccagaatcaccttccttctgcatccgcactccaagtgctgagcattcctacagccttttctctctaggataaaagaaggaaaaagcaagtttcccattccaaagagggtttccgtcttaaaaagtccttactgcggccgggcacggtggctcacacctgtaatcccagcactttgagaggccaaggcgggtggatcatgaggtcaggagttcaagaccagcctggccaagacggtgaaaccctgtgtctactgaaaatacaagaaaatcagccgggcacggtgataggtgcctttaagagggtggacgttgcagtgagtcaagatagcgccactgcactccagcctgggcgacagagtgagactccatctcaaagaaaaataaaataaaataaataaaaagaataggctctggaccaggtgaagggattaatccaggtgacaaaaggaaacctgtgattggcccatctgcctatttatccttgctccatacccagtggagagcttggtgttcagaacccatcactgcccacctacctaatcagcagagctgcaggccttctcctgcccccagggatggaaggaggctgagatttgggcctcttcctctcctctcccaggcctggcctggagctgggtcttcagaagacgggttgtgccagcagtgagaggtccagggtacccaggggattcctacctggacatccctgatgaagtggggcctggccccttgtgtttttcagaatgtgactgtgacacaatcccggtgccccggtgccatctggtatggagacgctcctcccccaacactccctggtctgctcccctttcctttcctctctatcccctcctctagagaatctgctcctttaatctagtgcaaggaacccggggttgcaagtcagcattcttttcccaagctctgccactggctttctgggtatggtgccctcctttgtaaagtggacataatcatgctttagagttgtggtaaggattaagtacaatgaagatgaaaattatcatgaagatgataatgatgatgctgatggtagtgatgatggtggggacagtgaggaggatggtggtggtgacgatggtgatagtgcagtgattatggtaataatgcaatgatggtggtggtggggatggtgaggatgatggtggtggtgatggtgataatgcaatggtgatggtggtggtgatggtgaggatgatggtggtggtgatggtgaggatggtggtggtggtgatggtgataatgcaatgatggtggtggtggggacagtgagggtgatggtgataatgcagtgacgatggtgatggtggtgataatgcaatgacaatggtggtagtggggaaggtgaggatgatggtggtggtgaagatgataatggcaatgatgatgatgatgttgatgacaatcatgacggtagctaatgtttactgagagcttactaaatgccaggaactttcctggggctttcatgtgtattatttattctcacaacaaccctgtgaggttgtttctgttgttttctcaatcctgcaaacaaggaagctaaggttaaggtcatgaagctagtatatcatggagccagggctgacaccaaggaaatctgtctccagagatcatgctcttagccaccaggctgcatggccactgagggaagtgaaaatactttaagaaatgtgaagtcgtgtttacagtccttttctgaattatatgtaaccctccccaccccagcacacatttcctctcactctgtcccccatttcctccctccttaacattgctgaaggaaggtgagaagtagtgtgagccacccggggctctgtccctcgctgtgaaaggagaggacactggacagtgctcctcattggggaggcctggtagccacactgggactgagcttccaggctgctgaggggccccaggcctgccagcccccctcctgcccaccacagggagggactgacgtagagaggggcccaggtggcagactgctcctgagggccaggctggcccccaacccagggtgctgactgcctctgccccacccagtgggagaaatcccagctggatgaggagttcatgcacagcgtggagaatgtgtgtggctgcgccaagtacgagtgtggtgagtgggggaagcctcggggcagagccatgcaggaggggcatgggtgcctgggctctggatgactgttgccgccctgcatgcccatccagtgaaggccccggtgtgtctgagccgcgagctgggtgtgatgcagcccggccagacagtggtggagctctcagcagatggcgtgtgccacacctcccgctgcaccaccgtgctcgaccctctcaccaacttctaccagatcaacaccacctccgtgctctgtgacatccactgtgaggcggtagggtgcagcccagggcggggtgggtggggttgggagggcttgcctggcagaccttgggtgctccaggagccagaggggcccttgaagctgccctaaacccccaggacaagtcagaggggccctcagaaacctctgtagaaagtgccaagaaagggactaggttgggagaggccagaaggggaacagaagggacggatttagtgcctggaaagagtgggtgttgacagacacagcacacatttattaggtgcctatggaatgcctggcacattccctgtccctttggtttgcgtgcttgtgttgctactatttggtgagcacttcttcatgcctagtacttaggatggtgactggcttctagtaagggctaaataaatattacttggataaagaaggttagaattattcccatttttcagaggagaaaactgaggcttagggagactctgtcatttgtcaaaagtcctacaggaactaagactcaaatggaggtctgtctggaataaaaactggcatccttacttagcagaaatggcttggaaagggtggagatgctctttgctgtaagggaggctcagggtagatacagggatgattagctgcctgtgacagaaggaggctgggagcgcctcttctcgagcacttacagagggtccttccaggctctgggatccctcacagataaccaggcagtgggagagccagggtggaggtgggcatctggctgaggcccaccccgccctggcctgtagaaccaggagtacgagcacccgcgggacctcgctgcctgctgcggctcctgcaggaacgtgtcctgtctcttcaccttccccaatggcaccacctccctgttcttggtaagcagccccctcgctgcccacttaggagggtgtcccagaaggggacaccaggactagggccctctctggcttgcaggccagggctgggtacaaacaggctcccagaccctatgggtttgcgcaggctgtccatctggccacagctcccattacctacttctgtgccctccagcccggggcatcctggatcgcagactgcgcccgccaccactgcagcagcacgcccctgggtgccgtgctggtccgctctcccataagctgcccaccgctcaatgagactgagtgtgccaaggtcagtgcctccttctccactgaggctgtaggccaggggcatcagctgtctcactggtggtggggtggaggtcctgtgtgcaggagtgcaggaagaagggctccctggagcctgtgcctgcactgccaccccaaatccatatgtctctctgcatttctttttgccctgaccacatcacaccctgcctcttcacacatcacatgaccacatgcagatgtgcacaaacacacactgttacatgttctaggcacattcagccagacaccaacacaggtcaccagtcactcacacaccacacactccagggacattcacatcagcatgccaatgcacacaccacgcgtcatcacacctcaaggcactcacataagcacactcttgcacacacatgccacgcagatgcagttcagtcctgtgatggctggcaggtgtccagcactagcatggacaactgtcagtatgggcgcacctcagagaaaaggatttcctggaaggcttggggttattgttgaattattaaagtccctgagattaatagtggacatttgaagatttccgactcttccctagaaaacaaatatacacagacactcaatgacactcatacacacacccacacatgcaaaatcacacatgtacacacagatgctcatgtatgtgctcacaaaatcacacacacatactgagacctgccccccaacacacacacttatgtacaaagaactgtcccatccattgttttacccatttcattatagaggaggagggttttaacggatacttgcccccattttagagatgggaaaattaagcctagaggaagaggatgatttgtccagggctgaggtagagcccaggccactgaccaaagtgggtgacccctgcgcccctcccctcccttatcctctgtgctgggaagcactggcagtggggtaggcaatggaagacatgaggggaactgccccaggaaagatgggaggccctgtaccatcttgacccaggctcctgccgcaagggggctacgtgcagccttagtggcagcttagcccccgtggctctcctatggcctggcaaggggcctatgctcctgccctggggcatcacggggagagaagagtcaagactcctgtactctgcctgtttctgggatcttggctcccggcctggacaggggtctccacacctacctacctcccccgacttcctctctctaggttgggggttccgtggtaccttccttggaaggatgctgcaggacctgtgagtgagcatggtgggggcccaggggtggggggctctgatgggggcacagggtgtcatgtcaggggacagaggaccaggttcctggcctggcacctaaaatgatagctcttctgggctgagtagatgaagggataacacccacaccacagggctcacggcactgacgcaaatatgcagatggctggaggccatgtttatgtccttgttcccatacaaaacctctgcttcttgtcacagccagaggacattggggcatagcattcaggaggtcagtagctcaccagttacttcgcctcctcctgcccctgccaaggcccccagcccagatgctcccacataaattctcccgtagtcagacgccctggtcttggaggagcctcctgggtgggattcaggcctccagggtccctgacagtccccgttagtcccgcctctcctccacgggttagtgtccactgtcgcccaggtactcctctcggaagcccactgcactggaggcaggcagccgcattgctatgtccagcaatgtcccttctgctagatggcctgatctctgggggcaagggagggggagggcccctgctccccacgtctggcacaggctattgggcctgcagtgcatgctgggtagtgagctgtatcccctgggcttgcatgggaaagcttcagcagggcccgctcacctggcacccaccaatgcctcggactgccactgctttgctcttgctggtcactcagccagtcttagtccagggcccagagggccatgtcaggacagcccttagttctcctgcctcctggagcagagagggaagacaaagtggacttagctatggccagaagccatctagctggtgcagtaggaaacctctgtggtgaggctcagagaccagaagaaaagattccattccatttctaaagggattcctggggttacagagtgagtgcacgtacctggcaaatatttgtggagcgccaactatgtgccagacactgttctaggcactgtagagccttgtggagctgatatttagtgggagagacagaataacaagtataaaaatatataccaggatggaagcattgagttttgtggggcctgacttatgcaatgtggggggcttcaacaagaagaagaatacaaaatgtacaaattcacattaaagtgtgaaaggaaatatttatttaaaatgcacaaagaacttacaacaaattctggaaggggcctgtgcaaaagaaggccataaagcttatgattcacatcgtaattaccgatgtgtctctgacaagacagtgattgtcccctcgacaaatataagcaagggaggggtcagggagggaggactgagtagaggcagtgagttgcaactttaagaaggggaatcaggtaatgcctgggagaggagatattgcagccaattgctaaaggaggtgagggcgtgaatgagccacaagactggttgtctgtgagaggcatggtccaggcagaggaaacccacactggttagtttccatccctgtaacagctctgtgagatgggtgaatccctggtccagtttgatagctatggaaaccaaacaaagcatcccattagaatgaagcgtcccactagagattggagtttctattcatttaggaaattgcataatcttaatgctagaagccctctcaggatgggaaaactgaagctcagagaggggtaagggtaaagtggccaacacagcttagaaataggcattagggctggggtggggaggcagcctcactctgtccccagatgcttctctgccctagcacagagtcctcaagggggccctgctggccttcctgcctcacttgctcacactgctctgtttctgccttcctgactccgcctccttccagggcattgggttaaaaggctttccctggatggggaggggcactaatgcatgggtgctaatgctggaagagagaccctccagcatgacactaactgccctgggctggcccatcctgctgccccgaagaagcctggtcttggccacagctgcctcatccccctgtccccccaggtaaggaggatgggcgctcctgcaagaaggtgaccatccgcatgaccatccgcaagaatgaatgcaggagcagcacccctgtgcgtggtgcccacaaggcagtggggcagcaaaaaatgggatggagggggtttgggggtgtgagcaccacagactgcctcactggcctgcccgttccaggtgaacctagtgtcctgcgatgggaggtgcccatccgccagcatctacaactacaacatcaacacctatgcccgattctgcaagtgctgccgtgaggtgggcctgcagcggcgctctgtgcagctcttctgtgccaccaatgccacctgggtgccctatacagtgcaggagcccaccgactgtgcctgccagtggtcctgaggcctgggggcccgggctagctggaccacctctgccagccccactttctgtttccagctggcccaatgtgaatgggggtattaaaggtggtagaaatctggcacgtgttgagcatggaatggtgggaagaggtcacaggagtaaccagaaagggtcacccctgcccatcctggctccctttctgggctccccattttccgcacatgggaaagtgccacagttgagggctcagggagctcacctctgtccctggtttgagatggaaaatgggctttaggtccaggggcagcagcctctgaacctctgtgaccctggccacagctcttggtggagggggtgagagctgtgggaagatgggaaggtgcatggtgcttacatgggaaccacagctggacccaagaccaagcacaggggcaggatgcagtggcccattctcttggcctttttgactacacaagaaaccagacacagtaaaaggaaagagggctatacctgcaacactcaggcctgcagatggctgcccagaaggagttcccaaagacaaagatggtggattctagggcccaggttgtctcaccaagatctgtgaaatcagagtgagctcagtgaccttcgcatctcctgtagtccaaagaaaggtgcctggtgtcctggtattgatatggtaattcaggaaaggatttggaagacctaagcctgtacccttaccccaaggcaaccttcccagcaggcaggccggccttgtgaggcggtgctgggggagtgaaaccctcagtgagggcccagcactacttatctaggatgctggttgacagcccatgccttcaaggccctaggttgctgagggggtaccttcagcctgcaaatgcagctccaggctttgcagtgtgccttttctccaaggccatgacagagtcgggctcagaggagcctgattatgggttgtgtggctcagccagtgccagtctctgtgctccatgggactgtttagcaagagagtgtctgttggtgtcagtggaaaacacagccccagcctccctgagcacttgtgagatccttgtcactgaaccagagcgtcccctaaagccagggccagcgtccccttccacaccccactctgcaagtctcccaccccctgtgccactttgtgccacgtggaaccgaagggcatgaacataaggttgtgcaggccccagcactgccctgtgtgtctgaagatgtggctggatgccccttgaggtgaggaggctgtgccaagatggaccctgctgtttccaagcctctttgtgcccatgtttgtgttctgtttattcatcaataaaccacaggatgacttcaggcctctgagcatctctgagggagccaggtttacttcgaacttgaaggagtgtccactgtgaagagaagactctattttgtggccctgaacatcagcactgcttctgccccatccgtcccagcactatgccccactcacagcagaaccattggtgggtgtctgctggttggaattgaatggactggagactggcttctagaggaaggggatgaggagaaggaagaggacattgggagctggggagctggcacccaggagagggactgaggagtgatcctggttctgtgggcccagagacagacgcttcttacaggagatgtgggtggggcagacccagagagtaggtttcatattggcctcttaacatttctgtatttctttccttgttgttctcccaatgagctcagtatgtttttgcagccatgtcagctgtggtaggattaaggagcacccagggacaggctctcagtgacacttcacctgcgaaggactgttggtacacctaaggagcaaatgggagggtgctttcctgggttgtcccatgtgggaaggagaaggaggggggctaggaaagtacccctcagtaatagggcaaactcctagaggagtcagtgcttacagtgcaagagcttcaccctgcctagagagggtagaacatctttttttgaacgaacacttggaaggcttggcttttatttcataagtaagctcttcttatggtgcatctgtctgctaacatggaccctgagtcttttcctaatgaagctttatggctttgtaagcagcacatttctaaataatcaatggctcaaataagaaatcagaaaggaaattggacaacattttgatctgggtgattttgaaattatgacacattaacctgtgagatgcagctaatgcagtacttagagaaacatttatagtcttaaatgcatacatcacacttcttaatttctcattattacagccagagatggggtgggacaaggcttccaaacttctctatcagggatgatgatccatggcttgtagtcagttatctccttagctatacacactccctaaatcaatagttttcagaattttgaactctgatttcagcagaacatgactttaaacagaacatggctgttaaagtgaactaggttcaaaatcctggttctattatatggcaagatgttttgactaagacataaggaagtttttatagccattgctggctatatagtatccctggctgttcattcctcacctcatcacccttcccatctgtttgtgtccagttacgggaaagcagcttttgaacaggccactcctcatcagctgttgcatagacagaggcagagggcaccaggttaagtcagccagccttggcctaaatgtctttctgcagtctcaattcgggagggtggctccaggctttcagacacctgttccccacatctgacccattgttggtgacacagtttcagtagcctggccctccttggctccagttggcagcagttctccagccctcctgctgtactcccactgtgtcctctcagatggccatagctcctggtgatcacaccctactgtgggagtcccagcatgcctggatgttccccccggccacctcacctccactcccgctcagacaacccccccgcctactcctactggaagccaacttctcactctaaatttttggtcaaaattcccagttctattttcctagatccctcctgaagatactgacttttttttctttcagggtaagacaatttagtgaaagattaatgagaggaaaatctccaaccctgtcttgcaatgtagggaaggcaggaaacagtgaagactttgaaccttaattagtgttgtccattgccctccaaaaagccagtgccagcagtgttaatgcgagtgttcatatcaaatagatacaatttgtagatggtgatttaaatgtaaaatacacatctcctttaactaagtcatcctatttctaggtagctatggaaggctgaatagtggtcctccaaagatgtacaagtcctaatttctggatcttgcgaatatttatattacattacatggtaaaagggactctgcagacgtgattaaggatcttgagataagaggattatcctgggtcatccaggtgggcccggtgtaatcacaagcgtccttatataagagaggcagccaggtcagagtcagagagaggagacgggatgacagaagcgaggttggagtgatgtactttgaagttagtgtaaggggccactggtcaagaaatccaggcagcctctggaagctggaaaatcaaggaactggattctctcctagagcccccagaaggaacacaggctggctggccccttgattttagcttagtgaagctgatttcatacttctgacctctacaactgtaagagaataaatgtgtgtgttttaagccactaaatgtgtggcaatttgttacaggagcaataggaaacagatagcatcaaaagaaagaattcctgcagaggcatgcgccaggatgtttattgcggcattgtcctgagtgttaaaaattagtaacaactgcaaatgcctgtcagtagggaaggattaagcaacctggtacagccacactcgtgaatattatgtagcccttttgggtactgacatgctgagctctccaggatatgttaaatgatgacaggaaattgtgggttgtttcacacagaatgatccctcctttatgcacctgtgtgggtaatacacacacacatacaacacaacacaacacacacacacacacacacacacgtctcattcccttgaagagttttcaagattgaggaaggtccttcctggctgttgagccaccaactagttcagtggcaactttggtcctagaatagccttttcagatcccaggagatcatcagaagagactagaatagactgaaggccctagggacatctgtggcatctcccccattcctgtttcctcccacactctgtgcattacttaaagcttgaggcaactccagtggccacacacagctgaggaaacagaaagccaggaccagcagagccactgagagattggtggccgagcagggtggctgcccagcttgcagccccctgtgacgtatttgcaaacacgaggagttttgagctgcagaaccatcccattctccgtggtgcaggctcaagttcccgccctgattttctgggcttaatcctcttcctgtggaaatcaataaggacattgtgatggaatgattcacgttcaaggtcaggccggagcaaattggaggcgacatgctgattttactaccctcactgtgaggagagccaatcctgctcacagacccccttaaccctttccttgtcactgtggtaagcactgtctgcacaggccccctccccaggcccagatccccctggcctcacccacgtgtggcgcttttgtttacattttcccaagcctctgaccacacaaggccttggagtcttgcacacttgtcatggtggtttggggaaggcagacgacaggttcaggaacagcttcaaattggaagtcaaacgctacatatctaacttcagcttcatgggtaacatcctgttcctctcccttcaccagagctgttccccttccaaccctcttttctgagttccagacccctcttccctgcttttctgggttgtcccacatggggaggtagaggagaggggaccaaattcctcatttatttttttcacacacagcaaggctcaaacatgatagaagcttattccttcctcctatttaaaaaaaacactcaaaataagtaggtagctagagctttgtgtccagaatgatttagggatcctggctcctctgtcttgaggttctaccaccttcagcacgggcctcccagagtctctgtgatctcaggcatcagccagccgaggtgcagggagagcatgtgcgggaagcttgcagggcccaggactgaaagtggctcactcccttccactcggattccactggcctgaactggccacatctcagtgcaagaaaggctggggaacgtagtccagctgtgtgcccaggaagatgggtctggtgggcagtgctgtctctgtgaggaagcggagagagtgaggaggacaatgctagaaagtgtgactggaaaagaagagatagagcatgagttaggggaggacttgaggtaggcagtgatttgactgtatgccctggagaagccagtggaaacagaaaagctttgctgtggagaaaagtcagggtctcagagggccatagctggcatgaggagggacagtgatgacacagatacctctggctgggcagaccccaccttaggtctttctttatctctgtttccaacatggaacactgaggacactggagaataagtgtgaacatacctctaagcttgaaggtgaggagcccagacaacaaagagttaaagggtgcaggggtgggcagaaccggggagccaggtgctccctaacatactgtgcggtgccagttaatcccctgcagcaggcaggaggcctgcacagctgtctctcccgagctgggattgcatgcttccccctccctctgccacctccctgatgcccccggccccttgcccagagaacacagcaccccagggattgggtgggggtgggtggagatgggcaggcagcatgctgggtaactggtccagcccctgaacccttggacaactctttctctagagataaaccattctctaggcttgtttctcactggccatgaagaccgtacctctcccaagccagccaaacccaaaccttatagctggtcctcctacacagtgtccattcctgcctctgtgtctttgcctcacctggagtgtccttttcctcctctccctcgacagtccctgcctagcctgcagagcagctacaacacagcagcacctaggagccctccctttggcctctagccccccagccctagtttctgcttgactggggcttcccatgccagcctgtgcctgtgctctgcccagggaggggagatgcaggtctggctccagcagtcattcatttattcccacgacatcttcattcataacagatgaggctgctaaggctcagagagggtaagtgacttgcacagcttgagagtggaggaattaggactcaagctcacaactgtttaactccagagcccacactcacactttctttctcagcccagaaagagactaagaagattgctgggtgcctgggagctcttcctccctgttactccaggctccttcttcctggaagccagagggagcagtggaaagaaggttctagtttctctttggccagttagcagttgtagaacattggcaaattttaagcctcagttccccatggtgaggagaagcaataggttctgcgacagagttggcaagagggtcaagtgagatcatggatgggaaagggctggacaactgcagaggctgtgctcatatgtgaggctgctgggctgagccagggaatcccagcccagctgggaccagagcaagagaaaagcaggctcaaagagccggactcagtcccagcccaccctccatccagcagactcagggctcactgctaagcctttgcctctgtgtgccctatccagctatgccatcttgcctctgttccactgaaccagatcaccatttacggatccttggagctgatcttcgggatctagtaaagggcctagattgtggggtaggttctatctctgaacagctgtatgatttacactctccaagtctcagtttcctcatcaccaaaatggaaatgagagtctggcaaagtgatggtgagaatgtttatagatagagtcctggcctatggtaggcatttaataaatggagctattgtttccactatgaaccttctttcctaaacctttaggaatatctttaaactcctccttttcaggattaggaaactgatcccagggaatgacagtgactcacccagagtctcactgcaaagtgagcaatggtggaggcagcgccagactccaaaccgagtgcccattccattgcctctgccagagaatcttccctgagctccaacctagggtgggcctccctgtgctgaccttacagcctctactatctgagtcgcccactaggccttccaaaagccctgtctctatctgagacaggaagttcccaggtaggacccaagccccccagcagaaactatcacctagctggatccttttcaaggtgtagatacccagctagggaagcttatttctcaaggggtttcccgggacttggctaagctgggtgacatcaacttcccaatggaggggagaaagaaataagagagggaagggttaaggctcagcagctgggacaggcagcctgcagacggcccagcccagtgctggggggcctgcaccattccattcctttgcagatcagttacacccagctgtctccctccccactgccagcacccctcggattaggcgggaaaggctccccggcctgcggcctgcacacggcccatggggaacagcgcctgcagcccacgcctccacgacagctgctgagtgtcaggcaagaacatagatcagtgggatcctggcagaggtgccctaagcccaagccctgcccccagcatgtgcaggaggggctgcccgagaagaaagggggtctgtgagggatttgggaggtacagggcagaaattgctcccaaaaatatctcctctgcccatgtgtcactgtgcctcaaattccaccattaaacatcttaaaagtttggggcttccagagacaccaattaaaaactacaccccatggagtagctggcattttgatgcactgttgataggaatgtatttgtaaaatttatgaacatttaattttattttacaaagtatatatgaagtccctcaaaaatatcttttcctttttctcagttgtcccactgagggctttaacttaaagaggaacttaacttaaggacatagtttataatatggaaagaatgtgggctggagtcttaagattaagagaaaacacaaactaaggtcatgaatactctcaaaatactcacaaaagccagatgaaaaaaacaaaagaaattttaacactagaaaatatctgtgcctgtaccggaaaacatgaaacagttccaccaataggtcagaaataggaaatttcttgaagttataaagcaaatgggaggcagcatagtgtataggtagaaagatggtccagactctaatcctggttgctttactcacgagttctgtgatgttagcaaattactgaacctccctgaatttcagtttcctcaactgtaaagttggaacagtaattacaataactgtgagaaatacatgaagattagaggagatcatttttggtaaatatccctgtgattccaccatcagaggaccgtgaccatagaaatcaccatcaactatgagtgaatggttatggtatgtctcctccagccacttgcctacatagctgctaagaaaaccctcacagtaccaattctaattaatccagaattttattatacatattaccagccagttaaaactcattatttgaaaagaatggacaatggcaaaatggtgcccaagttgaaatggcagggtaacttaccctcaatgaaaagtcaatcaattcaaggaagaggaaaagcatgaacagtattctaattaatattcccaggatgatccatgaggatattgtatctaaaaaataggaggctaataaagtacaatcagaaaaaaaagtttctagaaattaaaaccatatataacttctacttccatcacacagagtacctggtattcaacctaccctgcaattataaacaactagaaaattggtgaaaatacatgacatacatgtttccagacgtgggcaacaggcagtgcaaggctaggatcccgcagagaagggaaataggtgaagaattaataaatcttactagaaagttccaaattctgcctggataattttctggaacaagagacagggaagggcatgtcccagcagagcagggtggtctcgctgagttgaagacagatcaaattcaggcagtctgaggcaactgaaatatgtggggcagaataccagagatgagggagccatgtagaaaaagaactccagaaagttgcatatattaaggctgtggttgaacattaaggtgcacatgtgtaggctgaatatccataaagacaggtgaagaaccagtgggtaattgtaaactgagaaattcttggagcttttgcagagctgagagacattacatttcttaccagccaaagtgaaaagacctcactgaacatcccgggacttaattgagcttccagaaatggtcatactttagaagaaggattaaactacacctagagtaaaggctaccctaaagaagccctaattaagctttgaaaaaagcctcaaattgaccatgctgacacacagtagctataagacataagaaagtctaaatattctttaagggaaaaaatacagacattcagcaacatactattaataatgcctagaatccaattaaaattactagacatgcaaagcatctggaaaacgtgacccataacaaggagaaaaaaacagtcaatagaaacagacctagaaatgacaaagatgatgatat

SEQ ID NO: 458 - DNA, 38061 bp, Homo sapiens
caactcggaggaccccctgcccgggcagctcaagaagcagctggtgctccggatcatcagtggccagcagcttcccaagccgcgcgactccatgctgggggaccgtggggaggtgggggccagccccacacaggcgggaggggtgggagttgggggcgggccgggcatcgcgatgggccctgatgccacccccactcctgtgtcccagatcatcgacccctttgtggaggtggagatcattgggctccctgtggactgcagcagggagcagacccgcgtggtggacgacaacggtgaggctgggccgtggctccgtcacacctgtgatggaagtctgaggggggagggttggggctacctggtgtgcccgggtgccctgcccaggcctccctcagtgacagtcctgggcgccctcccctctaggtgggcagtcccggaagcagcaccgggagtggcactgggagtggtgtgggccgggggctccaggctggagcggtgctgggccgggccctccccatgggacactcctcctggcgctgcttccccagggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggtgggcaggagtggacacggtgccccccacactggccgagggccccagggcagggcaggtactctttcccctgtgagtcagtgcctgtgtaggtgggcctgcacctggcaccaaagagacaggagctgaggacgggaggagagccagcctggggatctgcgggtcaggcaggggcatggcctgtgggggaggggccacccccaggaagaggtccctgcaggctggtgcaatgccaatgggcttcctggaggaggtggggtagtgctgggcccacaggaggcagaggccccaggcctgggcttgttgggtgtatctggggtcttgggacctttaagtagaatggggggcagagcaggtgggggccctgggaggctgtgacctcatgaccctgctgacccacactgctccaggctacagacacgtgtacctagaagggatggaagaggcctccatcttcgtgcatgtggctgtcagtgacatcagcggtaaggtgagtgtcaccccctgccaccagccatcatggggaggggccacaccagccccttgtcccatgcccccccatgtgtccccagtgctgggtcctgaactcaggcagtgaggcctagggtcccctccccgggcctctgctcctctatctcaagaggggctgctgtgggggcctggctcctgagccaccagtgcccacctctgatctcagggctggctttgggcatctcgggcaggacaggtcctgagtgctccgggccttgccccgccctgtgtcacccatgcctgtctcagactcttgggggccttgcagcctccacccctacagtgctgccatctggcttctcagcagggaccgagtgatgcccctctcccctctactaccccccacccctctacttcctggtgtcacgtggaaggcagctgcccgggtttgcctgtgactccacacccagcatgtctgtcccctgccccaggtcagggtggggcctcggcttccgcaggaagtggtcttggtgccagccctgctgccctggctttgagctggggcccagtgccctctgggtcctgctggctgcagctggccctcggggaacccgcacacacagcaggaggggcctgcccaggcccagtgctgactctctcctgccatgctctcgggcccagaggtgccatccagcccctgccgtctatccacccatctgttcctcgtcccccaggctgcagggctccccacgccactgctgtggccgcctcacctgctccccctgtctctttggtcttgcagtcggcttctctatggccacagcctacttttagaagtgcagctctgttaggagccttgaaggtacccggtgcgcgggacagtgcggcccgccgcccctgcatgcccaggccgcaccccattagcatccatgattcctggtagcatttggagactgtcgctcatgtgacgtggatcatgacatggctccgggggccctggccatccccagccatagtggcatttacgaggcagatccagggttcagctgggtggccgccttctcactggcctctcctcccctcccctccctcagtcctccctcccctccctcagtcctccctcccctccctcagtcctccctcccctccctcagtcctccctcccctccctcagccccttccctggcgggcagcccgctggagcccccactgtgcccctcctatccccctccttctctctcctgcccccatctcggaccctcaggctgttggttctgagttcgcctcccactccctccctgtccttgccaaccatgccagtgcatgggatgagggcacccctgaggccggcgctccgagccagaatcccggatctgcttctaaatggcttcccagccactgtgaccaaatgcgtagatttgggatcttgaatcaggaagctgattcaagtgctggccatctgaacgcatctgcccagaggcgcccctgcaggggggtgacccacctgccgggcctgggccgctctgtgcacgagcacggctcgtcatgggggcgcggtgggtgctgtctcgggggcatctggcatgtgagggcccctctggcctctgcgccctggagatgcggctgcctccctctcagcagctgttctgcccaggcagggacctcctgggcccagctgtccaggaagattggctgtggccaggtgctggtgggctgggagtctgagcccatcttggcagggctcagggggcagcaagccagctgcgggccttgggggctcacatgagtggagggcagggcaagaccagaaaaggctgcctgggggaattcaggaaggcttcctggaagaggtggtacttcctagggcacgagtatcaccatgggagtgggcaggacacgggccgggcaagtgggcctcccgctgcacctggctactcctgctgtggaccagctactcctgcctgagggtggggcacacacaaccagggagtgccacgccagtgtcccctgctagcgccgggggctgcgggcctctgagcaggtgcaggctgtggtgggccaggctggggctcgaggtctctcctccggagggaaagaccttctctccatgcccctcaagggccccacatgccctggacaggtcaggcgagggcagtttctgccggaagggtggggtgggccatgtgtacttagatctgtagcagctactgtcccaggcagagctgccctagggaccctgctcctgaaggccctggtgtgtccacacacccccagcctgaggtggcccagcccctcggaccgagacacgcatggcacgtctgtggcacggtctggagagctggccctgggggagcagctgcagctgggctgggacccctggcaacagctacatgggctccttctcttgcaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccggtaagcccctcttgccctgcgtggtcctcccgcacgcccctggcatggctgggcctgggtcacctgctgctgcttctgcgtggacggtgtcgcctcgtgtgctcgtgctcgtggctctgtatccgtggcactgtctccgtggcactctgctcccttggcttgcctgtggcccatagccccagccctcctgtctgagcttgaggccctgggacttgggtggagctggtttgaggcccgacaggctgggaagaaccagctgctcttgctgagggtctggggccgggactgtggcctgacatgctgggcccctccggctgggcgcttccccaaactcacctcctgggcggctggcgacctgcatggcccctgatgcctttcctgggactgggggccacgtaccatcccattcccacctccctctagggcaggctccaggggtccctactgggaagtctgatgtgggcaggtagtgcagctgctgggcgtctcctgcgcccctgggacgcctggagcctgctgagtgctgcgtggagtagattccctgggccccagggcttcgctgctttgggctgaagcaccccactagaagggtgtctccttagcctggagggagggacatacacggagcccgccccacaccaccctgcccctccagacccccctgaccaagctttcctttctgcccccacccacgctgcctccgtagttaggaactgagagcggcgagtgacaggtaacggggcccagccccggtgtcccgtgctgtcccagcccaaggagggccccgtgtgcggcacagggcgtggactgggccccagcagcagcagggtggggacaccgagtgtgccgcgcccgggggatgcctcggggtgggagctgggcctggcgaccctcggcacagggcaccggggacaccaccctgatccgactcctctccgcctctctccctgcctccctctctctcttctgcttctccctctggctctctctcactcccccacctccccacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccctttccatttttacctggtttttcaccccaggtgtgtgtggtgtgcatctgtgcgcacctgtcctgagcctgccccgggaggcgcggctgacctggccacggcacaggcgggggtgcttgtgaggcaccagggctgctcaggacggccgtctgggccttgccctgaagcctgtatctgccttgcaccgaccacgccaccctctgcaccatgcctaagcctctgtcaactcccaaacgtggttctgataaacgtgctcaccagcacgcatgggcttcccgttcgctcagcctcctgtgccacttacttaccaggtgcccgtcggagcctgcgccaggcccagaagacaccccaagaaaagacctggcctgtcctcagagggctgagctggacaggctcccagggtaggctgcaaagcctgctcctcaggacgcaggccctaaccccgggccacaggccccccaacccgggggactgctctgcctgcagagcatggtggttccagaaaggcccctaccctagagaagctggggtgctggtcgggcctctggaagcctgtgctgcagcccgtcctctgctgccccaacagtgggagtgggtgtggcccaccctgtggccaggggagtcaggggatgtcctgccccatgaggctctgtcacctgcggctgcccaaggggcctgcccggcgcaccacccggatgagcactgctctgtcggggtatcccgtctcacccctggctgcgttgtgcccaggcagggcccttgggaaggcgggcctgaggcccggaggccgggatcctggggtgctgggggagctctaagggggctgttctgccctcaccatgttcctgcactgacagggattgtgggcggccacaggaatcgctgtcaccacttccccagctcagccaggcagaggggccactggtgccgcccttcccccagccccaccacgcccctcagagagagcctggcaggacttcgtcatcctcgagccccagaacacttgcgtgtgggcagctgcagccccaccgagagcaggggtgtggtgagctggttgcctggggcccggggcggcacctgaacctgaggagtctcagctctgggacaggggactcacagagcccccggcagtgacactgacagcagcctggtgaccgaggcctcctggcgagcccccaagtggtgccgtgggcagggcagaggttggggagccagctgggggtctgcgggagtcaaggaggggctgagggcctggggccagctcgtgttttgaggaaagcgccgttgaaatggccacatcaagggaacaaggcagaggccagagccctcctgctccagctccggcttcggcgggaaagggctggggaagggctgggaaagggctggggaagggctggggtcacagaggctggggttgcccggaggcacaggggtgcctggctcataggctgggtggccccttgtgcaagaggggagctgaggccgtggccaccggcaggccctgcatgggggtgtgcaggggctgagcctgggctaggccctggtgtctttgtcctggctctgtccttccaggcctctgtgcatcccccacctcctcctcggcatcctgtctgggccaggctcaggccaaacctctgtagtgggtgcgtccccagcacagatggactctccaaccccggggtcaagccctgtgggtgtcaggccaggcagtcacacatccgggtgcccagagcggccaggccactgctgccacccaccaccagtgagggtggggccaggatgggagcaagagctggaggggccgagtggggtcagggaaggctacagagatgcaggctgggagggcttccccatcagagagccgggcctgaggagagggccggaaagtggtgagggcccatggggttccgggggctgggcctctgccctggggacccacaggagggagaagctggagccagggggacagtccacctcaggatagcccagctgcccccgggctcctctgccaggacacgagaccctttggtggccgctgcacgagggctgggactcaggttccacgcagactccaagggcaggtcacgaagagacaccacagtgggggccagaaatggccactgggcacctctgggcaggccaggtctccatgagggaggggtcttagcctctgcaggttccagaccaccaagcaaagctgtctggaaggtgatccatgccaccccacctccttggcctaggacagcctgtgcttgggggtctcagtgaagcctctggatgtgggggaccccagcgggggtgggggtggtggggcaaggtagcagctcagcctcctcagggcctgcccagcagctcagcaccaggaacagctcccaccacatgaagtcaaagctgggggcctgcagccagcccaccccagcagggcctccgcaagccctgtgccctcctgccctctctacgatgctatgtgtggtctcaatcccacacctgggctgagggggaggacccccaggcgcctcagagctcccaggggccaggcccagcgggcctccctgctgccagctccccccagccatgcccaccctagccacagaacacggccccagggagcctggtcccaaggccatagcaaccaaacccacgcggtccacacagttcctagcagggtccacgtcggcccctggctgcctgagagcccttgagggtgatcgatgtcgagggctcctttcccaggctctcgagtcaggaattgctgctcagcacccacacatcccgcaggtgcagggggagggcgctggagggacgagggtggctgagttggttcttctggcccggagggagcggtgagagacgcaggggcccggggccatggggtctgcggggcggctggcactcgttgcctacaaggtctagaagcagcgcagggaagggctcccgctctgggctccccccatgggaggagtcgggaggggcccctgctccgaaataaaacatcgcagatggctccggcctcttttaaaaactctatttggtgcgtgcccacggtgctgcgtcccgtcagacatacctgtatagatctctctatttatatatatatatatataaaaggttctttagcagttaaatagattccaatatgaacgtctcccaggacaaagctgcgtctcgcctctgggtcacacgcatctgtgcggctggggtgtatgtgccgcgtcacagcagtaccatataaatacgttgatttgaacgcagtttccctgtggtggtaaaaacacattcctgacaagtgacaagcagaagagtccggcagctgcagcgcctcactcggctgggacctcgtacttgaagatgacgctgaagagccggccgcccagccgctcggccagccacgcgttcttgatgacggccagcttgaggctctcgcagcgcagggctgcgtggtagtttgtgtggacagcacggcccatgccctcgatgaccaccagatccgcgccacgctcccgcaccagtgcggccagccccttatccaggcggctttggggaggaagaggacggtgagactgggcaagcagaccccagaccccacttcccatacagtgcggcgaccaacgtgaaggctgaaacccctaccgctcaattccctgatgtggaggcctccaaacccagcctccgcctggtagctgcctcagcctggggcttcctcagagcagcagctcacacagggccagagcagctgcagcttggaaactctgccctagatctcctgtgaactctagggatggattccttgtcattttcacgccctccttgttggtgagagtggggctggggcacagatgaagccagcactggagaatcccaccaggcagagcagaccagcggccccagcactcagaacccgctcatttaaggggttccttcctcctctgcaatcaggaggacagacagcaccacatacaattgactaatgacctccagaaccacagaagcagagcctggcatctatgtgggacacggaggtgacagacaccgggcagctgcccaggtcgccctcggtctcagctgagtggccacagggacattggcccctcttgccccaagtccccaaacccagcccatgtgtaaccacctcagaccctgaatccattcaccctccccaggccaccttcggggatggcatatctgtcccctcctgagatcaatccgggcctggggtcaggagaggccgcaggggcagtcctgaggtcggtgtcccgcatgcacctgggtgcaggtgcacggcacagagggcacagagcccaggagggagagaacaggtgcagggtgcggggttacctgaggtcgaggcacggggagctggagcccgtctgcaccagcagcagcctctcttcctggagcgcagagctgccagatacaaggtggtcagtgcccccaggagctcccagttcagtgacaatccccatggcccactctgcccagctggtgcccctccccatcaaggcccccccagcactgcccgccaacactcactgcacgacagggtccatgcccgcaatacgctctgccacgatgagggactcgctgtgggtcacgtcgttcagggcggggcctgagttgcacgccaggatgacctgcaggaggagggcccaggctctttaggaacctgtgctggcccagcatggagcctgcgtgcaccccggccttcgagtggctgggctgggtgagggtgctgtgcccagcgggcctggccagccacctgctgctgaggagcagggacctcgcctgaccttgccactctgtggcccctgggagggagctgagccgaggggcagagctgagtttagagcctgcccctgggacctgcctgtctgtgaagtcacagccccaaagcctccttgctgtgagcacccttccaggagcctggcgtcaaccctgggcttcagcacatggaccctcagcctgagcccagggggctcggagcctccaccccagcagatgacggctctgggccgcctcccccgtgctgctgcctgcacctacctgctgcgtccggaggagccccgaccaccgccagaggcccacagcggcgccaaccccaccgagagcagagaagcccaggggaagggccccacccaccacctcaacactcacctctgtccctctaaggagtagctccctgacaaaggggaagactcccaaaatgatgtctattccactgttatctgcgaaaattaaggcacatttatgagggggcccctgtaagacaaaaccaggacgttcagttgggaacaggcgcatccaagcgagtcagtccgcacccctgctgcccgtcacgctgccctgcaggggccgagactgggggcttcagggccccagagatgccagggatgggctgtcctgcaggggccgagaccaggggcttcagggccccagaggtgccgggactgggctgggctgcaggggctgagaccgggacttcaggaccccagaggcaccgggacgggccagcctgcaggggctgagactggggcttcaggaccccagaggcgccagggacggattggcctgcaggggccagtgcctgtctcttctggcaaggctttgtgcctagagcaggtgacctaagaagcagtcacgacaggagggcaagtgtggggcaggggatgctgagacccttggctcgcaggatggtgagactctaacaggaggggagggccacccgaggcagcccatgcccacctccctccagtgaccacccccccgggccccgctgtgtccccagcagcagaggtgggaggcccctccacatacctttaatctctgaagccactcgctgtaggaatccacgagccagggtctttctgagacagagagagggacacatgattagcccggtgctccaggtcaggggtcagggagacgcgtcttcaggtgttcgtctctccaggaagcaagttctccccgcccccgaagcccagctgacagagccttgagcaggggaggtgcctggaccccgaccgcaactgcattcgctgttgcagagaacgtccaggcatggccccagcacaaggcaaggccccaagttacttggccatccgtaccttgtaacttcctctttgcttcttcaaacccaaagtaggggtcggattcaaggacactgcatggaggaggagaaaagaaaattaagacaacagaacaaaaaccttcagccacagtgctcaatgtgaagaccccaaatccctcccaggcgggacagaggcagctgctcaatgtaaagatcccaaatccctcccaggtgggacaggggcagctgctcaacgtgaagaccccaaatcactcccaggcaggacagaggcagctgctaagaccccaaatccctcccaggtgggacagaggcagctgctcaacgtgaagaccccaaatcactcccaggcagaacagatacagcgttcttaacatgctgcgatccgcagaaggctcagggggccaccaagcaaaggtctgagagagcacaggctgtttctcaaggtggactcggagccacggggccagggaagcctctcggtgactggcagccgcagtatggtccctgtgcttggcacccatgcaggcggtgtggggagcccccagccacaaggccaatcccatgggtcaggaccctcctccaatgctcctgacaggctgcgggaggggcctgtgtcccagaggggcagccatggttggaggcggcgttctcatctatgtctcgagacacgagtgggacccagggagggctgagaacccaggcatttccctccagccccacatgaaaaaaagcagggaccacgagaggtggtgcggccgcctggggaggcccagagactggaagcagcttctttgggagtgaaggtaaatgatggtgggggggttcattttcaagattcagagccccaggagacggcgccaggtgctagacacctgcgtgtcctacaggccagtctaggggactgctttgcaaagcaccctttgatcatcacatcagaaatgtttaattcctaccacacataggaaacatgaatttggattctgacaatagaaaatgccagccccgattttcaaatccacacccttaggcctctgcggcacccatgcttaaggaaggggcctcctcagaacctgaggggacagacaagggcgctgcgccctgcccagcccctggcgctgctgccatgtgcactccctgggccccaaagccctgagccaccaagccaccaagcgccacgtgacccccaagggacccgctccacctccttgcccgcaagcctggggcaggacaggcacccacaggctgcagagcctgctccgagcccgcagacacctacgcagacacggctttggccccccagtcgaagacattccccgccaggaggcctttcaccagcgccagctgccgttcctcccagcccagcgcgtccagggagcgcacgaccccggggaagcacctcagcgccacgccattctcccgctgcttcacctgtggagagtgccagatgccaggcctgagtgaagacgtggcctcagcccaccctggacacctgccaggcgcagcctgttccataccacgcccctcaggatcgaagactcaggcccaactgggaccccaccaggcacaagcctatcggtccgggacagtggccagcgcacagctgcacggggctctgaggacgaggcccaggacaacttcagcccccatgtgactgagcagtgggtgaagggcaggacaagagtggaggacacggcccccacaggtacccacagccctggcctcaaaaccctcgacacccagacttccgctgtcacaaggctcggcgtgtgaggggagggaggcatggcgctggcccttcccagaagaggtgggaggagtccatgcctccgctgctgcccgctgcctcctggcagaaagggccaaggagggctctggccgccagacttggggaagcaaaacggacgcccggaaaggcccaccttgcacggccctgcacgttgccgggataggaggcctctggtcactgtccagcctcctaggagggagccagggtggtccagggttccagcccctccccatgaggggaaagcagtccccaaccacaatcgcccaccctcacagaagctgggaggcccttggctcctgcaggcaggcagcctgtgtctgtcaggaacacatccaaactggggttcacacccttcttctctagtcacagcagtccccacccctaagtggccccagcatctgtgggggtaacacagctcctcagcagatgctgccaacagaggccctggctattgtggtgccagggctggagttggggccgctaccaaacctgcatggcctcagacaggacaggatgccccgagccagcgggacagagacaggacacgcggtgccagcgggacggggacaagagcgagcggaaggccagggcacactgcacttactttggagtagggatccgggaagttgaactcgttcagacagtgctccctggtgtccagcaggctgcgcacggtcagggtcccataggcgctggggacagacacggcagagggcgctgagcagggcaggccgaacacccgcccgtctgccatcctcggctgtgccacggacgtcctcaggagcccggcagtgcaaacgctgcttgaggcggggtccaagggggctgtgccgccagggcccacacccacccccagcgagctggggtccgaatgccaacatcacggcactttctcagaggtgcaggggccctctggatggaagaggtggccacacaccggggtgctgggcacttacaagggctgctgcctcagggtctgaagcttgttccagtacttctgccggaacttctccgccctctcggctgcatccacagagtctggctggctcgccactgcgcgcttcactacctgccagcgacagaaggagggggttagtcaagcgctggccctgctgcttgcgaatccccacgtgacagcagggggctcggggaagggtgggggtcggccgtgggggactgtctggggcagggtgggggcggctgtaggaggcctggtgcagggtgggagccggctgtcgggggctgtttggggcagggtgggggctagctatggggggcttcccggggcagggtcagggcctgctgtgggggactcgggcagggtgggggctgcctgggctgtggtcagggcagtttctactggaacaggaaaggctgacggtgacagttcacggtcacccgaggcttccctttgccattcgcccctcccagttgccctgggaggcaggagcaggagtgaccttggtccctcaccccccaggaaacccgaggccaagacccacgtcctcagactcgagcccccatcctgtgccggggacgaggggctctgggcactcagagctcactccgggtcctgggcagggctgggactcctccctcaggacaaaccctggcacgacccggcctctccgagggcttcgtgaagagtgcgtgttgctaccggggctccctggccccgagctgagctcctgaggggcagcgtggcccagggcctggcatttgctccacgggaccagcccagccttggagaaggtgggacgcaggagtcccaaggtggcctcgccgggagcttgctggggctgagtctcaccccacccccagagtcagggtcccacaatgcctcccgcacctcagtcacacctcaaaagagcagagacgtctcctaaattgctttttgaaggaatgtgctagctagcagaactatcagctgcccttagaagcaacgtgcctcgcagacgccacgtcctcactgacccaccaggtggccaggagcggtatttttgcctgagaaaccaaaatcgccccctcactcagacgcagatcaaggggtttctggacaacactggcctgtcccccttcgccaccttggctttgcccccggagccttggaaggttaacccggctgcggccttggaatcgtctagacggcacccggagccctcaccccgtccagggcctcctcaaagcaggtgagccagtattttcgggccagagcgtcatcggtgaggtccaccgtgtcgggcacgtaggagggcgggtccaggaggagcggcaggtcaaccagtggcctctccagccggtccatttccagcaagtcaaactggaagacaggcagtggcagggtggaaacgtcaccatggttcagaacgacccaagccacactcagaagcttccactctctctctaagaagggagatgtactgccttcttccgccacgtctctgggccacagacgagacccccactgggccccctcagctgcccggcggcctgagccggataccttgacttaccccctggtttgacactggggttgcgtctgctcccaccacacgcctcctgcccccagcacctccccgctgcagccacacctccccaatcaccgctgcagtcaccctcccatcacccctcctccaccatccctatagtaactccctcccccatcaccacctccctgcagtcacccctccctgtcacccctacagtttcacctcctcccgtgacccctgcagtcacactgttcccacctctggtcctccaggtggccgtgtctgcacacagaggtttggggttctgtcctcactaagcaccaggcagtgttccactccgtgccgggcagggagtccccacgccccacatgcacccttcttcctccatggctgccgggcctcccagcacgttctgtccatgaaggactatggcagggccaggccattatgcacccagggcaccccggggccacctgcacccagcacaggcgcgctcacgggccctgctggctttttctaccttatgccgggaggaagtgaactgaactgagccgacgcacacatcagtactcggctctctgcacgctcaccgcagcagccgctgctctgggaccagaggggctatgaggggaactgtgtagctgaccgcctcttcccaccctccggtggctaccccacaggtcacatgctggccctctgcccttctccactggggcacccctgctggcaacccctggggctggagaagcagcctctgggtgggcagggacctccagagcaaaggggacgccttccaggtgggaagcccatgccgggcagaagctccacgtggaaaaagccagtgacttcccaaagccagtgcagaaggcggcaggagccccaccttaactaccacggaccacagccgggatcgcctggtgctgccttgccaggtcgcaggctccttctatcctgacaaatgggttcaaatcttcgctttgacttttttggacaatataaactgaaataaatgactccatctctctgcatgtcagtttgatcctcagtaaggtgggggcccctcctgcctggcagggctgtgccactggtggggtaccaaataggtaacaagcgcctcctgaacggggcccccgaagcactgtggccgtccacgcagtcactccaggttacagtccaggacatttggcaaattatgcacacttggcaaatcagaaactgaggctggaagacaccaagcccctctgcccaacagcagggcaaaagctgagagcctggggctctgccaggcccccagagcctcgcccccactcccctgcctagtgctggcggtgggaaaggcagaccagggctgcggccagtgtggtgcgtctgtgcgaggccgtggcctggtgtgaactgcaggacccacacaaaagggaggcgccctcctgagaagccaaaactcaacaagtcgcggtcttgaaaatactgacactgaaccccatgtctacaaatgacaagcaacttcctgccaacaatgccagcggcctgtcctgaggggtccgactagctttgtgcgtgacctcaggttaactgctcacagctacagaaggaatgagccccgcgggggggcacggtcgaggaccctgacagcctgtgacacggggcggttcctgccatgtggggctgtgctgggggcatcccgtggctgacgcaggtcctggcgggggacccttccggagcagctccaactcggcagacatggggtgcgtctcctagcccgccagtgccacccagctcaggccagggcaaacccactggggatccaaggaatgagccgggacaccccgaggagagcagactgtaaccgacagaccatcagccacagtgcgcggcagtgtgcggcagagcgcgcagtcctaggcagggccctgggtggctcctgcggtttcgggtttcaactccaaagtggacgggccttctggcgtggggagaggtccccgtcacccctgaactttagcaatctctctgcaaacaagaaggccggatcacacagactccgtaattcctgctgaatgtttccaaaatacgaaagcacccaatgagggagatgggaaagcaagccacagtgtccttctcttgcccctagttataccccaggtccatgggaggattcgccatgggcagaggcgcctttcagccgggacagccacaagaggcttcgctcagggacaggcgaggtgagtgcggcataggctgctcccctggggcccggggcggccagagcccactactcacagtgccactccgcgcccgctgcgccgggccgagctcgggtgatgcactcatcagcccggagctgcctgcatagttctctccccagctgtactggttaggatctggaaagcaagaagccaggtcacttgtgttaaccttgcccttgattcaaaagcaggagagtggaggaggaaagggtataaaatcgcttattaactaaattgttaaaatgttagacatgcctgctgctgtcactttctgaggactcacgctccccaccccacctccaccctgggccgccctggcctggagcacaggcccaggccacagctgaggccccacgctgctcaggggcgccagcaccgcgactcactgtcctgctcagctcctttcaggaacgctccgatggctcccaggtagccttcgtgcctcagaaacagcgcctgcacttccccctgccgtggccaaagcacacgtgctgctgttggccccacacaacacccggtgcctccgcaaaccagctcaacgtgcgcgggcctcgcaccgcgcggcccaaaccctcgaagaggcgccatggcacccacggcatacttgccagtggaatcgcgcctggcaccagagggcgggctgctgtttgaagaaagctaagggtgagatagcttctcccatgcagcgagtccctggcccacaagtctctgcgtcaggcatgtgggtgggcgtgcctctgcgggggcaggggcaccctgaccccagcgcagatcagcaggcctgcctggagctctctagaatgctcatcactggtgatgtactcaaactcaggtggccacggtgccacaaaatgtaggctgcccagaatcagtcagaagggaggggtgctgggcttcttggcccccaccctccaggcctccctgggggtgctgcggtgtctaaccagcatgactgattgggaagatcctggggggtctgcgttagaggctggggagggcggcgcatccgttaccttggagaagaagttgatgctataggtgatggtgcgcatggtcacggggtggccccggataaagaagcctccaaagtacacgcggtccaggctgtgcagccgtgcgtggaggcaggccagctgcccaatgtcgttgctgatcatgtgcagcaggctcttcgccatgtcttctttggagaactctgaggaagggaaggaaaaggcactcatctccaagtacagcaagtgcacgacatgagagcgagcaggaggggagggggagagagagctgagtgggaggggagggggagagagagctgagtgggaggggagggggagagagagctgagtgggggaactggagcccaagtgcgggaggctgcgtgtgatgtgtgaatcattcctggacggattaagctttgttttgaaggaggaaaaaacccaatcaggaaactattttttcttccaaaaccaagaccgtggcgtttatctgccgacgttctgagcagtgggcctgagctgcagcgactcggcaggaagaggttacagggctgacacccaagaccccgactctccagggagcagttgtgggaaagcaatggtgggggaagctcctgtccgtgagaccccaagtgtccccaccatcctgctctctggcggcagaggccggggtgagcaccttggtcggcggtggccgacttcccgaagctgctggcgatgaggttcccgctcagcccgagagtctggtgggcgccgccgtagacgtcccgcaccagcatgtccacattgctgtgctggcccctcgaggccaggtgcaggagctcgtcaaacttctgcaggacacggcgagggggcgggtgaggcgccaggagctgctggaatccccacgaccccagaaaccaagcccatggcaggaggcacgcgcgggcagggggtaaatgggccctcatcgcgtgggaccaaaggcaggaggcggcaagcgggaccctcgggccacccagccaggatagaagctctgggttgctgggacacccaaccctcagggcgcaaagagtgaagccgcagaggccagagacccactgacgcgagtcaggagggaggcccggaagcagcttttgcaccgcccagctgcaggccttcgggggaaggaagcagacatctccgcagacccctggaaggtctctggcagctgccgcataccttcgttttggtgagcagagcgccaagcccccagaaggtgccgcctccaatggagctgccgccgacccactcgaacctgtcctccgtctccacctgcaacagagccagggcaggtgtgccctcagtgggccctcagccacacaggctcccccgccccccgccccatgtgctgcgctggggtgaaccccgcccccaccccaaccgccagtgggaggactctcatggccaagcctgggggcgctgatgcccctcccacagaggctctgagctcacagcctcgccacccccctcccgcccactgggccccatccatgtgcccagccctggctcctgcacacagcgagggcttaacaaactatggctaaaccatccactcattcattcatgaagccgggtcttaccttcacgatggagactccagagccgatattgacaagaagataggggaaaatgtgggggtggttggtctggaaccggaactcagggtcggaatccttctggtacacgaaggcctcatgggggatgttcttgagcacgaagttgcaccccttaatcaggcacgtcatcacgtcctccttgtcgactctgaaaaggaagcgccaaccccttaaagagtctgggccacagacaggtgcaaccatgcaagcctgcctggtccgaaggggcagccatgccccatgcgcaatctgacacacgagcgccagggacgcggctctgggacacccagggactcgggggcagacacatgttcctttctcgcccttgagatccccactcacttcagccgcagcttctcttcgatgaggtctttgaacttgtaggccccgcccccggtcgcctggatgaccttggtctctgtgttgacgagatggtctttgatgaagtccaggcaggcttcgatgtaggtattctcaaacttaatgaagtgcagtcgagcagtgatctcttcttgaactgaaatctcatagggcggctcatgttcacgttctgtgtcctggaaaacagagtaggggaggccgcatgtgtgtgggacaccgcgccgggctgggctgtgcgcaccctgccctagtggagctggctgttcgcgccagccttcaaccaggcggcgctctgaggcagaatcctgggcaagagggaggagcctaggaccgtggcgacctcagggccacccagcaggagcggaagcctctcccgggggagcacaggcgggcgcaggttcctacaaagggtcttgaagggacacggcggaaggcaggggaggctgtccctgctagaaactcccaggacactaaagtcgaggtctgcagcagcagagggatgactgcgagacaagtgccaggtccaagacgacagagaagcggctgccctgccccgggtggccacagtgcaggctcacctttccggagtggtcgaaagaccgcaccttggcgactttgtgctgtaccgttgaatagtaggccagcttggttaacgacccgcctgcaggggagacacaaaccgggcaggattcaggaccaggacacagcggggcctgggggtccatgccccacactctctgggtgtcctggagactaaagtctctgtagatgaggggtttggggctactggaacttaaaaaccctgtgggcacaaaagagaggacaggaaaacgaacaatcaaatctacacttttctttctcaaattctgctcctcctcagctccctggccaaactgagctcaagaggtcccgcttccccttggcaccaagtcctgcagaggaaagggagagctgtcttgctttgggtaaccttggttatcctcactgctttaagaaaattcagtttcaagtgatcttgctaatgacccaaagcgataagctgacaaatccaggctgttttcgttttaagaagtacaccctcgaccgtccctgcttacaaaggaggctctcctcacagcccagggcggtaacggggcctgagcagctcccctaccctggagaggcaaacggtgccgctggctactcttgagaggctccaggcagaaaatgcagccccagccccaaaagtagccagaagtcagaggccaccaaagtccgtttccccacaggccaaagtctctctgatgctctcgagaagccctgtggcttccaggatgccgcctgtgatcaaaggttgaataaatatcaggaaatggaaggggctctatgtacctgaaccagatttcagggaaaagtgaaaagattcttgaagaaggccttttcaaggacaaattcttctaagttaaaaaaaaaaacagacattgttgaggctagagttgtattcatagatttgaaacaacatgaatgacaaatagaaaaagaaacaaaatgtgactttgagtgcattgcgcggtgctacagtgacttaacagagggcactgtgtgtgttatagtgacttaacggagggcaccgtgtgtgttatagtaacttaacggaggggaccgtatggtgctatagtgacttaacggagggcactggatggtgctatagtgacttaacggaggggaccgtgtggtgctatagtgacttaacggagagcactgtgtgtgctatagtgacttaacagagggcaccgtatggtgctatagtgacttaacagaggggaccgtgtggtgttatagtgacttaacggagggcactggatggtgctatagtgacttaacacagtgcatttcttacagggcctgacaaaaagaggcaaaaatcccacatcatgagagtaatgaggctaaagttattttcaaattattgttttttgacaaaatactataaggatgtctgagaacaagcactcaggtcagtaaaaagatttggaaacaccaagcaaacagccaatgctgttcatgtagcaaaacccaccgtgtccaggccccacaacagccatcccagggcacctcctgcctggtggtgagggcaggctccccgacggctggcgtacagtctggtggacgcgtcacaggctcaatctgatcccctagcctgtggctttaagcctccttatcccctcccctgcccccagtgctggccgggcccggagagtctcactaacatgcaccatgccgccgactcacctcagtaaataaatcgttttctaaaacgacagatgatgcaagaggatgaagatctattttaagagactcatcaaaagtcagtataaacaaactctcaggtcacagaaatccagtttcaggccctgggttctttgtgttaaatacatgcccaaacaggatgtactggggttgggacagaggtgggggtgggttggtttctgcaagatacgcatcctccctccctgagacccctgcacggagaggcccagcaaggccagtgttccgtctgcctactccccacacccggggggacaaaacgggacctgaggcgcgaggggcacgcacagcagggagatctgttagagcagagggaaccgcctgcgggcggggacccttccgggctgagctcagggacccctcggaatcacagcaaaccgcgcctggcaaggcagtgacaggagtgcctcctggcggctctccgggctgcccgcgctcggccctgaggccaacagctggtgggggaagggggcttcccagaggtttggtcacctgtgctcttcacatctgagccatggccttctagttctccctgtcccacaggccccatcccctctgccattctctctggtcctgtgtttcctctttgggcaccaatggagggcaggacagccaagcagacaccaccgccccgtggccccttcctgtctcacctgcctctgaggaaccctccccacagcccgcagaaacctaaaatcagatcgaagctgcagtatgttttgagaaatacaacgtccctgctgctttcaaagaggtgaatctgctcagcagacatcagcgtcccatcgagaggaaaacagcttgccagaacacagggcaggtgagctttcctagatccagacacaggcaagggaagaggaaatgggagaagcctgcttttaaacaacactgttgacaagcactttggctttgagggttcctgggttgaagacaccccaccctgagcgtggcctcccagcagctcggtcaggagtaacaaacaaaaggtctctcagtatcagtcaacaggtcctcttaagaaccagagacacaggacccagacgcagggagaaactttgaagaggggaaataaataccagcactaaacagacctcttagagtatccttctaccaagaaaccccctgggctcagcctggagaacaggctggtactccagggccctctagggctgcgacagcccttcctggacagccccagctctgcggcttcactggcctctcggggccacacagaacatccacggtgagccctgttctcctggccattccccaagtgacttatgcaggtcaactgcaattgcatttcagaaacatttaatcccgacttgcttccagtaacagaatcccccagtgtaagggcagcagaaccttgcagagcacacgctctaccgggcctcaaggtctcagaaggctgggaagcatggctggggagcctctggtgaggcctgcggtagacaatcccctaggctagggctgcaagctcagcacctgcagcccaataaccagtcagtcccaagtcctatcagcggtccctaaagatgctactcacacgttctcatacctggcaccaggccacaccccctaagaagcattgcctcccataagctcactgaaaggtgggagccaggacctatagctacttccattctcatcgccccccacttccctagaggacacccttccctggctggacatctcagagagatgatgacaccaacaaccccgaggacaccacagcagcaaacatgtcagatgcaccaggagcacacagctcagagggaatggcctgggtctctctgagtcccagcttttccagggaggtgggaagcagtcagcggcaggcccattcatcccagtatttactgggcggcaaagacaggttgggcatccttttcgggggctggggctacaagacacaccgctgctcttgtgggattcacacacaagcagactcagcctacgaccgagatgagtgctaagagggagaggtatgtgaagccgcagcggctattcaaggggggtttctccaggtgaagctgcccccaggaagccctcatgcctgaaacatgggcagagtaggagagcagggagtggctggttcaaatcctggttctgccactttctagcccgatgaccctgggcaaattagttcacctttctggggcttggtatcctcatctgcgaaaagggagtaattcgcgttcctcccctagaggtggctgggaggtgtccgggagtcaggagcgtgggaaaaaggtctagaacagagcctggcccgccgtcattactgagagcacagccatcaggcaggagggtctgcagcggaccctggagaggccagggcagaagtgcaggccgccttaaaggccacggaaggcacgggtggcttttaaaccagaggcacgagttcccaggtcccacgtccacggccgcctgaactcacgcccggcgtccactctccagagagcggggcctgtgcacggactgtccggcccgcgggccacagctggccacgccgcgggaacgcgcggccttttcggggccactctgccaagggcttcccgccgagctcgtcctcgtctcgaccagaactaaggaccccaaatctcaggccagccaccagccaagcggcggagccggggcgcccagatgccgatgtggccgaagacataaaattccgccgaccctcccacctcgcggcgggtaacgctggaccccggcccccagccacccaggacggccgcgcgaactaccaggcccggcaggccccgctctggtccctgcggcgcctgccggtagctgtagtccggccgtcgccccgagcccgcgcatcagcgaccctgcggactacaaggcccgtgaggctgtgcgcgggcccgcggactacaaggcccgtgaggctgtgcgcgaggcccgcgcccccgcccttcgtccttcccgccgcccccgctcgccggcccaccgccggcgccccgcccgcccccgcagcccgcgcccggcgcccggcctgcggctacctatgtcgatggcgaagcgcttggcgttctccaggttgcggaagatctcgtcggggggcagcgtgatgctcttgtccagactgtccccgctgctcccgctgccgctcgctccacactccgccattttgaaagtgcccggccagctcatcagccatggagatatatgcgcatatatttgactgccaaacgccccctcgcatagattatgttaatgaggcgccggccccgccccttccctcccccacccccggcctctgaggtctcggccgctacagggcgagctagggccagtgctgggcaggggtccgagaggcccggggctgcgggcgggcgggcggttatcctccagagatcgcgcatcagcacagaacatctggactgatgttcttttaccgcgctgtccacaggcttaactcaagtgctctgagccctgctgagggaggccgcagaggccgcccacctgcttctaagggggcacgtgggtctgcagactgtcagagagccctgcccttcagcgagtgcctgctgtaagcttggccctgcacgccagggcgaatgtgatgcgctctttgctagggtgactcaatcctggcttcccaggggcgtgggactttcaatgttaaaagtcccatgcaaaccagaggagtggggaaccctgccccacctgggaggagccccagcctggcatgcacctgcgggtagggaagatgtgtgctgtaatggcgatccgtggaaagtgctgtggtcgggggaagccaggcaggctgcctgtgggcaagacaggtgcctgggaggctgcaggaacaagccttggaagcagctggagccaggacaggggtataggtggggcaggccagggttccagggtgagtggctgggaagccctgctggcatgaagagatgcgtcttctccagaggctctgggcgccttgggaaaaagcccagtgttggaagcagacagatcagcccctcccgggtaacccggggtcattactgcatgtctctggccctcagcctctgtctgcacgtggagaatgccaccagctgcctggcagggctcctgggagcacaggcctgtggggcggcacaaactccagggataatgcatctgtgtgcgcagggcaagccttcagggaggaggcatccttgcctgtgtcttccaagggggtgggtgtgtggctctggagggggagcctgccccagggaggcctgggtggaagagtggagcacaccccaggcggcttagacctctggcagctcagacccctggcagcatggtgtgccatgggccaggctggcaggaggtgccctccatgaggggcgcccacctgtgtgcccactgaacatgcgggaaacatgcaggtgaatgggggccttccctgtcctctgcccaccataccccggggctcggtagggaccactggcaggcactgggttggtctggtggggggaccctgtctagactgcctgtggagtagccagaaaggggctgaaggctgagcggagcgagaggggctgagcaggaaggagcaggcagggcaggcccacacacggggctaccattcagcgggggtgggaatgcggcccactccggcccaatccttgctggatggattttgccccttgggagctggtccctgggagccacaggcctcagttcttgcagactcagccaacaccctgtggcctgcctaaaaatacatgccctttctgaggcaagggatggccccgtgcaggctcctgccaggactgccagatcctgccttggcacggtggccagcgggcaggtgtccccggagcccatgccaggactggcgctgcaggccgtgggagtgtgcagcagcaactcggggcaaatgttttctcctgtttggcccagggccaagcccctttggctgtagcaacagatctactgcgggctgtggccctgggtcgcctctcagtggacacagcctaaggtcctgcgctgtcaccttgccccacccctaccttccggaagctagtgaaaggcctgggcggggggagacccagggctccgaccatgtccacccctccagcccacctccccctgcccctgcccctcacctgctttccctccatccctccctccccctgttcttccggagcaaggaccccacccttcttccggggtccagggggccactggcaggggtccctccctgcttaactgctaccatggccctgcccattccccttcacccctgcagacccgctccatggctgccaaggacaggcgtgaggcacagcagacgacactgtgttgggggctgaacaatcagattttattatggcggcttcggagcagtcccgtggcttccacgtgactgagagttcaatttctgagtacaaagtcgtgcccacacgcatccacccacacagaggaatcctttaaggatcatagtggaggcacccaccctccccagacagcccaccgtgagccccagccagaccaccaggcacactcaggagccttttggccatggccctcagggtcctggacgcccgtccggggtgatcactgtttcctatgaggatacagctcgagttcggccttcacaaaaggcaaatgtgcccgcggcacagcccgcctgccaggggtacgcccagcagctacgggccctgaagaaagtcctctacaggctgggggcagcagtgtgcgagccccggcactacaaatatcatagaaccccgggcggccggggacttcccagaagtcacttgcttaaatgcaaacacagaacaaccccatggggtcagacacttggcagaagatgggccctgattgtcctaaaacggcagggactctgcacacacattctctgagaatggggctcctgcgggccggccagcttggggccagagccttccggagaagggcgcgtccaagcccggggcggacgacggcgggaaggcgcttccctacaggcgagaggagcaggctcgccctctggtcgtcgggccgcgcgcccgcaggtcccgccgggtcaccagggccgccagaggccgcaggcgggctggtgcgcggcggcggcggcggcggtggccttggcggagagcgcgggcgggggcgcggcgcccggcgccttgggctccttggcgggcgcggcgggcgcggccgggggccgctggaagtggtacagcagcttcatctgcgtgtcgctggcggcgtggagcgtcaggaactgcacggcctcctgcaggcaccacgagtagccttcgctgtagtcctggtgcaggctcttggggccggcggcggcgacgaaggctgcggggagacgcggcggcggtgagcgggcggcggggcgcgggggagccggggcgcggtgggaactcggggcgcggggggcccgggcgcgctcacctttgctgtgcttcaggtagctgacagccatctccaggatgtcggccttctccagcttggagttgggctggtgccgcgcgaactcctgctccagcagcagcttcagctgctcgatgctgctgttgatgcggtcgcggcgcatcttctccaccaccggcttccgcagctgcgggaggagggggtgtcaggctggcccggcacggcgcagggacccccgaggaccggaggccgcggggacagcgcgccgggcgagtctggtacttactcggtttttctctttggggctgagcagctccacggccacagtgctgggggccatgcctggcgcggaacaggcgacgaggcgacgcggggaggccgggcgagacgaggcgagcgggcgcgggcaaggccaagcgcgtcccgggctggcgcggacaccggccccgcgcgccgacgccctatataggcgcgggcggcggcctggcgcctggagtccgggcgccgcggccgttcccacactccgcggccaatggccgggcgggccgcacaaaggcgccggcccattagcgcacgctaaattgcctgtgaattggcgcgggcacaatgggcgctccccaaggagcaggtgggccgcgcggcacaatgtccgggctgtgggaacgcgctcgccctcattagcatcccggggcctgatgccgggagccccgcgcctcaatatgctgccttttcccaggccgccaaacgggaggggggcaggaaggagggccccctcccccgccctcccctccgctcccctcccctgcctctccccagcggcttcccactgctggctggcagaggccgtaggagcagataagggaaaaactgtagaatgaacaagtgccacggcttcctgggggatgggcaccttccctgactgggacctgctgcccctccaggggagggggacagagggggcgacgctcttaggatcagtcctacgtgcctatattacaagccccctgactgtcacctgggactcctgacttctccagacctagaaaatgggccttgtgccttcctggctgggctccgggcagctccaggaagctggggcccgtgctccacgtggagcccggcacccggcagctctccccgcggagccgggcacccggcagctctccccgcttcctgcaccctgtcctcccaggagcactgtaacccacagcagcactggggctgctccacgagctggcaggtgtccctcaggggcctctccccacccctatctggccagggatctgactacagtgtccacgcagctcgggaggcctcggctcttggcatgcttgctgtggccactgtttatgcatgccacagctccacctagtctctctggcagccagggcacttgtagggcttgctttcctctggcattttgccagtgggtagggagtgggtgccaggtggcagacttgaggatcagaggccatgccagccctagccccccgcccccaaccaccggtccatgggatgagctaataaccccggtacctggccaactgagctgagtgcccgcagccactttgaggcaatgaatcccaccctgggtccttaggggagggtcccttgggagacccccaccccctagcctgcggtcacagttcctcaaatgctctgcagcagagactaggagaggattcggggcctgggctggctcctagagacaggttgggaccctgccgggtcctagcggaagggccttagcccccagagctggggctggcatcagggctggttaggcagagtttgaatccaggagtggggttccctggccagctggcagggtccaatgaggagccttccccggaggctctcggcagtgacccccggctctgagtgactcgcttggtgggcctagctccaggaggtcctcagcacaaggatggacggtccagggggcagccaggacagtgctgggacagcaggggaagacaggacttcaagccaatgcagggtggctctcccacaggccagccggacaccattgtgaagggttaggctgggaggctcccaggcagaaacatcaggtgactttggaggtggcaggaagggagcccctattcaccctcgtacccccgctgtactcccacaacacctcccttgaaggggactcatgctccaggctgtcagagggaggcagtgacactgggggctgggactgctgggggctcatctctgagcaggtggggtcccaccacaacactctggcccttgatggatgcaggagggcaacccgtgtgggggtgtccaggccacgcgctcacgccatggctcccacagctctgggcattgatggcggctggcactggctaggggctctggactcccggctacacaggggatctggttgtgttcagtggagctatttcgcagctgaagtggggttcatgctggcggcagtcacattgtggcatgtcccttgcctgactatgggctccctggggttggactgggggtggggagggcaggacgaggtagtcacccgtgtgcccatgacctatacgctgctggtccagcggccacatcaaggaggtgcttagccaggggctaggggtgcgggagcacgggcaggtggccccagcccaggcaggccctggccagcacctccgccagcaggaaacggaacctgagccacgtgtgccctgaccacccagctgctggcagcggggacagggcctgtgcccagatatgggggtggcactgaggccaggccctgctcccgcaggctttggagcggcaggtggctggggcttgtgtcctgtcctggtcccttcccctgagccagctcctcagcccacaggagacacgtgccgccgggagatgtggtccaacctccccacccccacggcccgcccacccgcagtgggccaggatggcggcctgccggaggtgagggtggtgggtgggctgtgtgggggctgctgcctcccgcctcttcctccctccccctggactggagcagctttgatccaattttcagttgtgggaaatatgaaatgaatggtgttgaatcctggccggatgaaaggctggttccctccctgagttcgggccagatggcagctctggcggcctccgaggcacacgcctggcctttgtgggccgtttaacactgtgaatggggccaaagtgtgggaaactcactaggctcccggctcacaccatccacggtgggctgcggagggggctggaggagggagggctggaggctgctccaggctggcaggctctgctccacagaagcactgtgaagtgttggggggctgggatcctccaccttggctgcccccagcagctcagcgtgggatgggggtgttcttgccccagccgggctttgaggagggagggagtttgtcctgcctgcacctccctgagcccccaaccctggagggctcagtaagtctaaggggcttgatagttggggtggggttggcacatctagagttggtaatagtcctcctgcctccacatacacagacattgaggcagggcactttgctgtctcaattcacgatgctgtgccaccatcaccactgtccatctccagaaaatgtccttctctccaagctgaacctctgtccccatgaaacatggactctctattctcctccacagctcagcaactgttgaggcagggggccttcaggcaaaacctacaagttgggcatgattaagctggaatgcacgcgtctagaaccatgacccatttctaaataatccacacgcccagcaccactccctccagggctgacagcaaagcgaagagctcctcggaggggaggggcccgtgggggtggggggcgatgggaagctccaggggcatttgctcccagctccaaagcaggacgtggtgctgggaaggtcaaacggcgcagacactagaaaacagcttggcagttcccccaaaaatgaagcacagagcaaccataggacccagcagctccacttctaggtccatgcacaagagaatggaaagcaggacctgggggagttatttgggccctgtcttcagagcagtgcggttcccaaacccaagaggcggccgccgccccattgtctgtgaacaaacaaatgtggtccttccacatagtggaccgttcttcagcctcagaagagaaggaggttgtgacgcaggtcacagcaggcctgcaccttgaggacactgtgctcagtgacataaagcagtcacaaaagggcccatcccaggtggtgccattgtaggaggcccctagagtcgtcagattcacagacagaaagtggaatggtgggtgccaggggctgggagggactgggcagtaagcgttcctggggacagaggttcggcttgggagatggacattttctggaggtggacagtggtgatggtggcacatcacgaatgcttttcatggcatggaactctgtgctgagaaatggctaagatggttgttttatgttatatatattttgccacaactggagaaaacaaaaaggaggagcttttctggagaagaaccacgaactccctcctgctgccccctccccgcccaggcagtggcagcccccacaatccttcccaggccctgcctccagctgaggaagtaggtgtggtgccgggcacccccgacctggtgttcctgtccccaagggtttccagcttggagtgtggggaacaggcaggctggcgggggccaggagccaggctgacctggggaaggagggtcaggggtaaccatagctcccagcttcttcctcttccagcccctgaagcccttgcttgggggcctctgggtggaaactctactcgaagtctgcaaaacgccctgctgcctgggaagtcagttcagggagatggccccgttccagatttcagagacagcggcctcccccacatccaggacccctgcctgaacagtggccagcactgcctgccattgccctgggcccatccatgcatagggctctgccctggagccaggccaccccccgcatcagcagccagcccacctgctgcaaggagccacccagcttgtctccccagctgtgaacagatgcagccggaccaggtgtggctccgagtctccaccctcggccagggagggcacctgttcatgggaggtggagtggctgggagaggtttgagatctctccttggggctccaggcgggagctgcagtgggggagggaggaagagtcctcaggcgctgagcatctgtgaatcaccaggcaggtatggaacatggaaatccgacttcctacaacagccctccctgcaaagtgcgtgggcctgtgctcactctccagctggggggctgggggcaagagggtcacagaggttaagtgacatgcccaaggtcacatgtactctgggtcagctaacaggaggagtcaacactcgagtatttattatgcacttcatgtgtacttgccagtttagacttgactacgaagccaggaggtaggcactgtttattttctgtttacactgagtctgcagcgcagagaggtgctcacaccacacagctggtgagggtctgacgtgagacggggacgtgtggtggtgcgccccgtcttcttcctgaggagctgagggaggtggggtggtgggaagggaggggtgtgcggagctgggggagggagcctggggcgctcacgtgcggggagccctctggcggggagggggcattggtgagggacggtgtggcctccccccgctccctgcagccctccaccctctggcgagggcagagcagcgcatcgatccgatcagtgctgggagctggagctccagatggtgggtggcctgcacggacgtgtggacaaagggaggctgtagcatgaaggcggccagcgaggcacgcgcgatgccctttgtcaccagggaaggccgccaggagcgcggagtgtgggaaccgccggctctcgtctttaggggtgctctgtgggggtggcgcaccaccatgaggccaagaggaaatcctcggccctttccacgccctggcccctctgctaggccggtggtggcctccctgtggcctcagttccttgcacccctcccctcctaaatgaagaactggaccaaagacctgggtccagaaatggggctggttccagctcctccccacagccagcccccctcagtgggcagcttctctttcgttggtcagcagatgcttgagcacacatgctgagctgggactgaggctcctgcactgggggtaggggacactcttacctgtgggagatgccttgagggtgtagactgggcccggcatggacctgcggtgaagccaggtgcaacagctgagctggagcctgtctgacaccggtggcagagtcgggcagccgcacgccccccagcagagccaacacagttttggggacatagatttggttaatttttcatgtctgtgttttcttgaatgagcatttattacttgtgcagtttttgaaagggcttccccacacacagacacacgcacacacacagacaacacacacatgctcacatacatacatacgtgcatccacatgcataggttcctatgggaggaagtcattgcatcttcagaagggcgagaaagaatccctgaggtggggacaaaggggaaggtgggtgaccaagaggggcttccagagggaacggtgactaaggagggtgttggcgagttctgcttgaggagttctgggaagcaccttccaggcagagggcactacagggacaccagcttggggcaagagagaccag

SEQ ID NO: 459 - DNA, 73045 bp, Homo sapiens
ctctaacaactcccgactcttcggagttgggaggggtggtttgcctggaaccagcttctgcttttcctgtacttctgggctgagccaagtgtcaacagagaggaaagtcattcagctctggggtcctgacaacaagttggttgaccctgcggccatgagcagaactctcaaagtcatgtcacccaagcgagactcgcccatctatcctatctatcctgacccttgcctactgggtcctaatgcctgtcagacaaacttcctctcctctctcttctccaaggctagtcctgcttctaaaaaccactccttgcctctggtgcttttctagtttctcctataagaatgatttctagtataaacttcaggactctattcccttctttaggcacccagactcaccaaccagaaagacataatttttgcccaaagctccatcatagcggggactacctggaattttaggatccctcctcagacaagcaggcctaacaaaagctattcctgaagctaggatatggggagcctcagaaattttatccttcctattcatataagtgaggacaaaaggcatcactcttccaactctggagttcctgtccctccctcagggtatggccctccacttcatttttggggaaaaacatctttataggacacaagtaaagtcccaatactaacaggagaatgcttaggactctaacagtttttcgagaatgcatcggtaagggccactaaatctgatttttctcggtcctctttgtggtctaggaggacaggcaagggtgcgggttttcgagaatgtgtctgcaagggccactaaatctgaccttccttggtcctccttgtggtctaggaggaaaattagtgtttctgctgctgcatcagtgagtgcaactattctgatcagcagggtccagggactgttgcgggttcttgggcagggggagaaacaaataacccgtgggtggtttttgtctttcagatgggaaacactcaggcatcaacaggcttacccttgaaatgcatcctaagccattgggagcaatttgacctgcaaagcctgaaaaagaggcagctcattttttttctgtactacggtctggccccaatattctctctctggtggggaaaactggccacctgagggaagtataaattacaatactatcctgcagcttagccttttctgtaagagggaaagcaaatggagtgaaataccttatatccaaggtttcttttcattgaaggagaacacacaactatgcaaagcttgcaatttacatctcataggaggacctctcagcttacccccatatcctatcctccctatagctccccttcgtattaatgataagcctcttctaatctcccccacccagaaggaaacaagcaaagaaatctccaaaggaccacaaaaacccctgggctatcagttatgtccccttcaagttgtagggggagaggaatttggcccaacctgggtacatgtccccttctccctctctgatttaaagcagatcaaggcagacctggagaagttttcagatgatcctgataggtacacagatgtcctacagggtctagggcaaacctttaatctcacttggagagatgtcatgctactgttagatcaaaccctggcctttaatgaaaagaatgtggctttagctgcagcctgagagtttggagataactggtaccttagtcaagtaaatgacagaatgacagctgaagaaaggaacaaattccctactggtcagcaagccatccccagtatggatccccactgggatcgtgactcacatcatggggactggagttgtaaacatctgttgacctgtgttctagaaggactaaggagaattaagaaaaagcccatgaattattcaatgatgtccaccataactcaggcaaaggaagaaaatccttctgccttcctcgagtggctatgggagaccttaggaaaatatactcccctgtcacctgactcactagagggtcaattgatcctaaaagataagtttattacccaatcagctgcagatatcaggggaaagctccaaaagtgagccctgggctctgaacaaaatctggagacattattaaacctggcaacctcagtgttctataataggaaccaagaggaacaggctcaaaaggaaaagcgagaccagagaaaggccgcaggcttagtcatggccatcggacaaataaaccttggtgattcagacaggacagaaaatggagcaggccaatcacccagtagggcttgttatctttgtggtttacaggaacactttaaaaaagattgtccaacaaaaaagaagccatcccctcgtccacgtctgctatgtcgaggcaatcactggaaagtgcactgctccagggtgcaatggttctctgggccagaagcccccaaccagatgatccaacaacaggactgagggtgcccggagcaagcaccagctcatgtcatcaccctcactgaggcccgggtatgtttaaccattgagtgccaggaaattaacttcttcctggacactagcgcggccttctcagtgttaatctcctgtcctggacaactgtcttcaaggtccgttaccatccgaggaatcctgggacagtctgtaaccaggtatttcttgcacctcctcagttgtaattgggagactttgctcttttcacatgcctttcttgttatgcctgaaagtcccacgcccttattaggaagggatatattagccaaagctggagctatcatctacatgaatatggggaacaagttacccatttgttgtcctctacttgaggacggaatcaaccctgaagtctgggcattggaaggacaatttggaagggcaaaaaatgcctgcccagtccaaatcaagctagaagatcccaccacttttcctaatcaaaggcaatatcccttaaagcctgaagctcataaaggattacaggatattgttaaacatttaaaagttcaagtcttagtaaggaaatgcagcagtccctgcaacatcccaattctaggagtacaaaaactgaatggtcagtggagactagtgcaagatcttagactcatcaatgaggcagtaattcctctatacccagttgtacccaacccctataccctgctctctcaaataccagaggaagcagaatggttcacagttctggacctcaaggatgccttcttctctattcccctgcactctgactcccagtttctctttgaggatcccacagaccacacatcccaacttacgtggactgtcttgccccaagggtttagggatagccctcatctgtttggtcaggcattggcccaagatctaggccacttctcaagttcaggcactcggtccttcaggatgtggatgatttacttttggctaccggttcagaagcctcatgccagcaggctactctagatctcttgaactttctagctaatcaagggtaaaaggcgtttaggtcgaaggcccagctttgcctacagcaggtcaaatatctaggcctaatcttagccagaggaaccagggccctcagcaaggaacaaatacagcctatactggcttatccttgccctaagacattaaaacagttgcgggggttccttggaagcaccagcttttgccgactatggatccctggatacagcgagatagccaggcccctctatactctaatcaaggagacccagaggacaaatactcatctagtagaatgggaagcaggggcagaaacaggcttcaaaaccttaaggctggccctagtacaagctccagctttaagccttgccacaggacaaaacttctctttatacgtcatggagagagcagggatagctcttggagtccttactcagactcgtgggacaaccccacaaccagtggcatacctaagtaaggaaattgatgtagtagcaaaaggctggcctcaccatttacaggtagttgtggcagtggccgtctcagtgtcagaggctatcaaaataatacaaggaaaagatctcactgtctggactactcatgatgtaaatggcatactaggtgccaaaggaagtttatggctatcagacaaccgtctacttagataccacctgctactccttgagggactggtgcttcaaatatgtacgtgcatggccctcaaccctgccacttttctcccagatgatggggaaccaattgagcatgattgccaacaaattatagtccagacttatgctgcccgagatgatctcttagaagtccccttagctaatcctgaccttaacctatatactgatagaagttcatttgtagaaaatgggatatgaagggcacgttatgccatagttagtgatgtaaccagagttgaaagtaagcctcttcccccaaggaccagcgcccagttagcagaactagtagcacttacctgagccttagaactgggaaagggaaaaagaataaatgtgtatacaaatagcaagtatgcttatctaatcctacatgctcatgctgcaatatggaaagaaagggagttcctaacctctgggggaacccccattaaataccaccaggaaattatggagttattacacgcagtgcaaaaccccaaggaagtggcagtcttacactgccaaagccatcagaaagatgagggagaagaggcagaaggaaaccgtcgggcagatgctaaggccaaaattgctgccaggcagaacctcccattcctgcaaaaaactgggtctttaccaacttaacataccaccctcgttttgaaggaaaagaccctttccgacttctaaatatgcaatcattagccaacttccccatctctgataggaccaagaataccctaacaggacatgcgatacaacttttgcgttcttacatttccaacctcacctattacacaagcaatgaaaagcccatacacagccctgtaactacaaataccatcttaactttccaagcccctttatgcatccaatgcaacctgttatcaggtctgctcctggggcacctactaccacatcagtgtaattacaccatacaacttcaagccccaactgatcatagtaacttccaagtcactcaaacagctccattcagacggcttgtccacgtctcaggggcccccaaaatcatcacctcctccctgcttaacaaacagtccaggttttgtaatggcaaacatactctctgcatgaccattcacccctggaccccctgcagcagtatccccaccactagtgaatgccatctcatcccctctttcaatcgctctctcgaatggttcctagtagatacaaaatggttttttctccaatgggaaaatagaacacagggagccactcagtttgctcccaacacccctttccagccactcatagcagctatcttggcaagtattctaggagtataggaaaatgaaaacaataaactcacacacctttataacatacacaaccagttctgtctacccagccaaggtatattcttcttatgtggaatgttgaactatatctgccaccccactaactggaaggcacctgcaccttagtatttctaagtcccgacattaacatttccccaggaaatcagaccctatcagtacccctcaaagctcaagtctgttagtgcagagccatacaactaatacccctacttatggggttaggaatggctactgctacaggaaccggaatagtcagtttatctacttcattatcctactaccacacactctcaaaggatttctcagacagtttgcaagagataacgaaatctatccttattctacaatcccaaatagactctttggcagcagcgactctccaaaacggccgaggcctagacctcctcactgctgagaaaggaggactgtgcaccttcttaggggaagagtgttgttttcacactaaccattcagggatagtatgatatgccacctggcgtttacaggaaaaggcttccaaaatcagacaatgcctttcaaactcttataccaacctctggagttgggcaacatggcttctcccctttctaggtcccatggcagccatcttactattacttgccttcgggccctgtatttttaaactccttgttaaatttgtttcctctaggatcgaggccatcaagctacagatggtcttaccaatggaaccccaaatgagctcaactaacaacttctaccgaggacccctggaccgacccgctggtcctttcactggcctaaagagttcccctctggaggatactacaactgcagggccccttctttgctcctatccagcaggaagtagctagagcagtcatcacccaattcccaacagcagttggggtgtcctgtttagaggggggattgagaggtgaagccagctgggcttctgggtcagatggggacttggagaaattttctgtctagctagaggattgtaaacacaccaatcagtgctctgtgtctagctaaaggtttgtaaacgcaccaatcagtactctgtaaaaacacagcaaccagcgctctgtgtctacctaaaggtttgtaaatgcaccaatcagcactctgtaaaaatgcaccaatcggtgctctgtgtgtagctaaagttttgtaaatgcaccaattatcactctgtgaaatggaccaatcagcgctctgtaaaatggaccaatcagcaagatgtgggcggggccaaataagtgaatacaagctggccaccagagcggcaagctgctcagcttcccttccatgctgtggaagctttgttcttttgttcttcacaataaatcttgctgctgctcactctttgggtccacactacctttaagaacagtaacactcaacacgagggcccgtggcttcattcttgaagtcagtgagaccaagaacccaccagaaggaatcaattccggacacactattttccaacaagttctccatctggcttctattttaaattcattaaaagtaggataacatcatatggaatgtaaaaaattgccaaaactgagggcaatttatgcaactgctgagattcactccagatcctcagaggaacttgctatgtaatgaaaaaagagatacacaatccatcatcccatcacaggaggcaaaatgaactaacttctaggccagaggagagagtaacaagggagggaaggattcattacaactggaggatcctggaaggcttcctaaaaagggggcatttgagcctaaaaaggggccatttgagcctatcggatgattagcttttggcaaggaaagaagggaaatggcacccatgatttcctgactcccagaaagcccctgtcccagctctgaatgtcccaactgacacattctcccaggccctacttattctctgcacctcccttggtataccccacttttcacaataatcactctttctaccttgcattatagttaattgtgtgcatgccttatttctcttgctaagccataaggtctttgaggaaatggaatccattcacttcatttctgcttccccatccactgagcccagaactggcccatcaccagcctctaatatatgcctggaatgtatggataaatgagtgtgaactgggccagttttaaaaagtgttcagattccttcagacatttatttaataatatgaattaaaacatcaactctgtgtgaggcatttgtgctaagtgttgaggataaaagtggtacacatgggcatgggcctaccctcaagaagccgatcacataaagtggtggcaaacactaaataaatgaataaatatttgttgagttgcaatggtgactatttttaagaaggaaaaatagagaacaatgacagatgaaatgtacctagattcacaaggtgccaggcactgggcactacccacgtgttaactcatttggtccttatcacagtcctaagaggtacaacctttttacagatgagaaaactgagacacaggagagtcaaagaactccccaagactaatagctagtaactagtgtggctagtattatgggagaatttcacaaagggacctaatctagtctgtctacttagggaaggctttcccagggaagtgacatcaagctgaggccagaagggtgaataaaggtgggccaggcaaagaggccactgtggggagtgttttgggtgggaaggcctggaggaggccaagggcttagctaacttgaagaactgaaaggaaagcagtgaagctggtggtgaggtaggcagaggccatgctaagaaatttgtattttatgctaaaaacaatgtacactttaagtagaaaagatgatccgactggagttttgaaaagctcatcctggcagctgtagaggagaatggagggggaccctgtctcacatatttcctatatgtggttaggagacaggatggtgagttgaattgggtattggcagtgcaggtggaggggtgtcagatttgctatatttaggagagagaagcaagagaatttgaaaattggttatggcagctgtgagaaatggagtgttgaagatggtgctccaggattccgacttgggtgcacaggtggctggtggtacatttagtaagatggggaagatggagttcaggtttaaggggaagatgaagactgaagtcctggccgttatgagtttgaagccctatgagccatctacgcggagagagctgtatacgctcttggatgtgtgtttagcggccaggctggggtggagaggtacatgtgggagttgaggcttgtatctgtggacccacagagaagggagccaagccctgccccaaggagccctcatgtttgcaggtcctgcctgcttcaaatgttactggtgataacctacatgtcacatttgacagggcttccaaactaagccatctaagaaaggtcttatgattcatggcttagatcctgtccctgagtaaaaaatcttactgtgagtccttcaaatccttttgtcagttcctcaaactgctgatgtactgattagtatgtaaaatactgacattgaaaagaacactgacttgtttctgaatcatataaactttgattttcttgtgcacaaaacattttagcctgtatgttgtcatctgcagccagtgactgtaacctgtgtaccataccctccgatgaaaaaaatcccacctctgatataaggggtcctcctcccttttcctaaactttcttctaaaacccttccaacgtgtaacaaattttgaaacatgcccaactttgctggtaagtcttcttgggtggatcctcacatttagcttccaataaatcaaattatttctacttcaacagccttaatttccgtggacactggtcagagtatttcctcctgtctttccatcatccacttcctatgagctgttcagaagcagctctctgcagccccaacacccacctacctgcaggcccccctctctctgctggctcccggaacaaggctctgattgggatggcagaggaaagagaaacgggaccagcagcgctactcaggcctcgaaactccacactcactaccgtttccgcgccaccctctcacgcggagctcctggaagggtccagcgctccctctgcaaggcaccgtcggtctacaccgctcgattggccttttatggcactgactgttctttgaagcttttgcagctccttctaacccgatttcaccgtgttggaaatgttgggggtggggcgtaaagggggccatcccatccacagaaagagtcgcttgcagaaatgattttaaaactcccgggtgccaggacgtgaggagaatccggcagggagggacgggagaatttccaaaggtgccgctcagtgggaaaatccctttgtcagagagtggcccgaggggcgcggaatgcagccgcgcccaccccgccccgcgtcaccgcgtcttccggaagctccacgcccctgggtacttggtttccccgcatggttccggaagagcgcggcgcagctggctgtgagcgcagggctatcccggcggccgcttcggcagccagggcggcgcggaggggcagggccagagggaagcgctttgttccgcgcgtggttcccgcgcctgggggtgcgcgggagaggcgcgaatccgagtgccgcgcgcggcccggggacttgcacgggcgtgcggggtggaaccgcaggaagcggagctctcgggttcccgccccgccccgccccgccggcggcggaggcagcgagcgcgagagcccagcggagtcgctgggagcctgaggcaccgagacacaaaggcaggcgggatgcgggagcaggcaaagggaaagcgaaagccgcgcgcccggccggtgactgggtgaaggcgccgcgcagctttcccgacgccggctgtacccggacctcctggtcgagcctggcgcgccgcagccatggccatcgctcaactggccacggagtacgtgttctcggatttcttgctgaaggagcccacggagcccaagttcaaggggctgcgactggagctggctgtggacaagatggtcacgtgcattgcggtggggctgcccctgctgctcatctcgctggccttcgcgcaggagatctcgattggtaagcctcgcccaggacggaggggagtggccgccccggtctggcccggtgagctgcgattttacggctcacaggcccgagtctgggtacgcccagctgtgatggtcgtgagcgtcaggaagggcagtggccccagttttatggtccaaagcgttctttgcccaggtgtttcattggtaccctggtctactctgctcgcatccctactcctcagttcttttgttcctcatgcccctctgatcggactgtggcttatagtttatgttccacccttagaactggcaccttgccaccagatttgccaagaatagctgtgtccccgtttttcacccctgtctcctacatatttgtccagccgcctaaaattttacaccagagaagttcctgagtggctacatggaggatgtgaagaccggtgctccatgagaagtgtgttctttcagtgtcttacatataattggtatttgctgagatcttagctctctagggttgtgaatgataggaaatatctgcacttggcaggcattagagggatcctcaacttggacggtcttacaaatgtgagatgaacaagtccccttcctgtaaattatcatttgagcttcataacagttgtgtgagattggaaagtctggtggtttgggcaggatcacgtggctacgtgccttaccttcctcatcagctgttctgactctccacacaggagagagtgtttatgaaccaacaggaaggtagcgcaggagggttaaatacagttctgtggcaggggaagagagaggacccagtgcggctggactttgggaaaacttttgtcagagggtgggtgggatttggacaagaaggagtaagacctttgttaaggttttgagatggcagagaatgttatatgttcctggaaagagagacacagtgactctcctagccaaggcaggaggataagtcagagttcctggagtctgagagtgaatatgggcctgggtcagcctggaacagaagagtgtaggctgatggtttcagaactgtgaagttattgtttgagcagaggacagactggttgaatgatggtggcatttagggtctgggaagaaggtgagaggatggggcctggagggctgggtgccagagagcaaggcatcggctgaggtcttgtgcacagagggtgtgaagagtggaagaaaatgggtgggtgattgctgtgcgatcaaggagtaaataagcagcacttgagtacctagtatttaataggccatgaacggcagtactggtcaaacgtgctgcggaggttgtatgtctgggtgagtggagtgtggtgttggtggtgatgggaattgtgaagttgagggaatagttgattaggaaagaatgactatgagtgtgattttgcaatctgcagcactaagttgttcagcttggcaggaagttgccaaattcattgtggaaaatagtttttagttttcctgctctttgcgcaggcatagtcatcgggatgttctttaagtttccatttgacagtggattgaggcttccagctgaaagcaaaaccaccaagtagcatgagtcctggagataatctctccctttggtcaattcctccttcagtactggctgtgtgctgaactcggtgctgacctccaaggacccgggagtaaaagaggcatgatccctgtcttggaggtgcaagtcttgggtacctggttgggacagaaaggcaggaggaaggagttagtcaccctctgtgaccaatctccacctctagcacatgtactagagggactcctaaggcacctgtacctgtaatgccttagatacgtctaaattggtgggctgtctgagaggtatttttggggtattgggagtggttttaactagcaagagtttgagctcatgctgtgtgcatagcactgttgtgtgctgagggagatgggaaaggattttgagaccttgttcttgccctgccctctccctgccctgtggcagtttactatgcagttgggcactagaaggtatctgttagcaggtaagtcattcagctgtgtgtaattcagcacccagccaggtgttgagctatgagctccaggctggtgaaggttggcaggcacttgggtgaggagctgtcaagcagactcccatgttttctgaagtgttttcaggagttccaggggaggacagacatgtgggatgaagctaacaggaccagggaagacctattagattaggtatacatttagataaaaccagaagaagggcttttgagaagaggggagaggtacatagattaatacatggagttggtacagtgggagggatcatgtcatgcagcatttaattttgtgtagttagtagtatgcactcagccaaaaacaaaccaaaaaaaagaacagcaataaagggagaatgaagtaattgaaatggagctggcactttgcccaccatattggccagtgaactcaggccccgggaagacactgagataaggcctgcagacttaaaacatggcttcatccttcctctgttgataattactgcttccctctctggtgcttggaatactcttttgttgaacttaacacagagctttataacctgtctatgcatgttttgcatggagattgaaactactctataaacatttgttgtgaattaaaggtgatagcttttggcatcatcagaccttgctaattgattgttatgtgcatgatgctgtaccttggcaatggggtgtcagacacacgtaggacataagaatctttcctctggaagcacggtctagtagagaagttgaacgcataaccctcctaatgcaggattcatggaacctgggcagtgtcagaagtgtgtactaaagcctgatgctgtggaaaggcagaaggaggggtttcttctgactcatgaacagtgagagtttcagggcagagttggcccctgaggcaggattccaagtgtgtggagcagtgttggctgaagctgagacgtgtgagacaacatgtggctgctggagctttagtggcaccgtcacatggagaggtgggagccaaagtaagggtccaggggctccacatgaaagaaggcatagcaaatcccattgttttcctgtttgtgttgggggggtggtgtgtgtgtgtataaaattagaaacgagaaaatcagctgtaattacatgtttttcctttttccacctgtatgataaactagtatatataagaattcatctcttttgatataaaatcccctcaagcgtaaaataaattatattttccagttactttccaaaaattaaattttctgtcaactgttgtttgataaaatagggttcaagttgaaactttgtggcgatttttcctttaaataaatgattttttactttaaagaaaatctattaaatcaagaaatgtgcatggattgtgctttagatttaagagcaggttctctgtgggggtgggagtgttgtaggttagagagagggaatgtcctcatatgataaaatacttggcttcatattaaaggcttccgtttggtctttggccttttctcttagtagttcagcccactgggctcctctcagaaaagagggactgagcctgcctgggccacagagacccatgggcatagcagcaggctgatctttatcaagccctgctgggtgccagcatggtggctgcaggtgaagcgtccactcctcagaggttctggccccttccctcccacagcagttcacgcaggtcctgcatggtaggcactggtgtggggctacctgggctggtggggactgtgttggggacagagagcagaagggactctgccttgctcattcaccagatcttggtctggctgcccacaatcacaggttgagggtcactgcagaagtgatgtggtctggaggggcatggcaaggctggtgccatggtcaaggtggaggcaactttggtagtctttgcggcagccactcattggtccagatgtgccctgtgatagtgagaattacaagcagaaaccctcctgagggagtggcaaggagactcttctgagttgtgcctgggagcattttgaaggcttttggacagtgagatactaaggattgaatgtaagaactaaaatgtgcacctgtctggttaggcctgatacttctagtcagcctttctaaaatactgcaggtgtgcctcctctgagattcagctgggtagggggaaaataagtgacacacagcaaaagacagtttaattgtgagtttgggctagaaaggctgtgtggtgggagccagagaagggagaatcagtggtttcaccagccctcatttttccttcctcttgtcttctaccatgtcttgccctcaacaagtgctccataggaatttagtgaaggaagtgccagagcacactagggaactctcccagagtggctgtgctgagggaatggacggagtgttctggataagggtcccagttgcttggaagtgcgccctctgagtgccatttaatgatacaagtgctgtcctgggtcaggcctgtcctggccacctcccagacacctgcctctgatgatagcagtaaaggatgcacatcgtcatgataggtaagttgtcccacttgatttataagctcaggttatattgcgtgtgcctcagattcttttttatgttatttttgtgatgaggaagaatctgtgttcagagtgcagaatggtgtactgtggaagaaggatgagtgtgatctgtgtggcttgggtaccctatgggtgtcaccttgtgcaagctgctgggagacagtgccttgaggcccttcatttctaacacatctactctcagatgcctctagaagtgctgcacatttcattgatggggggagaggtttaggaaatggctgggcgacagctttgtgtagaatataagcatgattgcatgacgtgaccttcaagctctgaaattctagaagtatttctctaaagttatgaattcccttagtgtgctgcagttatggactgaatgtttgtgtctcccaaccgcaaaattcatatgtcgaagtcctgatccccaatgtgatgctaattggagatccctttgggaggtaattaggtttggatgagattatgagagtgggaccttcatgatgggatgcccttagaaaaagaagaaatccctctttctctcccccctccctcttcctctcccccctccctcttcctccttctctccctctttccctctctctcccactaccccccttcctctcttcttccctcttcctctctccacaagtgcggccacaaggaaaggtgtgtgagcacgctgggagaagggggccatctgcaaactaggaaaagagctctcaccagacaccgaatctgctggtaccttgatcttgaacttcccaggctgtgagaaaataactgttgtttaagccacccagtctgtgggattttcttacagcagcctggttgaagacaaaactatcaacagaccagactctgaatgggattcatgtttaaggggtcttttgacagggcctcctgtgccctgcgcttagggctgtacaaggcctgaggcgtcaggggctgctttgattccctggtgcctcatgtggcacatatcccctgggaaggagagcccgtgtctcctgccaggatgtttctggctggctggaccaggtggggagctggggcagccagtagtctactagggaaagggtgtctggtcagccggggaccctgcctccctcacccactgacctcttagtgggcagccaccgttctgggtagagaaggacttagtctttctgagttagcactgctcttttgctatcattacagggcaggcattgggccagccccagtgagtcaaaggatagatataactgcagctgcttccaatatagtttgcttggagttcccctttcatttcctgcaactgagtcagcggctgggtggcttaagttatctgctctgttgtggctgaatttagacctgtctttgggaatatcttcaggctgctttttagcatgtaccagctggcaaagcagatcgattcttttcagggttgtctatcagagtgggccaatatttagggtctcatggcataggtcctataatagaacatcttcaactcacactaaaccaaagagccaagagagactcctaacccctccagaaggatgcatgctgtccagagagtctactgttggatacatgttttactttgttaatatttttcttgtacaagtagtagctaaatacatcatcatggtaaaggattcataaatctctttcactatgtgctgaaggtaggtggacactttgtgcagccttattgctgtactttgtctgcattagcataacgtgtacaccttattttattttttaaaacaaatcgagtcataccatagtggcttgctttttctcacttagtatgtttggagagctttccgtgccagtacataggtgtcacctcactgttttataatagaacagtattccatagcttagaatatacttacaattcatctaagcagtcccctaatgatggacatttactttctttcaaaatttctactcacacataaagcttgtttgcatgaaaatcttcgtaaatatttctctcctcccagcattaaaaggaaaggagactagtcgcagcagtatcagtttccagaaggatgacatcattttccgaatagttttgcattcctgcgttcctatttgaaataagtggaagaaaaaaaaaaaccactgccctgtacactatccagctctgactccctcaaaatgtgactgcattagaagtttggaagaagcattttgatgtgctcttggttttaagaaagaaagggcctccttcagggggtagaattgcaactttaagtagaacttcatgatacatgttctcctaacactgtaagtttccttcctaacatttaccataacttgaagttaggtaattacttgcatacttatctgttgaatactgtaagttcatttagggcagggaccatgtgtccttaaaacttgatacatatcggccgggcgcggtgactcatgcttgtaatcccagcactttgggaggccgacgtgggcggatcacgaggtcaggagatcgagaccacggtgaaaccctgtctctactaaaaatacaaaaaattagccaggtgtggtggcgggcgcctgtagtcccagctactcaggaggctgaggcaggagaatggcgtgaacccgggaggcggagcttgcagtgagccgagatcgcgccactgcactccagcctgggcgacagagcgagactccgtctcaaaaaaaaagaaaaaaacttgatacatagaagtattaggcagctctcacattgctatgaagaaataccagagactgggttatttttaaagaaaagtttatgtggctcatggttttgtgggctgtacaggaaacctagtggcttctgcttggcttctggggaggcctcgggaaacacagtcatggcggaaggcaaacagggagcaggcacgtcttatatggcaggagcaggagcaagagagaatggggggaggtgctacacatttctagtggctcacacctgtaatcccagcactttgggaggccaaggcgagcggatcatgaggtcaagagatcgagaccatcctggccaacgtgatgaaactccgtctctacttaaaatacaaaaattagctgggtgtggtggcgcatgcctgtagtcccagctacttgggaggctgagacaggagaatcgcttgaacgcgggaggcagaggttgcagtgagctgagatcatgccactgtactccagcctggcgacagagcgagactccttctcaaaatatatagacagatagataaaacctgaaaataggccttaggaccttcatggactctaggtttggattagcaacatccctttaaaaaaccatgcaaacaccttttttctgcagctggttgctttcttggattgcttccttgtcaaacccctaactgaggcagcgagagcttggtccaaagtggagaaagggaggcaatttgggggcatttgccctggctaagctaggaactctgggcgaggcaggccccgctgcatgctgtggggtttctgggggcagcagggagacattagttacttggggagaagggggcctaaagagaatctaccatctgcttggtaccaggcacacctagttctgtggggggtgaaaggggtggtggggaggggacgctgttgttttttaataaattctctataaagctcacactcctttttaaaatataaatatttatatatgtatattatatcattataaagataaaacttactgtagaaaatatggaaaatacagaagagaaaatagcagtacatctataatactaccagggataactactattcttgaaaaaccaaacactaagtcaaggccatgttaccatgttcctaaattgttgtacatgattttttttgttggcagtgacatggaatgttgtgcacgtgtcaaaatttaactgtttcacaagttttgtaatataaatagcattgtgaagaacactcctgtacataataaaccacctctctaaagatctcagtatttcaagtgattgtataattctaattacaaggtcaaagtatacatagacatttttaagatttgactggtgtggttgggttgccctctggatagacccccaatggatacttctccccgcagctgaaggagtggctttccccacagctggcaaaagttagtggattatcgtccacagcttaataggtgaacaaaggtgtgccattgttttaagtcgcatttattcagttacggcattgaatgttttttcgtatgtattttttccatttatataattctgtgaattgtctgttcttatcttttgcttatttttccaaggggatgttggtttctcaatgggttttattaactatttctatgtttcaaatattttctagctagcctttattgtattttcttttccggttgtccgtttcctttgaattctgtttatgttaagcatttttgttttttaatttttaatttttgttggtatgtaaaggtatatattcatggggtatgtgagatattttgacacaggcatacaatgtgtaataatcacatcaggagaaattgggtatccatctcctcaagtatttatccttcgttacaaacaatccagttgtactctttcagttatcttaaaatgtaaaattaaattattattgactacagtcactctattgtgccatcaaatactggatcttattcattctatttttatgcccattaaccatccccatttcccctgacagccatccctcagtaacctttacagtataagttttgataagcagaagttattttaagtcatcaaaactacccatcttttaattatttcttcagttgcattatgattagactgtcatagcccatccttaggtctatcagttttttaaaatgatctttaatgattttatttgaacatttacctctacagtctgttttgttcttttggtgctataagtcaagactctagctgataatccccccattgtcatttattgaggaacccgttcgttattcattgatccttgatgatttcccaatcatatagtcaactcaagtaagtgagcctatttttgggctgtttatattgttccactggtctattaattttcatgaaaataccagaccatccattttgtcactgctttcatactggcttgtttttagatgtgagtagatacctaggtaaattaaagttataaaatattagaatcatgacagggaaactgaagctcagcaatctaagtgagtgacttgcttggcaccaattgtcacatcgccttagcagattaatttctcataatatatcagatatttaaaaggctcttgaattataggaagagcatcattatcagcaggatccttactggaaacttgtcaggctatctcactattggaccttttaaaatattgtagttatgaggaacactattttgatatataataaatatttatttggtctttggtttcccagcactctgctgatgaggtcactgatggcagtggtctcctggatagccttgtgagccaggcttgttgccaagggaaccaactatgtgattagagggttgagactctcagccccaacccctgacctcacgggaggggagagggcctgaagcctgagttgatcactagtggctcatgatctaatcaaccatgcctgcatagaaacccagggagagggttccgagggcatccacgttacatccacgctgggagggttgtgcatcccaactccatggggacagaagctccttcactcaggacccttctgaacctcgctctgtgtatctctttacctgtctgttcatttgtatcctttaaaagatcctttttcgtaaattgccaatagtaagtaaagggtttgccttagtttgtaagtcactctagcaaatgaatgaaccataggaaggggttgtaggaatcctcaatttatagctggttggtcagaagttctattactgctgttcttgtaattgtgggaagctgtaataaataatggatgggctaaatagagtagaaatgctttgaaaaagattacaacttccagatcggttcagaaagtggtgaatatttcagtatgaaggataaataggctatacatggacttggtgcttcagctaatgagacaggcccattcatgggtaccccatggctgtcctggggtgctcactgcatcagccccaggaggtcccctcaccttactgctggtgtggcagtggagggagttttccaggttaattttaatttgccaaatgtctatatatgtcgaagttcagacagtaagaggaaacattaaagccctgcccttttttatggacacacctcaatctcagtttcttccccagaggtaactactgttcctgtttagtgcatattcttttacagtgctcatttttttgcagtttgctcatttatctttaatatgtcccagagatatcttcatgttagtgcatgcagatctgcctcatctttttaaatgtgccacaattttccatcatgtgactatacctcaattcatttaaccgtctgtttatgggctagtatgttcattccactttttcctactacaaacagtggtttaatgaacatccttgcatgtgcttctttgtgcagaatgtgtttctctagagccgtggttctcaaacattttggtcttaggacccctttacacccttaaaatttcttgagaattccaaagagattttgttgtctattggtatttatcatattagaaattaaaactgacagacttaaaaatatttattaattgatttaaagtaaacccattacatgttcaggtataacatatttttatgaaaaataattataaaacaaaaacttagtaataagaatagcattattttctatttttgaaaatctacttaatatttcatttcatagtagatgactggattctggattctcattcattatgttgtaatatcccacatcagtagcccccaaaactgcactgcatacactcatgagagaacgagagtagaaaggtaagtaacaacgtagtatcgtgaacatagttttaatgtcgtgaacctcctgaaaaggtctcaggtttcagggtttccagaccacattttgagaaccgttgttctagtggggtttgaaatcagagggacaaaagttgtgcacattttaaatttaaaagacactttcaactgccttccagaataccagtttacactcccatcaccaatataggccaaccccgccctacttctttaccaatgtttaatactttcagagttttaaatttgccaatcttaatggttaaaatgccatctcattgttttagcttgtagttccctatttacactgggatttcatgagacacacatttctgggctcactgtgacacttggcggtgtctggtgactgccccctccctccccagtgcccacctttttctttggcctgggatgtttgatcctagagagactgacaggtctccgcttgttttccttggcttatgaaataccccttccttctgaaatccatcttaactattttttaattaatttttttaagctaaaatgtttttttcaaaaaaccctagttgtttcacttctgagccctctgtttcctgtttacatttagtcaactagcaaatattatttattaggaaatgtgaataatgattaaggcatgagttataaagccagacttcctgggttccaattctggcatggcacacattgactgtgagaccttggacaagttacagaatttctcagtgcctagcctccttgtcagtaaatggggcagtaatagaattctcacctgtgtcacagggtgagaattaaataaattagcgctcgaagcactggaacggtgtctggtacgtaggaagcactcagcgcaggttagctgctaaacatcccctaatcctgttttggccctttgacaggtgacgacctggggctgctggggttggggaatgtgtctggggcacacagagtggggctagagtgcattgctctttccagagcctgggttctcaggcactgctgtgtgctctctgccccttcctgtcgtgtgtctgcgggacacaggactgcgtggggcaagctcacagcccagctcagaagctgctggtttgtgctgggtctccggctctgctgccctaggattatcttccctaccccttggattcctgctggggagggtgcctagtctgttaagcgccaccaccaacctcaccctcagttcagcactgcagcctcagctggtcattaggaacatgggtgtatggattatagtaccactggggacttgaaaacacaaaacacagctcctcaccctcacctaccaagccctccttgcctttactcataaatttaagtctggacttcccagtctgtcaccccaggatgtcctttatctgaccccagcttgactgtgtgctccagacacagtggtctgcttcctgtcttaaatgggctgtcagctttaaggactcagtgttttcttgcgctgttttccaagcctaggttcccttctctcctcctttgagtacgaacatttgtcatggttcagtcattacccttatgtgatttgttttcatctacaataattggtggtttatatccttggctgcctccactggactgtaagcccttggagggctgagaccaagtcttctttatctttgaatcccttgcattgcatatggtaccatgtacataatagcccagtgaatgctttttgggttaagcgccacacagttgagctgagtgccttagggagaatacctgtgctctgttgccccgtgtagaaacgggaagaatggagccctggggagggcgtgctcctggtataaaggccatgtggcattaaatacccagctctgatgaaaaagtgtggatgtcccttttcttttttgaggttccttgaaaaagtgtttgccactctagcatctgcatctgtcatgagtttttgtctatttagaatgcccttgtttgcaaagagatctcatgaccagttgtctacataatagtaacagtcattgtaagtccttttcatgttgccagagtcactaatctttgtttcagtactgaatttaaacactcaaggccttgtcctacacaaaagggtttctttgtcgcaagaactacaaaatccagcttttaaaaggcatctttgagggagagatgatgcagaaggacttaatgaagttggatctagtttcaggctgtggcccctttaaatctaagatcccagttatccaaggaggcctgctttcatgatgtgtttgctctagtattgtagaggataagacagatgggtaaacaaataaatatgaaattcatgataagtgcatggaagaaagtaatagaggatgcgacaagggagccctccattcttctatctccagtgcttaccatgttgcctgacaaagaaataaaaatactagttcccatttactgaattcttaactgtgtgctggtactatagcagacattttatttaatcctcctgggaattctgtgaggttttactaataagaaaacctcagagaggttaagtaagttgctgggaagtaaaagagaaaaccgaatgtctattgaatctaatagaatcttttttaaagcaacattcaggaataaagactccagagaacctctatttatagaacacttacctaacttttcccctttaagctaaaagtccctcctccatatctttttttttttttctttttgagacagtgtctctctatattgcccagactggagtgtagtgatgggaacacggctcactgcagccttgacctctggggctcaagtgatcctcctgcctcagactcccatgtaggtgggaccacaggcgcacgccaccgtgcctagctaatttttaaattttttgtagagacggggtctcactttattgcccagactgttctcaaactcatggcctcaagcagtcctcccaaagcgctgggattataggggtgacccatggtgcccagtccccctcacccatatctaactggatttctgcttgtttcatgcacattaggcctttgtgtcagtgaagaccagctgaagagtaattttgttctaacccttcttctacttgaagaagtctattaaagctgccccttggccttaaatagtctgttcctttaacatttttctgaagtcaatccctcttcttctccctcccccattttttttccatcattcatttcttacaatgcaaaaaccaagaccaagcacatttcctctagtgaatgtgtgaccagtctggggttgctgcaaggattcacttcccagctctcacatgtcacattcctgttgtgacatttttgatgatgtcgtttttttgatctggccctttccttccatgggtccagcttctgtctccaccaggtgaactccacctggtgcccagtcccctccaccctgtcagcagtctttctgactccacacagagtagccttaggcgctctgggtggggttctcacactccagccattgactgcaggtggctagtcttgtcagctctgtggtttttaatgaacttgggcctagagctcgggaccaggtttctggggagattggtgctggccctttcttgctgctgcttgtgttacgggctggcctggcattccacagtgcccatccttctccactccacccagcctccatggcctgtctgcaccttctctcctccctggccattcatcctcagggtgtcataggtgttggggaaagagtatgaccacacactcagggctgaattgcaacttgaccaagtattagctgtcttactttacttaacctctctgagcctttatttctcctctgtaaaatgggtataatgatagctagctcacaggtttcttttactaggttgaatgagagaatctaattcctgtcttatagtagtattcagtaaataccgtctccccctgattctgtgatggaaaggagctcatatgtctgatcagtacataggggaaatgatatcaacataatatcatatcagtgtaactaatcacattggttatatgtgattttttccaacatgtgaatgatttgtgccatcaagtaacaacatgtggatgaagcaagccaaagaggactatagcgtgtacgtgatgccccgctttccccttggctttgtttgaccatgtgttccatcttagaaatgctgttatacagtactctctgctctttgtgcatttagtccttatatgtgtaacttggcagcctcaacctttctttatacaccccttaattgtgcaagcatgtttttatcaggattctagtgctgttggtttaaaaaaaaattgcatagatttttgagtgatctgccccaaacctatatgctccagaagcactgttattttcgtggctttgcagaacacgtttgtgaacatatcaatagttgtatagcagagatatttggttttcttttcttccttccatctagctttttgcattcatggtcatttcatggaaccacaatctttggcctgtaccaggctgggacctagaagtgatagaagagattccttgcagacatgtgctgtgactgtatcttcataccatctcctgagttattgcaatagattcctgtctggtctctgcttctgttcttgaccccagatagttgttgacatagtgtccagactaaaccgtttaaaacaaaaatcagaaactacctttgctttaagaattctgaaattattttgtgtacagtttgggattgagtaaatgaataactatagatactgttgggagccaggattctcactgtgaaagaagaaagaacaaacatgggatgggggaagatgaagaagaacccagtggtagtggattagaagtaaaagtttccatctcagtttacaattttttataaaagatttcttttctagtttctgctgaagggcctaggaacaatggcatcttagtaacaaggagcacatcgagcacccaaataatggttttaaaatttctttacccaccaaaaggaacccagagctctttgcagaaatggccagttgcagagtggaaacagaaagtagacgacaagcccagaacattttgtaccaggatccatgggactgctcaggaactgaggggaacatgtcgaaggacacaggagctagtttgataggaaccatttgaacatcagagtgaataacagtaatggattataaaatattgaataacaaaggattacgtgagtccatattgatactaaaaaatcaagagaaagctcttcttaatccattgcaactaatacatgtagaaggagcaaatcaagttggaaaaaaaatacttattttgcaaccacatttaaagtatttgattcaccactgggtgaaagtgtgttctgggacacaatattgaccctgtctgcgaggatccctccacagaccacttatcattgcacagggggaaaggcacttttacggcagaagagacctagcaggcagcaccttgactaagtgcccaccatagctgatgtcacccagttatgggggaaaggtcatccaatgctcccagggtgctgtcctgaggacccacagcccttcctcgggattcctgccagcaatgcagaatctggattggagtttggagaaacaatcagacagacccaaaatgaagagcattgcattaaacaggtggtgctcgccacacacattagggtcgcaaatgacagagaaagacagagaaagttccaggataaggtgactacagagataggacaactaatgcaatgtgtagggcaggactggatcctgcttggatgaaaacagttgctataaaggctcgtttgggagatctgactatagataattgcttgtatctggtattttaagaactttagtaattgcactagattatttaaagagaatgtccttgttttagaagacacacacttttgagagtaaagggtcatgatctctgcaactaactcccaagcggttcagaaaagtaaaggatatattatatatgcatagagagagagggtgtatggcagagtgttaacactggttgaatctaagtgctgggtatatcagatttcattgtaatagtcttgtaatcttttggtaggtctgaaaaaattttcaaaataaaatatttaattttaaatagatgaggtaaatagagcaaaatgtcagtattgctttaaactcttaggtgtctgttacattattttctgtatgtttgaaaatctgtatttatcatctgtaatctgatgacaaaagtaaaatatatatatttaaatacatccagtactttcatcttaatataacattgagttcttctgatgccttttttccctggtacccaggtcatgaactttttttccacccaacagtggtgacatttacattggaattatatgggttttttctgtggtttagaccttgtgggtgtgtgagggactggacttggtaacacagggaggaaacccctcaaactgctacttagttttcttgtctgtctattcttgtgggtgtcatcctgtcttcgtggttgcttgtggctgtcatctccagcccagcctccttctcgtttctgttgctgcacttagcgggctgcgttgttcataccgtcattcccaattaaatgagataagcctcgcaggttcccttctgaggcccagcaatgtggtcatttgctctctttggctgtggggttgagtggtcacatcatggaccacgcgtttggcaggtacagactattaattcttccctccatctggtgagggcagtgctgtcttgacagtgccgtgtctgatctgttggactcacaggggcaaaccattcattctaaaatgccccagagttatttgttgatctattcaacagggttggggagggaagcatctggggcttcttgtaattcatttaaaaggaaacatttgatgatgctcagctttagttaaggggcaggtgttagccctgatgtgttctctttaaaagccaggcttagctgtgggaaagaaagacctggtgaaccaatgtggtttaaaggaaaaaaaaaagaagtatttcaattccattttttagtttgggctgcggagggtacttatattttctcactggtttaaaacatgcatgtgcctcagagtcagttcccacagaagaaaagtgaaggcagtaatggacaatttgggacatccagaatatatttaatttcatgtgtttgaagctaaagatgggtttggattgaagtctgctggaaaggtgaaaggagaggaatttggcttgtttttagtaagagaagttattctgagattcttgtaacattattgtattttatgatagttgagaactataagtattgggcaagaatacccttcggggcaaacgtcatttggtcttagtatgttggggtcagaggtactttaaacaaattcagacctgtttcatccttctgagtgcttgttggtgttctgggtttgttttcagagctgaccactgtccatctcttctctataccacacattcagggtcctctttgtatgattgttctcactgagaatttataatagttttcagatcttttggcaaccttaaaatatagccagacctttcaagtctggtgctttatgggttgtaatataatctacttggatcccatatatatggggtatgtgtgtctataatttacattaaggtgaattaaaccaattttttgttgtgtaacttaaaatcatttcgcagacttttaaaatcatgtgtatatgctaatgattgtacttgatataatcatcatcatattctctgttttccctttgagcctccagaacaaccccaggattttctctcctggctccttccttctcatccctccattgctgacctgattttctttaataatttatgcctttcacctcctctttcttgtgtttaaaaggtagagagagctgagttgatatcccagcttcacaacccactagccacaagatcactgtgcctcacacctcactttcctcacctttaaaataggggtgaaagtacacagcaagggttagttcccttctcctgcctaggagcaggatctaaccctgtgttattaatgcatgagaatgaaagaaagcatgttaaaggagaggaacaaaaaaatggggggcgtagatcatagcaaaagtaagccaaagccctcctgctgaagtggaacaagaatggagagccatcccactgtggtgtctttgagaaacctctggcttgctcaccccagccccagtcctatttttctttaggctatgttactttctaatcatttataggtacaggtcaaggctacaccaagggccacctgtgctgctgctcaggcagaaggtgtgaccagcaccctatgctccaggtcaaggcacctggaggagggtggatggggagatgtctgtggcatggattgccacagacattatttaatggatgttgtggctacttcctctgggccttgtgagcacacgttttctcctggtgatctgttattatatttggccagacgtacataaatgtaaagcccacagctgcctctgcactctcagccaagtggaagtagtattctttgttgttcttggcataaacctgaaactcctttctttctttcctgtacagtaataaaaggcagtgcatgtcttgcaaaatctgttccctagaaattatagcacacacttgttaagctgacacacagtggagcagagcatggggctgtggctggggatctcatgggactctgttttctcacctatcaagttggacagtgatatctttgggggatactttaacattaattgagatagtatttatgatagtactttgaaactttcaaagcaccagacagatgttacttggtacacaatcgtgcatgaagttcagagacagaatatgtcttgcctgtaaaaccttgatgtagtactagaggagataagacatatatgtctatgtgacatggttcaaagtggttttctgcacatctctgatttaaagatgtgcagaaaagcactgtgggaagtcagtgggggaggaagctttgtgaagagggtgatgcctaagcagagctttgaaagatgagccattgaggaagatggtgtgtatggggcattgacttaacaagcaggttctggcaagagggcctccgggcagaggggatcatgtaaggcatagatctgagtgcatatcaggcctatacaagccacagccttcattgagttggattggagcattgatttggatttgtaacccaggcagtagggaaccactgaaaaatgttgagccccaggagtggcaagatagaactgagctctaggatgaataacttggcaacagtttaaacaggtggagaagggagagactggaagacttcctgactcagactacttggaaaactcacgaagatctaacgtgtttacctcccaatattatcttgaagagtaaatgagatagaggatgtggaaatacatttgaaaaaatgaatccggatggtccctgtcccaagcttcctggcccccggccccctggcagcagctgatcaccctgaccccttgcctttaggtgccttcaggcagcctgggtgaaggtgtgggctcagagcccagctgtgccggtcccctgtaccctcctgctttgcccccctcttcactcctgctcttcactccctatttgttgcctgcccctccctgcctggctcttgacatccttgacttggtttcccatttctggcctgggaatacccaatacctggggattgatgtgtttctttttctagaaatgcccttgacccttcccaggaagctgtccccttcctggccacttggaggaaccacctacttagaccacacccattccaacaaagccctggtccccaggagctcctccagggtggccttgcaggggtgactggcttagagaggagtgctgagagaaactgggagttggatacagatttaaatgaatgctgctaccattcactagcttgggtaggggattactgaactacttggagctttggtttactccaggggaaaaggaaaataatgatgtgtctctccatttggttgtgaggcttaaatgaggtaatgatttaaagggctggttggtgtctagtgaatatgagttggccactgccttttcttctgactttccattccagatgaagaccatttcttaagagcttcacatgtttctgccctcctctctctattttccttcttcctcttttgcaaaagctttagtataaaaagtgtagttatttctgctccaggagtttctactgctgccttgagggggaggtcctcgagatcccaagatagagcttgaagcactctttcctatagaaagaatgttaataaatgttggatacttgcacaatgaggactttgcctaaggaacattctgggccaggcaggctttcatgaaatcataacagcattattcattttcatgagtgagtacttggacagatattcccaagcaagcagcttatcagcatccttgccagaaaccatctgattgtaacctgaggactatctgtccccttaggtatttactgttgccctcataagccttggtaggtggttggcttaggaagcatttcacactgatgcgggaaccgtgtgagcttagtgccaagtcctgtgctgtcccgactactcatctttttataaaatctaagaacttaagtttaatgggataagacagtcagaagggaccttgaaatatcttacctgtcccccactcatatttaagccattcttgaatggcaagaactaccccattatagaacacttgctgatgtttgtgacttttcatgatgatttcctgtaaagcctcttgctgacaagtcctttcttgatggctgtgggtgcacaggcccctgatggggaagaaatgctcagggctttgccgcataccactcctaccacaagaatatactctcctgaaaacatctccatcacttctctcttgtaccataagcataaaggccactccctccccaggcaaagatgagtgtcgaggccttttatgtgccagggattagggaaatccagctccgtaacttcccactgtccctatcattgctccatagggtgggaagggagaatggtaggcacatcccagtctttaaggcaatatgagaatctacttgttgcttcatctagaaaaatgtaacactaattcagcaacttctgggaaccagacaccctcgcaagtgctgcagcaagttttgttttttgttttttgtgtgtttttttaatttttgtattcaccacaacaaatctgtaatgtggatacactattaatgtcattcctattttagagatcccaggctttgggaaattaatgacttatcagctgtgactcaccctgctgagagtggcagagtcaaatttaaatatgactcatgtcagagcccagtcactgagcacactcccaggctgtgatggatgtggaagagagtgtgcctgtcatggagccttagctctgacccctatgcctgtgacacacacacctttgaatgtgccaggtggggacaggggatcagggctgggccaggcaaggcctagcgccagcccctgtgctactggtgggaaggggaggacacagccctgcctgagccttacgatcctattggtcagtttccctccatggcctgtgtgtgtcaggagcacaaagagtcttccagatggtaggttttacagatgtgacggtagcatctgcagagagatgtaatcttcagtttgcagaggagaaaaccaagtcccagagtcccttcccagaagagcgagtgaacggtagagccccaccaggacccaggtcttcccattccccatctaccgcccatctgctgttgggaggtttgcagtcgtgagcgtttcccttccaaatgtaaaccagttgggctgcagtttcagcctgtttcttctttagtgttacaggaggtaggaaaccactgatttcccatccagtgttctattaccaatgttcccttcagctttctcttcctcaggctaatagttctttgcttctttgttctaaaagaacttgtttttttagtccaattttccgcattcaggtgcctcactgaccctcccacataacctttcctttttctcaatccttactccaaactaaaccaggtctctccacgcttgcctcttgaattctgggctctggttcttttcctgcttcctttttctttgtatggtagttctacttcttttaagaatttttccccaactgaggccaagctgctatcatgaccagtgttggccaaaaccactctgtgatcttttgttttaatatgaacttgggtgtttgtttttagttctgtcctaatgtctccacctcctgtcctggtgctccctaacttagacaaaactaaaaacatgtgagatggggacaagagtccaggtaagctgtgttttcattggaaactatctgttttgcttcttaggtacacagataagctgtttctctccaagttctttctcctggcgtcaggctgcctttgtggattcatattgctgggcggctgttcagcagaagaactcactgcagagcgagtctggaaacctcccactgtggctgcataaggtaaagggagacatttccaaatagaacctgtttgctttatagataaggaaactaaagcccagggaggctatgccaaagaccacacagatattgtagccaaccagtgctgtatctcagattgtaaaactgtagcaccttatagtcaaaaagaacctcagagatgacttggtgtaggcaccatcatttagcacaatggggcaatgggaagtgttctttgagttttagctctataacagcaggcaccttttgtgtcttgacacctttatatcataatgcccagcaggatgtctggcccgtagtaggttcttagtacattttgagtgtctgaatgagcatagctagacagtggcagagctaggattcatgcatagcttctcagctagcaccttttctaccacacacagggtctcttgcagaaagtaaggactgacctagagttcagttgcttctagctgatacgttactggaacatcaaaaagcctagtgatgaggccctctgggggtgttggctgtagcactgtttttggaatggatccctttgctttttgatagatccagatactgcagggaaggggagatactacacaagagacaccaatgtctgggttccactccacttcccatagagaagaggtacattctgtagtcagggaagtggtggtttgtgcatgcaggtggcaggggatgcagtgaggaacttaggcagcagttgataagtttgtgcagaagaatgttctctgagttatgaagtgactgcattaggtcttctctgtgcttctgaaagtaggactttgtttcagcctgtcattaatttcaaccactgtttcttttgtccattgtgaaaacaattagaatgtgtatcttctggtattcttttctgctgaagaaaatatagaattttagctttcgaaaacccaaaagccaaagtttgactctcttctgctttgacctgcttccagacacaccatcagcatccttcttcgtaaaaggaatgatttaagggagctatgactcaggcatgtttgtttatagttgacccttgaacaatgtgggggtcggggcactggtcccctgcacagtcaaaaatttgtgtgtaacatttgacttccccaaaacttaactactgatagcctactgttgactggaagccttaccaataacataaacagtcaattaacacatattttatatgctatatgtattatatactgtattcttacaataagctagagaacagaaaatgttattaagaatattataaggaaaagaaaatatatttactattcagtttgtgcaaacgtaattgtgggttttgccattaaaagtaattgcaaggtgggtgaggtgggcggatcacctgaagtcaggagtttgagaccagcctggccaacatggtaaaaccccgtctctactaaaaatacaaaaattaaccaggcgtggctgggtgcggtggctcatgcctgtaatcccagcactttgggaggccgaggcaagcggatcacttgaggtcaggagttcgagaccagcctggccaacatggtgaaaccccatctccactaaaaatacaaaaattagctgggtgtggtacgggtgcctgtaatcccagctactcgggaggctaaggcaggagaatcgcttgagcccaggaggtggaagttgcagtgagctgacatcgtgccattgcactccagcctggggaacaagagtggaactccatctcaaaaaaaaaaaaaaaaagccaggcatgctggtgcatgcctgtagtctcagttactcgggaggctgaggcaggagaatcacttgaatgcgggaggtagaggttgaagagagcagagatcacaccactgcactccagcatgggcaacagagtgagactccaaaaaataataataataaaataaatatataaaagtaatggcaaaacgcgcaattacttttgctccaacctaatatttattaagtggaagtggaacatcataaaggtcttcatcctcgttgtctttatgttgagtagctcaggaggaggaggaagaggagaggttgttcatgctgtatcaggagcggtagaggcagaagaaaagccccataaaagtgggcccatgtagttcaaattcatgttgttcaagcgtcaactgtactgcttgccattttgcatagtggtgccctatagtgactcttttctccttttaggttgggcttttctctttattttcagccataggtgggttctcgtcagctttgcatggtttagtagccaaggcaacaaataataggacttgcagtgtgaatgaccacagttctaaagtttaacagcttgctttgtaaatccaaatttttactgttgtagtttaagttcgtttgttatagtgttctcatgaaaatagagagttttaatgagtcactgggctgcctttgatggatccgcaggagaattgtctaagagttggcaggggtgttagtaattattttagagcaagaataaactgaaagattttttatccagatgtattttacatttaagggtaagggaactttgagggatctagcctaaaggttataggaccagttactgaccaacacatcagagctcagatcttcagacttctagcccattgctcttctagtcaaggaaggggaaatctggaaacagtataggtagccaaaccttaagttacctggtattaatgagagattaagaaaccctctttctggcagtggaagactgcttgtttgaatggaggtttatctaagtttctcagcagagctcttgccagattcacaaggctggggacagaaattgaagtcaggacctgccacgttggaaggacccttattaacactccttggcatttggttgggactctgaaaggctgttccttgagaataaggggcgatccagaattaatctagctcccatagggacaagagtcctgatttaaatcattgcaatagcagttgaatgacagagatcggggattacgagtgtctggtctacttgcctgccagaagtaaaaataaatcctttctggaggattttctgggtgtgattatcattcatctttttttaaaaaaaattatttttctcgtttttttttttccttttttttaattatactttaagttttagggtacatgtgcacaacatgcaggtttgttacatatgtatacttgtgccatgttggtgtgctgcacccattaactcgtcatttaacattaggtatacctcctaatgctatccctccccactccccccacccaaaaacaagccccagtgtgtgatgttccccttcctgtgtccatgtgttgtcgttgttcaattcccaactatgagcaagaacatgcggtgtttggtttttttgtccttgcgatactttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatagtgccacaataaacatacatgtacatgtgtctttatagcagcatgatttataatcctttgggtatatacctagtaatgggatggctgggatggctgggtcaaatggtatttctagttctagatccctgaggaatcgccacactgacttccacaatggttgaactagtttacagtcccaccaacagtgtaaaagtgttcctattcctccacctcctctcccgcacctgttgtttcctgactttttaatgatcgccattctaactggtgtgagatggtatctcattgtggttttgatttgcatttctctgatggccattgatgatgagcattttttcatgtgtctgttggctgcataaatgtcttcttttgagaagtgtctgttcatgtccttcgcccactttttgatggggttgtttgtttttttcttgtaaatttgtttgagttcattttagattctggatattagccctttgtcagatgagtaggttgtgaaaattttctcccattctgtaggttgcctgttcactctgatggtagtttcttttgctgtgcagaaagaagctctttagtttacttagatcccatttgtcaattttggcttttgttgccattgcttttggtgttttagacatgaagtccttgcccatgcctatgtcctgaatggtattgcctaggttttcttctagggtttttatggttttaggtctaagatttaagtctttaatccatcttgaattaatttttgtataaggtgtaaggaagggggatccagcttcagctttctatgtatagctagccagttttcccagtaccatttattaaatagggaatcctttccccatttcttgtttttgtcaggtttgtcaaatatcagatggttgtagatatgtggcattatttctgagggctctgttctgttccattgatctatatctctgttttggtagcagtaccatgctgttttggttactgctagtagccttgtagtatagtttgaagtcaggtagcatgatgcctccagcttagttcttttggcttaggattgacttggcgatgcaggctcttttttggttccatatgaactttaaagtagttttttccaattctgtgaagaaagtcattggtagcttgatggggatggcattgaatctataaattaccttgggcagtatggccattttcatgatattgattcttcttatccaggagcatggaacgttcttccatttgtttgtgtcctctttaatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttataagcttaaggagattttgggctgagacaatggggttttctaaatatacaatcatgtcatctgcaaacagggacaatttgacttcctcttttcctgattgaatgccctttatttccctctcctgcctgattgccctggccagaacttccaacactatgttgaataggagtggtgagagagggcatccctgtcttgtgccagttttcaaagggaatgcttccagtttttgcccattcagtatgatatcagctgtgggtttgtcatagatagctcttattattttgagatacgtgccatcaatacgtaatttattgagagtttctagcatgaagggttgttgaattttgtcaaaggccttttctgcatctgttgagataatcatacggtttttgtcattggttctgtttatatgctggattacatttattgatttgcgtatgttgaaccagccttgcatcccagggttgaagcccacttgatcatggtggataagctttttgatgtgctgctggattcggtttgccagtattttattgaggatttttgcgtcgatgttcatcagggatattggtctaaagttctttttttttgttgttgtgtctctgccaggctttggtatcaggatgatgctggcctcataaaatgagttagggaggattccctctttttctattgattggaatagtttcagaaggaatggtaacagctcctccttgtacctctggtagaattcggctgtgaatccatctggtcctggactttttttggttggtaagctattaatttttgcctcaatttcagagcctgttattggtctattcagagattcaacttcttcctggttttagtcttgggagggtgtatgtgtcgaggaatttatccatttcttcgaggtgtttatagtattctcagatggtagtttgtatttctgtgggatcagtggtgatatcccctttatcattttttattgcgtctatttgattcttctctcttttctttattagtcttgctagcggtctatcaattttgttgatcttttcagaaaaccagctcctggatttattggttgtttgaagggtttttttgtgtctctatttccttcagttctgccctgatgttagttatttcttgccttctgcttgcttttgaatgtgtttgctcttgcttctctagttcttttaattgtgatgttagcgtgtcaattttagatctttcctgctttctcttgtgggcatttagtgctctaaatttccctctatacactgctttgaatgtgtcccagagattctggtatgttgtgtctttgttctcgttggtttcaaagaacatctttatttctgtcttcatttcgttatgtacccagtagtcattcaggagcaggttgttcagtttccatgtagttgagcagttttgagtcagtttcttaatcctgaattctagtttgattgcagtgtggtctgagagacagtttgttataatttctgttcttttatatttgctgaggagtgctttacttcaactatgtggtcaattttggaataagtgcagtgtggtgctgagaagaatgtatattctgttgatttggggtggacagttctgtagatgtctattaagtctgcttgatgcagagctgagttcaattcctggatatccttgttaactttctgtctcgttgctctgtctaatgttgacagtgaggtgttaaagtctcccattattattgtgggagtctaagtctctttgtaggtctctaaggactggctttatgaatctgggggctcctgtattgggtgcatatatatttaggatagttagctcttcttgttgaattgatccctttcacattatgtaatggccttctttgtctcttttgatctttgttggtttaaagtctcttttatcagagactaggattgcaacccctgcctttttttgttttccatttgcttgctagatcttcctccacccctttattttgagcctatgtttgtctctgcatgtgagatggttttcctgaatacagcacactgatgggtcttgagtctttatccaatttgccagtctgtgtcttttaattggagcatttagcccatttacatttaaaattaatattgttatgtgtgaatgtgatcctgtcattatgatgttagctggttattttgccgttagttgatgcaatttcttcctagcctcgatggtctttagaatttggcatttttttgcattggctggtaccatttgttcctttccatgtttagtgcttccttcaggagctcttttagggcaggcctggtggtgacaaaatctctcagcatttgctttgctgtaaaggattttatttctccttcgcttatgaagcttagtttggctggatatgaaattctgggttgaaaattcttttctttaagaatgttgaatattggcccccactctcttctggcttgtagagtttctgccgagaaatcagctgttagtctgatgggcttcccttggtgggtaaccccacctttctctctggctgcccttaacattttttccttcatttcaactttggtgaatctgacaattatgtgtcttggagttgctcttctcgaggagtatctttgtggcgttctctgtatttcctgaatctgaatgttggcctgacttgctagattggggaagttctcctggataatatcctgcagagtgttttcctacttggttccattctccctgtcactttcaggtacaccaatcagacgcagatttggtcttctcacatagtcccatatttcttggaggctttgtttctttttactcttttttctctaaacttctcttctcacttcatttcattcatttgatcttccatcactgataccttttcttccagttgatcaaatcggctactgaggcttgtgcatttgtcaggtagttctcgtgccgtggttttcagctccatcaggtcctttaaggacttctctgcattggttattctagttagccatttgtctaattttttttcaaggtttttaacttctttgccattggttcgaacttcctcctttagctcggagtagtttgatcgtctgatgccttcttctctcaattcgtcaaagtcattctccgtccagatttcttctgttgctggtgaggagctgcattcctttggaggaggagaggtgctctgatttttagtttccagtatttctgctctgttttttccccatctttgtggttttatctacctttggtctttgatgatggtgatgtacagatggaattttggtgtggatgtcctttctctttgttagttttccttctaacagtcagcaccctcagctgcaggtgtgttggagtttgccagaggtccactccagaccctgtttgcctgggtatcagcatcggaggctgcagaacagcagatactggtgagcagcaaatgttgctgcctgatcgttcctctggaagttttgtctcagaggagtacctggttgtgtgaggtgtcagtctgcccctactggggggtgcctcccagttaggctgctcgggggtcagggacccacttgaggaggcagtctgtccattctcagacctccagctgcgtactgggagaaccactactctcttcaaagctgtcagacagggacatttaagtctgcagaggtttctgctgccttttgttttgctattccctgtccccagaggtggagtctacagaggcaggcaggcctccttgagctgtggtgggctccacccatttcgagtttcctggccactttgtttacctactcaagcctcagcaatggtggacgcccctcccccagcctcgctgccaccttgcagtttgatctcgactgctgtgctagcaatgagcgaggctccgtgggcgtaggaccctccgagccaggcgctggatataatcttctggtgtgccatttgctaataccgttggataagcgcagtattagggtgggagtgacctgattttccaggtgccatctttcacccctttctttgactaggaaagggaatttcctgaccccttgcgcttcccgggtgaggtgatgcctcgccctgcttcggctcacgctgggtgcgcggcacccactgtcctgcccccactttctgacactccccagtgagatgaatccggttcctcagttggaaatgcagaaattacctgtcttctgcgtcgctcacactgggagctctagactggagctgttcctattcggccatcttggctccaccaacctctcttttttttttttttttttgagacagggtctcactttgtcacccaggcctgagtgtagtggcacaaacatggctcactgcagcctcaatctcctgggtgtaaggcagtcctcctgccacagcccaccaagtagctgggactacaggcatgcaccactgcatgtggctaatttttgttattttttgtagaaatggtctcaaactcccgagttcaagagatccacttatcttggccttccagagtgttgggattacaggcgtgagccaccacacctggcttatttttcttactttttattttaatttttaagttttatggttacataatatttgtacatatttgtggactacatgtgatattttgatataagcatagaatgtataatgagcaaatcagggaatgaaagtgttagaagtgggcatccttgttccatatcttagaggaaaggctttcagtttttccccattctttgtgacactagctgtgggtttgttgtaagtcttctttattatattgaggtatgttccttctgtactcagtttgttcagggtttttatcatgaagggatgttgactgttactgaatgcttttttggcatctatggaaatgatcatatgctttttgtccttcattctgttgatgtgatgtatcaaatttattgatttgcatatgttgaactatccttgcatccctaagataaatcccacttggttgtgatgaatgatctttttaatgtgttattgaatcagtttgctaggattttattgaggatttttatatctgtgttcatcggaggtattggcttataattttacttgtctttgtctgattttggtgtcatggttaagactggctttataaaattattccctcctctaaggatggtttggaattattccctcctcagtttttttgaatactttaagtagggttggtgttagttcttttttaaaagtttggtagaatttagcagtgaagccatcaggtcctgggcttttctttgatgggagacttattattactgcctctcccttgttacttgctattggtctattcaggttttgtatttcttcatggtccaatcttggtaggttgtatgtgtctagaaatttatcaattttttttaggttttgcaatttattggcatatcgttgctcataatagtctttagtgatcctttgaatttctgtggtatgaatgataatgtctccttttttgtctctaattttatttatttggtctttcttttttttttagtctggctaaaggtttgttgattttgtcttttcaaaaaaccaacttttaaattttattgatgttttgtatttttttggtttcaattttatttctgctctttaatagtctactgaatttgtgtttgatttgctcttgcttttctagttctttaagatctgtcattaagctgtttatttgaagtctttctacttttttgatgtaggtatttattgctttaaacatccctgttagtactgcttttgctatatccagtaggttttggtatgttgtgttctcattttcatttgtttcaagaaatttttaaactttattcttaatctcttcattgacccagtggtcattcaggagcatattaatttccatgtgtttagtttccaaagtttctcttgtcattgatttctgaccttgtggtcagaaaagatacttttatgatttcaattattttgaatttttcgagacttgttttgtggcctaacatgtggtctatctgtgagaatgttccatttgctaaagagcagaatgttctgcagctattgcatgaaatgttctgtaaatgtctgttaggtatatttggcctacagtgtagcttgagcctgatatttctttattttttgtctagatgatctgctcaatactgaaagtcgggcgtgaagttcccgactattattatattgggctttatccctctttagctctaataatattttctttatatatctgagtgctccagcattgggtgcttatatatttacaattgttacaccctcttagtgaattgatcccgttatcattatataatgacttactttttatctttttacagtttctgtattgagatttattttatctgatacatgtatagctattcccgctcttttttggtttctgtttgcatggaatatatttttcagcccttcattttcagcctatatgtgtcttataggtgaagtgagtttctggtcagcagcgtttggttgggtcttggttttttatccagtgagccattctttctcttgattgaagaatttagttcatttacattcaatgtgattattgataggtaaggacttactactgcaattttgttatttgttttctggttgttttgttagtttctctttttttcctttttctctgtcttcctttgtgtataaatgatttttttggtagtatgttttaatttcttgctttttatttttatttattttttttaattttttaattttattattattatactttaagttttagggtacatgtgcacaacgtgcaggtttgttactaatgagcaaaataaccagctaacatcataatgacaggatcaaattcacacataacaatattaactttaaatgtaaatgggctaaatgctccaattaaaaattctcagctttttattttttgtgtatctattataggcttttactttgtttgccatgaggctgcacatgaggctgtgattggaattaagttatcttccgtttaaaataattggttatgtggccgggcacagtggctcatgcctgtaatcccagcattttgggaggccaaggcaggcagatcacatgaggtcaggaattcaagaccagcctgcccaacatggagaaaccctgtcccttctacacatacaaaattagccaggcatggtggtgcatgcctgtaatcccagctactcgggaggctgaggcagaagaatcacttgaacttaccaagaggcagaggttgcagtgagctgagatcgcaccattgcactccagcctgggcaacaagagtgaaactctgtttcaagtaatataatagtaataactattattattattattggttatgttattaaccaattattttaaactgaagataacttaattccaattacaatgaaaataaaaaaacaagccaaaagaaaactaaaaagttctggactttaacttcatccccccctcgctttcgacttcttgtcactttatatctttttatattgtgtatctcctaacaacttgtaattatgattatttttgatacgtttaccttagggtcttcattttaaggtatgagtggtttacataccacaattacagtgttagagtattctgtatttgtctgtgtacttacttttaccagtgagtctgtatttttagatgatttcttgttgctccttaccatccttttctttcagactgaagaactccttttaccatgtctcgtaagacagttctagtgttgatgaaatacctcagcttttgtttgtctgggaaagtctttatttcacctttatgtttgaaggataactttgctggtgatgatattctaggttggaagcttttttcctttagtgctttgaatatgtcatcccactccctcctggactgtaaggtttccactgaaaagtctgctgccagatatcttggaactcttttatatgtaatttgcatcttttcacctggtgtttttgggatcctttctttgtccttcacctttgaaagttggattattgtattccttgaggtagtcttgcttgggttgagtcttctttgtgtcctttaaccttctcatacctgcatattatatcaggcatctatctggtgctttattttattgtgactgagcctgatatctaagttgcaagacagtatcctctgtactctttcctctcctttgcccaagttgaaagatctctccccaagctgcactgcttggagttgggagagaggtgatgcaggtgttcccatggctggtacagttaatgtcgtactgggtcacatcccaagcccactgcttctaagaccagtgcagcaccagggcttgtccaaggcctacagttactatgtcctgattggcactcagatttatttggggccctaagtcactttagtcagttggtggtgaagccagcaggagtcacttttctcccactggggcagaagattcccctctggcccagggctggtctaaatgcttcttttgtgggacctggcagaagtctgcctggtgttgtgtgaggctttgacaaggcagcactgagttccagtgcaaagtcgcatactcattttgctctccctccttcaagcacacggattcttctccagactgcactgcctgggtttaggggaggggtggtgtaagcagtgcaagaccgtacttcctactctcttcaatgccactttcgttgttatgttaaaaccaggtacagtgattgctcctctgattttttagttcttaggagggtgctttcttgcatggatactttatatctttttatattgtctatctcctaatgggggtcaatcattggagggttcaattcagccattttgctctgcctcctcttatgtactgtcaaattcttgctcaggtttttcacatatgatattcagcactcactaggaaataactagatgtacaagaaaaccaagagaaaaatcagaaatagaaacaaacctgttggagatccagatagtggattgatcaaccatgcattttaactaatcattaatcatatattcaaagaattatgattatatggagattttttacgtagaactgactgaaaactgcaccaaaataatcaaatagaaattcttgagctgaaaacatttagtcacagttgatttcagctaacgttgattgagggcctaccatatgctggaatgtatgtgcagtggcagaaagccacagatgacatggtcccttcatcaaggagcttgttgtttagtggaaaaaataaacatggaagaaggcagtgagagggaataatcagctaaatggtaaaaggagagtgtttcagacagtagtgaactctgttaaatgctgctgcagagaagccagtgcagtctgggagaaatacaacttactggatttaatgaaaatattggggatccagcaggaatgattttagtggagaagtgggaggcagatggctgtggtgaagagtgaatgggaggtaaggaaatgaagatgattagacaatttcttcacaattttttttcccttttcataaactctctcttcctgataaccagaagagagaggaacaagctgggtgacaactggaaggaaaatacaggcccaaaagcacaaaaaaagcactgtctgggagggtgggaagcactttctgggggaggcgtggcctgttgggggcattggggccttgattaactatgatgcagggtaggctaggttacaggggactttgaaaactaaccagatggatgggctaaatgctggggacagcgggagccattgcaggtacctgagcagggtgaacttggcggttccaagagttaagcctcagtaatggtgtacaggagagaatagaggcagggagagccacttggtaagcacagagtgagggttctaattagggaacagaaaggaaaagaagcagttttgtccaagaaggcaaagagcaaacaaaaagcaatactcttatgtcttattgctgattagaagatcacgcaaaaggatagtcgaaagtgacatcaagggcctagaccagggtcagcaaacttctgcagagggccagatcataaagtttttttgtcattgcagatcacatggtcactgtcgcagctacttagttctgcagagtagacatgattgcttgtggccagatttggctcaggggcagcagtttgctgatccttggtctagagtgacagcagttgagatctagggtgacagcagtggaggtgggaagtgcatcttttctaagactcagggcatcttttctaagatacggaagtaacaagatgtgctgattggacatgggaagatgagagaaagatcaggattaaggacatgaccaaggtttcaggcaccggatggaatgacaccttcatgacacttgaagaagcctggtgaagaagcagattttggaggaaaatcaaagagttctgcttgaacatgttgaatcaggtgctgtggtccagatgatgtgtcaggtgggcagtgagatatggtatctggagattgcaggctagaatagagctatagatatggcagattgtcagaaaatagatagtgtttaaagctataggagtggatggtgtttcttagggggtgattatatgtagacaggggcaaggtctgagggctgctccaacatggagagagggtggggtaggaccagtcaacagaggagacacagagaggtggggtgatgaggaaagttaaacagtgtgctgtatgcttgaaaggcagggtatcttgtaaagaaagatggtgtcaatgtgataacctgtgtcagatgctgccaagagtgcgagtaaggtgaggactgagacttaggctaactctacatttgggtggtatcatgggctgaattgtgtcccccaaaagatatgtcgaagttttaacccagtgtgccctaaactgtgacaccttatttggaaatataattatagcagatgtaattagttaagatggggtcttactgcagtagggtgggcctttaactcagtatgactgctatcctcataagaagaggggaatttggacacagacatgctcagagggaagacaacatgaagacactcagggagaaaacagccgcatgcccacagggggctggattggagttatgcagccaagccaaggaatgctggggcgactggaagctggaagacgctgggaggatcctgccatggagactcgggagggagcatggccctgctagcaccttgattttgaactcctcacctctaaaaccatgaaagaaaaaatttctgtggttttaagccatcaaatttgtgggatttggttggtaatgccaggagttagagagaaatgaagattcagcctaattggagaaataaaacctataccagataggaatattagtgcatggctttcttaggccagattcagtaatcgcagctgctttatttctacgttgatctctttttcaagtttttctttttcttttttgataaaatatacataacataaaatttacctttctctttgtaggtatatagcccagtggcattaagtacatttacattgttgcgaaaccatcgccattacccatctcctgaatttttcatcttcccaaactgagacctgcatccattaagcagtaattttccatttccccatccccccagcccctggcaacctccattctgttttctgtctctctgcatttgtctattctagatacctcatataagtgaaaccatacaatatttgtccttttgtgtctggcttatctcactgaagaaaatgttttcacagttcattaatgtggtgacatacatcagaatctccttcctttttaagactgaataacatcccattgtaaatttgtacgagattttgtttatccgttcatcagcgcatacttgggttgcttgcccttattggctattgtgaatattgctgctgtgaacatctgttcgagtcctcactttgtttcttttggatacataccccaaagtggaattgctggattctctttcaaagatgaaaaggttttcttgtggcttctccacactgagcagactcgggactgttaagctgttagggtcctctcattcaggctccgagggccagagtgatcagtgccttttctgaggtcgcacagccagatggcaggtgagcccacatccttcttcagatttcagacatgtttcccatgtgagaaggtccagttctaacttctgtggcttgagaattctggactgtagcctgtaggtgatggtcacctgctgatgagctgcagttcaacacaaggagagtctttctggcacaattgctgtccagcaggggagcccactgttgacccaggagttccttagttcagcgtgctcatggacttgcgtaatttcttcccatgcctgtatttcttaccttgctactgtttcttcatagaaaactcagttccttagctgttctggatactggctatgccttccccatgccctcctcattgctgtcattctcccagtcacccctcattcattcaggactcagtcatgctcatcctccttcaccaccccaaggtgacttctgtgtcctcctggatggcacatctagcctcagtctctgtctcatctgcaagaacttttacctcctttccatttccatctccatcatgagttcctgtggccacctcattctgaacttgctgtcacttgaaactaacttcaggcatcccactccctgtctctgcctcctgccctccaaggccttccccaagcactttcaaataaaatggaagcttgacatgaaaatatcttgccataattctgctttattaattctttatctcttaagactgtaagctttatgcaggcagagaccatgaccatgtcttgtttatccatgtacccctgagacaatgcgtagtccatagtgggtgcttgaagactatatgcggaagggaagagggcagtgaggtagttgtgtgtcctgttcagaaccagacttggttctccaggagcatcctgacaaaggatgggggattagaggcacagggtttattcagcacttctcaatttaattctgatgctgaagttaggagagctcagttaccccaaagaagttattcagtgtaatatttaagtcagcactggtatgacactggtatgatcaatggtgtcatttttctccaaccgactttgatttctccctgtcttcctcctccctttctctcccactccatgcactactgatgacctctaaggacacactgtgaggcctttgctggagatgtgggtacagtctcggggggtggggggcacccagtaggtggcgctctaacactgcttgagaactggcttttttttttcctttgagtgttctgttccctttgttcaagtttagaatgcgggaggcaactattagtaagatttctctctgaaacaggaaagtccgtttttgactgaaaaaaacaataagaaaaacaagaacaaaattaggagagtgggcaaatctttatttctcttaagtagactcatagaaacttggttggaggaatcctctgaggctttcagaccagaggcttccaaaccttagcattgccagagtggccttgtgaaaattcaggctcccgaggccatctaggccattaggttggagcttctgtggttaaggtcaggaatgtggtttttatcggcttcccaggagattctgatgtgagcccatcttgccgtacaatgtgggcaccacccatctacaccatttctcaaattctctgtgcatgcagatcacctggggattttgttgaactttaggctctgattcagcaggtctgatagggacctgcaattctgcatttataacagactgccaggtgataactgaggtttgtggtctatggaccacaccactctttgagaagcaagaatccagagccagggttggcagactaggacacacatgcttgagccaaatcagtccatacctgtttttgtaaataaaattttattggaacacaactgtgccccatttgttcacacattatctgtggctgcttttgcactataatggcagagttgagcagctgcaacagagaccatgtagctctcaaacctgtaatatttactctctggccctttacaagaaaaccctatggacccttaatctggaatactcaagctctcccagatgatcacaaactgtattgaaagggagctccttgcctcataggacaattcattgcatttcatagatccgtgggaaggctgctccttgtcacttggttctacttatcttggtaggcatcttttcctccttctgtgaacagatactttgctcgctgtcttctccagggctctccccatgatgggttccctccagctgcactccagaatgtcacccagtgcaaaccacagcacctttggtgctgaatagaagccatgccatctgtattttctgccttctgtaagcttctcagggagtgcacattagctttctggggtagctgttcactcttgactcccgctgtctaggattgtctgtaagtgcggtattacctgaacagcatatagccagaacagacatccttcatgcatctttttactccacttccccagtgcaggatgttcttggtttacctacttcctactttctgactgcttttctccatttcttccaagattctctttttgcctgacccttaaatgttatagggtctcaggcctgttcgtggtcttctggtcttctccttctgcccattctccttggatgatcttaaccatacagttggctttgaccacatatgtgctgccaaatcctgaattgtacagctagattcttttcctttattttcagttatctactacagaccagggcgttttgactgcaggtatctcatgttcaaaatttctcatcttctcaggtctgcctcccacctcactcccgtctgctctgaatctgggactcttcatttatttcacctgaaggttccaccccgtcatgcccttgcatgagctacacacccggcgtgatcctcagttcttctccttttccgtccccctcttctgtgtggacactgaagtgtatgtctcccccatctgttgctctcagatctgtcttctcttcctgcctctctgccacagtgacctcctgcctggtctctctccttcccatgtgtttcttctttgcctctgtagtggttttctggaatatatttgattttgccctctaccagtggtaccccattgtgtatggtgtgggaatttgtggccctcttaattcagtctctgcttacactttttgtgagtttcctagatctgctataacaaattacaacagaaatgtatttcctcctagttttggaggccagaagtccacaatcaaggtgttgccagaattggctccttttggtgctttcagggagagtctgtgatgtgctttcttctagttcctggtggctgctggcagtcctctgtgttcctagggtggtagatgcatcactccagtctctacctctgtcatcacaggcttcttcctgtgtgtctctgtgtcttcatttggccttctgataaggacacaagtcattggattaggacccaccctaatttatcatgaccttatcttaatttaactaattatatttgcaaagacctatttccaaacagtatcacactctgaggttccaggtggtcattagttagggttggggggcagtattcaagccagcacacccttccagcctctgctctgtctacttcctcactcacaggcttgttcatttaccttggtgctctggatgagtgagaattcaacagacaaacacggaggaaaggattccaagcagaggaaagaggattccaaagggccacagaggtgacatttgtgctgagtcttaacataaggctttgttttattttattgccgcactgtactttaagacatagttcaggtgttacctcttttatgaagcttccctgaccacctccccagggacttttctgttccctcagtgcttagtacctacatgttttgatgatttaattatcagcttgtgttcccatctgtcctgtgtaatcttggggcagactctgtgcctagtctgtgggggccgtgcatccagcccactgcctagcacatagcaggtccccaggagatgtttttgagtgaatttacccatctgcacttaatcccctaagatgaggtcacatgcattttaggggaggagttgttcagtccgaattggatggttctttgccttcgatgaggtagagaggatttgaatatggagggaagttgtactgctcaccctctaggttccttccatctggaggtttctgttgttttaactataacccattccagaaacagcacacatttttaaggcagatagactgaaaattgtagttggacagctgcttggtcccacaatgatttgagaagtttccctattcttggaagagctcaatactcactcgaacatcatgcagaatagtgccatcatggcttcaagagatgctgagcatcccaggcctaatgtggagttgacacagcttatgaacaaagctgtttccatctgcagatgcaccctcaaagccctgcagcttttccatatttcttatttgaaattaaagactgtaattttgtgttattttggattcttatttcctgttttactacatttttatagaatcactgaaagttgcctttttattttggtgggaaaaaaataaaaagaggttttagtgtggagaaaaccaagagatgtggcattaaatgatgttattatagtggtgatcaaggtacaaggctattttagggaaatttacaccctatatgtaatttgtttttctaattacaatgagctgtgctgaactattcattgtaccacttattgtaccaaattattgtaccacttgggcatgtttaaaaataccacagactgtaaatagtcactttttaattcaagggaacagttcgaagtgaaatgccattattcaaatagctttgaaacaaaagtgacttatacagatgtttcacaagcccatgttagaaaaagttttctccctgtggttcccagatagaatgcctggctttcgtggttatggaagcagcagaaactctgtgtcatgcacttatgtttttaaactaatgggcacccttctgattgggcaagaattaaatgaacattccttctccccacagccagctatgaattatgcagccaaaattcagctaatcacagcctgctttgtgtgtcattgtgtagcagccctttgcaaattgggttaatacttttgaaacacctcatcccgtgccagaatgccaaagtaaagcagctgtcttggtaagagggctttgcaaagttttggggtcatttgtgcttatttctgtcttgcgtctggggcagagattccttatgtgggtctgtgatagtgacaggaggcctgcaaactaggataggaaaatatatgacagctttattttttattcacttccaaataaaatttagcattaagaaagtttttatgtaggcaacaatccatagtgatattagcagtacctgtgagtttgtcacccacagaaaatcacagatatcctggaatatcgtttactcttcactacttcaaagtttcaatagctgttagatcatctgctagatcctaatttaagtatgaataaagaattggatgcaaaatattaatattttggtaactgtatatcagtgctctatttcctttgtgaacctatatatatattattttatgcatttaaaaacaaggaaagattgaagaactgtcacaaaaccaaggagtctagggagacatggcaactaaatgcagtgagtaccctggattggatcttggaacaggaagaggacagtaggggaaaaactactactgtactttacaaataaaagtctgaagtttagtttctgataatgtgccgatgttggcttcttagtcttaacaaatatatcacagaaatatgagtcattagcaatgggggaaactgagtgaggggcttatgggaatgctctgtacatctgaaattacagtgagggccatgttgtgggggctgccgtccactcccagaaatgttttgaggggagggtttcatgtcaacttacggccatcatggcctcgtccattacaactctgagaaatggtggagatagacccatccaaaagtaaggagaagttttccagaggagtaaagtaattgagagtgtgttagattggaaaaagatgtctctggggtcagagaggttggcaacatagtctgactctcacttaccagctttgtgatctggggccagaaactgctcccggctttctcttcccatttgcagaatggagccatctatagagtccctgccagggttgctgtgaggactgaacataacgtgtccacctagctaatctttttgtggttacctggagtgtttgagtgcctgttctatgccaggccctttgctaagcattttccatcaattatctcctttaatcttcatgacacctctattccatgaccatttcatacataaggaaactgagggtcagagactttgaaaactaaccagatggatgggctaaatgctggggacagcgggagccattgcaggtacctgagcagggtgaacttggcggttccaagagttaagcctcagtaatggtgtacaggagagaatagaggcagggagagccacttggtaagcacagagtgagggttctaattagggaacagaaaggaaaagaagcagttttgtccaagaaggcaaagagcaaacaaaaagcaatactcttatgtcttattgctgattagaagatcacgcaaaaggatagtcgaaagtgacatcaagggcctagaccagggtcagcaaacttctgcagagggccagatcataaagtttttttgtcattgcagatcacatggtcactgtcgcagctacttagttctgcagagtagacatgattgcccaaggccgcaatgctgagcttcaattcagatctgcactgactgcaatttacggtcttcctaagtcttctgctgaggctaagccacctctgaccaactggtggtcctggttactggggtgctcctcaccctctctgacgtgtgaatcccctcttgtttggtgtgtgtctgcaccctgatgtggatgctctcctcttgattcccttgcccgttgtggatggcctctctgagcccaagtttatccaactatacgatgagggtgttggactgccttcaaagtctgttccacattcattctgcattctgtgaattcaactgcttatttcagctgtcttattgggatgattactgaatcactgaagtcgaagcttttctaatttgttttgggggaagttacatgtttctttggcattttcccagattccagagtagggcaaaaatggagccgtatgccttagttgcttcttaaaaccataaaagttaacaaaaacccagcagaagccttcgtgatagctgcaggtttcttaactgggattttgttcagggaacgggagtaattttatttttttattttccttctgtgattagaacgtacacaccatgtgtcaccatgcagttgctgattacttcaaattaatacctatggaagaaaaaaaaataggtagttacctgtgacaggtattacctggacaggggaatttagccataagaagtagttattaggtaatgagcccaatttccacaatacacatttgtctcaagatgtgagaaaatgagagcatcacttggcgccataggttactgcatggggggtttgttaagcccatgatttgttctcttgtttttcagtttttcccctacatcctgctgctctttgcgatcctcctgtacctgcccccgctgttctggcgtttcgcagctgctcctcatatttgctcagacttgaagtttatcatggaagaacttgacaaagtttacaaccgtgcaattaaggctgcaaagagtgcgcgtgaccttgacatgagagatggagcctgctcagttccaggtgttaccgagaacttagggcaaaggtaacttagccccagcaggcagctcatcgggttttgtaggacaaattctctgcccttctactgccagtctgggcccagagttctcattgctaggaggcggggcaggagtggaagcagggggacgtcatgcacctagtgacagcctgtagtatcccgggatgtccactctccccaaatctcaccgcgacccatcctacccatttgtttatccttctgtcaagactcattcccttgatgagtgaaacattacatctcattttaaaaatgcagttcttgtaggggtaacagattgaggtgctatatgaagcttgcttgctttgatctatttaactccttaatggagacgcacagaggatttcaaggcagctgagcaagggatgagagagaaatggggaatgagtaggtcgtggcttgccttttcacaaccttcttttggttcttgttattgaataattggaataataataagagccatcattttttgaatatttaatatatctcacacaccgtattgagttatttaagtacattatctcctttaaccctcagagcaacattactagtgcatttgttaacctcctcctccacttttattctggataaaaatactcttctgtagctgtaagtgagagtctgggaactgaaccatgccctttagaccccatagtttttgcccataccccctgagttgtcccaccccttgcctgtaagaggcgtatgcttacacatatttaggatttaccagatgccaggcatcactctaaaaatttccaaatattaactcatttaattaactaggccttctgttaaatattaaggggaaaagcattttattattccttttcttcctcctcttttaaacggattttatttttgactactgacgttgtaggtaaagaagtatgggtgtttgaaatttttagtgtgacattgttgaatgtgtatctgcctttaatatttgatggtcttgatgagtgcctaagttatttttgtttcctttattttttagtttgtgggaggtatctgaaagccacttcaagtacccaattgtggagcagtacttgaagacaaagaaaaattctaataatttaatcatcaagtacattagctgccgcctgctgacactcatcattatactgttagcgtgtatctacctgggctattacttcagcctctcctcactctcagacgagtttgtgtgcagcatcaaatcagggatcctgagaaacgacagcaccgtgcccgatcagtttcagtgcaaactcattgccgtgggcatcttccagttgctcagtgtcattaaccttgtggtttatgtcctgctggctcccgtggttgtctacacgctgtttgttccattccgacagaagacagatgttctcaaagtgtacgaaatcctccccacttttgatgttctgcatttcaaatctgaagggtacaacgatttgagcctctacaatctcttcttggaggaaaatataagtgaggtcaagtcatacaagtgtcttaaggtactggagaatattaagagcagtggtcaggggatcgacccaatgctactcctgacaaaccttggcatgatcaagatggatgttgttgatggcaaaactcccatgtctgcagagatgagagaggagcaggggaaccagacggcagagctccaaggtagggtttgcttttggcagaggctacgggagtctaccgagagcctttgcagcagccttgtgggaatattgacagtctttaccctgcccatcatttaaaccatttccaagcattaaaaaccttaataccaaggtgcggggtagggggagtgggaacccctcagtataaggagagagaggaaaagaattggtgctgctctacatttccaaagaagaataacttctgtgctttttctggtttttccctcttctctgtctgtctcacactctctcttgctcagcaatcttccttgtctttcttgcttatttttgtcttatcttactggctttcctttctacctctgatctccttctctgttactctctgactttctctttcaaaggggactaaaagtttattgattcttttagttaggccaagaagcaaaacatggtatagactgtgagaggaatttttggcagaagaaaaattgattagtattggtaattcctgctatgtttctgtcataaatatttgttttcaattttgacaggtatgaacatagacagtgaaactaaagcaaataatggagagaagaatgcccgacagagacttctggattcttcttgctgatgatttttttccttgagctgtaaatctgtgacttctgcgacatgggatttaatttggctaaagcacccctgttggtttcacagctggtttgcaataaatggttcttggtggagatactgagcatgtcttattgagtccctaatggaaatggtgatcaacaaaaggttatggaagaatggtttatgaacttcccataggaagcacctgagagatagtaaactgcagcaagtaactatgtgtaagtcctcatcaaatgaaaagcagaaagacaagaacaattagtcaagagcagtagccctgtcagagcctcggagcaatacctttctgtacccgtggtgagacaagacccagagctactggaaaacaagcactttggaagatttgttttgttttcatggaataataatatgtcagggtataatttaacgtgagtttcttatgtgcccttaaagactgttagacaagaaaagcattcactggctaataatccataggtcgacctatgtcctaagttaggtgtaaggtccgatgccttggcccacactcgagctctctttacattgttagttgtcaaccttggctgatggaaatcccgtaaccactatttgttgcactgtgccttgaagggcagcaggcccaagtgctgctctgactgaaaactgagttaacaagatgaaatctaaaggatattcacagtgacttcaattcaggaagaatgcttccaaaagagcccagtggggaaatctgacatcacagaagacattaattcagtcactttcaaagagtttgtctacaggcggtttctctgttatcaaaggcatttgaaataggattttacttaaacaataatggaacacaggagtatttaaagtgaagaacactttgcctgaatgtgatcagggcacataagtgacattggcatgcttcatatggcgtgcttggagccagaaaaacttagcggtttattttgtttatatttaagcacagctttaaaaaattcattatcgtttattcagtgtccgaattgaggccatttgggaagaaaattctagcactggtggagaattatagaataaagattataaatggttggataagacaaatgtaagcttatttcataaacatttaaagctgattcagaacatgttaaaaactgttcccaattccaactatgtaaatagatcctatgttcacattttacacacacacacaaaaatctttaacatctgtggaacttcccagttttagtcttagaaagttagcatgttgcataagttcagtaatcctcaggaacctccaagtttacttttagctcttacggacagttgtttacataatctaattactgttttctgaagaacggaaattatataagctgctgtctgccttttggaatattcagaaaagcagattttatttgtacttctgtgatgttttctgaaatggaaagctgatgataaatatcaaagtagcaatcagtgcgttaaattattctgttacatgatatttattactgttgaattattctgtgacttagaaatggcagtaacctaaataatggaatttgcaaaattattatattgccgtatctgagatgttccatcacaagtttctacactggtttcttttgaaaatttaaaaagatttacgagatacattttctaggatatgattttttttttacaaaaagcttcatcttctgtagactatccttaatttctattttgaaacggtaaaaattgatattttaggacaccaggaagtctccaagccattcccactctctgaactccagtagggtctgtgatgtcccaggcaccagtaccaagttggatgtgcagatatgcataggcaggtcccatccttgaggacttcagagtccagtaaaaggcagcagaaacatgggctggtgcctaagaggagaaagcgtagccacagtaaaggctatgccagaaaactcctagcaaatgctctgtgttcttgggagagggcacattgtttttgttttctctcctatagttcctgtaactgctggttttgagaatatagtaatcatttttcccagaggcagatgaccaccttaaggttctttagctgcaaatcctctaggttgaagtttgtgtgaaatagtcacagtgattttgaatagtaaggaatccagttgccttttgaaccttccctcacagggatgagagaacaagcctgtggaggttgtggagctactggtaaacaactgtcagggccccagaaggctgatgtggaggcctggggatacatttcatctaataaaagtattactaggtatcagtatcagtaataaaagtattataataaagtatcagtaataaaagtattataataaaaagtattattaggacaggtaaactcatccatctactgtgagctgctggcttggagaacgacttttgaggagccagtttcctgaggagaaatgcttttataaagcactcattgctttgtaaaaggagacaaaactgatcctaaatgaccactccagggttgctgattttgtttctggctcatgtctgcctagtaaaccaccagcaagctgctgaaccaggctggaaacaacattgttgcaactgggagggacatagagtactgtgaaagcagcgttccaacacatcttcacttttacaaagggataggcagagacttccaacatagaggttcttaaacttcgaggggttacaatccccttgcaaatatttttatagctatggaccctctcctcagatctacagccaacattttcagtgcaccttaggaggtcattttagtccacgcctctgaaaaagctgcactccaacggctgaagagcaagccatacggccgagaatggggctccctttgccttcatgaaagctacttcccccaacactaagactcagctgtacgtttgcttagctcagtcacatttacattcttctgggtgaactgtaccttttgagtacctgccttcattttctagaatcagacctaacaaggtcagtagaagcctgggcagcagcaggcctggaaagacgaggcagccagcatgaactgctgttctctccctgaccacaaggcgtcgtcttcctccagggtcaagtaattgttcttgttccgcctcacaggaatgtggggaggaaggacgtaacactataaaatgctgcgtcctaccttaaacttgtactgtgagaaagctggaaacttccacctgtacagtgggtctggtttgcatgtttagtttcatttgtgggaactgcttgtccaagagtgagctcaggtcagggcagtttgtgcctatgagaattagctcagctatcaggcaggtttttagacacctttttaaaatgtgctcgtgtttggtttgttttgcttactgtcagtcctgggtcaatcaaaggtttgtaagggtgagaatttttatgcactgctatatcgcaagtgcttaaaacagagactggcccagatgaggcattcttcaaatgtttgttgaaatgaatggacaaactcttaggataaatcctaatttgttggcaactgttatttgattttagaaggcaaactgattttattttagagaggggaaggggaggggaggctcattagcctcttggtagaaagaggactatttctgcaaatgaataggtttccaccttaagtagtgacagtccttaacttcttattatggagtgagtcttgaccgctttccaagttcaatagaagttcaagattgcctctcagtgattagggaaattgaagcttttaaagctcctggtctcagtaattcctcagaataaacctctttaaaagggatattgatggaaatgtacaattaccagtaattgaggttttatctgaggggatggagatgatgaaatggttccttcttggaagttgttggcattttggctttatttttcacaaataaagtgaaaccatttaaaacgattgacaacgattatatagtgccatgtggaatacaatagatattaatttgtggttggtttttctgcctgctttaaatgaaatgtattatgtttctgggttccttttttagctgtaaaaatacttcgtcactaaagcatgaaatttaatcagcagttgttcttcaagttcctgaaagctataaaagtttctcatgacttgagtggttttttccctgcccaccagaggagaaagcccttgtagaattctgcagtgttacaagtgttccctacaaaaactgaaaccatcagctcctctttaacaagttggctttttaaaagcacgtaattacaatttaatggtattctgtaaagtggtgctttaggcataatttaaattctttttaatgactatatttcttcaaaactttgaaagaaaaatgtgttctttttgctgcatcctttgtaagaagactgccaacagaggaaaaaggactttacaaattaagaccatcttggtttcatttccacaaagatgagaacaaatcatggtgttaggaaaggatccttagaagaacacaagaatttgaaagcccttggtggttatcactactatatttcatatttccacagaagtgacttagccaagctctgcattttgagcctgctgactttcatttaaaaggaatgaaaggctgaaaatccaggctgctgtgtctgtagataaaggtcaaaccatgtttgagttcttcactgttgtgtccacctaaataaaactgagtaagtaatgaaaaatgtcttaatatttcttgccttccctttagggagagtcatttcatggaagatgtaatgggagatgcattccaaaatgtcttgaggctcattgctgtctgctggaaacataaaattccataggcttcatgctgcttgctaaaatccagctggcagtgactaaagaaagagagtccttgattaagggcccacagattctggaatttctaaagcacaaatcacttgctttctgattgaggattgtttgcctgggcttgggaaaaaaagatcagcaaccatgtgctactaaacatgggttctcctgctcacctctctcaagaggaggactcctttgtacaatggttagtacagcttactattgtgggtaatcagagccatgtgaaattttagtgccattcctggcatatcacaaatatagtaaattctctctaagtgctagctttgactatcttgctcaccagctattcccagggtggcaaccccaggacccttggatgttgtattagttttctattgctccataacaaattaatgcaaacttagcagcttaaagcaatacacatatatcatcttgcagtttcctgggtcaggaatctggacacagctcagctaggtcctgtgctcagggattcacagtgctacagcctagttgtggaaggttgtattctcatctggaaggtcaactggggaaagagctgcttcaaagctgcctcaggttgttggcagaattcattttgcctaactcagaatcaactgatttgggaccttaatcacatctgctaaaaccctccacctttgccatattatcttggctagaatcaagtcacaggtcctgcccacactcttaagtgggagtcatggggctacactacactctgtcagcacagataacctaaatcctacccagtctgtctcagagacctgtagctttacccccttaacagtcttctgaggccggcctctgttcccagtggtgtcattcaggcccttgtctctcctgaattcctctgatagtcttactgtatctaacccagctaacacattttctgtctgtggactttctagaatgcagcagtgatcatgcaaactctccctaccattccaccatcagcacttttaaatcccttgggactcttcgtggctttcaggacaaagaacaaccttgtttcttagaccatacaaggccccacctcttgaagatcatcacatagccactactctccctctcatctcttacacagcctcgtgcactgtttcttaaaagcctctctgctttctcggatgctgtctgtcctcatccgcctcatacattctattcagaagtcacctccagcctccccagcaggaagtattcgtgacctgccactccctttgtcctgacttagatgccctctgtgcttgctattgctccttgcctcagtgcttagcactctgcactacgttgatggctttgtctgtctccccctgtcttggaggccccttgaggctggatggtgccttccacatccctgtgctcccagcacctggcacacagcctgatgcccatgtgctgagggattatttagacccccatctgccgccatgaatgccttctgaacatgtccagagtgggtgacagcatcaggttagaagtgaattcttcccccaggccttatccatctctatcacgacgactcctactttgcccaatttgaagtggccaagtacagctcatcctgtatttccttctcctattttagtaattgagggcttaacctgaaggcttgctgaagcacttctaagaaacttctcatggtggtggtttctcccctctgcacccatgctaatttacatctgagtggcctcacttttctaagagttctaacattgaccagcttatttgaactccacagttgggtgtgctattgatctgagatacttaatgccattgtggtaagaataatgatggcttttctgttcataatttgtgtccacccagggaagatgtttatgaagttttcccccaccccacatccccctcctaccatcacccagtgctgagagcagaggaggaaggagagaagccaaggtggaggctaccgacctgtgtcccccttgataaaaccaaattacagtaactaaactgcacatgagacaatttgctgatcagatcctacctcttctcccctcatataatgccagtgttctgaattcccctctttgaaagaggagtggaaaggaaaggcccaaatgctcctctgtggtacaccagagactgtggagacccctcaggggaaggagaagcacaccaagcccatgaatgaggaaaagtcaaaataaatcttcccaagagccctgttccattattgcaatgtaccttttctcagacacaaggaaatggaaacaactaaagtgttaccaaaaaatcacttccaaattcccagaaatgaaattcacattacctcaggaagcaaagaatccaataataaaacccaagctttcatggaagattcaggaacgtaaaaggcaatgttctcaaggtaatttcataggtagagactcctaaagagatttgtctcatttgttcattttgaatatcagaactgttacaaaggaagcttgtttttttttgaatgttagaaatttctttattattacttattaagcgccagcttaatgctgcagaaaatttcaaattacccttgataacccactttcttttctcccacccaaattcttgatcaagagtttttcaagtaaagacatgctcttctctcttctgtataaaactttacgaaataaaggcaaaagattgtgtacatcttgatggaaaatgctgcccagggctctggagacggtggctgcccgggctcccttcactgcccaggtcctgaaagactcttattcatgaactgtctcttcacaaagcaagtccaccacttgctgggtttatcattctgagggtcgaaaactttctcacaaagtctcagtccagtctcttgccttagctgttgtaaataggctctcatcacttcatcttcctgtttgtttgcaggtttggcataaattgcgttaagtagaaaaccaggctttccaggaatgggaaaattagtgattcccagtgtatacatttctttctcaccttggcttttggaattgcacttttggagtttcttcagacattcagaaatgtagagagttatatatatcattatatattatcaaggtcctatcagcttcattcttaatttcatagtttttgaagaagatattggccttgaagtaatagatgcttcatccacaatatctgtatcttttgtctctctgggggcaggtcgtttgaattgacttctgataggcaacagtgccttgtttccgatgagtttgatgtcaggatccatgagagaagagtggtaagccagcatcttggcggcgcccgggtttcaacccagaggagcaggatcggaagcattgttaagtacagaggtctttggagttccttatcatctttgtaagtaacccatgagataagggaagcttcatttaaaagaaattacccaaaactatggctgtggcaaagagagcagaaagaaaaaaaaaagagtaaacattaaaaaaagaataaggggccgggcccagtggctcatgcctgtaatcccagcactttgggaggctgaggcaggtgggtcatgaggttaggagatcgagaccatcctgggtaacaaggtgaaaccccgtctctactaaaaatacaaaaaaaattagccaggcttggtgtcacgtgcctgtaatcccagctacttgggaggctgaggcaggagaatcgcttgaacccaggaggcagaggttgcagtgagcagagatcacgccactgcactgcagcctaggagacagagcaagactccgtctcaaaaaaataaaaataataataaaaaaagggtggtctagacactctgtccagttgaatatgagagacgtatgtaagtaattttaaattttctaatagccacataaatgagtgaaattaatggttattttaacctaatatatccaaaagacttcaacgtgtaatcaatataaaaatattgagtttcttttattatactttaagttctagggtacacgtgcacaacgtgcaggtttgttacatatgtatacatgtgccatgttggtgtgctgcacccatcaactcgtcatttacatcagatatatttcctaatgctatccctcccgcctacccccaccccacaacatgccctggtgtgtgatgttccccttcctgtgtccaggtgttctcattgttcaattcccacctatgagtgagaacatgcagtgtttggttttttgtccttgcaatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctgttgtgaatagtgccacagtaaacatacgtgttcatgtgtctttgtagcagcatgatttataatcctttgggtatatacccagtaatgggatggctgggtcaaatggtatttctagttctagatccttgaggaatcgccacattgtctccacagtggttgaactagtttacagtcccaccaacagtgtaaaactgttcctatttctccacatcctctcccgcacctgttgtttcctgactttgtaatgatcgccattctaactggtgtgagatggtatctcactgtggttttgatttgcatttctctgatggccagtgatgatgagcattttttcacgtgtctgttggctgcataaatgtcttcttttgagaagtttctgttcatatccttcacccactttttgatggggtttctttttcttgtaaatttgtttgagttctttgtagattctggatagtagccctttgtcagatgggtagattgcaaaaattttctcccattctgtaggttgcctgttcactctgatggtagtttcttttgctgtgcagaagctctttagtttaattagatcttatttgtcaattttggcttttgttgccgttgcttttggtgttctggacatgaagtccttgtccatgcctatgtcctgaatggtattgcctaggttttcttctagggtttttatagtttgaggtctaatatttaagtctttaatctatcttgaattaatttttgtataaggtgtaaggaagggatccagtttcagctttctacatatggctggccacttttcccagcacatttattaaatagggaatcctttctccatttcttgtttttgtcaggtttgtcaaagatcagatagttgtagatgtgtggtattatttctgagggctctgttctgttccattggtctatatctctgtttggtaccagtaccatgctgttttggttactgtagccttgtagtatagtttgaagtcaggtagtgtgctgcctccagctttgttcttttggcttaggattgacttagcaatgtgggctcttttttggttccatatgaactttaaagtagttttttccaattctgtgaagagagtcattagtagcttgatggggatggcattgaatctataaattaccttgggcagtatggccattttcatgatattgattcttcctatccatgagcatggaatgttcttccatttgtgtcctcttttattttgttgagcagtggtttgtagttctccttgaagaggtccttcacatcccttgtaagttggattcctaggtattttattgtctttgaagcaattgtgaatgggagttcactcatgatttggctctctgtttgtctgttattggtgtataagaatgcttgtgatttttagaccaataacaggctctgaaattgaggcaataattaatagcctatcaaccaaagaaagtccaggactagaaggattcagagccaaattctaccagaggtacaaggatgagctagtaccattccttctgaaactattccaatcaatagaaaaagagggaatcctccctaactcattttatgaggccagcatcgtcctgataccaaagcctggcagagacacaacaaaaaaaagagaattttataccagtatccctgatgaacattgatgcaaaaatcctcaataaaatactggcaaaccgaatccagcagcacaccaaaaagcttatccaccatgatcacgtggacttcatccctgggatgcaaggctgtttcaatgtaaggcaaatcaataaacgtaatccatcacataaacagaaccaaagacaaaaaccacatctcaatagatgcagaaaaggcttttgacaaaattcagcagcctttcatgcta

SEQ ID NO: 460 - DNA, 95188 bp, Homo sapiens
aaccgcccggaaatccagcttttggaacgtggggcgaggcgggagggacctgcccagcaatatggagccggctggggagagccagggagcctgcaacccggagctaaaatatcgtgggcaattctctggaaaccacagctctaacctaagctcagaaactgcccctcagatcacaagacaaagagaacagaaaacctctggccaggcactcctgtacagaaatacactttgataaccagaattggagcctgaaatgcaaggatatatgcagaatggctgttacgtgttgaatgcagaatgtgtgtcaactgggtttgggggaattcttctgtttcccggggcgctattaatatcggaaaggtctcacttccaccgttaatcccttgagctgcagcgctgttggtgtccgagtgtgagtctgctctttatttgggggcttcatgattttaggttttttttcttttttctcttcttttcctctttgtcagccagtgcgaagtaccaatggataaagcagttccgggttttgaatgcaacataagattgtcattttggtgtgatgaggctcaagttttagtaatcaggagggatattcacagagcttattggtcaaggcttgatgtggagttatattttaatgcttcattagttctgttacgttttggcaaccttaaagatggttagatattagctaggaagggttggagtgggcagacaggttcatttcttaagcaggttattagaatattagattgtcacagtttgaattactaggaatttggtgacttctgcacagaaggccacaagtatcttttaacattgaaaaaggaagaaaaagcaactcactagctatacaactttttgacagattacactgttcttgaaaaaccgtttagaagaaagcagataagagttttcttaggtgcaaaagttgattaaactttaggaagcaagtgtttttgaccagtataaagaaaataagagtaatgtgtgggggtgtgtgtgtgtgtgtgtgtgtgtgcgcgcgcgtgcctgcggctaaagtttgggaagaaatgttggttcagagttaaggtttaagttggaaaggccagtggaggaggctccctgccttgcagaactgctgggtattgtcactgcttgcctcttcagcttttatatgcaggtaggtactagataatcatattactttttccagagaagtggatagatttttatgattgggagaaagtttaatgtatctgatactggcttgcaaagtgtaatgtgcatttacttttaactttcatcttgacttgggacctgttcttagttgcataacagaactctgcagtgtacacactgctatttgatgttttatctgctttttaaaaataatgatatcagtgagtctcttcctatccatgatgctgtatagtcagtgtaaaaagcattttgtttcccatttattgaatgttttttctttagcgatttcttgagtttaaatatactaagcgcaggaaatcctcacagaataaagttggttctgggaaacagaagtggaacaataagttataggaatacatattttgattatagacagtgatgatggtggtatgcgtttatcttttggtaatgtcagtttcacctaacgtgatttttgaaggactttgaattgtaaatgcaaacctactcaaactaacccaaattttgtactgttaaaagttttggccatttctttacatttttccatgactgtcatataatttttaggttgatatgttgattgaacatatcaacctaaattgatatgttcaatcaacatattggtcgttcaggggagtattgtaaaaaggcatctactctgaaagattgttcacatgatcattaaaataggaacaattctagttcagcttttattgtgtttgcattttgtgatttgcaaaatacatgttttattgaataaagagatggtgaatgagcaggctgaaaaaaaattgatttttatgctcaagtagaatatagccagttgagataatgtttgtgttgggttttggaattctctcacgtcaaggcatacacaatgcaaaagatattgtatgtttcatatgagctcctccagctctccctcttgcagggcacagggtttgcaagtgaaggcaagagaatgaagcattttaatgaagccctggaagactagaaagttagttatcaatggaaggaattatcaagttagtttttactttagaaagcagaatataaattatatcacagctttttatcaaaacctaggttttaattaattttcaaagtattcatatcatttactgcattttcccatgcctcctttacgtacaccctaatgccctaatgtgattacttgccatgattctgccaatacttgtatggagttacttgcttaaaagagtggcaattaacgaccatttcatgtacattaagccacatgagctgaaaaaatagactatatagttacttataaacttgtctgtatggcctttatttatcccctaggtgttaggtgtttatttatttgaaaggctagagtgattgtagtatagtgttattggaaaaaatgtctactgtagaaacatctttggagattttattctgctagcattgttttccttaaagtaaatcaaatacatatccacaggcacctgtagtcaaaatagttgtcaggttaatgatcatccaagagagtattgaagtcacaggagtctggccacagtgtgaggaggctccaccagtgagtgtagtgagttaataaagccaaggcatctggaccagccattccttgcctgttgtcttcctccccggatgtcccagtgtcccagcctggggttctgccccaggatcaagggctgtaccatgaggacacagctactcatctctaaatcctggggatgcacacacacatgtacacatcccttggcctctcccaggcctcctttgtcctgacctctgtagagccgtcctctacctcaggtaaggagagaactacatgggcaaagtccacactcagcctttatctatttactccaaaaggggtttaagacagcgggagttttattttagctagattcaggattcacttagaactgtttgcagagttaagaggcaatgcagaagaaaatccctcataaatgtttgttcctctgttaaatctgaattgtataaatggcagtaggtgacattcaatactaatagaaataatagtaatataatagttgcaatttactagctatgtaactttaggcaaaatatttaacttttatctgcttgttttctcatctgtaaaatagagataattgttgtacttagagtgattgtaatggttaaatgagttgatatatgtacaactctgagaactatgtgcctggcacatagtaagtactatgttggcattaattatcctaagctcctattatcaagtatggagcgaagtgctttatgtatgtcattttgttaatcctcataatgactctgtgggctgtaggtttgcttatagctgtctcacagatgataaaactgtgccacagagaggtttaagtaactttcctgaggttacatatttaggcacaatctgactggggcagctgcctgaatctgaagctcagtgttcatactaaccttgccaagaagtttacagaatagcatctttttttcaaaagaagagagacttgaagtcatccccttcagtcctctcattcctgccccctcaggtcctcttcattgtgatgatgcagagaaccggaatggtcagcctcatggccttttctgggtgataggatctgtctgtccctcaggtcccagaagctacgtcaccctttctcccagcctccgcgtaatggctactgcgtgcctaagcgttgctgtcacctgggccagggtcattcctctgtgtttcctgcagtaccttcccctcatgttggctgctttctgaagagccctagctccttgttgtgttacctgggcttgtgctacctgttctcctctccctcgccccacaaacacaacaccaaaagggcttgtaggcgagaattacagcctatacagcctgtttacccacaccacacacccagccctgagcatggcagcatgcaacacattctatttagttggttggtttggaaatgaatttgatgtctattatttggggttaatctcagcccattattttcattttattttaattgatataaagtccacataccataaaattcaccctaaattcatcatttcaaattgaaggcaatttattatgtttactaggtgctctgggttgaatgtgtcccccagagtttacatgtcagaaatgtaatccctaatgcaactgtgttgggaggtagggcctaataggaggctgtgctctcttgaatggattaatgtcattatggcaagagtagattagttatcttgggaatgggcttgttataaactcgagtttggccctgtcttgctgtcttgcccttgcaagaggacataagatgaaggccttcaccagatgctagtgccatgctcttggactttccagcctccagaaccaaatatacttctgttgtttataaattacccagtctcaggaattccattataacaacacaaaatggactaagacactaggatattttaattttgttcgtcttgattttcatgatttctgggacaccatgatttggaaggtaaaccatttttaaataatgatttttttaaagactgtatgaatttaggtgaggagcttgacctagactctgaactagcacactgaagttaaaaagatggactgtagagagatatgggctgtgggcccaggaacccttccataccctcctgccttggttgaagacccatttcgtgctgccatccaatgcctaactgctaatttcattgggagatagaatcacatgacttggatatattcttgattaatttaatgtgatttaaaaatatcctgtattcctgcctgtccatcaagttctccaaattcttgtcatttctaaatggagaatggagtaactcaacaaagtcagagagggcttttttgtttggctctttgccaaaatgcctataggttagagggttacacagaaaatctactttacagcagttgtacgttaagtagctgtggattgctatttgtcaaacatcagaaacaattttattttggggaatagaaagagaatttctctgtatgttagcagggacagaaaatatgcttctgattaatgggattgcaggcagtcattagaaggattgaaagactggagaaaaattccttaaaattttgaactgttgcatatgatattatataagagtaagttagtttacttgttcgtaggattcctttataccctttgttacaataacttatgcatgcactagcttggagcctatatcacaaaactgccttggttatttgaaaatattacattgtagataatgttatctacatataaaaagcctttgctatgtgaataatcatgtcagaactgggtaaaaatagtttagtgggcaggtatatgtagcaaaagagaatagaggcatgatagagtgaatctgaggaaaaatcctgttgatttggatagtttaggctccaggtcgatctcggtaggggtggtggttacacaggtattaccaaatacctcaggctgctgggtcttctgcagtactgtgaagaatttgaggatgagagaaaagagaacttcccagtcctctagatgtgacagtccttgtggcagtgccatatccccctaaggaggagctgggttattggaaattgttcagtggaggggcctgggatagtggcaggaggcagaggtgctaaggatacaggtggcagaagcgaagctcatagagcagaaataggcaggattccagaagtgggcagccttccagaagtggtgtgcccagtattcttttattcactagtttatggacttctttcgcagggacacattttaatgaagtctctttggaagaaaatttgcatggctgagatgctgggttttggagttgatggaactgccgagttaaaatagcttttttgtgtgtgcaggtagtgtgaaagagccacatacactatcagtaaagccgctgtctgagagagttaaagaggcagacagacagttaaggttaattggagtgatcagcttgtgcaggccacgaacctgcatcatccacaccaaagcaagttgagttcaggcagtagatgctggaggtgttaaaaatgggacttacagagctagactgcctggatctgaattctagttcctcttcgcaattgctaagtattatcgtgacagagatattttctgtcctatgttaagtgagactactgatagtacctgtttttatatagttatctacacacacacacacatacatatatgactatatatatgactatatatatatgactgtatataactatatatagtcagcatcatcatatcatctaatactaattgggagctatatgtgtacaaactcaatcatcatcatcatcatcatcatcatcatcatcatcatcatcatcacccaatacttaaccggagttttatgtggattaacccattcagtcctcaagaatgacagacgtcaaaatggacatggcagtcaggagaaagtgtacaatgtgcaaaagagtaggggtggctgccttctctgtctagctaagggctctctacatcttatcaccatgctgtccagtccccaccccaatgacttgactgctctccttttttttttttttccacaacattgccctcagaccacttaattgacactgactaatggctggccttgaattaacgtctgcatcaatggatggatgccctgtttgtatccatcttcctggccttactttggggtctcagaagacagaaatggtgtgttctatttaccatcctagagtcatagaagatttgtggttctttttatcagatgaggacccagagttctgcacagggttcttcttacccacaaagtaaggttcttcttacaggtggcaagggagagagaatttgtagagacctttagttctctgtcacttcagacagggattgcctctctggtgtctagcctctaaaagtcatcatgttccttaggtttctatttccctttgcacaaatttagcctcaggcagactcaagcacagcttttaggtttgtaaaaccttgacaagtcctggagccttttcttaatacagagccccctggcaaggaacagcttcagaggtaagctgtgagcaggggcttgcttgatggttcctggaggattgaagatggggaagagtttgttcattatacttcccattctattaagaatcccaccaaactggcccactgggtggctggaataaaggaagtgttaggaagcagctggcataaagatctacccagcctactggttgaggatttttttttcccccctaaaagacatacattgccaggaaaagctaacaaaaatttcaaggcagatttggaggaattaaattattcttaggcacattgcctggtttctaagcatttagggatatgtaaatgttcatgttctttagaggtctctgtctcttttgtacagagtacattagtactaaaaatgagatttgctagttctacattttcatgtgaatttatgcagtgaatattcaatttgattctggatctttcaaaaggaaaggctttctttaaacaaataatatagcttatttttctgatatgctctattggttgctttgatttttttctccgacaactgaaatgcgaagtagagtactatccccaattaatattcttgctccacaaagacttccagtgtttgtttttgcttcttttaatatgtaactctcctaagtgtgttattgtattacagctaagaggctttacccatgtaaagttgaatactttacacttctgaatgccaacataacaattaatctatgattagattttgcttcttaagatgcctccactgacgagtgcctgtaatattaaacttctaaagtgttccactctttaaaacttataaaagctctctttgatatagcccactgaaattgtgtggctattgtttttattgctttattgtgcagccagcttaactgaaacctttgggtggcttttactctttataataaagataacattgagaaatgcctggagtacaaagtgtatatgtgtacatgccgttctcagccatctactctgacttagtaactctctaattcccttgcctccactatgtttaagaacaaaaaagaaaaacacttacatttcacatttcctccatcaagctgtctttatagagtggtctgtagcaaccattgctacttcctctctaatattttttaactccttaagatgttgttgctgtcctcactgctggactggaatctgcgtgatgattccatcatgggcgaagccccaaattatttagccttgactcagtctctcctgtctggatgcctttgcaggatttagtcttagggatcacattttcctacttgaactcttcttccttgtttttgggatgttgtctctaaaccttgactttccttcctcagttacatacattgaacttcactatttggcccttggatcatttttttttttttttaacttttgatttgtccttgtgagctcttccattccattgaattcagccttgcctaattgtggccgattgccaaatccctagcatgtttcctcttctgaatcacagaccagggtttcatcagccactagcacacttgcacaggggtgcccagaatcaccgtcagcccatcaggtcacctggcttctctttgcctgatagtgctccaaactctcattaatgcaggatcaggcaccctttgctcctctcgttctcgccgcacatttaagcatttgccacatcccacatgttctttctctgcagtgtttatttcactcctcccctttccacacctgctgctgccaccctggtttgtgtcctcactacctcttggccagacctctgcaacacacctttctcgcacactgtggttagattgatattcctggagtgcagctctgatcccgttgctcacttttcaccaagccctttccgtgttccacactgtgggctgaattactcacaaactcagcatgggcatgcgtgatgtcctacagcccctacctaaatctctaaccccaatcccactgctccctctttggctccagacggattggactgcctgttctagctcttctcagaatatgacattttcttggtcacttctgtaactagcgtccgaccacacatgccattctgtcttcagattcctgcagttagtgtgctttctccctcgtttgaaccctgcagtgtttagtttctgcctctcttatgacatgtactagtgttgtggctctgtgtactctgagccacattatcagcgataatgtcacattatcgctaagacattgcctcatgccgacactcctcccctctgcccccgcccggtgttcttagaaggcagggactgccttactaatctctgttgtgtcaagcaatagcacactggcctgtgtctgtctgccaaatcgattaagtacttgttgaatggaagtagaaattccaattaacacagatggcaaagtgtgctgttcattcttaagtctcgtttttttcattcctaggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaaggtcagtattgataagtggttgcttaatgactccctttctttttctttttaaggaaaagtcttaagtttgggttgagtcgttatgttctgggcagaagttaccttggcaactgcacctgaattgatgtgtggtgcataaaagcttggtcaatcattacacaactagaaatttgtgtttgtggggttggaagttgttataaaaatagggacacagtatccgagaacctgtttagtgagtgtcgttgaacactattattatagttgtcattgaattaaacatctactatatttcttatttttgtaattggcattataggcggagtattcctagtctgaaaatatgaaatctaaaatgctgaaaaacccaaaattttttgacacccaaaggaaattctcattagagcattccagaattcagattcagtggtcaaggggtataatgcaaatattccaaaatccagaacaacatgaaatctacaacacttctggttccaagcatttcagataaggaatactcaacctgtgtatatctaataataattttgggaaagtggagggtaagtctaatataagtatatttaacatgatttgtatggaaaaatgtagagagtaataaaatgaccacagaactcggctgagaagaaaccattgtttttataacctggtatctacctcttggtttcctctccaggatcgctgtggccaaagctgaaacccaatcctatagttagtataaaagtaaagggatttcacttcctttgtgggtagtgtcatttgtagcattaatgcctatagtctggttcgccttcatgagggggaagaaaaattcactgaatactttgcttaaatggaaaccaccttcattcaaaaaccacttattgcttattggagatggtccatacttgcgcttcaggcacagctgtgtctttaaggtttatcttctgttcggtttcacacagagacaagccttatgctcagctttgctgttatcagctttgtcaaataccggtttcctcactagtaaatcacacgcatttttcttttttctcttgtgtagtcttctttcttagggtctaagaagggaatgggaaggaatggtttaagatgggtgggcctaactgcagtagttatatattgaggagacctgactggcatcacaggatatttctggaagagattctgataccactagtaagctattataccttctttaatgttgccttattctaacacaagtgaataagacaatgagaacagagaaacagaatgcaagggtaagagctgcctttcagtattgagtagtaatagattgggaatattgtgttaaaatcaaggaatttattaatgatacctgaagggaagcccttttctttcccatacccagcccaaagggatacttatttcataaatgttatactttataatgttcaaataatatcttttattatattgttcaaaagccaaagttaatttttctttgcagatcaatcaaaaaaccatgactctccgcacatacataagtgattttatcaaccattgcagcacttagcagattgaagatacatacgtaatcgtttttctccaccaagttatatattttcaccttttattttttttaagttaaaaacgctttcttcagtagcctaattccaaaggaaaagtgatttaatttttccgagaatacagagctttacagaatcataaaaatagttgaattagagaagattatttaaaaggtggaataagggcaccttgtcaagattagttacaaaacaattttataaaagcagtttctaaacaaaatttgcatttgataattgctatcaggtgcaagtttctttggctctggtgtacagaaaagcaagtctttccttataggaaaagtcattttctctttttatatcctaaactattttataatgcttgctttctcatgtaatgtgatgacaattgagatttttagcagctttttcatttttctttaatacatggaaagatggagtgaaatgaaaatttttagcagaattcaagaaagagacccatgataatgtgcataaaagtattagagcctgaatataaatgagaaattagtaataactgaaagattgaaaggagagtgttgggggggggtcatgtggggagtataatactaaacattcaattttctagaagtgttggtcttgtattctcatttaaatattcctatgaagcgagaattcaatagctcctatgagttgcatgttgaattcatatggaaagtagttataaggacaaattttatatgttagaacctgtgagactagtttcttttgcctccgtttgtatttctttgaaaagcttttgcagtgacaaattgtgtgaaggcaagaaatgatagttctgttctattcttaccataattgaattctttagttcttttctttttttttccttttaacaccctccacctccacctgacttagccagtttttcatgttatgctgtgtttattgcatttagaaggttattcctcaccaacccccaccccaggtctaggaaccacatgcagttttgttttgtggacttggcacacctcgttaatgggcagcagggtagacagagggtgcgaggacagcctgcatgccaattgtgtgtctgtgtcctgctgagccttgctgccctctctgtttttaaaaggaaattgtccttagactctggccaagagtacgttctgtgagagattcctccctgtacgatagtgtcttacttttccactttgcttgtatgttcttggaaataaagctgtgatatttaactttttgagagaaagagtcaaaaacccattaggaaatcttatatacggcactgtactttcttccaatacattttgcatgcagtttttaggaagccctggcatatagattgaatgaattgttttaattggataattttggatgtttttggacttaaatacattcagtaagcatggtctgagtccttattttgtgctggaaagcaaagataaaagatgaaatcaaggctcaagagccagcatgccctgagatgctctctcatgcctctcttccacctttggagctgtgctttttctcctctgctagtacagctcttcccctagacatctgcctgactgacccactctcacttctctgctcaaatctttcgtctcatggagtctggctctactcacgctattctatgctgggacctacctctctgcttttgcaaatcattgattacttaacccacgatatcgtttacttattacgtttattgttcattgactgttccctctgttagattttaagctccataaggggagagatctttgtggtcccccattatcctaagtacctaggacagtgtggtagtttcccaacatgctggtaaacaggtgctgctgcagctcatcctacagctatttcactttctgcattgcttttgaaattgaccacgtgctctgaatgtcatgtgcagtcatacaaagcttaatggcccatcttgttttagaaaataacagcttatttgttatccacatccttcatctgaggcatcctgccttggccttaaccattgcctggtatgtctccagaactctttattttcttcccagggcctgggacaggtagttctgctggtgggaaagtgcattaagctgatagtaccttcagtcacttaagccaagtgagtagaggggctgtcatggtcagcgaatatcctcagggcaaattctgtgccctttctcccatccttttatctccttccctttgcatgggggctaaaattgccaatatgaggatgacgttttattttatttttctacaagccagtagagccctatgttatgttcttcggagagaacctcttccatgttttgtttggataaagagtgtgctgggtgtgcaaggtgggtgttacatgtcctcgggtgaggcagctattgaaaggcaatcttatggctctttctgctttagcttgctcagatcctggcatcccatcccgctacaccaaccccattcagccagggtcctgtattttctcttgtacacaacgaaatgagttgattgaaaatggggatatagggatatgggaataaaaatatattcctctgtcatatgtaagccatccagtggggctatttctcaagacagtggttttaactcatactttgagatcctttaattaaagtcatgctaatgcagaatatttagacgggtgagagtctgtgcccatgttagtttgtgcagtgcagtgaaacctgctaacacaagagattacttactgcatacccacctccatcctgacctgcacaaccctccctggctcctcctgcagcctctgacagtggatttcagctggtttcaaacctaagacataaagcatgcatttgacatggcttacgctaaattttgatcaaaatcccttttaaacagaaagaaaaaggccaccattggtgttggttttcatggtttcccaaggcatgttattgttaaatttttcacattcagcatttgagtgtcccttcatggttgttgttccctgtccagaaagcagggctgcaataaatcacaaacattgactacactgtacagaggtcacagaaaatagtgacctgatcccaaattacacacctctgctgagcccgttggtcataacctacgctgtctccttgaggcaaatagtgcttgtgcaagtaatttgctttgcttcacaaattcctgcctttacgaattctgttttctttcagaatatactttctcataacattcttcactcttccttcctacttaagtctttgctgtgaacttggaggtttgtcttgttaagcccaagtgatggggaaaaccacccaatttatggtgctgactgctcattctgcatctatcgaccactctgtttttgcgagaaagttgggtcagttacaggatcttagaagataagggcctttgagctctgtctctaacttctgaccacaagaaaagttcatcaggacattatggagatttttacccaggcatgaaaatttaagtgtttgccctctgtgtttcagtaggaaatgaaatatatttctactgaaatataattgattaaagagtgtgtctggaaaaaacaaatgtgctaattattttgaataaaatcagattagcctaaccacttagggtcacagaatatgtcatttgcatattaaattacttattgcaacacagttcaccctctcatgagcatttatattctcaatacattcttgattttttaaaaacattttttctgttaactttgtttccctaaaaatgtgtaagagaaaggaaagtagccctaattagcgatttgtgtatccgtggttttttgaaaatgaaattgacaaaaagagacaggatgctcacttttattgctttttgcaggagggttcttaccctgagctggcctggccactttaggaattcacaggcacgctctgaggggcctgtgagtagggaggctctcttacccagaggggagaggaaggcatttctccctccttccctcagtctgttatttgaagggaatcacttgaactgctctcctagagctgcggtgacagttaagtccagggttgcagaataagacagtatttgaggagaagaagctttctgccaggtgtctgtttctgcctctgtcctttagaatcacagggttatggtaggcaagttatattttcttatttaagtgaaatgtttgttcagatgcttttgttaaggcttctgttctatacacttctttctgtgttcttttttcaaaaatgggaaaagggtccagtgtccttatatgtatatcctaagtaaagccctcacacacctctgattcaaataggagttatttaattagagggagcatattttgttttctggcaactaagttaatgttgatattctaatacaattttctttgttataaatatggaactctctatttaacttgtcaatagattctttgataaatttgatgtcagtcttctctggtttctaggtgatgcatctttgtctacaacaagagacattctgattagtaagaatttcttctctgagttagaaaaaaaattagaaattctgaaattcaacaacaaatgctgacttacatctgctaagtagcacccaaaaaggggagaattttttacctatggcaaataagagtgccaaatgtgacatcatttacatatccatgttttgattagtaaaaaccaaacagatgttagcagtacagctggctcttgcatatatgtgtatctttgttgctaacagatttccatggggaaggatgtagcactggtctgaagtctcagataggagaagataacatggtgtgatagcttgaaatgaggagcataattgcatgatggattatatctgaatgttttgaggtcttgagtttatagcattcgatatcaaagcagtccttaggctttcaatagaggaggacacatggagggggacaaagtgaactagaaatgggctttatttcaattgcttgggtatagtgtacctaaaatgtcaagttgtttaacagaatatcagactactttataaatgtgttattccttcttaccaatttatgtaatattttatttttactatgaaaattccatgcagtatacaaacagtacgtggaattgtagtagaaacattgttaaaatataactttgaattaaaaacaaaacatggtatacattgttatataatggataacatagtgtatacattgttaaaatatatccttgcaattaaaaacaaaacaaatcagctgcaaacctttgtttaattatgtatgcagaactttctcccaatggctttataccacctaaggcatggctgtgattttcaggaataccctctctggactgtttcttgcttggaggtgtttgcgatgtatttgtatttgtctgtctatctattctcagttggtagattatgtaatgcctatagattattctgtcctgtcacagtttgattcattttgaagttataactgtgaatttattacagcgtattgcaggagacgtaatttgatgatcaaatctgatatccaagatcgtaaagaatataggcataaatgaaatataaatctgtgatatattatttgaatcagaaattccacattgctttgctttctataaattccttaacgttctagttccagtgttctctaattgtaagatgagaagctaaatgctgtctcttttgagtttcagcagtttttgttttaatccttctcttcccaatcagaagaactgtcggagaaataagacccagaaaaattggttctcactagtagtgtttccccaataatgcaacccagaagccctgtatatgagaataagggaatgtagtgagaggatttatgcagagaaacaacctaggatggttggaaagatgtacttacatgacctcattgcacgatctgattggagactggtccatggattgtatgggattattgcttatgaaagtgcccacctggtatcaagtttttgcagatgcatgcggtgtatggttttaagacatgtttcaccagtgtgaatatttaggctctacttctgttggtgggcagttagcaattgctggtatctaaactggtttgagacttactgcctcatttgaacagtatctgtgcagtagcgctaaactcgttgacatgatctgtactgagagttcctacagatttgtttcatatatatttgttaaattttccaaggtaagtagagagtgatggttataacatttgtttattcagacccctctaaatctacctaagaggtaacatgttagcataggcattagacaaggctgcattgtgaagtcagagtgactgtctggggttgtcactgtcatcttccaagctttctcctaaagaagaaaattgacataatgctctcagacttggcacatgggaccagtgccacagcaagcactggttctagcctgctactggtttttggtaaaatgcagttttcagaactactcaagggtgtaataagattaatttttatgatattagatataatatgttaactttttagctattgttaatcttaaacactgatggctttatttttattctatttaaaaaaataatttttgaggccaggtgcagtggctcacacctgtaatcccagcattttgggaggccaaggtgggcagatcacttgaggtcaggagatcaaaaccagcatggccaatatggtgaaaccccatctctactaaaaatacaaaaattagctgggtgtgatggtgcatgcctgtaatcccagctactagggaggctgaggcaggagaatcgcttgaaactgggaggcagaggttgcagtgagccgagattgtgccactgcactttagcctgggtgacagagtgaaagtgtctcaaaataaataaataaataaataaataaataaataaataaataaataattttcaatgcttaagaattttttatcagtaaacagttcatttgaatttttttttgcattcttgtttcccaactatagaaacatagctgaatatttgtggcatcattaatgcataatttcaaagcattttacacattgttaattaaatctcaccatgttctttcaggtagcaaaaagtaagtttatttttgattcagaagtatttgaagaagttagaacaagatgattttattgctaaataataaggaatatctgtggagtaccaaggaatgagatataatgaatttggttagagtatatcaaagtacatattatagtttttgtcttacacttccctgtgggtctgtttaactattgaaaatgtcttcttcaaaatgaaccttaaacatttgcaaacttactctttgctaattattctgccaggcatttttttttttcttttttttttgaatcttgctctgttgcccaggctggagtgcagtggctcaatctcagctgactgcaacctctgcctcctgggttcaagcagttctccagccacagcctcccaagtagctgggactacaggcacatgctgccacgcctggctaatttttgtatttttagtagagacagggtttcaccatattggtcaggctggtctcgaactcctaacctcaggtgatccacccacctcggcctcctaaactggtgggattaccagcgcgagccaccacgctggccctgccaggcattttatagacatttttcatttgacgctcacaaccaccctgcaaagatggcatattataacctttttttgtttgtttgtttgtttttttgagatggagtctcgctctgtcgcccgggctggagagcagtggcacgatctcggctcactgcaagctccgcctcctgggttcacgccattctcctgtctcagcctcccgagtagctgggactacaggcacctgccaccacgcccgtctaattttttgtattttttgtagagacggggtttcactgtgttagccaggatggtctcgatctcttgaccttgtgatccgcccacctcggcctcccaaagtgctgggattgcaggcatgagccaccacgcctggccctataaccgtttttgagatttaaaaactgaaggtcatgtgattgtgtaaatatttaaaaagtgatcatattaaaaaatatcatagtgatggcacattgataagattcaagaacattttgggcaaggcaggcagtcatgaggatctccttaagcagtctcttgtgaagtgatcggtaactgaattttgctttttgggtggtcttcaattatgtctgctttatctgttaggtttcactagctattacattcatgcaactccagaaatttacctccaatttatatgtgacttacaacattttcttatgtctggtaaatatttgaaaggattgaattacaaagagacggataaggccatgaagctaagacaaagttttgggtatgtgcatgtaaatgcaatttttctcaggaagaaatacaccatgatcagataactcaaaagttttataaccttgataaatagatttaccttcgtttctgttgtttttgaagaagttaaatgtctgctttaaatgtttccctgagtttcaagttttcttatttcagactcataattatatcattttgattaaaatggagcacagactggagttattacttgcttaaaagccaaaaacttgagggtatccagcataagaattgtgtgttttggtctgtggatagcagctgcttgaagtccataaaaacaagaaacctgaagttgattcagatgaatctgaagtcttgtacctgaattatgtcaaggttagcagtaaatgccatttaaaaagactgagtacaaattgccaaattcctttgaatgccaaaccatatttctcaggaaagttggccactgccaaatttataacatttgtgtttctgttacctgaattccaagggcagaggggtgattgagggggtaagggaaaggcacaggtgaattttattttcagatgtctaataggacagtgtgacattgcccagagatagtctctcaaaggtagtgagtgccagcagaacttctcgaatgcgaagttgagaaattttacttatttacttattttcccattgaaaaaaaaaaaaaaaactttaaatgttttctgagttaaaaaggcctctgactggtagtcctgacacagcttcttgagagtctccgagagagcctcttctcagtacaattcctaagaagataggaagaaaaaaaaaaatattcttaacacataaaactagaattagtgggaagaaatgcctactgtaaactcaacagaaccggggttaaaaaatataggataagttttgactacctaaaagtagcagggcagacccatctcttccctaactctgtccataattcagaaagggcccagggaactgtcctcaggaatgctcttcccccctcttccttgtcctctccgacagagcctttctaatcagtaggaggtcacaacttagaaaataaccagagagagctggaatggtaagttaggggctattactgttatattctgagaatcctgatccatgaaaataaagtgctgaaggtggggtagagttagaaagacctgtgttcactgagggttttgagtattacaggctctccatcactcagagcatcagaaagtcaggcggtgaacgcaggagatttttctctcaggctaaccaaaaccatgttgaaatgaaaaccaccttggaactggccttttcatctcagactgccaaataactagcacccaagtggatcccttagctcagagcagtcaccaggcatgggtaggtctttccttgtttagtgataaacaggaaaaacctaaccgagcctactgaaccatgtccatctataaaagaaaaagggagatcatactggagatttgaaagaagagtagacctccagaactgattgattataatttatttctgttatagtatttccacttagtattatgatttatttctgtccctcatgaaagggacagaaagtagtcaggcggttatgagatgaaaagacagtaagatgggatgaaatcggagtgaaacaataaaaaaaagactaagttaaaaatgtaatagcatattaaaattcatgtgtaagggggtaatgagctgaaaataaagtctgtgttttgaaggagaaacaagataaagctctttggaatccaaaggataaaaacataaaatgagggagaagatatatagagagaatatctaacaggagaattacaagtgttgataaacagggaaccaagtgaaatagaacaacatcattataagaagttttcatgcacgtgtgcagatttgaaagtgttgccgtatttttcatgtgaaatcaatgaaaaatatgtttgggcatttctatttaagaataatgttaaagtaccttgccaaaatatctggcaagatattagctaccagggaacaaagttgtttttcttctcctttctagcaataaatgccaaaaaaaaaaaaaaatagtgcattgattttagtagagttttgaggagaaaagatggtgacttaagaacttactgagcttcctccttatatgttatgtggaaaggcaattgagaggcattcgttgataagcaggagctcaggaaagatacactaaacctcttgttcacgtgggagtacctaaaggttgcctttttattgttaagctttataatttaaaaaggtgtaaatttaaacttaattcattttggttaacttcagtaattatcaaaataataaaactataaagtatgtatcttctaaacacctagaaatatatattccaaaagataggcaacaaagaaagaataaaaataatacagggaaaatgtttactatatatgactactttaaagaaatacagacattaacatatgtatgtacgtatatacacatacatatatacatataaaattgaccatatacatatatttgtgtgttcaacacacgcattatttttcaggtactgcactaaccttttattccattgacttgttacttttcctaagaactctgtgacactggccttattatacctgttttaaagataaacaagtttagttagagatggcccaaggtcacacagctagtggaggagctgggatttgaccccaaacagtctgactgttgacccaatgctcttaagcaactgtgcaatacagcgaaaggggcgccgggggttaatgttcacactgcttgatgctgctgacttccgaccagccacaaggcaccccggagccaaaggcagatgactccctggcttgccagtgacgtgtgatgcggtctgatatgacaaagtgagttaaacaagcagatttttcctctcaggaaacagacacaagaacaactgaaaagaataaagcagatgtgtgagttactattccttacagcaaaagaacctcatcagaaccgcaggctggaaagaggtgattacttttaaagggcagttcattcctcctgcatgttggaaactgtggctcttaactggctaaaattttaactttcagtgtagccctcacttggcttgtgcttcttaatgttgtagataacattatagatttatataatattcaacttttatatatatattacttatatataaatgtttatgtataaatatatatttgtatataatatgtattcgtatatgatatgtagtaaatgttatatttaaaccatcatatagaaaagccattattgggtacactgtacaaatctgcctttataattgagtgtactgttctactaaaagcagctttagagaaaggattgaaagccagctctttctacttcactagccttcattgtttggattggcattatgtgtacagttatattgtaactgtcacttgtggtctaatcttccccttaggggaaacttgagaaacctggtcagctttaacatttagaggaagtttaaacatattggagcataaaattcacagttgtttaactgaaactccagttcttgtcagaccacatctctccagcccttctgtgattggaatcatctaactttggccctcaataaggaaaactttgacaagatgcaaaaaatgtttactcttgttttctttgccaggaacctgagtctgcagcagactctgagacctctttgcctaccccaaataagtgaattgtcactgtaactgttttttatccccataactgctttcggtgaatgccaatctagttgttacatgcctttaatattttgggtaattatgttctttaagaatgaaaatattttttccttccttcctttcttctttccttcctggttttgttatagtctagctgtgagaccagttgcctttcatatattctagaagagaaggatgaggtgagtttcacagtgatctttttccaaaatacaaaaccactgtcactctccacttcccaggcaaccccactcattctattttctagtgagggttttgcttagatgatgacgagtctcttgattcagtggactcctaagggaccatctttcaccagcaccaaatgctgtttagttcacatattgaaatgttttaaattataacttagcaattgtagttagtaatcttcacattatattgtctcacatttaatgtataatttcctaagagaaggaaatggtcctggtgggggtcaatagttatagtaactattaataatactgatgactactagttaatagtaattaaggcctcctaaaatgagaggaaaaaaaatcttttgtttataaggtttaaaaagaagagttgatacttaatagttttagtaaaaccccagtgcatgttcgattaattttgttactttattctgggcatgtagttgaataattacctgcatttttgatttgctgaaaaggtggtggttacaattttttttgttttttttttttttacagtactgtttttagttcattacattgagatgctacattttccttttcttaaatacatgcaagatgaaatgttttacctctgagatgaaaaatttgaaatttctttaatgtgactccttactaacacaattgcaggcaagcattgaacatttgctttgttccaggcaccatgtgctgtgtgctctacctacctaatctcacttagtccacttagtgctatttgcaggttgaggcttagaaagaaaaagaaacttgcccagagtccaacactagtagctggtaaagagctggtctttgcatgcagcctctctcacttcaggatgggtgcttcccagcaccacactgtaccaccctcaagacgagttgcaggaggaaaggaacctctagtggtattaactaaatcttagcaagtagttgcctgtaaattgtagacttttaaatacaatctcacatttctgtgatctttacccatacaccagttaccttcaaactaatttaagaatcttatagatattaaaaatgcttgattggccaatatctcatttctgtcaaaatcatgtactagaagcatgtatcaaatcagagacttatttatgacaatttgcacacacatttggataaaatgcatcaacttctttcaaagtttacttgaaataaaaagggaagaatacgaagtatcacaggttaaagcaatgccctcattccatttaggcaaaagtgttgtgctatttgaatagtgttagtttgagaatatggagttgtactccttatagcaattccaacctagaaaaatgtttgtgttttaattgatgggttaggcaaaaagttaatctttgcatagaggaaagaaacagctctgacttagaggttttggggctagaacatggatcaagtgtctgaagtttttcatgtggcctcaagttgaatcttggtcagagaatacacggtggtcaaacttcacaccatagtcataatgtatgaagccaaaagaaaagtcctagttgctgggtgcttccattatatcatcaacctgggtttaatgattttattggaagcacgacttccagtgaggcaaggcagtaagccccagaagagaggccttccatgggtagataggaactcaaatgctttcccaggctggacccaggagactgtgtcagctactgtgatatggcttgccaccaggacagatcattctacccgtctaaggagttagggtatccccaagagctgtgatgggaggtggaaattcacacctgtgaaatgggaggtatgctgagttgaacgggatagcccaaggcctgtccatgaactgagccatggccaaggatttcttaattctagaggcctccttcttgagcttgccttcttttgaacttggccctcagtgtctgggtaagttggagcgtgactatccagggaaagcccctggtttgtatttagtcaagttggccagagaagactggatctaagcgggaataaaatttgctgacccccatctcagaggttaacattttcatttgtgttttgcatgactcattttaaattacagtgctctacaagtatagaaagaagccttcctcttcccaccgtccccagacaccacataatggaaaaagcaagaattttctgcataagcaaggccttaaaaaaaaaaaagccagcctctgatgggacttctttcctgccagaaatcccactggtccactgtcgcaatttttacaaaaggccacgatgaaagagtaaggcccattttgagccctttgcttctgtattatgtgaaacataacttgtatgtttcacatatgttcttggtatcagaagaattgttagtttttgaacatgtaaaatctactagggtctctgactgttaaagtataattttgattaagaaaagatttgttccactgctttgattagacacataaaactttgaaaagttttgatgttctgtttcctgttttaaaaaaatatgtcctctcctatgaactctaactagatgagaggattttcctcagagaaaattcagccctgggaagaaccatctatggaggtcataacctagaaaattcttcaagggaagttgcagtgaattaaaagagggcggagttagaaagtcctgttctaccaaatttgtgctaatagttgcacctttctttctttcccagaatggtcactggagaaaatgtgtaaaccaactgcaaacaagtttatccgttgccacctttcttttcctttagtgacagttcaattcgttaacctgaaggagctactgtaccatcaagactagctcccagcccagggcttcagcataaagcagctgctcagttaattttggtggatcacgggcagaaacaagttacctttgggatgcagattctgaatagtctgccatgaaatgattaaatgaatgagagtgatgaggggctacttaattggactatgtaaaatggctccttaagcttcgtggacaattgagtaatttcagtttcctctcttcactcttgtttacttcctgctcttctagcatcaagtgttaggtattctgttctcttacaatgagaagattaaacagctgtagtttaaattaaagcattaatttggagtgttctgtggctacattaattatattttctactaagattaaattgcagatggatataagcagcaatatatgtttatccagggcaaaccagaattctgttaaccagccatccttggtgactttttatttatatataaaaacctttttaaactgaaataatgtaacttgatttttccccccagttaggtagaagaaaaaataattggatgcagaaaacagttgtatggagcgtatttgcataggtacaggacttgagtgacagaaaattccttttatttttttccccagtgggatttagcaaaaagcatgtgttgaaagtctcttgactaaatggatcataattaaagactttgggatttatttatgggtattttaattagaaacattaagttcactcagtggtccttgtgaaaacttttttctaactgcttattttatatcaagtaataaataaaatttctgtgggtatgaagatgagttttagggccgcctatttctctaggaccgcccccccgccccccgccgccgcttcagagagcttttctctttctttcacctattaaacttctgctctggacctcaaaaaaaaaaaaagagttttagctgtaaccacattgtaattcgtgctgaatatatgaatgctgctgttcactgaatagttaactggttatatcccttgttaatttgaagttttcttccttcgttttggaatgatagttataaggcaacatgcattttagaaaaatgcacttgtttgaacttctcagatctaatgtgactctgtgggactagatgttaagaaaccatatctttaactgaacatcatctatgatattccatctcataacatgttccatgagttttatggacaatttctaagaaatccaaagtagcatgcagttttatcaacctctctgcatccccttggcacaaggaataatttttctgttattgaggggcaaaacagaggggtaaaggcactcatacagttaaatgccagattaagtcaggcatccaagtcactctgctttgggttgattctctgagactcagctggctgacttcaaaaggacgaaatagatttcaacattggaaaagaatacagtatagaatatatgatgggtcttgttagctatctcttattttctaatccaaagagcctcctagttggaggaaaaacttgaactacataagtatatcagcaaattttcattatattttataattctttattgcattatacgtgaatatatttagcagtggtagtacgtcttggaaagtttaagaatttagacaaatatgctttttttttaaaaaaaaatagttgagttttaaatatgctgtttgggtccttatgagcatgtgggagatatataggagaaagagtttgttgctgatgttatagaatcaccaatgcagcattgcacttttgttcttttccattcattgttcttgcttacatggagcacttgcaaataggctggacgtctcagagttctgaacaatgcccttggctaaccgttagtcctaattgctgtgactaatgtgctgtgtgacctaaagacggtaacatacttaaccttggttttctcatctgtaaaatagaattgatgacctctaccaagccaaggatttcagtgaggcactcaaaaataaaaattaaaaaatacatttgggacaaacatgaaaaaaattactttttagacttaagcaatgcatttaaacctgacgaaaatgaaaggaattgaaattgtttagccacagaaaataaagaccaaggaccaatttaaacagttgaaaattatatgaagcagtgttttatggagagtagtaatgaactcttcttcaccttttttgaggctgtccaaagaagaaatgaagttagattattgcagaattacataagttagtaagcatggactgaccagttctttctaagacacatacttgagtatttattctcttcagttgcaatgaaggtgacagtgaatttgctgaatagctgtgtacatgtttccccaaagagaccactggaataaagttttgtttcttgagacagtttccattgcatttataagtcttgtcccttgaaggatgttttctggtaaacacctgtattctttttacattatatatcttcattaccgtacaagtttggttgtgagccattccaaagtctttagtatgctgtatgggtgtattctatactttataccttatttggaagtcataataatgtcaaaactatgcctagccatccccttccctgcagagtctcttttgctttgtccacttggtgtgtatattttttttttttttttttgagacagagttttactcgtcgcccaagccgcagtgcagtggcgcgatctcggctcgctgcaacttctgcctcccgggcccaagcgattctcctgccttagccccccaggtagctgagattaccggtgcccgccaccacgcccagctaatttttgtatttttagtagagacagggtttcaccatgttagccaggctggtctggaacgcctgacctcaaacggtccatccgcttcagcctcccaaagtgctgggattacaggcgtgagccaccgcgcccgtccatgtgtgtcttttttattttttgttttttgagacggagtctcgctctgtcgcccaggctggagtgcagtggtgcgatcttggctcactgcaagctccgcctcctgggttcacgccattctcctgcctcagcctcccgagtagctgggactgcaggcgcctgccaccacgttgtgtgtctttttaaaagatttccaggacttctttttcctttacaaatccaaaattgcagtagcttaataaataacaaatattttggttttatgattactgtcaaatagctcattagtaagagaaaaaaaaaaatgctgagccttaagaggggagaggaaaggcagtctttctgaagctgaatcctttgcctaaattgtcttagcaataaatcttgccacctattggtaaaaaggaagaactaaaactaaaaggtgtttgccgttctcacaggtagttagtagtgtgatcgaaatagaattctttcagcggtgcttttggataaggggcttggaaatatgtgatttgatatggaacttttccctgtgctttgaatttatcatggctcatctctaagtcataatagttttttgagtagaggaggtatgctgctctcatggtctctcttaaaattatattttttgagatagaattccattttaatagatcagtggattttaattggacacattttagaggcttgattgattttgaaaacatttttcttttttctttctttctgtctttctgcctttctttccaccacggctaactgcagtctgaacctcctgtgctcagttgatcctcccgcctcagcctcctgagtagctgggactacaggcgtgcgccaccatgcctggctaatttttctgtagagatggggtttcaccatgttgcctaggctggtctcaagtgatctgtctgcctcagcctcctaaagggctaaaattataggtgtgagccactgcacgtggccttttttttttttttttcttgagacagggtcttcctctgtcactcaggctggagtatagtggcatcaacatggctcactgtagccttgacatcttggggtcacctgatcctcctacctcagcctctggtgtagctgggactacaggctgaaaacatttttctaactctgttgttagtttgggctttccttcattccagcctctgaaatccattatttcctgcccaacgggacaggccagtggtgacgttggcctttggtgccagggcctgtttttccagatcatgggcaccatacaaagataactgccctaaacggcatcattgccccagagtcattgaatgtccttaaggtgcatttgataaaacaaaaacagttttttgttttgaaaattctcaagtatttccatactgggaaaatgttctttttttttttttgacagggtcttgctctgctgcccaggctggagtgcagtggcgggatctcaattcactgcaacctctgcatcctgggttcaagcaattctcctgcctcagctgggaccaccggcacatgccactaagcccggctaatttttgtatttttagtagagatggggttttgccatgttggccagactggtcttgaactcttgacctcaagagtgacccatctgcctcggcctccgagagtgctgggattacaggcatgagccaccatgcctggccaacaatgttctttttaatggtgttttccccactatctggatagatatatgaattcagttactaagatgacttagatttaaatataaaacactagcatagcagtttttgattcttaatattatcttaaatccacctcccctcattgtcctctgtatctaaacacccttcaattcttgagaaaattaagattaccaaagattagtaatctatttgtgattgtgtgtgttggtggacatcctaacaaatttatgaataaagccaatactgttttgttagtgtccttattttttctttacgtctgttcatatttggaattctaaggcactacccagataatcatttgataccctttgttggcatgacatgtttggtcaattgttttggcaaaattatttatccaccactgggaactaagcactgtaacaactaaagaaagaggtcatacaagggaaattggaagaactatatgttatttgtttcaatttttatgtagtacacctatatatgtgtgcaaaaaaaatgtaaactgttacaaagcaacatattgatgaatttaaatgagtagagcataataaaagcaaaaaccaaacagaagagtggttggagtgaggccataataaaccaagagatattttctgaaggaagtgaacatgtttgcattttccagcatactgctatggatgtcagcgttaggctaatacatagtattgcagcgtgattcaaaaaggtgagatagaggggaaataagatagcttcataaatattaccaaggaatttaagacatgagcattttatgtagggaggttgaaatgcattgttataatcaggctgtgtaatttccttctgtcaagacctacccatttaccagtaatgataccttctttctcttctatttttgtctcttcctttaggaaaaggaatatatgcttactcattatttaaaattcagagtcattttcctgttccagttggttttgttcctggaaccaccaaagaagagtagaattaggtgcatgtgaaacttttgtttctgctttttctactcaatcaacttttatccctttttaatttttactctctcaaccatcagttctatatcatggtatctcttcttggtctttttgtattatatttccataaaaccagatgtacggggttgttaaaatactgcctggacatattatctaccctgcactaagtggtcctatcacaaaatccagttaaacacacattgaagtatttaaattgtttcttttttaaataacatcatattgggcattggacttcttaactaaactatttctttcactaaatgacattggttaattcaacaagccattgtaggaattctgttaacccagtagcttctactactatgttactatggtaatgacttagcttcccataaagctgcatttaaataggtgtttatagtcaccaattaccaggtatttcaagtactctttgaaaggggcctgcttgtggtggggtggggggcgttaacatagatactttctcagtcacgtagccatttgaagtttttcaggtagaagacagttgatagactatttggtgagcaaatgaataactggatgaatacccatctgggaacccctaaagaactgaagatagttccctggccatcactgttcacagtcatctattatgtgcttactctatgccaagtgttgggctggattctggggtcaccaaagggaagagaaaattttcactgccttgagggtagctaaaaacttaatggagggaagctgagagcatgagcgagcgtgccaccccagctgggtgagcggcacaccttgggaacagctgggagacccccagtggtgtgtgtcttccttcgcccttagcacttgctcctctccagctcactgtgtttcttttctctctggggtctaaggagcttaggcttcactgcctgctcctcagattgtgggagcaggagcagagagtgggtgcctgccacgggacagggggtcctagagacaggccccagcatgggaaggcagtggaaacccatgcattgctctctggcattgccacacgtcttctgctgcctgccttccagccctttgcttttccccagctccgtcagctccttgcctctgacatcagtgatgaaagtcaggcgtggggggattagattatttccattggccttgatagacttagacatataatagaagctatgataagtgagttagttttccatgtttgtttactgaagtttatattaccctttatgtcaccaaaacatgcccgtttgcagtcattgccaatgtagtcatgcaaaatcacttgagtgaaatagactttggggatctaatctcaggacctaaccaccatttataaagcttttttggggaaaatgtgttctggatttcgcacagccagcttacaaatgagctttggaaacacaatccacatgtaagttggagacttcctattattagcattcagccctgcgaggagagcccttgctttgttagcaggcctatgtgtcctcagccctaagttcctaaaaccagcactacttgaggagcttgaattggtgctcttggagttctttagattagttatgagacttcagaacctgcttaccagcagtactgagctcaagaggaagcctaattcatatccttcagaagataattttaagagagtgtgtatgttttcgttttgtgaacaaaggaaagttaatctggtgctccgtgtctgttttgtaattccccaagggagaaggaaagggagggaaatgattgatttccagataggataaaaaccagtcagcacacaatgggttactgccaccgctttctgataaggatcctacttcaactatctgaagagattcttcaaggtggaggatacagtggttatattagttactctcacccttgttattatggaaggtaaaattcctggatcctagatttaattttaaaatagtaatttaataatgtctggtggaaacctcttaaaaaaaacactttgcagcacatctctggtagccctgtgcttgagatgacttttaggctgccagttcagaagatggaagatataaactgtgttgatgagttggtttttcagtggaccctgttaggttccttttttaaaaaaataataatttttataatgagtatgtcttcgtgagccctcacaacccttgaagtttttacttgtttggcagaactaagggcactgaacgtttgtaagccgttcactaacacttacaggaagggcataaaagggtgctcaagtcagtctgtaggtggtgggggcggggtggaaagaggggattcctgtaggcctggatgaatcagccactgatttctgatggtagccccagctgcaaaaaagtaggaagctttttttatggacagaactacaactcctttctttcaagtttttcagccttttcacacttttccattcttcagactttgcaagtttttaaacaaaatgtttgtatttccccaaaggaaatcacacagttgactgcattatgagagggaaaggagcaaactctgtctcatctgaggaggggctcagatcaggagttgtgtagggccctcacccggttgggggtggtggagccttggctgtgtgcaggagtgactgttcttggagatgttctggttggatcatgagtttgggcttggaaagcactgcctcaagttcatcagcaggaatgaggtagaattcactacttgctgtcttaagacctttctgtctgccaagtgtttgagcaatccctcacatctcccccttgaactaaagagcaacaactggtcaagagcccagcagggatgaaaaaggttggccccttgcatccttcatctgctgtttagactaagggccgcattgtagaccactctcggccatgctgtcctgaacccgaggatcagcagaattacaggcccaatttcaggcagacgtgagcttgcatctgatgacaggcaagtacctacatgtgtctttcattactccgctgccttaggagatgctgtttaagttggcagatatgcttatttgaaagcaaagcttgttgctggtgagattactgaatttacaaaaaaaaaaaagtggggggatcagatgccaagggagagggaagggagtgtgtagcatttaaaagtgtggtgaagccatcaagttaacaagaaaaagtagaataaaatgtggttccaatttgttgtactgggctcaagatgataatattgcaatagtaaactgtagggatgtgtgcgtgcaaatgtgattacatgtgtgcttgctttctgaatttcaaaattgtagaagttattagaagttctaattttagttcccaatttaatttactctgatagtaaattagtaattttcaagggatttactgataatcagaacaaagatttgcaatttctaggacagatccccaattttgggggtgggaaggagctactttgtatttccctgaaaccttgagttactggggccgaacatgtagggcagatattgaatgaccaatcctaatgctcttagcaactttgctaagtaaaaccccgctgccatccagtggcaattggctatacggcatggtagctgtaaaatatgcccttttctgccttttctccctcagattccacctttctcagatgctcccagttttttttcccagatggcacctgacacagtacttgacaggaaaaattgactttatgtctggcttaggtaattcagggcaagtgtgcatttatttaccttgtctcttctcctagcaatactaatttttatctacgttgcatttttattttctccccagatttgtcataacacacatactttttccttgaatatttttgttaccttagctaaagaattaatgcattgtggtatttctgcttgtcatagttttactttagagtagatttcgcttatatctttgtatttatgctttgagctgtggtttaccaatttcctagcatgtttcatgacacttatcctacatttcagacaaggatttatgtgtcccataggattcaagctggacttggagaaagagccagctagcaaatggaattattctgacttgtgaaaggttccagccttttaaaactaggctctgagaaataaaaaaacaaatattcttgggaagaaactgggtttgtgagtacttggctagaaattttaggaaaggaaagaacatttcctctggcctcgggagcacattcaatgtgaaatattgctgcctttaaaagagccaaacttaaatttctatttggatcatttacttgacttaaaaataaagggatctatttttttttaaggttcagaaccctattttaaataaaatgacattctagtaagtcaggcaagatgcccccaacatgagctattaattaaaaacagccggaacttctggaggtgttagcaagtatctactatgagcttggggattggcgaaatctggtacaagttagttccagctgcgcacatttgccttattacagttctttatgataaattaaatgcatgcttcatacatcctttggtgtagtcatattctctcagcacttgactaagcaggtggaaagcttatttagtcataggatgactgaaaacaatgaactataaacccatgtatatccactccaagaaaagagctaataaatgtcatgttttttattttcccgtggaccccctttttttttttttttttgtattttataacctttccagaatcttgagtgatttttaaatgtttgccctttggtcataaatgcagcaagtaaatgtgagtctgcacactcgaatgttgtataaatcagttgaccagtcagtgttggagcaaacttctcaggattgctctgtgaactccctgttctctggcagttgccaaatacaaagataaaccaggagagacttattcccaagaaaagaatgattctgcatccttaacttacatataaactgttgagatgtttcattgttttgtatggtcaagccccttctcttgttctctctcttcatcaattagtatggaaaattggaagtttactgaaaagagtttcgaatcatgggattttagatttgaaaaggaccagagggatcatctactcttccaacaaataaaaaataaaacccccaaaggaatgaatgatccatggctgggacattggaatctctctataaaggagaaatcatattaaggtattttcatcttaggcctctaaccccaagggtatctttacaaagactttattttagtgaagccttcaataaacagtgacctcatgtcaagaattctaaagagagggttatggaatattggtttgatattaaagtcattgttatcttggagctggcctgaatggactaataagtggcctgtcaccagttgtaacttacttttacaattttaatgtgatttaagggaagacactcttggaaatgcttagttatggttcatacccataatcgtgtttcttttaggtcttaaaattttatataatacaggggagtagattgcatcagtacagtctttttctttttttcttttttttttttatgatgcaaacaaagcagtatcttaaattaaatcaaggtttcttaaggttccagattcttattcctaaattttccactgagtaacctccaaattcttctcctgcctttgtccctagttgacacaagtcaggccacaattttttttctgcaaatggacgagctgctgctcagaggctgcacttactggtgagagatccttcaagggaaatgaatctggaatggcctggaacatttgtctttgggttgctccagggctttattagagcttctgagatttctaagtaggtgatgaaatttagcagcatctgattttctaaaatgaccaaaggagaattgtttcagtccctgatttgcaaagtactcactttttggtcctctcaaaatttttgtcagataaagatttttccgtgccatggatataagaaataacccactcttaccgataaagggaagttagtgttgtaaaggaacaaatggtgattcaggtttgggagactttggaggtattcattctccactaagctatatcccaataccatcattatctgggtcagcctccgattcagcctcatcctgtgcttcagcagtggggtaaaacaaatgtcacttgttagctgcttcttcatgaccttcatagactatgcattaatttgaagccctgcccccaaaaatagtgcttgggggggaaatgagttagtgattttgtgaagataatgggagttgaggaaaacacttaagtttgcttttctgagctctagcttcattttacttctcagtctcagtatttaattgtctccactgttttttctaacttggaaggaaatcagatggcgaaagtgaaacatacggctatcaatgtgaaaaagctgctccctatagcactggaattctcttgtcattaatagctcttgtagtcgacagattataatatacagagtcataaatgttcttgttgtcatttggaaaattacaaattcccaaaaagtggtgattatttggggctttgggtctgcaagacgtttcacattaaaatgctgataatatcttcaaaaaccacagagccatgggccttgcaggcttggtaactgactgcctttgtggtgtggttttattctttctactgaagcacctggttgaaaggagtgggatgctgaattcataggggcgtgttcacaaaaatctttaacatcaagtatctgtttattcaaaatagtgcatagttcaaagcaaccttgattccttaaactagatgtttttctgttctttaatgaaaacagcctgaacgtggttattaatctgagtctttctccattctgaccaccccactctgtttttctctttgaatatcaaaaaaaaagtataaaaacattttgtaattttttatttatttatttttgttgagacggagtctcgctctgtcgcacagggtggagtgcaatggcgcagtctcggctcactgcaagctccacctctcaggttcacaccattctcctgcctcagccttccgagtagctgggactacaggtgcccgccaccacgcccagctaatctttttgtatttttagtagagacagggtttcaccgtgttcaccaggagggtctcgatctcctgaccttgtgatccgcccgcctcggcctcccaaagtgctgggattacaggtgtgagccaccgcacccagcaacattttgtaattttttaaagggctacataaattcaaggtattattgctgtacttcttttctgttaccttatgaagttgattgttgttgaagcaccaacagtatgcatacatgggtatccagaatgaccatctagtctcagttgtgcaaaattcactatgtagtctcatggattgagaggggcaattagcaagagtgtgagataatggagaacaaaaaataatgccaagctgggttaaaaaaaaaaaagtttgggaaagaaaaaacaagtgctcaagacaagcctcctatttttcagtttggcctagccctagccctattgaagaaggttagtacattcacctggccagttttagctaacttggttacctggcaagtggcggggatgcagtacattagtacttgtcctgtggtacagagcatgtgtctcagggtgtggccactccagggagagggaagacgtgctttatggggcctcctcagccatcactgtgatatgtgccaccaggaacccaggacctttcatggtccagtctgaggtgggagcaccacagaagcaagagctgcctggcccagccaagcccagattaccctaaaatcttactgcttttttcccttcagcattttaaattataggagcaagtaaaagtgtacataacgcaaggcaatctgaacaggtggctgatagctgctccatccagaggaagagccatgaagttcccccgacccacacatttcaccctgtcttgtctaccaaaaatcacatgaaaatgcagacataaccatggaggagtaacccatgaacaaagggctggtaattacagtttaatgctgttctttttacccctttggctggctggctgtgcaaaggcaggccccggtaattacggtttaatgttgttctttttacccctttggctggctggctgtgcaaaggcaggccccacaggggagtaatgtatttgtgacagccagttggggtggggagagatgggctgtactacactttgaatttattatgttctgctaatacttttactcctatgctggaaagttatgttttccttcctttgttagacaatttttgcagagtagtttaacattttcaaacatttactatatatagcacttttaaaatccaggaactgtcatttccaaagaagattccatgtctataatattaattccctgtcctctcctcattgcctttttcagacatccactgtagatagcctctgttccccaggaactaacatttccaaaggaaactcccttgcctataattccctgttatcttcttgttgcctctcctgaataataatttttgattcagtaccttttagctatttataatgttatcgtataatctgagtttgggaactgcttgccacttccagtttctgacacccaaaacacattttatgcttagagaaaacaatagcaccctgactttttagaagacatagttttcccttggggatccaaactggaagcagatatttgagctgtgaacacattttttcttagaagagtcaattaggagctgggttgaagcttcagtctatgcacttagagtcaggttttaggaccaagagcaagcactgtgggcacctgttgtaagaaaacatctgacagcacgaggtgctaaattgcttcaaaatcctccatagctcgtggggatgctacctttttagtaggagtttgaagcccagaatgcactttatattataaccaacacagttgaaaaataggttccatgttctataagaatggattcattaaactgcatgttctggaaaaaggatgtattagagactttgaatttgaggatcctgtgttatatacatctctgagccatcttatcaggaagaaaagcagctccttaaggtgcctgcctcttcctctaatactatgtacatatttcgacctctgccctctttaagttattttcatttgtcttgtagccagtatcagacatgttaatgaccactaactttgtaaatgaaattattgcagctcataatgtcaagatgtgaacctaagcaggccttaggttttctgacttaatagccgaaccataccagtctttccctgatcattgaaccttctgtcttctgcagtcagcagaccgtctctaatgagaggtgcacagacacttttgatgcttattttaagggaagccagtggcagatggagagccatcagatgaaactgttattaatcacaccatttctgaagctgttctgactccacaccctgcattgtgacaaacgccaggatgccaagttcctagtattgcagcaggttcttagtacataacaaacactatcagtgcccccagctcaacttcgactaaatgccttccaatagagttaagctgtttttatctaatacatgctaacagtaaaaggacacagaccctcttatttgaccctcttagcatctaaggaatatgatactttttttctttatacttagctgtgtattcaaagctaacacattctctaagtaaccaagttcacactaaagaaaaattgaaggccatcctctaaagccatgctgctcagtgcaggagccaccagccacatggtcaaagccacacagagccactgaaaggtggctgctataaattgagatgtgttatgagcataaaacaagagagaaatgaagactatctgcttaataatttttatattgattatatgttgattatattttggatatgtggggttaaataaaagattaaatttcaccttttgtttttgcttgtgatgtggctactagaaaatgtaaaattacatgtgtggcttacagcgagaccccactatttacagggcactgaaagtcattcttcctcttaattcctcatctaaactctactcattgactattttgtgtatctgcatcttttcttccaaaatgaatgatcagctgctagaaggcatgactatggaaacagtgtatcttctactgtgatttttcaagagtgaggaagtttggctatcaccatgggcgtgaggagaggggttctgttctcatttggtaaacatacaccagatatgctaaacatcccatagaatatcttagacaaagaaaattacagtaagtagagaaatggatcaaagagtggctattcttggactctctactttccaggtctttttggctagagaactctttttctaactttgttgcctggctcttggcagtcaatgtccaaagtagtgcattgagctgccccccaaaaggggcacagtttgtaaggaaaccatatgccctatgggacctcatgggatgacactcagttagtacataaggatctcttggaagggagctgcctttatgtcctctaaaccaggtcatctcttatcagttaaatcctggtgctgactagtacagctatatgagcctggacaaatcacttctgagcctgtttttcctctctgtacaatgacaatgatgatagaacctttcttataatgttatgaaagattatattttctgagataattttagtaaagcaacgtagcatagagcctgatacatgttaagtacgttgtgtatattggccatgattattattggcttcttggtaatgaaagcatcaaatactaagggcagcttttagtatattatttctgatcttgtgtgatcagaaataccacatttttgagaatgtattattttccaaagaattaaatgactctcagaggggaatggataaacccacagaggttctggaaatggagcagtttcctgtaagtatcatgacttccaattaagcccctttgtctgttttatccctgtcacttgtactcactgtgtagatcatgagctaattttgcttggactctcccctcccgccatctcttagagcccagcagtgctgtgcatgcatgggttaaaaatttcaaactgtccaaatgaattgcatttattggcaatttaatgctgaaactcaaagagggaaaagaggagaaaaaaaatcaaagatgaagtggaaagacaagggcccttggatgcagccggacagaggttgtaatatctgctctgccaaacactagttaagtgatcttggtgtagtcaccaaacctcttgagtctctttcccacatacaaaatgaggttgatgtgtttcacaaggctgttatcatgactcaaggaaataacctaaatgactagggcagtgacagttcacctctctctcttcatattgctctcaatttcatgatcttcttctccccgcaaccccatgatttatagaagccaaattacgttctctgatttatagctgttgtaactttggaatacatttaagaacatggaattagttgtcttttgttagatccacatacagaagtcacagaaatgttttcatcattttgaattttactgttcattctggcaaagtgaaaatgtataccaaaacactattttaaaccacctatcccctgggttagaaattataagttagtgtagcccagtgaagtataattaaatgttgccattctcccatttatttaacttccttccctccatatttgaagtaattttcgcttggtgccaactccagtcattctccagatgcctgtgatttcttccagattttcaacacacagtggctaaagataatatagaattattttttaagtaatttgtgattaaatgtaaatttagtaattttatgttgggacatgtgatctccttgacattttctccaaaacacagaatttaagcactagaaatgattttaggacatctagttaaaccattaccacttcactgttatgacagtgaggcctggagacattaaatgttttgcccaaagttaccaacatgttgttggcagaaaaatctggaacatatggcctcatctattgtctaaattttttctactagtgcacagtgccttttcaattgctttttatttgataatagtgacaatcataaataggggatttaatcaatactcttttaaaaaaaaaagtcacagaaagaaagcaattgtattgaaaacccctttctagtttttccagtaggttacattaaatggccccaaaaagtaatttatgggctaaaatgaatgtcttcagaaggctaacataaaagatgaccaacagggggaaacctgaaacagccttttaggtaatttgcttaacttctagcccttttaaaaaaattactcaagctcatgttagagccaacaaaaaacatctgttgttttatttatagccacaatttctaagaagcatattctatagcagatgaaaaagtagttgacagcttataattcataaagttactgaggcctaatctgatagaacaaaatgtacaaactccctcccgtggttcagaccctatcccttccctttctgctgaagacagaaatggtgcaacagaggagtggagcataggttattacggttgttaaggaagaggcgactctgagatgataatgcagaaaggagtaccccgcagtgataaatgattgctttcacctctgggccatccaccagcctgagtcactgctactttttcattaacattgtatggactttcattataggaagccaacattttgctgtgttcaatctacagattgttaacagcgtatttccatcaggaatctaaagtgttaattaaaacgactgattgaatagttccctctctgagggaagcttttagtttgccccttcctttcaccagttagctgtagtctatattgacataactttctccctgctgactcttaagcaattattagaattcactcattactcaaatatcacctctctgtatctgttggcttatttctgagaatctttttgagaacatgaccaggcttctttctataatttttatatatatatatatatacacacacgcacacacacacatacactacatatatatgtatgtagaatacatatatatatctatatatgtacatatatatctatatgtatacatatatctatatatgtatacatatagatacatagctatatagatacatatctaatgtatacatgtatacacatgtacctacatgtatacacatgtatctgcatgtatacacatgtatacacatgtagatgcatgtatacacatgtatacacatgtatctgcatgtatacacatgtagatacatgtatctgcatgtatacacatgtagatgcatgtagatgcatgtatacatatatacatgtagatgcatgtagatacatgtatacatatatacatgtagatgcatgtagatacatgtatacgtagatacatgtatacatgtagatacatgtagatacatgtatacatgtagatacatgtagatacatgtatacatgtagatacatgtagatacatgtatacatatatacatgtagatacatgtagatacatgtatacatatatacatgtagatacatgtagatacatgtatacatatatacatgtagatacatgtagatacatgtatacatatatacatgtagatacatgtagatacatgtatacatatatacatgtagatacatgtagatacatgtatacatatatacatgtagatacatgtatatagatacatacatagatatatagatacatagatacatatatatttatatatgtacatatatctacatatatatctatatatacatatatctacatatatatctatatatatatttctacatatatatctatatatgtagaaatatatatatattctacattttagttctgctatatctatagggccttctgtatatcacagttttgtgtgttgttgtttttttttaagtgcattggtttggcacaaataactatagtactatttattatcctgagcttttttgagaatgtagtgatagggttcaacatctgcccaaattgacccatctaaaattataattctaaaaccataaccagaagaagcccattaatttctttagtagagaggtgagtagcctcttgtttatttcactactgatcatagtctattgtgagatatgaagatgtattagcccaccagaattaatcacctttgtctgaagtagtgaaagtatattgcttcattttgttaaactctgattccttacacaattgttaaggattgtgtttacttttatctcaaaattgttaccttttaatatatatagtcttatatcagtgatcttttcaaacttttaaaatgaagtctgaataaatattattttcttatgcatttcttctgcaccagctgatagggaattttctgtacaatgttttcaggcctcttgcctttcttgcctttatttttctctgcaattccacacacaggtcattgctttcccttcctctccctttttgatcatggatgcttcaactcccttcatatatttgttaagcatattttactaagatttcattttgtgatgcttgcaaatatacattacaaaatatatatttttaaaaagtgatttgaagggccctctgtccatctgatgattaactagaagagtcttttgtaccttgctaaaagtgataagttagccagctatatttagctggataaaacccattacatccttggggaagaatgtgctttgtttagctttatgagaaaatatttaataaatgctgtcttgaaaatatttagcctggctgagtgagctggcaaggcttcaatactgataaagcagaggtgatggtgaaaagctggcctgccagtccaagctcaagttaaaaaaatgcacctcttgtcactaagggttgcaactgtcgccaagtgcttgtccatcagtgtcacgtaaagattttttaacctcacatatggcatcatgcagtttgtctgcctaaaaaggcaacctagattcacagagtggttacaattggctttgaagtcccatctgttctgtaaaatcctagctttatttcttactgctggtatgactttaggtaacttgtttaatttttcttaatctcagttttctcatctgtaaaatggggacagtgataatttcttagagcgttgtacagattaaatgagattaaacgctgagcagagtttcttacactaagtgttcactacatgggaattaatcagcagtagtagtgatttgtaatcagcctaacattttctgtccctccctaactcctcccaccccacaggagatacaaagagcaaagtcctcttgaatgtggcgaggtaggaaaggctctggcatgggcatcaggaggcctgggtcctcggcttgaacttcctgtgggaccttgggcaagttgtggctcacataatccctccccactcatcagtacacagtgcacagggcagcagagctcctggctgctagtctctcttttgatacctaattcgttgtggtatcagaccaaatttgatatgatagctagacccgccggtccgtcagtatcatttggggtctggtgtaagatcagcctgtgaaactcaggcatgtaggcaacaagttatcagtaagaaggtcaatcattgggattctgtctcccacaatggtctggattttctctctgtggctggtgggctcagccccaatccttgctactcaaagtgtgattgtggtccgaggaccggcagcatgggcatcacctgggagcctgttggaaatgcagaatcccagactgcaccccgacctcctgaatcaggctgttaatatgtacattaaagttggggaaccactgcctcaaactactgcccttgggaatattctgacacgcagagggtatttatttactaaatacttacagaatttgtgtttgacattgacattttctagacaaggttccattcctctctttgggtgtagtgtactgatgtgttaggtcagggttaccataacaaaacaccacagactggtgtttatgtctgtaccaccatagacatttagaaatctatttctcacagggtgccagtgtggttgggttctggtgagggccttctccctagcctccaggctgccaccttgtcactgtgatctcacatgggaagggtggggagaaaggtctctggtgctgcttcttataaaggcactaatcccatcgtgagagcacttgccctcatgacttcctgtaaactcagctgcctcccaaaggcccatctccaaatattatcacattgagggtcagggcgtcaacatgaatctggggggaagggacacaattcagtctgtagcaactgacttccacatctgactttaaaatgcatctttaaaaaaaatgtgctggcagataaatatgtaaataaagcaaatatgaaaatgttaatcgtagaatctaggtgaaagataatgtgggcgttcactaaacaattctttcaacttttcaggatatttaaaaatgtcagagaaaaaaccccctactctctatagttatttaaaaggaatctggtgctgcttttttctccttatttccatccaggctttcttaagagtgcttgttcggtctggctggacaaacttgcctttttggcagtttctctctctctacccactcactttctccttggtcagccagtggcctgcttctgcactgtcagtgaggtcccagcctggatccaaagcttctttctggtctctagtctgccagtagcatctttctgtccagttcctctccatccccctgccctctcctaatactaatcaggggatccttcaattgcttgtgacatcgcagcttctcaagttacattttacaactctgctttattatttttaagcatttctaacatgacattttataagtttgactctgaaatttatcatcacatgtaagtaggaaagaagtgtctccacaagtttgccctcagccagagatagtgtggttcatctggaatgcccctgcctttctctggttattaataggggctcctattgcttttccatttacagtgttaattatctgcatttcaaagtagttcataatgagagggaatatattaacttgttatttggggaggaagtacaaaaactgctattatcaagatcatttaacttgagcataatcagaaagtattaaggttattcccttgtgggattgaccatcagatatctgtgtgtttcataacacccttattgcagataccttttaaagaagggaggcttgcaggaagtgttgggaaacttactataagcttctttccttgactggcacttgtatactctggcgcagggaagacaagcccaaactaaatacataggcattacttaagagctttgtgacattggacaaatagtttccttgcctttaaactggggataatagagactatacacctttgaactgctatgaaaaataaatgaaaatatttctgtaaaatacttactgtgggaatgtggctcctagttgatgttcagtactaatcattcattcagcaaacagcctaccgcccactgtgtgtcatggcctgtgatttgtcttttttctttttgggggcttctgggtcatacttcgtatgaaatctttcttagcacaccgaaagaccaactttccttataaatcattggcttcaaaaatcctgtggactcaggtataaattatttttctggtgaggagaggaggaaatccctttcttccccatttacatcctgcctagctattttaatttgctgtacaccgtaaattgtaatcttagaatcaaactccaatttaggtgataaggatcacaattaattaggctagcctgtcaaagattaaatgtaatcttgcatttcagttacctcctaactctgaggctttagctaagcccgtcagaaacaaagctgttaggtctgcttaggtttaataagatctttgcctgctgtttgttttctataccagtctgttgtctagaaataaaacgaatggacagaggatctcaattccctttcatttgtttttagctgtgcagcaggagagataaatgagagaagataaacttaacgatattaaagactaattaggatatctgaggagatttgcaaacttctagtttaaatctgtcggcaactcttttaattccctcctgctagttatctctgaaaataatgtagttatggctgaagatttatttccacatctactctttgtactctcattttcagttgcgcatactttttttctccttcttcctccaaaaaaaaaagctcttgtttcggccacactcaatataatttagcacacagtcattccaacttcattttgtcttcacattcagaaaactgaagtctaatatctcaaatatattagtattgtggtccttttggggaaagtatgataaattgaaaatattttggttttgacttctgaagattttgagtattgtttatatatacaaaggcaaaatgcaaatatatacaaggcaaaatgcaaatgtgcttccagcttgcttccttagaaaagtattgagaacagtctaagtatgataatttctggtcttaaaacctgcaattgcaatcgggtatttccataatctaaacaataataaagattacatgactaattctaacaataataactacctattagtttgtgctttctacatactgggcacgatgcctgtcatgtttatatatatatattatttaatccttattactgcacataattactcccattttacagatgaataaatgggattcaagttaactaacttgcccaagactactgaattcagtaagtggcaaagcaaggattaaaacctaagcctctttggctttaaagctctgcttctaatcacttttttactactgattaaacagatgtgtcccaaaattaaggaagtcatcgttgttttttttgctttgtttttgcttagtcaaagagcacaggccatcatttgttgtagtgtcacccgtaaagcttaataagtttaaagttcagggtgttaatcattacaagcataaagtatgaatatgctttaaaggtttatttaagaaaagaattgggattagatttgcccaccagaatatacatttttcacttgaagtcctgagagagattcagacagaaacagctttgactcagcagcagttagcagacaaacatcttgatataatactgatccacactttgcatatacactttcttttctttgtattacatttttagaggtaagtggcagtttttcacacacttccaaactgcttccatcagtaatgaaatatttggcttgggcagcctctggagtcccagtgtttcagcttaaactttccagtgggccctgccaggcactaacttcaaaatatctttttttatggtgaatgcctccagaaggtgcaactgtgtggtggtttcattttgcacttcataacggtgttggcatcacttaatgcaaagaatgccactgtctcccacacaccgctggtgcccaaggactgtcgaggcctgtccatgttagtggtttgggaagggctgaagtttggagagaaggctctttttctattccatgtgattggctgtcaccagggcaaagggggaaaactagaacgagtggaaaatgcagcatcggatgtgtcatcaaatattcttcctacaacctgggacacctagttcattggtgttctggtcaacattgaaggctgaatcctcctttcttttgaaataatgcgtgtcttggattcactacttttaaacctttctgctgatctttatccttttcttcctaagcaatactgatttctttcaatgaaaaatgatttagctagtgaaaaactgggattgggttgtagtaaaggaatcaacaaatttgcccagattcttaagagtggagttggttctccacacttatacactgtgctacagcaagcttcacaaccaaaacccattacttattcaggtataaaaatcaaaagctgaactgtaatgagaatttaaatgtaaactgttggaggatggtgctctgttaatttgtgtttgctccataccccaccctatataattgataatatttgcatctttttgtttttagtactattattttttggtttatcaaactttgtaacatggtgctttattgtggacttttcaaagaacaccttgccaaatttggtaattcctagcaattgtcatttcctgttggaatttcttaaagtggaatctaatggaaaagtaattcttgaccttgtgtatttagtaaaattaaaggcatagttgattttaggattgtcataaaaattaatattttgttttaaaagactttttagactttcaatgctaattgatcctattgttggaagtagatgatataaactttaaagctttttgggtagaactttcacattcaccatgtctaaatattttaaagaggaaatggattgactcgcagacattttgtactaaggaatagaaaatctttgaattgctatttaaaaaaaaaaaaatccctgtaaaatttaccattttaaactccagttgcaaaatcctgatcagctatgatgattcatacatttgagcgataaagcttttttcaatattacaaattcagtggggagtcactcaatacattacaaaaagagtacttacacttcctagtacccatgtgtatttttttttctttttaaagcaatctggtgtgccttttgagaaaagttccagtgttctcacagatcctgacttggtgtagcacagtgcttttcagaaacttggtccaacacctgaatgagtaatgtgtaaaacatataatgttttgtagctcaggatactgcaggtaaactaacactttttgccgaaaaaacattgaaaagacaaaggaaagcaaggaagttttgcttttttaaaaaattttttcaagcttaatgaagaaagagctggaaatccttttgtatggagcatttgccagcccagcaatataacaacttttgggtgcatatttcaatcacaattagatgaaatctttaattatcatttaatttgactttcatatttgcctgcagaaatgattgtgttgataagactctggaatgagacaaacctttattaagtaattccattttcagagccaacattaaagttttttttaattaaaaaaatgcctgtgtaatttatgagaaaaggggaagaggaattggcatgttggttgcatgagagttgcatggatatgtatttactatttaatctttagctttttgagatttggggtgtgctaagtcttgttagtttgaggggcctaaggagtgacacaataatggatcttaataaataacacttttctacatcatttctctacctttatatttcccttctattatatatgctgacaggatgatatttcattgtattcagtgtagaaggtgtttgtgagagaggatacttttgtgagttgatattaaggcaaagggaagtggtttataatttatcagaggaaatgaaatggtgtgctctttcattttataatatttcttttaaaattttataatgcttttaattggactgtgaaacctttaagacatttgtatttgaagtgcttttcagatatatttacattttaacatacagggatttgagagatgtcattgctggattttttcataggatcacccacatgaattttcttatcaaaagagtatgtcctaaagcttatttctaaccccaaacaggttactagcccattcctggatgttccgattctgaagatttagggtggtacctgggaatcagtatttctagcacgtcctccaggtggtgcttagctctggcaagtgtgggagagaccagagagaggtgaagttcccacccagccctctgcacagtgactggaaagttaatggccagtcgtttgtgcttctatgaaacctaagatgtgttacagtgatgttgcagtaggacaaagtcactcaggaaatcgagtggtaaacattgcagggctttgagttcaaatattgattagctctatgttaagatgccttgtcttcagggatagctttagagtgggatctctaacacaaagctgactcgggaatctttcatctgccattgacaaaatttgcccttgtgcaggcaagtaagactatactctctaattttatgggcactagccacctatggttgtttccatttaaatcagttaaaataaaaaattcagttcttcactgggaatggctgcattttactcaataaccgctgtggctagtcattgctttatcagagagcacagctgtagaacatttccatcatcacagaaagctctaatagtgctactgtaggattttccctcataatatagctcttctctttttatcctgggtagttgcaatggctaatagaattaggtggaaagatcatgcatccatctatgtactgcacattgcatactgaaatctgaaagaatgtttttgcaaaatgacttaatcatacttctctgagatcaaaatttaataacattactttcataacgtgaatttgttctatgttgacttttagtacttgaaatacaggcttaattaaaaatttgttggccaggtgcagtggctcacacctgtaatcccagcattttgagagattgaggtgggtggattgcttgagtccatgagttcgagaccagcctgggcaatatggcaaaaccccgtctctactaaaaatatacaaaaaattagctgggagtgatgctgtgcactgtagtcgcagctactcaggaggctggggggggaggatcacatgaactcaggaagttgaggctgcagcgagccatgatcacgccactacactccagcctgggtgacagagcgagaccctgtctcaaaaaaaaaaaaaaaaaagaaaaaggaaatttgtttaccatagtatatggcttctaataaagagctatactggtaaaatctcacagaaacaaaattgcaaatatttagtctttctcagattatataaattattcctagaaaagactgcaagcaatgaggctaataaacaggttgtacttatattttcataatgactttaatttacctttattttgcagtttcacaaatttaagatgaatatatttagctccctcttctggcataatttgagaatttttttgcttacaatggtcttatttattttttttggactgagaataaggttatcaatgtaatgttgaagaatgttatttatgagtgtcatccagttagattttttggtatcattgtaaatggttaaaacgcatgcaaaaagtttacgaaaacaccacattttaaaaactactaattgaccaaaaaatacataaacaaaggctttgacaaagttatacagaaatttattttgatatcaagtgggcagtgatcattcatattggcttctggatctgagactcagcccatacctggcatttgtgaggcttggggcaagaatgcaaaaagaggcccaagtaccctgtgcctaagtatttttgttataaatcatgtcaactgttcaataaaatctgtcccatcctttctaggcagttatttcttcctaatgaccaggaggagagatctgaattcaggttcttgggctcctgagagttctgccctagagtgtggtattatggggagagctggatcctggttcatccctggcttctccctgcacatccaaactcccatccatcctgccactccccccacctttggggcccaggggtgtacctagacaggggggtttgtcctggggagggtggacctgggggaaaggccataagaggccatttagcaggaaatcctggagcattactctgagtagaccctaggtgagaagcagtgggcatatcactttggcctggaaagtgcaaaagcccagagcaggggttcttcttgctcgggcctgatgtaattaaattattttgtacgtccttcattgtggtctaatgcattcaactatccaaattaaatacaatggtgggattttgttgtttgcagctttgactctcccggatcttgcagagcagtttgcccctcctgacattgccccgcctcttcttatcaagctcgtggaagccattgaaaagaaaggtaaccagactgctagagggcatcagttcctttgttctacccttatttcatggctcttattatttgtctcttgtgcattcattaagtaaatttcctactaccagctatgtccagatactctgctggacactcaaactgtttggggctaagtactgggaaaaatgtctcagtctataatttctaactctagattatcatgtagtttccatatggaaactattaaattcttcataatttaataaatatgattaactttcttcttagaggccagatggttttgccaaaattatcaacatgccaggtaagattaatagtaggagttgacttccaagaatatttggtacacatctagaacagatactggatggaaactggaatgtctctggcagcagcctcacaggttctccagagagctgtgttttgcatacatggtctgtggtctgttttgtgtcctaggtctggaatgttcaactctatacagaacacagagctccagcaacctggcagaattacgacagcttcttgattgtggtgagtgtcacagagctagaaatgcaaatgggaaagacaggtcttggctttctgtttcaggtaatgcacacacacaaaattgaatttaatctatgcagtgttctaaatttaaagggaactcaaatcatgtacagttctccctgccctgttatggtaacagtgcaaacctttgaaatttttctcctgagttgggctgcaagtgtgtgcacgcctccctgcaggcatgttggtcatcatcatagccatcaggccctgggtcctgcagaggagagaaaccacctcttggtgtttctctcgctctgtgtatctaccatctttccttgaccctgaatttggctacatctaattcatctgaatcaattaaaaaatatttttaagcctatgtcacttaagaaatgtctcttctgacatcctttttcttttattacctttcccttccattttccttttccgtttccctttctttctggcttgccttctttctttttttgtgttgagtgcattaagtaacatcacgatattgttatgttcagtggtgtgctgataaaccaactctctaggaagaaaaaggccctggtttgtagcatctgcccatttttgtggcatgaatattcccaccggggcttatttcaagctaaccaacatgatgtcactggatgtggaattgggaagaattgaggacagtttgttaaataacactaattaatttagccaagagggctttagtaccccaaacacccactccctcctttggcatagatgaaaaactacaaatcaatttacttgccagcattccagcaagtcatcttcttataaatctttcaagatccttcattccctcataacgcttaaaaaaattatatactgcctcacatcattttaactgaaattaggtgtttaagccaaaaagagtgaaactcagttttggactccgtcagaggtataattgtacaaagaatgcccacatgacagtaaatgagaatttgaagcatgaggcagtttcaaaatgaggcaacttctgagacttttagaaaagaggtttttttggagaaaaggaggagactagacctttatcagtatcagtaaattcttacacttgaaatgttctgaccagatgtttcaaaagttaaaaaaatgtttaactccatttttcctttgtacatggaaatcagttgcatgcgaacagagcatatcctctttgctgctctgcctcctgcacttcccacagagcaggtcattagaagttaacatgcagaacactcaaggtgaaaaggcttgtttttcggtgtttctgacagctttatcagggctttaaggaaacgctgaattttgtccttagccaattgaaatgaagacacatgtttgggtcagaaaattggtcaaattatgaacacgtttagtcacaggaagagtttagacatcagagcccgatgaagtggaagttatttgagaaatagtggttaggtttataatgtgatcaacacaaaatgatgcagtttagttatttaaaaaaaaaaaaaaactcttcacaccactcgtgagatagagtcaacaaccaagattcacgtcaatggtacattttgaccaacaggtttccttccccagtgagatcaaaacacatagaaaactggtttcatttggagtctgtgctaaaaaaaagtgaaatttgtgccccaccccaaaaaatataaataaataaatgatgtccaaacttgggagtggatctgccagatctgtttccaactcaaagatttttcaatacataaaaacattgtataatatcctggaggaagctccaaaatagtcacttacacctaaaaaaaaaaattatggcttttaactaaccttgtgaattaccagtctttgaaaaggacagacatggcagacaatagcccacttttattagcacctgttatgctagttcatccatacattaactttgtgatgtatgtcctagtaactttaactcaccagaaaagaaagctgaccctcaggtaaataatttctttcacatttttcagtgccttagtggctaatttttctgactccaaaagtccttgatttttttctcttttttaattttgccctaaaatgaattgtttctttgtctcatgcaagttttaatgattcagattttcacctgacagtttttggtttcatttaacctaattcaggctttcttagccttggtactattgacattttaggctggataattctttgctggaagagtgggagcttgtcccgtgcattgtgggaagcttagccacatccctaacctctacccatgaggtgccagcagcattctcccccagttgtgacaatcagaaatgtctccagacattgccagatggctcatggcagagggcaggatcccactcccactgggaaccactaacctagggagagacctaaggaagaggagactccattccagggggagggagggaggagtgaagggttggagagtttactgggtacctgtcatgagtagactcagtgaaaagtgaggtaggagagaatgcaaacacctccaacccagacctaaagattatgtagctcttcaaaagtcatcgcatgacaggtaggaatagctaatggaagagcacgttaggccagtttcaatgcagaaaaggattcttagagagcagaagtcagataaatagaacagactttgtcactagctctagtagaatttgacataaggtaaggttacccaaagacctgcataggataattttattcatatactatgaaagttcttttgatatacctcatgtgttggaaaagggctttgatgaattaacttcacttgtggattgagccttctagttcaatccacaaacatttaacacgttgtatgtgctggacactgagggatgccagaagagcaggtgacagccacagtccctgcccttgacgtacctcggtctagtagggaaacacataatcccacactatgattatactccttgggaagtgtcttgttagaggggtggctcattagcactgcagaagcacagagggaaaccctgcctgagggagggatgtgtgcatatttattatcttaacgtttatactgcatcaccaaatgttttatcacatattttaggataagcaaattcggtaatattaattttccgggcagagagacattagatgaaacatgcggggcaaagtgtatgggaaaccagaagcacggccaagagtggtgaccatagagaattcctatagcagcacacacacaattttatttgacagtatttaattatgctcacaattgcattaccttcaacgtagatcctttatgcagaggatctactacagtggtattgcccctcccacacttgttaaacatgtgatatgtctctggttggttgtttgtaggacatttaagtgatttaacacttcgcctcttcaccttttaaatttaataattcttttcctcaagttgacctatccatatcctattccagacctacttttcttagagctgtgtggttgtgtgactcactttcggaacgtcggcctacctagtggggcaagtttggtttatgatgatatgtccaaggaatttttgtagtcttaggctcaacctagaatgatttgtactgtcatattccattcaaggttatctaggatactaccttctcccactcatttatactcaaacactttgcagtaaactttcatacttcctcattctctcctaggccacagcccaatgcagtcaatcaccgagttatatgaggtctcgataatattttgtacatttctaactgcattagaattcagacccccatcaccttgattcagagaactaaatctggtagttttacttctagcagcactcccttccaatttattcttaacactgtcattagtaaagctgttacaaacgtagtatcttgcccatcagcccacctttgctccactgagtacacaagtccccagattactttcctcaagttatccttcgcattgctagtgtacatccttcagcagcagccaaagtcctctccttttctagaggcccatggtcacccctgcccccagatctttgtttctagcatccctttcttctgctgggcattgtgtctttttccaacccaagtacttagagtgccatgcgtagtgagtgcctggagggtggtattgattagttttacccccattattggattgcttgacctgtttcccagctgagggatttactggacaggtatgctcatcttattttctgagattgtctgatatccacaggttagattagtaatactcagacagaattagggagaaacattctaaaaatgttcaaattattttcatggatattcttgagattggttgctaaaagtctgtagtatcttactgttgaatccatcactctgttggtgacatttacatgaattctgagacatatcaactcaagtcttaggaaatctgggaatatgcatttttaaatttttcctgttgaggttttaggaaacatttactatatgactaaccattcctagttagaacccttttcagtcagggcagaaccaccctcagaggatgttaggaaatgtttgggttctgtattcgtttgctcaggcagttataacaagttaccacagactgcgtggcttaaaacgcagaaacttggccaggcacagtggctcacacctgtaatcccagcactttgggaggctgaggcgggtggatcacgaggtcaggagtttgagaccagcctgaccaacatgatgaaaccctgtctctactaaaaatacaaaaattagccaggcgtggtggtacacacctgtaatcccacctactcaggaggctgaggcaggagaatcgcttgaacccgggaggtgaaggttgcagtgagccgagatcacaccagagatgcactccagccttggctacagagtgagactccatctcaaaaagcagaaacttacttctcgtggttctggaggctagaagtccgagaaaaaagcatgtttggtttcccctgaggcttctgtccttggcttgtagatggtcacctgctcactgcatcctcacagcgtttctcctctgtgcctgtgcatccctagtgtgtctctctctgtgtcctcatttcccctcctagaaggatatcagttacattggattagagtccactctaatggcctcattttaacttacatgcagtcactttctgaggcattaggagtttgggcttagaggggtgggacagaggatggggtaggtaaccactgaagatgcagcccaattcagcccataacaaaggcattattttttgttgccccaaagtgtggaggtctgctactggcatcatgggcagggggtcaggcatcctaagtgcttgcaatatgtcagagagacctccacaggaaaaattgttctaccccaaatgcccggagcaacccctacaagaagtacggctaacgaatactttgtgtcttgtatttatcctcatattgcttccttatttttttttttttttgtcacatgtgagtcaaattgttcagaaaattagcccaactgatgtattctataaaataaatgtctgaaatatttcttaaattgtttcctagatacaccctccgtggacttggaaatgatcgatgtgcacgttttggctgacgctttcaaacgctatctcctggacttaccaaatcctgtcattccagcagccgtttacagtgaaatgatttctttagctccaggtttgttttttctcttctgggaacctcattgaacatacatggagatgtagaggtgcttgtatatgtcttgcatatatagaaatagtggttagaaaatagtagtaataacctgtccctcccccaacaataccacctcaaatttcctcctccacccaagcatccaagagaagacccagattctcatttgcttgggaagcccgtctgcatgtcagaatcagaaatggctcattgttaacctattggtcttaacaaagtttgtacgtcaatgaaggacacggtcttccaagtactagtgtcagattcaaggaactgggactagaatccagtgatgggggatgttcttgtcatctttcctgagtggccataacagaatgtgttgagggaagatggctctcagttttaggagataaggttcagttaagtgctttggggacaggaaactggttcgtaaccttcaaagttaaaacctgtgatacttatctgatgctcctctgagttagccaatcacacttgaagctgctcaatactgggtaagttgctgccagcacaccctgaacagcttgtggtttctttacacactgagctttttgcatttccatttgacctgagatttctactttctcataatgcgttttctaatgagaaggacaaatgtactgtgtgcttctcccaacaactttttaaatgactcctatagcttgaagaaagagcagaacttttctaggtgtttattcactgatacctggaagtagtcgcttactcatttctctttttttttttttttaaacttgtagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccaggtaagtgaaaggagacaaacatgtattttggggtgatgagggtagtcctaaatggattggtcatgaaaatgtattctgaatatactactccagagatgcatgtgcagatgctatcacacacattcacttgagtgtatataaatgaaaatgagtttgcttttagggaaaaggtttctaataaactctctttcttacagctctgataatactgaaaacctcataaaagttatagaaattttaatctcaactgaatggaatgaacgacagcctgcaccaggtaatgctttttgagcatttaacattctctcattgttcattttttagagccttaaaaaatgatggctataaacctcctttgaagtaacacagcttcttatggaattacagttggtagtaatatgttaccttgtgatttaaagaaaaaatagctgagtggtagtgtatatgttaattattatccgagtttcaacatttgtggattttaaattatcttggttttaggtgagagtttggagagttccctgtacccttcaacatttatgcttcaggttgttgaagagatttatggagttcattttagttgttgacatttttgtttttctttctaatacttacaaagtaggggatttataattactatataatttaaagtattttagaatgtgttttttggaagtgggtatgctgagaaatgcctgtcaaaataaacattttcaataatgcaagcagtatgaaaccagtgttccctgcagcaagttcgagcaagccagacacttctttgaaagcaggctgctgttcagttagccatttaacaaagcaggaaatgtagaccatgttagcaatgcatttaatttaaactgatgtatttttcttctaccgtggaaagtctaaacaacctcattttgctatataccagttaaaagttagctaatcgacactggtcatttagaatagtaattagggtactatacgtgtgaagtttcaggaccagtaaaaggtgttgcttgtagtcttaatttatgcctggaacttaaaatgaaactccatgaatatatttattataggtaatatatgcagattaccatatttatctctgtatgagcaggcatggggactcagtttcatcttcatgcaatggagagttaagttgtgctttttcttaattgggtattgcacagccaggcttggttacttgcatctggatggggcagcctaagagaggccagggcctagactcaaaacccacctgcagcaggtaggatagaggatagggtaggtaaacactgaagatgcgggtattgggaaaggtttatgtggacaggcccaaaatgtaccaaaggtgagagagaggtatccggtatagtagataaggcaagcatgggatgttccaaatcacagcaagcagaatgttttaacaggggtgcccagaattctaggtaaactacgtcaaagaagactgtcaacaggtagggactaggacttcagtccaggggttggccaaaaggcttcatctcgtgtgagtacacaggtcactgtgaatggatttgggagctctgtgctggtgttcagaggctgcctttggacttagtggaaaagaattggggtaggggtgtggcacatggcacttaagttgaggtttatgttagagactaggtagagctggaccctgctctcagtgaagggctagtgggtagtcctgatcttttcagtggccactcctctagagagaggagacacatggaagccaaagccagacagggtttgacagatacccacaaatgaatttatcacatggaattttggagaatttctactacacaaggtatagcagaatcagtggtagagtttgattagcctgactggtgtaaactagttaaacgcctttgttagtttcatcctaattccaccaaagtaaaaacgggtatctgcactattttcataatgccacccggaaagctgtttgatatgtcaaaggaccctacatttctctgctgagcaattggtgcgcctgtttcaaaggaggattagttccatcagctctgctaaaggatgacaaagccttgaacatttgctagatcatcccagtatttatgtggcctcttaaaaaaaattaaatccaagtcggttttaaactctagtttgagccgttttcccaggaagtttgtgtgatttgtataggacctttggaattaaatggctgttttagtgtctctcatgtgtgcatacattgtactgcccactccaggaacaaaacgtccccatccagaacatcttcgtattcaggaatggctccagtgcaaatgactgctatggcagcctgggttgaagaaatgattcttaggcctggtttaaaaaatgcaataatttcttagagtccttcagcattgccacagcatgtgctagtaccagacagaactttgaaagcacagcaccttacatctccagcgaatggccatttacagtaacattgttgtgaacacaaatgagtacctgaatgatgtttaagggagacaaaagcaagactctgttatagggcagatagacagcatttctaattattaccagatagaacttgaaatgacaaagcttatgatgtttgaggcaaagtatcagttcaaataagagccattagcacatagtatctaattaaatgctaggtgggagtacacatactctaagtacaaaaagaactttagaaatgcagctggtgactttctagggtaatggagtagacagaaaaggctcatagaagaaatagggcttgaaatgtgccttgaagaataggtacaatttgaataggcaaaggagaaatagcattttgatgcatggagtttaaagacttattcaaaataaattacacagtacaaaataatggcttggtattttacaaaagcagtacatattttaagtgatagtatcacaaaaaacatcattttagagttgaaagcattgtccagctttaccaatttggacatgaggaaaccgaggcccacagatagaggttcgctctgtgctacccggccagtatgggcccaaaccgggtctgcccaggagccgcctcctacactccagcccattctatctgccatgccctgctgcctggatttttggaaacttcgtgagcaatgaggctgcttttagtgtccaatcaaaaactcctctgaagtttccagcatgtaataaactaaaaatatgtgaaattagcccccatgggtcacatatagtaaacaaagtcagggcaatgtttatacttttcaggataaggctccaaatcactccatgagctgtgcagtggaaaaaaaagtgggcttctgactcaaatagatctggattggaatctcaactctctcgagtaactcagcttttccaaattgttttccagactgtggaattgggttaatgcctctctcctggggttggtatgagatttaatgaactgataatttctctgctatctatcgcatcaactctagcttttgaggccttatgggagctgtcctcattcagcaggtctgattccttcagtccacccattcctcattagttgtgtgaatcctgtcaggcctttttccttactgacgccatgttcccagccagcagagctacggcctctaggagcctgtaggggctaaaagggacacttgggaagttgccaccctgatgtgggtacattgcttggagggagaaaggtgcctttgtatgaatatgtggcttggtgaatggagcagcctagatttcatcaccactcctccatcttgcctaggtgcctttgcacagtgcacaaaatatgcaaccatacgtcgctgccccaagcagtgccatccactttatctgcactcaagtaggtccttcccgttttatatgcaagttaagtcgacccattcagtatgtttatgcctttaagcttcctgtcaccttatgtttaactgtctatagtttttcctattcatctgcttaattacatttctaaagggtaggggtaaaggctttttctccttttgagctcttcctagcagagaactaggtacagcataataattatctaaatttttctttgataaacttccaactttcaaagaatagtaatacatcaacacatctaatacatccagcaatcctgggaaataaggattctcctcatttacagagggaagctaagatttggaaaaggtagggcacagagtaagctctctagactttgttgatagtttgctgttctattttgttactaaaaagtcttaacttgtcgtttggctttcaatatttttttcttgaatcattgtgttatctttacccaattaatgcttaggcaggtaaagtagatttctgtaggcaaaccaaggtaaaaataagtctatttaacacagggtgcctttgaatgaaacccattataagtgtatttacatatttcagatttcatggatatattcagaaatattaatgtaatataattgaagtctaatattgcaccctcaagcccagagtggaaaataaatgactctttctaccccttgcccttctacacctgtcaaagttaatttttaaccactggcacattgcaaaacattcatcctgaagagcctgattcataaatcttgttttaaatgctctgggcttggttctcaacccagactaaaggcaagcactaaggtagagggaaatgacattcaaagagttttacttgtctctgatttaatttttattggtttaaaatgtggtctgacattagagggttgcttcaaaggtgaaaaatgaaactttgaaaaattacatgtttgtagatgcgtagaactaaacgggcaagccacactaggttttgtcaaacaatagttttatttgtgtcctgagagacacaggtattttggtatgtatgtgtttaggaggggtatatagtcagttttacttttgttttcacagtgcagatgtctctttgtctcaagggacaaagatctgagggagaattgcaggggggactactttattctgctaagcagtggggatgcctttatcagaaacctggtagaatgtgtcagagtttatacatacgtaaacctgggcttatttatatacttaaatggatgttttccttagcataatgtcagttaagaccagtggatatggagcaaataatttgaattaccctaaaaggccctctgttctaagttgtcttaagttaaaattatgaagagaggtattcattttacccttagatgaagattttggttaatttttgttgtctattctttttttcatggtctttgttcataaatgatgtccagaaaaagaagaagttttctaggttgaaagctgcttgtgcaacatttgccacttgatggtgacttgtacatatgaaatatagtattcagtttgtaacttttgaacagtttaaggatcaagagacattttcctaactatatctgctgagaagtgaaacaatgggctgtatttgcctctgaaatgagttttacgaaactttgaggaaagggagaatgatacatattgttttaaagaatccagaaggtaaagttagttttccagtgtgtctaggcctttgaggtcccagagaaatgctgacattaaaataaaagttttcctacaacactagcagcttcgtgaaaactgtacttttgatttactaattagtgagtcatatagatcaagtgacagtaatacaattatgtacattagttggtgtcaaatttggacatacgaaatatacagaaagttgatggttttctcccaaagcaggaattactgattcagttctaccagcagagggctcccttttttaagctaataaagaacatgtgtcttgcagatcactttttaaacactaaaattcaacgggaaaaagattcagctcacactttcctaatataataggacctctttggtagatgattgtacatattgtgagaaatttgtttaaggcaaagtttttccaatctatttcaagactttctatacgttgagagagtactgctttccagtggcttattttcttctgaaacagaaaatatactggtggacttaacagagcattttaatcttagaaggttttgacatgaaacatcatgtgaatccagacaggtatgcttaggagactgatgtttccaatgtttctagctttagaaaggctatttttaaaagtagggcaagattatgcagctcaggatgcaagggtattctctgaactaaccatatgtccctatgatcagatggcagattcacttatagactgttatttccattgggaaagtttttcaatattatatcagttgcactaaaggaaagtttgtaaaatcactttcattgtgggtttaacagcactttccagatatttcaagtaaccctgaagctagttgctgctgttggcctgtgtggactttatgtgaccactggatcactttcccatgcagagtatgagggtattattgaaagaacctatgtcttcaaagggaatgaaatgttttgttttaatttaagcaagctaaaaatagaaaacagaaaaaaccagagttttgttaggggtgtgaaattttttgcatgtggcttaaaagattaacttcagttttgtccatttttttttacgttctctagcaaagggaagtgaggagcagggacaatgggtagagaagggcatttgaaaccatcagaagattgggttctagtcttagggctataatcttctgtaaaccacttcacctccctgggtcagatttcgttttcccctctatggcatgcaggaattgattgaagtgaactctaaattactttctggtgtaaagtttggtgatttccctggataaccttaaagctatctatgctcatgcaactgaaaattttcttagatcaaattttaattaaatagtagtcagtaatcccaagtctggtccattgccactttctcaaataaagggcaaacatccgcttagaaaggtatgcccttctctgcccttctatcctttaccccattagctggcacataaacctaatgcagagacaccttttaattagcaggtcatatggccatttaaatgcgagttgcaatcgacctcataaaaatagccgcagtgttgttttattctgaatcgtcacatgatcatggagtatagtatgcatatggtgtggggtttaatattcgtccgaggatgccctcctactacttactattgaacatttttgtaatctcctccctgcccgagttgctcacaagggctttcctgttacacctgcagggctgtctgtgctggtgtgtgggaggaggtgcaagaggtggacacgagcgaggcgctgtgttctgggttgttccaagaggttcaggcctttacaagtgaggctttgattctattttttgctgaactagctcagccacttcctgtgtttggctgtgcatagtgcctcgcttcactgtcggctacttgagccccgcgagccagccagcgcgctcagcagccagtgagactattttaggtcccctcacaatggccttctcatttcccaggcgaaaatgagcaagttggtcttgcattggccacttgtcagccgatgacaactttgacttgggctcccctccccctcccgaaatccctagctcagcaaatatttgaacctgcccaagttaatcatgaagctgcgatctttatctaagggagacgtgcgagcgcctgggctcctttcctccccgatacagtagcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagcactgcctgccgggaacaggctggggggaggtgcgggggcttggcccacttggtggaagaacagctttggggattttttttttttcattgtcggatacaggcatttcaaagggaaaccgttgaaatgcataacctgcaaagtaagttgccttgaatttgtgcacttctctgttccttatctgagcggtgcctttctgtagtttgtcttggagtacgtgtgtgtgcgtgcgcccctgtaagcgctgcctggggaggacagatgggagattaggggagacactccccctgtcctcgagggggacagtggctgggaaagatagggtttaggttggaatttcagtaagaaggtactaattacaacgtgcttggttggaagttggtgccaggccagggcttggagagaccatgggaaaatcacctgtctccctgccttctccctgagttagtttgccacagaagatccaacagccagactggtttgcaccgacggttcccaaatgcatggactggcactctgggctgttacacccgccacagctgctcggagaacttgtctccttgcttcgggggagggtcgacattttaattaaactaaaaaagaatgtttttctgaatcttagggcatacagccacttttaccatttttatttgaatttgagttcaggtaaacttaggcaaatagaaaagtgggagagggtgggaagagacaaggtgagcctgcttttcccaatactgggaaaatgaattaaactagacgggggacgtcagagaacagaatgccttgcctttggtctgctttttaatatattttatgatcccaaattttacagaaagtctcaagggtttctgtgttttttaaatggtcaaatatgtgacatacatgtgtacatagatcacagagccccactgtagttttttaaatgagccacatttaccttggggaagagcccctccccccccgccatcataatattgtgaatgtaaagagagattggttcacaatgagaatgtacagtaggctcctataagggtgacaggattatatgcagaatgactttgaagagccaaaattgatttatttatgttaagtagtgctaagaaggaatatttgtcccggagtgaggcatttgagatagagggggaaaagcaaaaaaaaaaaaaaaaaaaaaaaaaaagtgattacatcatcttcccgttcaagcagtattagtagcgaagatgggttcatcagtgaaatattttgcaaagataaatatacctccactctgcattctgatctatagcctctttctttttggaagaagcattttctttgcccagtttttttaggcagtcacattaaaattctcattaataatgttgacagacaattacgtttattatttctgctaataggcatctgcattcctattcagaattttcattgttagtctataaagtctagttttaactttggaatgtttggtagaggaggacatctatacattttcttttaactgtcctttctaatgtggtacatttgtgacagtgtttgaattctgggttttcagtgaattatggaggactaaaataccaggagtagtccgtactgcttctcttatacatgagagatatctaaggactataaaacataacttaagtatacccttttaatgcctttgtaagatttttaaaccaaggaatgactgggctatctataaacccagatgcactaagtggggagaaaagctcggagctgcagcatatcagcttttgtcaacctgccaacagcagagcgtaccatgctgcaaggagtaataaacaaggaattagaaaactcgctgctggagaacagtcaaattaaacacctttttgaaaggatgagcatgtatatattgcagttctattaaatgtagcttcttagtgaggttggcattatgttaaggctggtatggaagagaactgatgaagcaggagtggtctggtgacatttttctgacttgattggctggggcgtgtgatgtaataggtttcagtgcagccccttataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccaggtaatactgcagtattattgtagagagttagttaatttcgtggctttttaatttttcgaaagctactgtaaaagatcctttttggatttctgtttttattaatttgtttcattgataaaaattagtttgctcatggcttaaaaattaaacagattgtttgactgtctgtggaagcaagcagctcaggctgtgtgtggtaaatgcttattcttacttgaatggatatgaattgaactccagtttttcactggtgtcttttgttaatcgagatccttccctgggtgagttatgttgtgggatattgtccctgtaattaaaatgatgcatcttttgtgctgcttttctctgttgccagtggatgagaacagtgtagcactttgcagtgataacacttggtactttagaaagcatgtaaaatgtagcagtgattacaactcagttctctaaatgttgagactttgcttgctctctcatattaagatattataatgaaaaaagaagttgactttccattattgttagtctttgtaaaatattcttggtagatacctgaaatcattttttgtataagttaaaatagtaacagtgctttaaaacttatgacagaatttacctaaaaatcctagatttattttgtttcctaagtaagttgttttattccaatgttagctctccccctgcccccatttaaggtattcaggaatactgcagtcttttatttgtcaccaattggtatatatgaatactgatttgacattgaggaagggggatatcatttttaatcagacctagtatatagagcacaatttatccaacagaatattaacatattaaagagatttagggcacagatgagagtttcttaaagtggcttttggcagaacagtgcctgaaatactaagattagagaaacccaattgctcctcttaaaacatactgctgtagatgagcctttttattactgcaacagagtttgtggaggacagagaccaaatttgtctttcgtaattaaataagaggaaattaaagccaactcatgttattcctgctactcatatgttcatagtttcttactttagatggatttgaccaggcatgaaactttaatataactagaatctagaagtacagaatgtcatgactctggatttactttgaaatttattcacatggccagcccaatttatttgttagtttctaaggctctctctcttttctccttttcagtttcatttctttttgagccatgctctgaaagattttttttaagaaaattatcttccatattgcatggaattgtgaactaatgctatatatttcagttactctaactttttatttttttaaagtaaaagtattcatctaaagaaatttagttctaatgtagttgggattgcgaacaactttttctttttcatctgcagcactgcctcctaaaccaccaaaacctactactgtagccaacaacggtatgaataacaatatgtccttacaagatgctgaatggtactggggagatatctcgaggtaaggctacagaaacttcattttcagagagttttagattaaaagaaagaaaagcaccagcttgctaagttccatttttaggatatcatccaacataagcatgaagcatagttggttctcttccaaagacgaccagaaaaagtcactgagcactggagaactgtgggtgctggatgccacaggaaattaaatacccgggaagtttcattattgacagagatgtcagtgaagtgccagagtgaagtggcactgcctaagaacagagtgtgaaggcactctatctattaagcacaactctaagaattcttgccttaaacacaataagaaaacaatgccattttatgttagctttgggaagggggagtaaggttggagaaactcttttgagatcatgagtttctgtgctcatttgtcagagagattgtaatgtttggttgaaaaaataaaaacttagtaccacagatacaccaatagtgaaagtgatatgcacctgtttgtgatgagactgcaattgctaacatttctatttaaacaaattattagctcttattagtgagctctgaaaatgcaattcattaatttaaatctatgtgggcaggaggaatatgggcactcactgtactttccacttgattttgctgtgaacctaaaactgctctaaaaaatagcctattttaaaaaatataaatctgtggtcactaaaccttaagatgagcattgttttgtgttttcatttcagggaagaagtgaatgaaaaacttcgagatacagcagacgggacctttttggtacgagatgcgtctactaaaatgcatggtgattatactcttacactaaggtaagccagggaatatagctgaaattagggttttgggctgatattaaaacatatttccttattccaaaatgttaatacctttatttttatattgtttttacaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggtaataaaaactgaatgaattatccagttacgatgtttagacaagatccttttaatacttagaaaacatttgaagcagatgaattacatgtaatcaagtctaaaaaacttgacactcgtaattacataattgcaattttaaagatgtttccatgtcagctattttgttaaacaattgttatttgattaaataccttatccattgaatttattttaatctttctaggatcaagttgtcaaagaagataatattgaagctgtagggaaaaaattacatgaatataacactcagtttcaagaaaaaagtcgagaatatgatagattatatgaagaatatacccgcacatcccaggtgagttttctatgaaaatcagattaaaaaataagagttctaaacttttaaagactaacatggaaaaaagaatttaaaaggttgagtttttacgaatgaggtgggggtgagagcatttatttgtgaatcattgttgattattctagtgtaatatctctaaagctttaaaccaaaaattttaagtatcagaataataaattaagttcacgtgataactgaagcagtcactgagtttcaagttgatttaattcgtgatagaaggatcctgtttagattggaagttagtaataactggaagtttcacagacttgtctaatccctgaaatggagatttaggcattaatatatatcctaccatgaaaaggaagggctatatactgctgtgcttttctagacccttattcttcactggtcactcatgtatctgggaatgccagagggaacagaaaacaacagggatgctataaactacaatagcttttaagaagataaaaactataggaaattgctacgcaatcatttttcatagattgagaaaattctccagaggaaatacttgtttctgggatactgttttaatggattttatgaatttgagtcccactctgctaataatacagatcaaatgtcctggtagtgtcttgcagtaagagattgttctatgaaaggtatgacattatctttttaaaattatgttgcaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggttggtgtttcccttgttcttgtgctagagataaccaaaatcctctaaaaccatttaaagatgatctcgctttctgtgctttgaatgatcacgtggacacaggaaggggaatatcactctggggactgtggtggggtggggggaggagggagggatagcattgggagatatacctaatgctagatgacgagttagtgggtgcggcgcaccagcatggcacatgtatacatatgtaactaacctgcacaatgtgcacatgtaccctaaaacttaaagtataataaaaataaaaaaataaaataaaataaaatatgttgagccactccaaaaaaaaaaaaaaatgacaggaagagaagccacgctttacctaaggaaaactgctgggaaaccatagtgaaacttttcataaactttggggaccgttcctgatgtacccagataataacaaatacgtttcttttgcctgcaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtaagtatttgaaatggaatcctatacatgaataattggtgattgctacaattcaggatgagttaatgcgttctcttttcaaaactgtttttcaggtggttgactcaaaaaggtgttcggcaaaagaagttgaacgagtggttgggcaatgaaaacactgaagagtaagtagttactaaagatggtgatagcagaagatttttctcattttaggaaaatgcatgacttgctttgtttttagaacaagtgaggaattttactgagtttggaacatcttgtaggagaaaatgtataaactcagtgccattatccagaattttaaaaaaagaaagcttagctaaggaggactaggatttatttttactcataatgctgtgaaacaactctctgtgtccataatgatgtccctgaacatctgaaaaatcccaaaatatttttggaacagtcagagaaaaaataattatgcttaatatattttaaagcttaagtatatactttgtttgaattagtcaaaaactggcaatctgcctagtcaatttcctgatctaaactggataaacgagattgttttaataccttccactctgcccaggtacctgagtgtggttgcttgaaaacagaaatagtacagttgattggtaactctttgtcctgggaggttgcactggaggctgaataccaggagaggaaaactcaggtcgggcagaggcaggcatgtgatggccagtctgactggcttggtaggggccaggagggaagtgacgggggtatgcctagggaagacagcaaggcaggctgatggctcctgcactcttcatttagaaactttctgtcctgcctgcctagccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtgtatgtatctccagcaaacttttctttacaacatctcatgaagagatgtttcatttattcattcattgagttttgggggcaaagatttgacatagttttagtcttgaataagcttacagtacaataatgtagaagagaaaccaaagcagctgtaataccattttaaagtctagccagaagtgtatgttaatacagtctaatagatacctactgtttagttggaagactaggtttggattcccattcagtgctaattaatcatgagaaatcgccaagtctttttttctcatctttaaaatggaagtggcagtgcctgccttttttgcctctcaaggctactatagttagaatctgaggtaatttatgtgagaacatcacccataggaaaaatactcatcaggaacaggtgaaaaaaaaaaggattctgatcattatccttgagataggtacacccacattggatcactgacatcaccatttccaagaaattaatgtcctctagtagggaatggttctaaaagtatgttacactccatgatcacctttcatttaatgagagaaatagtcctacagcaaagaagggtacttttgtccttactgtgcataagggcacatgcagagatggagagttgtgcagacacctcaaggacagccagaaagaaggaatcctatgaatagtcataatgggagtaatagtaacactgctagtcatggagcactgcagatagttgtcctcatcatgattggaagctaccacttgttgcatgcttactgcatgtcaggcattctatctagcattttgcatgcatgatctcatttcatttctcaaagtaactgtattacatgtattttactattgtcttccctttaaaccattttaaagatgaaaatacagtcagtcagtgaagctgggttacctacccaaggcactcggccaggtgtcagttgtaacctaggaccctttccccaagttgagactgcacaataatgctttttattaaagatgccctgaagagttgtgaattgtcttggacaagctcaaaagacagtttttcttctctcctctctagggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatgtgtgtgtgtgtgtgtgtgtgtgtgtatatatatatatatatatatatatatatatatatatatatgtgtgtgtatatatatatatatgtgtatatatatatgtatatacatatatgtatatatatgcacatatatatatgtatttaaaaaaatcaaaacaaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaagttttgggttgaaatttcacttatcacctaagaaatctttctaaaacagctaccttttggcttataaatgttgctgctatttctgttgtctcccacccactcccttttgattgttatcacagtatctcatttttgtaaagttgagaaggacattgagtggtcacatgtaagtaatacatatgagctgtctttcataatttcactgttttttgagacggagtcggagtctcactctgttgcccaggctggagtgcagtggcgctatctcggctcactgcaagctccacctcctgggtttacgccattctcctgcctcagcctcccgagcagctgggtctacaggcgcccgccaccatgtccggctaattttttgtatttttagtagagacggggtttcaccgtgttagccaggatggtctcgatctcctgacctcgtgatccactcgcctcggcctctcaaagtgctgggattacaggcgtgagccaccgcgcccggccaatttcaccatcttaaatgaggaaatacacctaggtaatgtcccttcaaggcacgttctcgctataggaaaactagaatgcccatcatccttcaattctcgcctcctccgcattcatacccaaaccttgagaatcatcctctaagaacgaagtgtccagttttgtctctgttgtgcagtctgcatattttgaacactcacagtgcagggatgacatgggactgtagacagggagctaagttacacctcaaatgcagattttacattgtatcacctagtcaagatacacaagtcttactgtaggataactttcccatttgttttgattgctaagtggacttaaggcaataccactttgcatgtatatggtgtttacatgtagacacagtgagggtctagacctgaaagacatagtctagtagtagaggggagagggacgtacaaataattactctcagggcaacaatgactaatattttttgagtatggcagtagctcccagactgatgttctgctttccccctgctctgtttggtatcacagagaactatattcgctggagcgcttgtcctggggcttctaggtgtctcttccctggctctagctcctgccagatagaccctcattttcaggtctgagcaaaccccctctgctctagctctcaggagaaggctctggaaacattacctactcccattttttactccagcccaagaagtggttgcagctttatgctgttgctaaacgtctggtttccctcaccacccccatttggtttctgaacccttccctcactcaagtaattatcattcaattattccagtaagagctagggtaattccccccccacatacacacactggtctctgacatatcaagtgattattatctgttaaactctttgttttactctttccacaattacctgggtaagatgattatattcccattctttagatgagaaaacaagcatagatgtgagatgacttgctcaagatcatgcagcatctgagaacagagttgaacgcataggcttctcaagccagagctctttgcccctatgctgtaatgtaatagactttcaatggaaaatgcacaagagaatgcaaaaaaaaaaaaaaaaaaaggctcactggtaactttttgctggggaggtaaccatgtggctttcaattagtagacagtgcacaggtggtcaatgatgaatcacaggaaatagcctgggcttgctttaaaccagtggttcccaaagtgtggttcccagactaacagcattcacatcagcatcacttggaaacctgttagaagtacaaattcacaggccctacccctgacctactaactctgacactggagcccagcaatctgtttcaacaagctgagtgattttaatgtatactaaagtttgaagatcacgactttagatcacctgcttactgaaatagtacttctagcattttaactaaaaaccattaccattaatgagtgatatgttactttctaatttattttcataatgtaggccataggaaaaagaaaacagattgatttgcagtttaggaggcccagtctgctctttttatctgtctttaaccagctgtgggaagtgggccaattcaaggcaccttccaggcctccaactccttatctgtgagataaaggtatgggcctctgggactccttctagagcatatgctgtgattaagtgagctgaatgaagattcccagtcccccaattctccatttacaacttgaccaccaattttaacccacaactaatggtcctttatgttgccagtgactatggccaagtgaaagcatgcctcgaattggggtatacttttcttgctgacatcttaaaagtgacacttgaggcgaatctaaactggcagccaagttcttgacagtgtggagagagtgtatttggaaatgacactctgcccatctacctaaagcgtgaagtgctaagagaatttggcctaccaaaccctctggggcatggtgggaggcaggaaagtagagtctgttaagacctgatacaatgtcagtcaatttcaaaaacccttttttttcccccgaacttgtcccttaaaaggtctatttaaaaataaaaatcagttgcaatatcttaaagagacagaattgattattcactctccaaacttcagattatcttctcaaaagatagcactttgtaacctccagtttggtattgctgtcataaatcaactcaacagaaaaccgctgagatgctttgggggagggagggtgtggaggataaatgagtaatcaccaacatgctaatctgcattttgctttccagaaggaaaagagaaattcccttctctctgtagcactcaatcataagagtctgaagcatcacctcaggcttaacttgttaaataaaatattctaaatctatacctgtcttgacaggtgtaaaggtttggcctataatatgagaacaggacagtcaacctctaactaccaccactaatcacattaggaagaaagttacaagggaggtctattcatcaccaagactgctcattagaattatagttttgactgtgaaatataccatacgttgtaagactaactcgctggaaccaatttatttatggagctctcatttcagaactcagtgatttatagtccaaaccctcacaaatcaaaaaatatagataacttcatcacaatggagatgatgtgctagtcactttatgtcatatttactgtcctctaacagaggcccagtgccatgtttaaaactatttaaaatagttttgttgacagtggtgatgatctgtttctttggacctgcgaggataagacatccaacgagatgtctaacgtactgattcattcaaagctttattgagcacctactatttgctggacactatttccctctgaaggtccagtgataagacaggtgaaatcaaagattacagtctgctggtgaaagcaaactcaaacaactgccctctatcatgagatacagagaggaatgaacactaagtctcaagcaggcctgcatgagcagctaggccaagcttcagagaagagttgacatttcaaatgtttcctactctagtaaaacaggcccatgtactcctggtggttgctcctcccaccagccttcatggaagctggttctattgaggctagaccattgtacttctttaatataatcacttttcaggtgacatgtttggtttttcaatactgtcaaaggcattatctccattataagttctctagagttcaatgttcccatctgcagttcccatgctgcaggtggttcagacagctgacatcacacacctcagcttcaggcaagccacttttctccctgtccagggacagatgccagggcctcacttggctctttgccttggcacattagacgtgatctgcatgcaactgtaccttttccttttattttagatgagaaattctcaaccctagctgaacattaggatcacctgggtatccatttaatagaaaacctgacttattggagtctctaggggtgagcattaaataagatgtacagaatgcacctgcaacatggctggcacttaataaatggaaggcaataaatatagttgttagtcagtcttgcctatcaagattagattccccaaaactatcgctttcgatttcctgtcgtttttaggatagggctggctggacacatggtaaatcacccaaaatctgtaacttttaagatattttatataagatatttatatttattcatatctgtacctactttcaggaagtatttaccttttattggctcttaggcacacagcattgatttactcatccaatggactaaaaatcaccaatttatgtgtggctggctcttctattattctgaaatattgtataacattaaatacattgaatgtatttataacattaaatacattcaatgtatttataacattaaatacattgtatacattaatatacactgtataacattaaatataagtatgacaaaaaagccatgaaatagacacaaaacaagtagtgaaggaagaaaggaagggagatgttattgaaaataaaaaccaattgtctctaagtttcaataattgaaagaaaacaaagcttcctattagccaggcaaaaaaaaaaaaggggtgcacaatgctttcatagttccagtgctctgggagaaggaacttgtcagttcagtgtgaactaaacgatcctctggccctgacacttgagaggaatctgtcaaagggatctctgtaagtggtagtgcctcttacacaatgttcgattagaaatggttcttcagatatattctccatatggtgctttcttatttagtctgtggcagaagcagaatattgttctagaaaggaggttctgtgatgttggctccagaactctgctcgaggtgcatcttgcctgtttcctagcactgtttgggctgcacccacttcagcatgccggagaaagctgccctgcaagttctacagaaggaaaggccaacaaaatcagggccgctgcttatttgctagactgttccaggccagcagttcggtggtgaatcttcgggaagtctttgtgacatctcaggcagtgccaagtctcaaagctgtgggggactagacactccactcttttatccagacatcagctttgtctggtctagagcccaacttcatgcagcactgtgtttcattcatcattttccccatagaagatcctagttctagttcattttactacctttaaaattttatctctcaaagatacattccaatgatacattttaataacaccccgtaaaactggaagttcaagttttctggctttttccccaaggagaagggttgtcatcaatatatggaacttttgaggaatttctgcaaaagtctgtaatcacagtagaatgaaggaaattttaaccagcctacaatacataagggaaattgtctctggcgagtggctgtaaatccttagcagaactgcacagtgtattctcccacatctccctagtttagagaaattgaggctagaactaagggtgaggcagtaagggtgcatcggaaaaccttcaatcattagctcttccgcatgtcactgaacacagagttgggaggaggtgcacagtagcacaccagtatatagtattgccatcatccagatgcaatcaatgaaaagtaatctcaagagtattgataataaagtaaaacaattaggaagtgatgagtttttagtatttgattgtaagtttatggttttttaatgatgcctgtaattataatttgtgtgatattaagcttgtatcatttaatgtttaataaaagctgtgtataacagccagctcacaaaatgcccgaaaagtgtagccatcagctctcagggtttggtttgaattggctccagcacaccctggcagttagaaggggcaaaatcttaagtttaaggatgctttgggaaatgcattggatgccagtgtacaccaattggctgtgatctcacatccggcttctgcttggaaagatggttgctaagaaaaacagaagtagccccataccaggttcctaacaaaatcagttaggaggagcagactatgtcctggcatttaggtctatcacagtaaacacacaaaaaaatttagtgcaagttctcccttatccccttcacagaaaaattgtttcctatctagtctagaaaaatcaaaccttttagagtttaaatattttaaaattaaaaacttttattaaaaacatacatgtaactcctcacccctttccaatatctgggattaaaagatttgaacagagacctgtataatctcaggcaaaattcatatggattctcattactcagtcacacagtaacctccttcctgctgcagaagctttacagacaatcacagggcatatgaaatgttttagtaatgaagatgaagggttggagcaaatgtctccatacaaaacaaattgactctaggaaaaaggggaaaaatcaaatcaatgtctctgaaacttgagaaacttgtatttattaataggaaaaaagttttgagctcaggtctaattgctatcacatgaaacactattagcaaatttaaaaatgaacggttatgagtaaaaaacaaattggatgctacagagacaaattagtaaaatagaatttacaattcaagatatcctctcagaatacggacagcaagaaaaaaaagatgacaatgataagtaaagagacgacctagagaatagattgaaaagatctaatacatgcacaataggaattcaggagacagcagagcagattgagaagtactaatcaaagaactgagagaggaaaattttcttgagttaaataaggattgcgcctacacatagcaaggacccactgagtagccaaaaacaataagacccaaattgcttggtaacttttcctagggttcaagaagaaaaatttataggtaaccaaacgaaaacaggctactactacaaaaaaattgttttaagccaagtgcagtgtggcacatgcctatagtcccagctacttgggaggctgaggtgggtggatcacttgagcccaggatttcaagcctagcctgggcaacagagcaagaccccatctcttaaatttaaaacttaaaaaaaaggttaataatgactatccttcatagcacttaatgacagaaaaaagattgtggcaacagctatataaaccaaataattgtttatgtttggaggcaacaaaaatttaagacataatgccaaagagtgaccacttttaccttttcagagaaaaaaaaaaaactaaaaatcctccagccaaatgaaaagcaaataaaaagaacacaagtaaaaggaagttgtcttttaaaaatggtagagaacaataatagcagtaacagaaccaatatgcaaataatagttaacatatttatgaaaaataatgaaagacaaattattgaatgagaatatatgtaaagataaattaagatttaaaaaactaggatggatgtaaaagttcaaattgttccaataattctgagagctgggagagagaatgaataattaggcaagtgtgtaaatatttagaagcaatgatgcttattggtacatttaatactgaaattaatctaaatcacttattgaataaataatgctatagtgtaagtcagaaggaaaccatcagcaattaaaaagttatacattaatatcctattaattggcatgtaaataaatctatatgtatatattcaaaatatatttttaaacaatgaaaaattatcccattttattcaatgtgtgtatacagctatatcttatagagtatgtttatgacaattctggaagtctattgggtttagttaataaaattacatggttgatttttttgaatgtatgtttttcctcagcaagcatggaacactcacagaatttgaaaagttaaaagcaaatgtctaagaaagcacaggacaactttaattgggagtgtcagaaagtctttgatgagataccgtaaataagtgagggaaaagattttgaaaggcaacagactgcagcaggaagaaaggtgtggaggggtgtgtgtgtgtgtgtgtgtgtgtgtgtgtgtgtgtttgcgcacgcacatgtgcagcctcagagatccaatcacttacctgaagaacaagtaactgggttactgtggggaaatttaagagttcaagagcacattcagatggtaccttccaggttttttcttgacactctatctttgtcctacctcaaccttcccttctagcccccatcatttgctgatgatagagacagcacaaaacaaaatggtcttaccaaaaaagacagtttcctgcccttgagttttccacagtgtccttgaagtccaaacttctttagaacttgccaaagtccaagccagtttactccagacaatggcaaccctgaacccttcactgagtctaaaggtcattgtttaaagtttttatcttcttgccttacataattcttgtatcttctgctgggggtggggggatgggggagatcatagtgatttttagctcaaaaatctacttaaagggcttaaaaataacaaaatgctggaagttatttacacactccaggcaaactgatttcaaagaaactttctcaaggatcctccttagcaggtaacacagctttgagagatgacattccctactgatagatgtaacaattggattctggagttaagcaggcatccctatggtggcatgtaaagatgaatataataatatctgatcacaataatgatagtaataattacctctcaggccagtaaatgcttactatatactaagcactttgcatatgtcaccttgtttaatttttattgccctcaacttaaagatgaggaagctgaagcttaagtaggttatgcagcaggctcaaagttatgcagctggtttgtggcagagctgggcctcaaacataggtctacctagtgcaagagcccttgctgtgacacatcatgttgtgctgccccaacttatacaaaatggcccagccatgtgtcacatcttagggatcagggacctgtgacaaccttgtcgttagagttacggattcagtgatcaattcttggtgcatccactctggaaggctattcttcatcccatctgctacatttccatctattcaagcactccccattgacctcaattccaccaaccaagcccttccacaactctccagctcttgctgaattgacctcactgatctttcagtgcatttactctctaacgctctcatttggccttagtcttcaacaagaataatcggcaaatatgagaaaagccacctaaaagtcacttaaatgactactactaaaagtctgtaggtagacagttgctggaattggtttggtagtacaacaatgccatccaagactgtggttccttttaggttttgctctgtgtatgggattttcagccaaatgtttactgtttcatgaccacaaggtgactgccccactccagccatcacatttgtattcaggcaggagggaaaaggagcagtgccagtgagctctcctttcacacctttctcttttataagggaaaggaagctttctgaactgcctccaactgattctacacctcactgaccaggactgggttatgtagtcacttctagcttctggtgaggccaggaaagcaaatagctcacttcttttgcatctatactgggaagtgggcagggggaaggtactgaatgcctctgggccagactgtcaacagtatctgccattgttgtatttttcagctctttttctttaatgctttgtcacccctaatagactcttcatcgtgcctctctgattctcaccattacctcagagttctggggcacattgttggtattgtaaaaatatctgcaaaatttaattaagtacaaaatacatatcctagaaatataaggaacattcttttgacactttatttgataaagttttgactgagatacaac

SEQ ID NO: 461 - DNA, 79046 bp, Homo sapiens
atatgccattgtgagggtccagagacaggaatgcatcctgcattagtcagggttctccagagaaacagaaccgataggatggagatagatgtacatagacggatagtgagagagggagagatttattttaagaatcgagactggcaagtctgaaatttgcagggcagtctggaaattctagcaagagatgctgctggcggtgcggcgtgagtcccaattcaaaggcagtgtggaggcagaattccttccttcttagggaacctcagtcttttctctgaaggccttaaatggatgcatgaggcccacgcacattatggagggtaacgtgcttcactgaaatctacttaggaaaatgttaatcccatctaaaaacatcttcacagacacatccagggtgctctgtgaccactgagccaggcaccatagcctagccacattgacacataaaattaaccagcccaggtcccaaagctcaggaagtatcatcttgtcccagggcaggtaaccccatatccagtgccacccgtacaccccaccgtattggagttcctgctcatcgagcttcctcacctgtctgagcacacctggctcaggtgcagccgttgtccatcagggacccggagccttctcttgctgtctccatccaggctccccaaggctttggtctcttccattgctgacttgccctgttgagctggggctcatcatatttctctattgttgctgtagtttttgtgtgtggaatttttttatttttgtagagacgggtcttactatgttgtccaggctggtcccaaactcctggcctcaagcagtcctcctgccttggcctcccgaagtgctaggactacaagtgtgagccatggagcccaaccagttaatcatgtttcaactgttcattgacctcattgagaaattacatatttgggctgggcgcagtggctcatgcctgtaatccctacattttgggaggccaaggtaggaggatcccctgaacccaggagttcaagaccaacctgggcaacatgatgaaatcgtgtctctacaaaaaaatacaaaaattagctgggcatggtggcacacatctgcagtcccagctactcttgaggctaaggtgggagggtcacctgaatgcagggaggatgaggctgcagtgagcagagatcctgccactgcactgcagtctgggcaacaaagtgagaccctgtctcaaaaaagaaaaaaaaatctaatttcaattaaaataaaattaaaaagaaggccagtttcgatggctcatgcctgtaatcccagcagtttgggaagctgaggcaggtggattatttgaggtcaggagttcaagaccagcctggtcaacatggtgaaaccccatctctacaaaaaatgcaaaaattagcccattggtagtggcatatgcctgtaatcccaggtactcgggaggctgaggcaggagaatcatttgagcttgggaggcagaggttgcagtgagctgagatcatgccactgcactccattctgggtgacagagtgagaccctgtttcaaaaaaaaaaagaaaattatagctttgaagaattggcttttcttccccccgagacggagtcttgctttgtcgcccaggctggagtgcagtggcgcgatctcggctcactgcaagctctgcctcccaggttcacgccattctcctgtctcagcctcccgagtagctgggactacaggcgcccgccaccacgcccagctaattttttctcttttttttgtatttttagtagagacggggtttcaccgtgttagccaggatggtttcgatctcctgaccttgtgatctgcctgtctcggcctcccaaagtgctgggattacaggtgtgagccactgcgccccgctgggctttttttttttttttgagacagggtctcagctttttagtctgtcacctaaccaggagtgcaatggtgtgatctgcgctcactacaacctgtgccccccggggctcaagcaatcctcccatctcagcctcccaagtagctgggaccacaggtatgcaccaccacacccagctattttttaaattttgttttgttttgttttgttttgagatagagtgtctctctgtcacccaggctggagtgcaatggtgagatctcggctcactgcaacctccgcctcccaggttcaagtaattttcctgccttggcctccccagtagctgggaatgcaggcacgtgctaccatacctggctaattttttttttttttttttgagatggagtcttgctttgttgtccaggctggagtgcaatggcatgatctcagctcactgcaacctccacctcccaggttcaagtgattctcctgcctcagcctcccgagtagctgggactacaggtgtgtgccaacacgtctggctaatttttttgtttttgtttttcttgagacagagtctcactctgttgtccaggctagagtgcagtggcgtgatctcggcttactgcaacctccgtctcccgggttcaaatgattctcctgcctcagcctcctgagcagctgggattacaggcatgtgccaccacgcccagctaatttttgtatttttacaaacatggggtttcactcctgacctcatgatctgtctgcctcagcctcccaaagtgttggaattacaggcatgagccaccgcacccggccaatttttgtatttttagtagagatggggtttcaccatgttggccaggctggtcttgaacttctgacctcaggtgatccacccacctcagcctcccaaagtgctgggattacaggagtgagccactgtgcccagccctagaattggcttttatcagttaataaacttgagtgatttggagactaattagagtgcacactaatacaatatttgaatagttccagctgggcgcagtggcttatgcctataatcccagcactttgggaggccgaggtgggtggatcacctgaggtcaggagttcgagaccagcctgaccaacgtggagaaatcccatctcaactaaaaatacaaaattacccgagtgtggtggcacatgcttgtattcccagctactcgggaggctgaggcaggagaatcgcttgaacccaggaagcggaggttgtggtgagctaagatcgcgccattgcactccagcctggacagcaagagggaaactctgtttcaaaaaagaaaaaaatattgaacagttcctggcatgagatgtatgagacattggagcagtgtgtgagaatgaactctatgcaaaatcaaaagcagatgagggccaggcgtggtggctcaggcctgtaatccccgcactttgggaggccgaggcgagtggatcacctgaggtcagtcaggagttcaagaccagcctggctaacatggcaaaaccctgtctctactaaaaatgcaaaaattagctaggcgtggtggtgggcacctgtaatcccagctactcaggaggctgagtcaggagaattgcttgaacccaggaagcggaggctacagcgagccgaaatcagcgccctagttttcagtggcttctcgttcatttttctcagtgaagcctctcagatcctaatcatcctttaagaacaactcaagttcctccagtgtcattttcaaatactcccccatgtaccgtagctctggtgtgtgctgtgccccatctgggttactgctacctttattccctgtgcctcacaagtgagtgctgggattacaggcgtgtgccaccacgcccggctaattttttgtatttttagtagagacggagtttcaccatcttggccaggctggtcttgaactcctgacctcatgatccaccctcctcggcctcccaaagtgctgggattacaggcgtgagccatcgtgcccggcctactgcaacctgttttattagcaaggtctttatgacttgtattgtatcttgtcctgacctcttataccatcctgtgactttgaatgccttaactgtctgggaatgcagcccagtaggtttcagcctcatttcacccagctcctattcaagatggagttggtcttcttcatacgcctcacgtatttctcctttttttttttttttttttttttttgcgacagggtcttactctgttgcccaggcttcagtgcagtggcatgctctcaagccttccaagtagctgggactactggtgtgcaccatgacacctgctagttacaaatttttttttgcggctgggtgcagtggctcacgcctgtaatcccagcactttgggaggccgagatgggcggatcacgaggtcaggagatcgagaccatcctggctaacacggtgaaaccccgtctctactaaacaaaatacaaaaaactagccgggcgcggtggcgggcgcctgtagtcccagctactcgggaggctgaggcaggagaatggtgtgaacccaggatgcggagcttgcagtgagccgagatggcgccactgcactccagcctgggcgacagagcaagactcggtcacaaaaaaaaaaatttttttcttcttttgtagagaccaggatgggtgtgtgcagggggcagtgggggggtctcaccatattgcccacactagtctcaaactcctggcctcacgcctcctgaagtgctgggattgcaggaatgagccactgcacccagtctagtcatgtctttctttttctttttttgagacagagtctcgctctataccccaggctggagtgcagtggcatgatctcggctgactgcaatctctgtctcctggattcaagcaattctcatgcctctgtgataccctaccttgttttaacctgagtgaccctctcctaggagagagagagccagacagactccattttagtttcttcattggcagccccctttcacctccctcccttaaggcgtagctagtgtaaactgactctaagcacgtccaggaatgcacctactgataagatagtgaggcaagccgcactagcagctcctggggatgagcacggtggatggcacccaaaacccctgcatttatctctttgtgatagtttaagcccctgcacctggaactgtttatttttttaactgcatttgtaaccaattaattttttaattttttgccagttctgcttctgtaaaaattgtttcagctaaaatccccctcccctatttagaccatggtataaaaacaaaactagccccttcctcggggccgagagaattttgagcgttagctgcctcttggttgccggctaataaaggactctttaatttgtctcaaagtgtggcgtttctctataactcgcttggtcacaacacctcagcctcccaagtagctgggattacaggcgcctgccaccacacccagctaatttttgtattttttttttttttttttgagacagagttttgctcttgttgcccagaatagaacgcagtggcgcaatctcggctcactgcaacctccaccttctgatttcaagtgactctcctgcctcagcctcccaagtagctgggattacaggcgcctgccaccatgcccatctaatttttttgtatttttagtagagaaggggtttcaccatgttggtcaggctggtctcaaactgctaacctcgtgattcacccgcttcggccttccaaagtgctgggattacaggcgtgagccactgatcctggcaatttttgtatttttagtagaatcggggtttcaccatgttgcccaggccaagagtttgagaccagcctggtcagcaaggtgaaatcccgcctctactaaaaatacaaaaattagctgggcatggtggcgggcacctgtaatctgagctacttgggaggctgaggtagaagaattgcttgaacccagcaggcagaggctgcagtgagccaagatcatgctagtgcacttcagcctgggtgatatagcaagactccatctcaaaaaaaaaaaaattaacaaatattatagaaaacatgttgtaaagaaaatagaatggctgcttatttgaattaaaatgtacctgtttttttttctttctttttttttttgagacggagtcttgctctttcgcccaggctggagtgcagtggcgcgatctctgctcactgcaagctctgcctcctgggttcacgccattctcctgcctcagcctcccgagtagctgggactacaggcgtctgccaccacgcccggctaattttttgtatttttagtagagagggggtttcaccctgttagccaggatggtctcgatctcctgacctcgtgatccgcccacctcggcctcccaaagtgctgggattacaggcgtgagccactgagcccggtctgtttttttttctttagaaaccacttcggtgctcaacaccgggaagagggcccccatggccacacaggtgtggttggaggcaaaggtggattcacagggaagcaaatgagtcttcaccccctctaaagccccatacctacctcactttgaattattttcctaaagactcctcacagtatgcaagtttcagggcccagcaaactttgcccatccctggaggaggagactactgatagtgcatctgtcaggggcatttgaaccaaagcgactccatcttgaatagcgactgggtaaaataagactgagacctattgggctgcgtttccaggaggttaaggcattcttagtcacagggagagataggaggacacaagacacaggtcacaaagaccttgctgataaaacaggtaaagaagccggccaaatcccaccaaaaccaagatgaggatgaaagtgactgctggtcgtcctcactgctcattatatgctaattataatacattagcatgctaaaagacactcccaccactgtcaggacagtttacaaatgccatggcaatggcaggaggttaccctatatggcctaaaaaggggaggaaccctcagttcccacccctgttcaggaaacctcatgaataacccaccctgtgtttagcatataatcaagagctaacaatatatgtataagctgccgggggaggaaggcagggcaggaaagaaaaacaagcaagcaaacaaacaaaaagtataagcaactgagcagccacgccactggtgggcctatggagtagctgttcttttattcctttgctttcttaataaacttgctttcagtttatggacttgccctgagttctttcttgctcaagatccaagaatcccctcttggggtctggatcaagaccccctttctggcaacacatcccggcctttcccccttttctgaagacagacttcagaaatgaagaaaaagaagggtggccgctcatggtgggtgaaacggcaaagcagctggcagagaaggcacctagctgatgaccccagagtcttctgggcccagagtgggatggcagggcctgggcttctgtctgccctggacttgctgcagctgcttcctgggctctgggtgaccatgcgctcaggtcctcctgtggaactcctgctgtctcacaggccagatgcaaataaatgaaagcttcagaccgggggcaggtgtaggtgtggccagtgagccccgggctgcttccaggggcctgaacagcatgtcacagggcccctgcccctgctgagaagggcccaggcttggggtaaggttctgctgtcactgccttgaaattcttcactgtaatttctgagccagggactttgtcttactggaatggggtctcaatccagatcccaagagagggttcttggagtttacacaagaaagaattcagggagaatccacagagtaaagtgaaagtgagtttgttagagaagtaaataaaccaaagaatggctactccataggcagagcagccccaagggctgctggttggctatttttatggtccttttttttttccctagaatccgttcctgaattatattggttatttcttgatcacgtgctaaacaaggggtggattattcatgagttttctgggaaagtggtggggaattcccagaacttaggcttcctcttccatttatttatttatttattggagatggagtcttgctcgttgcccaggctggagtgcaatggcgtgatctcggctcactgcaacctttgcttcccaggttcaagcgattctcctgcctcagcctcccaagtagctgggactacaggtgtatgccaccacgcctgcttaattttttggtatttttagtagagatggggtttcaccatattggccatgctggtctcaactcctgacctcaagtaatctgcccgccttggcctccccaaagtgctgggattactggcgtgagccactgcgcccgaccccttttaggcaatgtagggtatcttccaaacgttgccatggcatttgaaaactgtcatggcgctggcgagagtgtgttttaccaagctcatatattataattagtgtataatcagcagtgaggaaggccacaggtcactttccccgccatcttggttttggtgggatttggccggcttctttactgcatcctgttttatcagcaggatccttgtgacctgtgtcttgttccgacctcctatctcatccgattactaagaacgccttaactcctggggggtgcggcccagcaggtctcagcttcagtttacccagcccatgtggagtctctctgttccaacacctattgacacttgcatctggatcttgcactaggctctgcagattatgctcagtcttgaatactgagctttttttgtccccttgaacttccctccttgggcaagtatctcagggcctccctcttgcccaccctgctgcttcccatctttctgaaagaggcggctctgcagctgcacagcacttggccaagacctcctggcggtgtggagctctgaagacacaggagggatgtcctccgagctgttcatgcctagacctacccccaggctccctctagcaatcagctccagtcctgggcctgtctgccttccgggaggagtgggggcccacagagctgcccttcccgcgctgtgtatggactcaaggcactgatggccttcggtgggccactgcataaatggatgtttctgcagtattgaaggccagtcaggcaaaccgtgtgctttcctacgcagtggggaatgtgtcgccctttccttacatcttggagaccaaagccaccatctgcacttgtgggtacattgtggcagtggtcggttagggtggtctttcaaagcagtttgaaatgcagacacttgtgggcgtcccctaaggcaggtgccctttacctggaggccgcattggtcacctagacccgcaaggctcacctgggccggaaggtgtggtcaagcgaggccaagtagcccagaggccacccctaagcacctgtggacatcatgagtccttgctggggtcctcacagagggaagacagcccccagggtaaagcctcaggtgctaagcactcgcgctgccgcagggggggaggcacgtgagcatccactgtgccgcccaggacgggcccacccgggctccagagcctggggaggaaggctgcgaggctcccacgggcttacattcaaaccgggcacacacagaacggaggccttcggctacgggacgcccggcggtggggttacggatggtacagccctccctccccgcctgctcgaggcaaatggtttcgcccggctacacacacctctcctgggcggcaaccgagggcgcggagggggcaagacgtgcgctgaggccacgcccctactgcatagtcataaggcgggaggctctgccttcggggcggggcagacagctcctcgcgctcgggcgcggccggttgggggcacggcctagctccgggtgcgggcggggctggaggcggggccggccaccgcccggttcccgccctcgctctcctcccccagcgatcaggccccgccccgcgcccgccgccgcgcagggaggggcggggcccgtctccggcaggccccgccccctctctgaatattgatgcggcgcgcgtcggcgtcgccctcctcccattgagcgaggctgtgtcgcgtggcccagcgtcggcgtgacggttggacgcgggcgcggcactgcgggtcccgattgctgcagccgcttgtcagtgtgatgaagattggcacccaggtaagctgtcactcaaccgctccgccgccgccgccgccgctctcgccgccgccgtccctatcaatcacaccggcccgcggccgccgcccgccgccgccgctgccgcccgggtctggagggccggcgctgccctcgagggcccgcatttgacccgccgcccggggcagggggcggggagggggcgcgggtgggggaggggagcgggcacccgcgggggagggggcgccttcagcccaaccggcgcgggggcgcgcccagttggtttcttagtgtgggttgagggacgcggaaatttctggaaggcgccgccgccgccgcgctgggcctgatcgaagcgcgcgctcctaaccgtccctttcggagtgcggcgcgcgccccggcgcggggcgggggcgcgcggagcccggcgcgggcggggcggcgggcgtgagggtcgggggcgcgcggcggggcggggccggggcgggcggcgcgcgtggggccggtcgggtccgcggcctcgcggagtcctcagggccggcggggctgctcggagggtgcggggcgcgcggcggcgcaggcgggaagatggcggccgcgaccccggccccggcctcggccgtggcgagcgggtgggtcggggtcctgggggcggtgggcgtgatggggctcgtggccctcagccgggcgccggcgcgggagcagcccagggccgctcgctgacggcagtgtttggggccgggtgctggggaagcggttccggcgtcccgggaattggtgggaagagccgcttctgtcacacgggtcgtggtaatggatgacaggaagtgccgggcagggtctgggcgccctgtgggtttgcaccttccttgtgagggaaatcgtgtcacttaacgaaaaatgaagaaacgcggagtctgctttatgtcatcctcgtggctctcgaaatgccttatttggacagtggctctgcgacgggaccagttagggcctccgttccgatggcggattcctgacgggaggcccgagggtccgggaatggcggcgtcctgaggtcgggcccagggcaggccaggctgagcgccacggcggggccgcagccctggggggtgttccacctgtgtgtggggttctcttccaactctacgagagtttgctttttaaaacagtagatgatttttccttaggaagtggttcctcttcaggatgaaagaaacccccagctttagttaggtctactttcatgatttttcctggcatactgaaaaataggctttctctaaacataaggaagaatcgaggtgaaatgtgaacctctgccagtatagttattggtgatgctcttgcatttagtcataatttggaagatggcaggctgaccccaatgagcctttcatcactctgcttaatttacttagagtgatttgtgaatcctgtccttgtacacaggcgtacctcagataattcgagttctaatccagaccaccgcagtaaaataagtattgcagtaaagcaagtgacgcaacagttttaggtttttcagtgcatatgaaagttgtaattacagtatactacttaaagtgtgcaatagcaagcattatatctataaaaatgtgcttacgttaattaaaaaatattttagtgctaaaaatactaatgatcatctgagcctttagtgagtcctgcttgttttatactttgacaatctggcctcagtgtggatggctgctgactgatcagggtggtggtggctgtgtcagttacttaaaataagacaacagtgaaatttactgcattgatggactcctcctttcatgaaagacttctttgtagcatgtgatgctgttttgatagcattttaaccacagtgaaaattctttcaaagttggaggctattctcaaactctgccactgctatccactaagttgatgtgatattccaaatgttttgttgtcatttccacaatgtgcacagcgtcttcactaggaataaattccatttcaagaaaccactttctttgctcatccgtaagaagcaactgttcattatttccaccacatctgcagttccttcctccactgaagtcttgaactcctccaagtcatcataagggttagaatcaacttcttccaaactcctgttaatgttatttgacttccttccatgaatcatgaatggcatctagaatggcagattctttccagaaggttttcagtttactttgcccagattcatgcgaggaatcactaccacagctatagccttacaaaatgtatttcttaaataattaagacttgaaagtcaagattactccttggatccatagctgcagaatggatgtggtgttagcagacatgaagacagcattcatctccttgtgtacatctccatcagagcccttgggtgactaggtacattgtcagtgaacggtaatattttgaaagaaatctttttctgagcagtggatctcaacagtgggtttaaaatattcagtaatgtgttattccatttccagagcacaggcaagagtagacgtaacataattcttcagaaccctaggattttcagaatggtcaaagaccactggcttcagcttaaagtcaccagtgacatttgcccctaacaagagagccagcttgccctttgaaactaagcactgagttctctctaggtatgaaagtcctagatgtcatctccttccaaaggaagtcttttgtctatattgaaaatctgctttttcgtctcgctgccttcatcaatgatcttagctagacctggataacctggtgttgcttttctgttaggtagcacttgctgcttcaccttgtactttcgtgttatggggacagcttctttccttaaacctcatgaaccagcctctgctgcttccaactttttttttttttttttttttttttttgagatggattttcactcttgttgcccaagctggagagcaatggcgtgatctcggctcactgcaacctccacctcccgggttcaagcgattctcctgcctcagcctccgtagtagctgggagtacaggcagctgccaccacatacagctaattttttgtatttttagtagagacgggctctactaaatgttagctaggctgggacttctgacctcaggtgatccacctgcctcagcctctcaaagtgctgggattacaggggtgagctgccgtgcctggctccaacttttcttctgcatcttcctcacctctctcagccttcatagaattgaagaaaacttgggcctggttctcgattaggcttcagtttaagggaatgttgtggctggtttgatctaatcagaccactcatactttccacatatcaccaataaggctgtttcactttctttccctccctccctctttttttgagactattgcccaggttggagtgcagtggtatgatcatggctcactgcaacctctgcctcctgggtgcaagcaattctcttgcctcaacctcccgagtagctgggataacaggtgtgcagcatgtgtccagctaatttttgtattattagtagaggtaaggtttcaccatgttgaccaggctggtctcgaactcctgacctcaagtgatccgcccgccttggcctcccaaagtgttgggattacaggtgtgagccaacggacctggccattttcttattcatgtgttcactggagtagcactttttaattgcctttaagttttcctttgttctgagaggtgatttaaaatttcaaaaatttgtgtatgtatttttttaatttcaaaaattggaaagaaacttctgctttgcatttacaacttggctaacttgtttttttcttttcttttctttttttttttttttttgagatggagtcgctctgtcgcccaggctagagtgcagtggcgcgatcttggctcactgcaacctctgcctcccgggttcaagtgattctcttgcctcagcctaccaagtagttgggactacagacgtgagccaccacgcccggctaatttttgtatttttagtagagacagggtttcgccgtattggccaggctggtcttgaactcctgacctcaaataatccacccaccttggcctcccagagtactgggattacaggcatgagccaccgcacccagcccttttttgtttttttttaaagagatgaagtctccctatgttatccaggcaggtctcaaactcctggcctcaagtggtcctcctgcctcagcctcaggcatgatccactgttcctggccttggctatgtttttgagagacagggtctcattctgttgctcaggttgggatgcagtggtgagatcatagctcactgcactcttgacctcttgggctaaagtggttctcccacctcagccccctgagtaactgggactacagggatgtgccagcatgcccagctaattttgaaaaagttttgtagaagtgaggtctcattatgttgcctcggctgtctcttaagttcctttccagaatggtgaatcctttcaagccgccttcctgcctcgtccttccgaagtgttgggattacccatatgaatcactgttcctgacctgaacatcaaagatcactgatcacagatccccgtaacagacataataatgacaaagtttgaaatagtgaagaattaccaaaatgtaacacagacacaaagtgagctcctgtttttggaaaattggcaccaataggcttgctttcttcatacagggttgccacagatcttcaacttgtgaaaaacatagtacctgctgagtgcaataaagcaaaacacaataaaaggtaaaatgaggtgcttatagccaggcgcagtggctgacgcctgtaatcccagcactttgggaggccgaggcgggtggatcacgaggtcaggagatcgagaccatcctggctaacactgtgaaaccccgtctctactaaatatacaaagaattagctgggcgtagtggcgggcacctgtattctcagccacttgggaggctaaggcaggagaatggcgtgaacccagggggcggagcttgcagtgagccgagatcgcgccactgcactccagcctgggtgacacagcgagactccatctcagaaaaaaagaaaaaagaaaaatgaggtgcttatagtctgttgaatctaaaatgcagcagtgtgttataccactacagatgctcccagtgccttctggcacgctgctttcttaccccatcagtgaaggatgcttttcacttcagacatttaaaagtgtgccttagaattgatgaaacatggtcagtgaagtatgacttgtttcaaagattaaccttctgcgcttatgatctaagtgccagcaggttctgtggtaatgatactgagtacaatgcattttgttgggattcctgtactctatatgtagttaacgtttctctggcagtaactttagaaaagtactacttgtgaggccaggtgcggtggctcacacctgtaatcctagcgctttgggaggccgaggtgggtggattgcctgaggtcaggagtttgagaccagcctggccaagatggggcaacccctgtctctactaaaaatgcaaaattagctgggtgtggtggcaggagcctgtatccccagctactcgggaggctgaggcaggagaatcacttgaaccaggaggtggaggttgcagtgagctgagatcgctccagtgcacttcaggctgggcgacagagcaagactccatgtccgaaaaaagagaaaaaaaaatactacttgtaaatagcagaaatagaaaggtgctacttatgagaagtaacatcctatttgcggcttacacttttgttgcaaattgttaaaagtgtctgaaactgtttagaaggacagcctgaaactgctaaagtgatgcaaagtatagactctggtgggagagggggcgtcttaaattttcacgtttgcttggcctctgggggcctcttaacagcactttaaaggaaataaatagatgaagaagagaacaaattattttgaaatacagttattaaaatactgtattgaaccaaattggtgatagtcccatttattagcttagtaaccggattgagctgtggctctggtaattcatttgggagtagtgacgagattttttgtgacactctaatgctttggaaaatacctgttgctgttcctgctaaaactccagggcttattgtctgcctttgtaattgaaggagtgctacatttcagctagaagtttttgccttttatcattcatgttcacaaataccaagttgatttactctcagcctatccatttgtaggaatatatggtgtcctttctttacttcctcaaatgattatattgatgacaaaagagacaaggaaataaaaacggcacagataggggaacccaaagcctaacagtgtgtgtccttggaggtgagggtgaaggaagtggctgcaggccctgggaagtaccatcttgcatccgtgtgcagcactgagtggatacctcatggttctgtcttgtgtacactgttcaggaggacatgtagagtggacatatcacatagaagaaggtcagtctggaaactgttaggagaagcactcaagggctgagaggcatggtccttggtggaaagagccagcaggcctggtgctggcggtgccctgctcgtgacagtgtgcaaagtctggagcctggcctgttcccgcccttggcagatggtagctccttgttttggattattagcccctgccggtttagttactgtttctggaagattcacatagaaggcagtgtggtaattcagtcaacgtgttgtctggcatgtggtataaaactcctgtttaaagctctgattctgaggccatgcctcagggacttgagaaggggacagagcagcttattttattttattatttattttatttaattttaattttattttattttgagatagggtctcactttttcacccaggctggagtgcagtggcacgatctcggcccactgcagccgggagcttctgggctcaagtaatcttcccgccacagcccccaaagtagctgggattacaggcacgtgtcatcacacccagctaattgtactgtttgccgtctgcgattgacgctggaatgattggctgttttagtcgggttctcagggtggcagggagcaggctgacttcaagttgggtgggtggtgagataggtggttcaggatcatgcagggataaagaaaacaggagtctatgggattcttgggaccactgtattgttgctgggcctctgggcagatggaaccatggtttgtgctctggcaggatccagttctgcaccagggctcttggccttccgcttcaattaggtggttgccctccactgtctgttccatctgtacgctcccctcacagtgggggctcacccagccttacctgccctgtactctcccttttccagcacccacctcagagagagtgcctgtgctctttcccctcacaccacctaccaggcgctgaccttcgggctgggggctggccttgggtgttgcagggctacctggcccagggagtggtgcttggggaggaatgagcttctgacacctgcacaaggaaggccccctttgagcagggcctgccagtggggttgggtcactcaaaggggctgtggattggtaggtactatgatcacagtttccagaacataatgcctgagtgagcgcatgtgttttgttacatgttctctcagacattttatgaaggtttgtacatttttttgcattaaaaatgttaggaatttaacttgacaagaaaaaggagcataaggccgggtgcagtggttcacgcctgtaatcccagcactttgggaggccaaggtgggtggatcacctgaggtcgggaattcgagtccagcctgaacaacatggagaaaccctgtctctactaaaaatacaaaaaattagccgggtgtggtggtgcatgcctgtaatcccagctacttgggaggctgaggcaggagaatcacttgaacccaggaggtggaggttatggtgagctgagatcgcgccattgcactccagcctgggcaacaagagcgaaactccatctcaaaaaaaaaaaaaaaagtttaataaacattaaattgctaaactttacgttcttctaaatttagttacgtatttgagcatacttttttttcccccacgaaacaggggcttgctctgttgcccaggctggagtgcagtggtgcaatcttggctccctgcaacctctgcctcccgggttcaggcaattctcctgcctcagcctactgagtagctgggattacaggtgcccaccaccacgcctggctaatttttgtatttttagtagagatggagttttaccatgttggccaggctggtctcgaactcctgacctcagatgagctgcccactgttgcctttcaaagttccaggattacaggcatgaaccactgtggctggccttttttttccaattttttgttatggtaaaatacacgtaacaaaatttaccatcttaaccattttcagtgtgcagttcagtggtggtaagttcattcatacttttgtacagccatcaccaccatctgtctccagaacccttcatcttgtaaaactgaaactctatacccattaaacactgcctccccatctcccctccctgaagcccctggcaaccaccattctacttcctgtctctgaatttcgctactatagggacttcataccagtggaattaggtagtatttgtctttttgtgaccagcttagctcatttaccataatgtccttaaggttcatctatgttgtagtgtgtgtcagaatttccttcctttttaaggctgaatactccattgtgtggatatactgaattttgtttatccatccctcaacagacacttgagttccttctaccttttgactattttgaataataaaactgtgaacctgagtgtgtaaatacttctccgagatcctactttcaatttttttggatatagatctagaagtgggattgctggatcatactggaattctgtttttaattttttagggaacctccatccgatttttcgcagcaactgtactgttttatattccttttaatttaatttattttttatttttccaaggactcaataaggagagagtatcagtttacattcctaccaacagtacagaggttccagtttctccgtatcttacccaacacttattttcttatgtgttgttgctttttttaatagcagccatcctaatggatttgaggtggcatcttactgtcattttgatttgtatttccctaataattagtgatgtggagcatcttttcacatgttcatcggccatttacatgtctttggagaaatatctcttcaagtcctttgcccctttttgaattgggtttcttacatgcatacgtgtgtgcgtgtgtgtgcgtgtgtgtgtgtgtgtgtgtgtgtgttttaaagagacagggtctcatgatgttgtccaggctggtctccaactcctgggctcaagtaatccagtaatactcctgcctcagcctcccaaggagctgggacttaaagacatgggcccctgtgcctggctatgttcatacgtttttacatattttttaagctatattgtgttatgcttttagttggcattttagtgatttttaaaacatttatataatccacacatttctcgttttaaaaatttaaggtctcatacacttttgtgagtccagtttttttctttttctttttttttgagacagagttttgctcttgttgctcaggctggagtgcgatggcatgatcttggctcaccacaacctccacctcctgggttcaagcaattctcctgcctcagcctcccaagtagctgggattacaggcatgtgccaccccgcctggctaattttgtattttcagtagagacagggtctctccatgttgttcaggctggtctcgaactcccgaccttaggtgatctgtctgccttggcctcccaaagtgctgggattataggcgtgagccaccatgcccggccagttccagttttttgtattattttacggccatgctctatgttgtggagccttttgagtatttaggttttgatactttctgtgttttgccatccgaaagctggagtccctctgacccaccaagcttagtgctgacagggagagtagagaggggtggctgctgtgcagggagggagtgcaggtgccagttccacagtgctgtgtgcccagtgtaggcagtgcctgagagaggctgtccatgggaaaggggtccttgcctccaagggttagggttcctcattttcttttctttttttttttttttttttttttttttgagatggagtctcactcgctctgttgcccaggctggactgcaatggcacgatctcggctcactgcaacctctgtctcccgggttcgagcgattctcctgcctcagcctcccgagtagctgggactacaggcatgcgccaccatgcccggctaatttttgtacttgcagtagagacaggtttcaccacgttggccaggctgatctcgaactcctcacctcaggtgatccaccctcctcggcctctcaaagtgctgggattacaggcgtgagccactgtgcctggccccttattttctttctgttcctttttttgtttgttttttggtttttgtttgtttgtttgtttgttttgagacggagtctcactctgtcatccaggttggagtgcaggggagtgatcttggctcactgcagtctccacctcctgggttcaagtgattctctgacctcagcctcctgagtagctgggattacaggtgcaaggcaccacacctggctcatttttgtgtttttagtagagacggggttttgccatgttggccaggctggtctcgaactcctgacttcaaataagttgcctgcctcgacctcccacaatgctgagattacaggagtgagccaccacgtccggccagggtcttaaaactttgatgcgaatttaaatttaccagctgtaacagaccatccagctcagagtctgttaaaacaaattgcaggccgggcgtggtggctcacacctgtaatcctagcactttgggaggctgaggcgggtggatgacttgagaccaggagtttgagaccagcctggtcaacatggcaaaacccagtctctcctaaaaatacaaaaaaattagctggtcatggtggcgggtgcctataattccagctactcaggagactgaggcaggagaattgcttgaacctgggaggtggagattgcagtgagctgaaatcgtgccattgcagtctagcctgggcaacagagcgaggctctgtctcagaaaaaaaaaaaaaaattaaaaaaaaaattgcaaaaccattaaaatgtaaaatacctttgatactagaattttgttttgtctttaggggacatatgtgggcctttgggttagaaatactttttgatacagattttaacaggatttacgatctatgattttatttgaatattacacttcaaatgatacctcgccaaaccttgtttgaaaaataaagtgatggctgggcgcagtggctcatgcctgtaattccagcactttgggaggccaaggcgggtggatcatgaggtcaggagttaaagaccgtcttggccaaggtggtgaaactccatctctactagaaatagaaaaattagccaggcatggtggcaggtgcctgtaatcccagctactggggaggctgaggtaggagaatcccttgaacctgggtggtgaagattgcagtgagccgagatcatgccattgcactccagcctgggtgaccgagtgagacttggtctcaaaaacaaaaaaaaagtgatttcttgacaaatgttttcctcagaatgagtcatttattgactgaacatctctttggaataggagctgtggaagccagggtggaagagagatggacaactggcttgtggtttctgaaccacaggtgcctaaaacttctcacacacaaaatgaaagctcacttaactgtcatgatgtatagttagtgtcctaaaaggtgtcctggagaaggtattttgggaggactggtaacaaaacacaatacctagagatgcagtctctggatctgactgttgtgttgtcttcagtcgttttctggctttataaatgcctcagtgttactgtttgctagaactggaattaccctagaatttccagtggaattgtggctgctcattagtcaacactgctctgggtagcagctaggaggtggcactctgggagttggtcctctgctaggcgcggcacctggtgagggggatggggctgtgtggactcctccagcaaggcagcgtctagtatattacattacagtacacaggatagtgtcactaaactgagtcagagagcacattttaggtggatttaaagaagtatactcaggccaggtgcggtggctcacacctgcaatcccagcactttgggaggccaaagtgggcagatcacctgaggccaggagttcaagaccagcctgaccaacatggagaaactcttgtctctactaaaaatacaaaactagctgggcgtggtggcgcatgcctgtaatcccagctactcgggaggctgaggcaggagaatcgcttgaacctgggaggcggaggttgcagtgagctgagatcgtgccattacactccagcctgggcaacaagagctaaactccctctcaaaaaaaaaaaaaaaaaaaaaaatatatatatatatatatatatatgtatactcagattttctgactcctctgggtactagaaagaggaaaagaaagtctagtaagattttttaaaaagtatcacttgtctttgaacagctataattttggtcagggattggcaaaccacaggcctatgggccagatcccactgaccttttttttgtatggccctagggctgagaatggtttctactttttttttttttttttgagatggagtcttcgctctttcacccgggctggagtgcagtggcgcgatctcggctcactgcaagctctgcctcctgggttcacgccattctcctgcctcagcctacagagtagctgggactacaggtgcccaccaccacacctggctaattttttgtatttttagtagagacagggtttcaccatgttagccaggatggtctcgatctcctgacctcgtgatccacccgtctcggcctcccaaagtgctgggattacaggcgtgagccaccgcacccggcctctacatttttaaagacctgtaaagaaagcatacgtaatacagacagtatgtgacccacaaacctgaaatatttaccttctggccctttacagaaaatgtttgctggtcacacctcccacaccttcagttctttttgtttttgtttttgtttttgagacggagtctcactctgtcacccaggctggagtgcaatggcctactctcagctcactgcaacctctgcctcccgggttcaagtgattctccctcctcagcctcttgagtagctgaaataggcgcgtgccaccacacccagctaatttttgtatttttagtagagatggggtttcactatgttggccaggctggtctcaaactcctgacctcatgatccgcccacctcggcctcccaaactgctgggattacaggcgtgagccactgtgcccggccagccctcagttcttacttggaccaaatcaaagttggtctggatctaaatggaatcaaatagcagaactgttgggagatatgaaaaacacatggggatttggtgagctactctccttcagctgactcatgccttgctgtgattggtatacagtattgtctatgtaaaagttgagcctaaagaaatagctcttaaatcaccattagaattgtaaaggaatatatgtgagtagttctaacagctgaagtctagaactctgcttcagtgactagttcccattgagcgctgggacacgctttgctgagagtcactgtggagggtcagattctttccggtggctcccatgcttcaccgagagcagttgtgctgatcccccaggccactgggacagcagggcaggctccttggtcagggctggcccaggaacggagtgggttgatgagagggagcctggtccctgggatactggttagggtctacaggctggggaccctgcgggctggatgaggaccccctcactggtctttggcttctcaggctggggaccctgcgggctggatgaggacccctcactggtctttggcttctcaggctggggaccctgcgggctggatgaggaccccctcactggtctttgacttctcaggctggggaccctgcgggctggatgaggaccccctcactggtctttggcttctcaggacttctttctttgtagaatctccctcatcccttcctttttctgtttgatgtctctttcctcatttcttctgtaaaataaacgtaaaaagggactgaataatttccaacttttttttttttgataaagggtctcactatgttgctggttttgaactcctggactcaagcaatattcccgcctcgggcttccaaagtgctgggcttacagatgtaagccactgggcccggcctatccccaacctgtttttttcagtttttttccatttttttcagcttttgtgatagttttctcatggatcttttgactggtcaggataacattgcttagagatgtattttacttgattacttaaatgtatgtttctgtttcaattttttattttttttgagtcagtctcactctgtcaccctggctggagtgcagtgatgtgatctcgatttcactgcgacctccacctccagggttcaagtgattctctcaagtctcagcctcccgagtagctgggattacaggcgcctgctaccacgcctggctaatttttgcatttttagtagagatggggtttcaccacgttggccaggctggtcttgaactcctgacctcaagtaatctgcctgcctcagcctcccaaaatgctaggattacagtcgtgagccaccgcccccagccaaaaagcagatttaaaatgttagacaagctgaactcaaggcggaagcattagatagagggatattaacatatcatttacaggcatagttaataatcatgggcaggcatggtggctcacacctgtaatcccatcactttagaaggccaaggagggcagattgcttgagctcaggagtttgaggctagcctgggcaacatggcaaaaccctgtctctacaaaaaatacaaaagtaaaccgggtgtggtggtgcatgcctgtggttccagctactccggggctgaggtgggagggttgcttgagtgagggaggtcgaggctgcagtgagccagatggtgccattgcactccagcctgggcaacagagccagaccctgtctcaaaaaaaaaaaaataataataataagcggacacagtgtgcctgtaatcccagctactcgggtggctgaggcaggagaattgcttgaaatcaggtggtggttgcagtgagccgagatcacaccactgcactccagcccgggtgacagagcaagactccgtcataaatgaataaataaataaataaataataagtaacgatccactgtggcttcctggaaacatccatgttcacagctggggtctggtcagtctgcatagtggagcacactgctaggatgcatccttagcaagtgaaaaaagtgaggctcagaactgtttgtagagtatagccttttatctaaggaaggcagatgaagactggcttatgataaaggtgctaacccccagactagtaaaaatggggttccctgtggagtagggaaggggcagtgttataagttggatttctggccatatctgctatagtactgatcatggaactctaggggaggaaagatgttttccttctacccatcttacgttcattggctggggctcctggaacagaagacagatttacaaaagagaaaggcacacaaatttatgtaatataagttttacatgacatgggagcctttataaggaaatgacccaaggaaatggttaaacctgagtggttttgtgttaggtttgatgagcaatgaaaagctatggagaactatgataggaggagtgtgagctaaacgcaatgaactgggggaaacttagcaaggtctgttcagatttctctctgtatccttctttggaggtcagcatgtttcctccccccgtagatacggagggcacttctcacatgagggtcttaccacctgctttgggtgagggtcagaaagtccttcctaggtttcgtgacctgcctcaggagagaagggttggggaaggtcagagagatgttcctgcacaagctgcttctcaaattctttcagcttcaaatattcagtgtgcccaggtgccacattttggggtagcatgtcctgaaccttgtcaaaactatatggatgttttaatatagttttaaaataaaatgaagtcaaaagttggggggaagtagtctctaaaaattgaaagcagccgagcactgtgactcacagctgtaaccccagcatttcgtgaggccaaggtgggaggatcgcttgaagccaagagttcgataccagccttggaaacagccagaccccatctctacaaaaaaagaaaaaaaaaaaaccctgaaagcaaaacgaataaaaataaccaaaccacaaattgagttggtggcttaactatacagagaggagttatttcaagtgacttcaaaacaaattgtattggccaggcgtggtggctcacgcctgtagtcccagcactttgggagatcgaggcagtaggatcatgaggtcaggagattgagaccatcctggctaacacagtgaaatcccgtctctactaaaaattcaaaaaaatttagctgggcatggtggcgggcacctgtagtcccagctactcgggaggctgcggcaggagaatggcgtgaaccccagaggcggaggcggagcttgcggtgagccaagatcgtgccactgcactccagcatgggcgacagagcgagactccgtctcaaaaaaaaaaaaacaaaccaaaaaaacaaattgtattgtacatcctagcagggtaaatcctaaagacaaaataactaaaaagaaaccctgggcagtttttagtatgtgaattgttagtaataacattttaacttatttatttatttatgtacttactgacttacagctactttttgagatgggatcttgctctatcagccaagctggatcatgccactgcactcagcttccaaacctttgctcttgctggagatgcactactacaaataagccacaggacatcactttcttcagaccctgcagagcatgttacactcatgtggcttcggaagctgcattctggtcacagctgagcgtctttcgtggtgcttgcctcatgggccagctgcttcatcagctcaccctgtgtttcccattttgaataatgccgtaattcataggttgaattgatgtaattcactgttgcaggcaccagagttgtacagattgttgacaagtgtcctgtccttgtgagttcgaccttatcttagaagcacaattattttatcgtcagaggtcaggctgtgtagaagaaatagcagggctttggagctggacagattgaagtcacccaacctctggtacatctgtgtcctcaacagggaaacaaggacaactaacctatctgcgtcttctagagtagtctggtcacagctagtgtgaaccccccggtcacactgttagtggcaaaaaaccattttattatgtggacaaattctgtggaccaggaatatggagaggaagtggccgtctctcctccaggatgtctgagtcctcagctgggacgactcagcggctgggggtgacgtaatgactgaggaatggtatcttctggaggcgctttctgaaatccgtcagctggaacacgagctggggatactgaccagagcacacgtgcagactccacaggacctgggcttcttcacagattagaggaggtcttcacagcactgggggttccctcacagcactggggggttccctcatagcattgggggcttcctcacagcactggggggttctctcacagcactggggggcttcctcacagcaatgggggccttcctcacggtatcgggggctccctaatagcattgggggcttctttgatatcattgcgagcttcctcacagcactggggggcttcctcagcactgggggtctcctttatgtcattagggggctttctcatagcagtgtcaggggggcgttcctcacagcatggggcttcctggtagtcggagtgtcactatgaacaagatggaagcctccttgccttttctaacccagctctggagtcgcacaccatcatttccactgcattctcttgttctcaaatgagtcactaggtcagcctggattgcagaggaagggacaaagacctcgtgtctcgatgggagaaatgccatagagttgggggatgcactggccttggcatgtagtagacacagctctgtctgccctcactgcccctttcctcccctcacgaagctccattcttctcctgacactcaaaacgctgactgaacgaatgtccgtctcgcctccacagggcctacatcaacaggactcgcgggccgagcttccaggcgccttgagtggctgggccgggcctccacgttgccctgctgcagggttaggtgggagcgagactggccccactcctgttgactgttccaccagcaccttcagtttgtggaagtggttgtgtccaaagagattttcgtaaaaacatcacaattctaaaacttttttttttttttcacaattctaaaactttatgcatttttggcatttaaaaagccctggcaagtctactgccttatttctcctgctcccttggcctgtgggtctgttcctgtatggttacccactttgttttttttgtttttttttttttttgctgttactgtggctttgtagtatattttaaaatttggtattcgttaactctttttttttctttttttttttttttgaaacagagtctcgttctgttgcctggcctggagtgcagtggtgcagtctgggctcacagcagcctccgcttcccgggtgcaagtgattctcctggctcagcctccggagtagctgggattacaggcacacgccaccatgcccggctaatttttgtatttttagtagacacggggtttcaccatgttggccaggctggtctcagactcctgacctcaggtgatccactggctcagcctctcaaagtgttgggattacaggtgtgagccgccgcgcccagccttttttttttttttttttttttaaggcaaggcggggtctccctttgtcgcccaggctggagtacagtggtatgatcacggctcactgcagcctcgacctcccggactcaagtgatccccctgcctcagcctctcaagcagctgggactacagacatgtgccatcatgcccagctaaatttttggatttttagtagagataaggtctcactttgttgcccaggctggtcttgaactcctgagctcaaacgatccttccacctcagcctcccaaagtgctgggattacaggcgtgagccactgcacccagccaatttttgtatttttagtagaggcggggtttcaccatgttggccagactggtcttgaactcctggcctcaagtgatccacccacattggcttcccaaaatgctagtattacaggcacgtgccactgtacctgactgttttaaccagttttgttagagagaaggactaccaatctatacattttgaaattctgacttttccctcatattatgaacattttgaaagacaatctgagagtagaatcttgattatctgctacctagattcaacagttattgttatctggacccaatttatttatgtttatatttttattgatccatttgaaagtaagttttggatatcatggtcatacaactaaacattgagcacgtacttctcaaaatggtgatatttatgctgtgagcttatagctttatcacaccatcaaaataacactcaatctctaatagtatataatactatatattcacatctcctcaaatttccttaagttgtcttttacagtgtttgtttttgaaaccaagatcacataccacatttggttgttgtttcttttcttttctttttctttcttctttttttttttttttttttttaagacagagtcttgctctgtcgcccaggctggagtgcagtggcgcaatcttgacttactgcagcctccgcctcctgggttcaagcgatttttctgcttcagcctccccagtagctgggattacaggtgcctgccaccatatccagctgatttttgtatttttagtagagacggggttttaccatcttggccaggctggtctcgaactcctgacctcaggtagtccacctgcctaagcctcccaaagtgctgggattacaggtgtgaaccaccacacctggccgtttacttttatttttgccagtttctttatagagtgcctctcagtttgggttcctgggtgtgtcctgaggattggactcacagcttgcattttaggaaggactgcacagaagccagtagagtgtatccttttcattgcatcattgttttccctttgtaattaataagtgtcttgagcctggtgctgtggcacatgcctgtaatcccagcgctttgggaggcggaggtaggaggacggcttgagcccaagagttcaagaccagcctgggcaacagagtgagacccctgtctacaaaaaaatgcaaaaattagccaggtatggtggcatgtgcctatagttctagctactcaagagactgaagtgtgaggattgctttaacctgggaggttgaggctgcagtgagccagagtcttgccactgcattccagcctgggaatagagcaagaacccatctcaaaaaaataaaaaatgaaatgtatcttgtggcaggtactttgagattatgtacatttcctgtttctcatactttcacaaactagtgttagcatccatcgatgattcctgtctgaaacggcttactgtggtggttgccgaatggtgatgtttgaaagctgtcgtcatcctctacacgttagagaactcttgtattttagagctttttctgctccccatctattcatttatgtatttatatttttaaagaaaaacttattctgacccttattaaagttagcaaggcacttagtgctttgggaggcaaggcaggacgatagcttgaggccaggagcttgagaccagcctgggcaacaaagtgaaacctcatgtctacagaaatttttaaaaattagccaagtgtggtggtgtgagcctgtagtcctagctccgtgggaggctgaggcaggaggatcacttgagtccaggggttcgaggctgcatgattgcaccactgtactccagcctaggtgacagagcaagaccttgtctcagaaaagcaagacaaagggcaggctgttcaggatgatcatgataggtatagggactgctgcaatgggattgtgtagtgggggagacctaggagcaggagtgggggccatggacggaaaatttaactaagaggaaacatcagggtgcagggggttctggctgaactgacctaacaggattcttgtggaaggccgctagcatcactcctctggaccataaacactcggggagtcccaatctctcctgagcagtgcattggcgccagctttccagatgtgtgtgtaagtccatcatcctttaagaagtttgcttagaaagcctagatgctgagacttaaaaatggagtctcaccatggacagttctcataaagaattgtctcccaacaaagtggctgactgtgttgtggctgtattgttacagaccttctcagatgtgtttgctgcaagttttgtttatttggaactctttggaagctagcacaactacatagaaacccatataagttagccaccatgctcagctaatttttaaaaaaatttgttgtagagatggggtctcgttctgttgcccaggctggtcttgaactcctgggctcaagtgatccttccaccttggcctcccaaagtgctgggattacaggtgtgagcctctgtactcagctaatttagctagtttttgtatttgatttttttttttttaatagagtctctgtcatcccggctggagtgcagtggcacgatctcggctcactgcaacctttgcctcccaggttcaagtgattttcttgcctcagcctcccaagtagctgggactataggcatgtgccaccatgcccagctcatttttgtatttttagtagagatggggtttcgctattttggtcaggctggtttcgaattcctgacctcaggtgatcctcccacctcagcatcccaaagagctggaattacaggcatgagccataacgcctggccccatatgctgtttatttcatttttcccaagcaaactaggacttagagattgtttcacaaagccctgctgactcattttcaacacttctccacaggactagtgctatgcgtcagcagacgctgcctgtgtggggatggaggttggctcagacacagtgcgtggcctcgggagccttacgttccagcaaccacttgactaacagtcataaaaattaaaattgtaaaatattttgtcaactgtgcatcagccaaacaaaaaaaattaaaattgcctaaagtggaacaaggagatgtgggatgaagtcaagcaaattatgtgtccaaaaatgtataatgtcagtgattagcttcaggaagcatttgtatttagtgcctattgacatcagagacagcgctagtagttggggatgcagcaagacgggcccctggcccttaaggaacttgtagtccaaatgaacaactgaagtactgcggagctgagcagagggtgctgtgtgagggtccagcatggacaaacttaaccccagtgtgggtgagattcatcaggaaggctttctggagaaggtgatgtgggcgatgcatgttctccacctagccatgcccagagggaagtgtgtctgggcagaactatcaggctggggaggactcaggggtgggagagaacctggcatgctggggaagctaaatgtggcgattggtttgtttatacaacttggagtgcggaagggggtcagtaaggggatgctgatgcctgagggtgagggttgggcagaggcaattttaagcatgtgagtcacatgatcagatttccattttagaaagcttggagaatgggtctactcaggtagctcacaccttgtgttgtccattttcacactgctgataaagttgtacccaagactgggcaatttacaaaagaaagaggtttaattggacttacagttccatatggctggggaagcctcacaatcatggtgaaagacaaggaagagcaagtcatgtcttacatggatggcagcaggcaaagagagaagcatgtgtgcaggggagctcctctttttaaaaccatcagatcttgtgggacttattcgctatcatgagaacagcacagaaaagacttgcccccatgattcaactacctcccaccagctccctcccataacatgtgggaattcaagatgagatttgggtggggacacagccaaccatatcattgtgcccctgccccctcccaaatctcataatcatgtttcaaaaccaatcatgccttcccaacagtcccccaaagtcttaactcatttcagcattaacttaaaagtccacagtccaaagtctcatctgagataaggcaagtcccttccatgtatgagcctgtaaaatcaaaagcgggttagttacttcctaaatacagtgggggtacaggcattgggtaaatacagccatttcaaataggagaaattggccaaaacaaagaggctacaggctcccatgtaagtctgaaatccagcaggacagtcaaatcttaaagctcctaaatgatttcctttgactgcatgtctcacatctaggttatgctgatggaagaggtgggttcccatggtcctgggcatctccgcccctgtggctttgcgggatacagcctccctcccagctgctttcacgggctggcatttagtgtctgcagcttttccaggtgcatggtgcaagctgttggtagatctaccattctggggtctggaggacagtggccatcttctcacagctccactaggcagtgccccagtagggactctgtgtgaggcctccagtgccacatttcccttccatactgtcctagcagaggttctccatgagagccccgcccttacagccaacatctgcctggacatccaggcacttctgtatattttctgaaatctaggcggaggttcccaaacctcaattcttgacttctgtgcactctcaggcccaatgccatgtggaagctgccaaggcttgaggtaccctctgaagccaaggcccgagttctgcattggcccttttcagccacggctggagcagctgggatgcagggcaccaagtccctatgctgcacacagaacaaggaccctgggcctggcccatgaaaccagtttttccttctaggcctctgggcctgtgatgggaggggctgccatgaggacttctgaaatgccctggagacattttccccattgtctgggggattaacattaggctcctcattacttatgcaaatttatgcagccagcttgaatttctcctcaggaaatgggattttcttttctttttttttcttttgaaatggagtctcactctgtcacccaggctggagtgtagtggcacaatcttggttcactgcaatctctgcctcctgggttcaaacaattctcccgcctcagcctcctgagtagctgggattacaggcgtgcaccaccaagcccggctaattttcgtatttttagtagagacggggtttctccatgttggtcaggctggtctcaaactcctgacctcatgatcctcctgcctcagactcccaaagtgctgggattacaggcatgagccattgctcccggctgggattttcttttctatcacattgtcaggctgcaaattttccaaactttcattctctgcttactttataaaaccgaatgctttcaatagcacccaagtcacctcttgaatgctttgctacttagaaatttcttccaccagataccctaaatcatctctcaagttcagagttccacaaatctctagggcaggggcaaaatgctgccagtctctttgctaaaacataacaagtcacctttgctccagttcccaacaagttccccacctccgagacctcctcagcctggactttactgttcatataattatcagcatttttgtcaaagccattcaacaagtctctaggaagttccaaactttcccacattttcctgtcttcttctgagccctccaaactgttgcaccctctgcctcttacccagttccaaagtcacttctacatttttgggtatcttttcagcaacaccccactcctggtaccaatttacagtgttagtccatattcatgctgctgataaagacatacccaagactgggcagttttcaaaagaaggaggtttaatggagttacagttccacatggctggggaagcctcacaatcatggcggaaggcaaggaaaagcaaattatgtcttacatggatggcagcaggcaaagagaggagagcatgtacaggggaattcctctttttaaaaccatcagatctcatgtgagacttattcactatcaggagaacaacatgggaaagacttgcccccatgattcaattacctcccactgggtccctcccacaacacgtgggaattcaagatgagatttgggtggggacacagctaaaccatatcacacctgtaatccagcactttgggaggctgaggcaggagaattgcttgagcccaggaattcaagaccagcctgagcaatatagcaagacttcatctctacaaaaaatttaaaaagccagcatggtggtgtgggcctgtagttcctgctgtttagggggctgtggtgggagcatctcttgagttcaggaagtcggggccccagtgagctatgattgcaacattgcagtccagcctaggtgacagaacaagaacctgtctctaaaaaagggagaaaaaaagaaagcttggagaatggactggaagagggaagactagaggctcatacaaccaggtaggagcctcctaccaccattgaggtgtgaggtgatggcgctgaattagagccactgcactggggtgcaggggagcagatggaagtgaaattggagggaaagcagagatttggaggagagccaggttatggtcaaggcggagtcctgttaggagaggttcagtgacacgtttgcagatgtgtagggtctctgcagaacagttgtcttggggaagagttcctgaagtgttttcctcatattttaattgcacatattccatttcatgggtggccgttatccgttataccaggctgctgttgaaagcggtttccagccttttctgttaccagtggctcccatgccgtgttgcaagggtgtacctgtgttgataggattcccccgggctgtgagattgctcagtcacagccttctccctgcaggctctcctgctcattggcagcaccctcagccccactcttccttggcactcagcctcctcttccttggcactcagctgtccttgccgtggctggcactcccacatccttggtcctccttctccacgaggctttgggggcaccacctggttcttttgctgtcccatggcagttcttcatcctgtgctgtgtcctcctgtctccctgagctccagactgtcttctagcacaggctgttctctctcttcctgaatggtctcataaagtcttaaggctttaaacacattaaatatctaaaaataaagttggccgggctcagtggctcatggctataatcccagcactttgggaggctgaggcgggcggatcacaaggtcaggagatcgagaccgtcctggctaacatggtgaaaccccgtctctactgaaaagacaaaaaattagccggacgtagtcgcaggcgcctgtagtcccagctactcgggaggctgaggcaggagaatggtgtgaacctgggagatggagcttgcaagtgagctgagatcgcgccactgcactccagcctgggtgacagagcaagactccgtctcaaataaataaataaataaataaataaaaataaaaataaagttttagccacccaccctggcagatttatttttagtattgtaggcacagggtcttgctatgttgcccaggctgatcttgaactcctgaactcaagtggtccttccacatcagctctcagagtgctgagattacaggcatgaaccgccgtgtccagttagacgtgtctttttggaggacacagttaccctctacatgtactaactatactttgatggtggccaaatctgcgtttctaggccagactcccttgctcagagttttaatgggggtgtctgagaagcatctcaaacttaaaatgtcccaacatgccctcccctcccaggccacagaagctgctcccattgactgtggccccactcttgtacccattgaccgtacctcctctcttgtactcattgactgtgccccctcccttgtatccacaactttgccccctcccttttaccccattgactgtgcctcctgtgccctttgactgcacccccttagtggctccagaatgacgctgttgagggtgagtcccagctcagcctctggccatcgtggtggctgaggccacattgctcaggcttctaaggtgtaagtggcatcacagcagtgcctcccacggattttgtgagggcagattgcactaagatggctcaatgtgctcaagaggcgacctggctgctgccacggctgctgctgttctcactggactccttgttcctttttctttcatttgtttgtttttggagatggagtctcgctctgtcacccaggctggagtgcagtggcacgatcttggctcactgcaacctctgcctcctgggttcaagcgattctgctgcctcagcctcctgagtagctgggactataggcgcatgccaccatgcccggctaatttttgtatttttagtagagacagggtttcactatgttggccaggctggtcccaaactcctgaccttgtgatccacccgcctgcacctcccaaagtgctgtgattacaggcgtgagccactgcccggctccttgttcctttgaactgtctcgctcaggacaggacggtagtccttctgcatcctgcaagacttggacaggatttctttccatttaacactgtctcctaaagtgctgctttccttggggaactttgctgttcttgctagtccagaacaagtggcacaactgcccttgacctccacatgaccttctcagggcagcccagactctaaatgtctgtgacctgcaccagcagcagcaaggccatgccggccgtggtccagcccggctgctctcccccactctgcagtgtttttccacacccatgctgcaggtgctggttgcgttcctgctccatccttcagtgcggaagtggcattttgcggttttctgttgtcatgaagcaagtgcgccacacttgcctgtcttatgtgcgtgtgtatatgagcatgcccatctcagtctccctgagcgcctcttttccacccgtctcaggcctctgtgttagctgttccctctctctgaaacaccaaactccctgatctcagcctgtctctccagtctcgacgtaacagcatcttcccagcgaggcctgctctgaccacacggcccgggaaagcagcccaggccccctctcacttcaccctgtgcccattcttgaccctgtgtattgtgtctctcccttgcctggtttgtgtcaggaaggcagaggccctgcctgtcctgctcactgccgcaccccaggcccagcatgctgcctggcatgggcaggcattgacttgatattagctgggcaatgaatgacagtgactgaaaatgtaatagcaagtcagggcctagcacaggaaaataagtgattgctatgtaagtgaagggttgctaagtaggatttgggtcataacatactgttaaggataatttttttgttctctacatgtaaaaatatgtatttttaaaaattggatgtcatgggctgggtgtggtggctcatgcctgtaatcccagcactttgggaggccgaggcgggtggatctcctgaggtcgggagttcgagaccagcctgaccaacatggagaaaccccgtctctactaaaaacacaaaattatccaggcatggtggcacatgactgtaatcccagctactagggaggctgaggcaggagaaacacttgaacctgggaggcggaggttgaggtgagccgagatcgcgccattgcactccagcctgggcaacaagagtgaaactcggtctcaaaaaaaaaaaatttgatgttatggaatgagggagacaaaaaatgctctacaactattaactgatgcttttctggttttgttctccagacaccattcgcttttcacccaagatgatttgatgtcttataaaactctgatgaaccatgatggctacacagacattaagtatagacagctatcaagatgggcaacaggtgagcttgaacttgattctgcattctaattacaaatcaacctggcactcaagcatgaacattgctttgtatacttgcaattcaattgccatgaggttgcatgctcagtgttagtgtattatgcatttattgtacattcgtgttcagaaaaaaagccatagaataatactatttcgttaactgataccaagattgccaggaatcttgacttccctaagtcatatgacagtttcttgggaatttacctttttaatgtcagtgttaattagcactgttactttgaaagaaaacccggttgattttcatgatgacagattcccatgttgactggtggctcttctgagtgtctaactggatcagcttttgaatgggaatcttgtagcctcgtctccccagttgtaggcatgagaggggctgtcccagtaatgaatttgcaggggccccagtgctctatctttgtaccttgctcgtgcttggatggttgtgccatacacgggcagctctccattgccctcccaccatagatgagactttgttctcctggaagctgtggtgttttgtgcttttgagtatctgagtgttttgtgttctgtgacctgaatgaattgaggagcaggtggatcgagacttggctgaggcccttgtggtctttcttggcttgcgatcttgttaaacacggtgttctgaacccactggcatttggctcatcatcccactgactctggagccagtgaagggatttggccctgccctttactttcctgcccagcaggcaggggcagtgcagtacacccccctcggctctcctccccacctcgaggacttcggtggcaaggatcaggctccggaaaactcactggagccatgctggtgaggtctgaggaggggttaggagctgaggcgctgggtccccctttccctggtggttagttttaccaaccagtccttgttcagttcctgtggcagagatttttgttgttggtggtggtggtgttagtgtttttttttctctgtatagcaattaaaggagggagattctgtgatgtagtcagcctgcttccttagcctagaagtccttagtcctttggtatttccaattgacttttttttttttttctaaaatgcaaatctaataatgtcccgcctgagctctccagtggctccctgtggattcctgtgggtttcatgcaaagactgagctgctctgtggcccgaatcgtctggcccctctggaccccaggacgcccccaacatctctgcctggcatatcttgggcacctctctgcctgccctggagcaccggtcctcactgttcccatcactcttctccctcctgcctgccaggtctttgctccgaccccactgctgcctcctgtgcaccaaggcacggtgaccacctccaacacagcctggttgctaccagccacctcctcccaggcagctgtgccaggtgcagatgacacctggagcactgcccttttcatacccgagtgtttccaagggcctcggaagtgtttaatcagcattattttaaataaacattgaaatatatctacagcgtagacctatcataattattttgccatttttccaaggttgaacatttaggtttctctcttttcacaatcatttttttttcaaatactgaaatgaatcttttaaggcttcttattttttattatttatttatttacttatttatttattttgagacagagtcttgctctgttgccccggctggagtgcagtggtgtgatctcagctcactgcaacctccgtctcccaggttcaagcaattctcctgtctcagcctcctgagtacctgggattacaggtgtgtgccaccacgcccagctaatttttttgtatttttagtagagacagggtttcaccatgttggccaggctgatcttgaacccctgacctcaggtgatccgcccaccttggcctcccaaagtgctgggatcacaggcataagccactgtgcctggcctttttaaggctttttatacatgctggcagattgccttacacaaatactgtgtccacttaggctttattgcttttattttttttttttaagagaaacataaacagttttcctaatatgttgtaccatttaaaggcagcagaatagaagtcatcttattgcaaaaacaagacattggagggaagagagcacagggctggaggatgtgagaggcgtcctgtgcgggtgggcgttcatggctggcccccagtctgtctggacagtggggatggccccgctcccatgaggtctccccgcccccgctgccccaagctgcttcctcaaggggcagaagcatggccaaatccaccgcgggagaaatggcccgtcctggtcctgaggaagctgaggtcaggacagtctaatctgctgctcatggataactagaagtttactttcacgaaattttgtttttgtaaactgattttttttaacgatttaaatgttttttacctaaatgacaaaggcattgcttgtttaaagcagtttaaatgatagtatcttttaaggctttaagtaaacacagctggccttttcctttctgaatgcagtgacatttttatggctatgtattgctgaggtttgagggtagatatgggagaagttcaaccttgtcccaaatatgtagcgtatgggttaggttgtgtctgtgacatggtaagaagaccttggactatttgtctatgcttctctgactgtagtattgctacacgtgaggagatatagcaatagacggaggagtagattgcacgtgtgccgttctcttcattaggccatcgccagtgttattttaaaatcatgagcatttcacagacattggttatctcagttcttaagcagtttggaaattttacctttattttaaagcacattaaattcaaagctgttttgttggtagcattctttacatatgattgcagtcatactgctgtctggcaattccccactccaactgcattcctgttggagcatggaatacctcgtagtagtttgtgtttgctaataagaattatcttcctccttttacagatgcaagtagtaacagagttaaagacagaacaagatccaaactgctctgaacccgatgcagaaggagtgagccctccccctgtggagtctcagaccccgatggatgtggacaagcaggccatttataggtagtgcccggggtgccggctgtgggggcctcagaggagtgaggagtgtccacaagtttgttaaaaggaacaccagaactagtagcgaggcagagttgtgaggtgccattatgatgtgataactgctcggctgaaaattttctcagattaagatgttatttctggccaggtgtggtggctcatgcctgtaatcctagcactttgggaggctgaggcgggcggatcacttgaggttaagagtttgagaccagcctggccaacatggtgaaactccatctctactaaaaatacaaaaattagccagacatggtggcacatgtctgtaatcccagctacttgggaggctgaggcaggagaatcacttgaaccggggaggcggaggttgcattgagctgatatcgcaccactgcactccagcctgggcaacgagagcaaaactctgtcacacacacacacacacacacacacacacacacacaaagatgttatttctaatacctataaaagttttagaatatcaatctataaattttgtgtaaccttgcaaaaagaaatattcaggcacagatgattttactgagaattctacccaacatataaagaagaagagagcagcaagtctgcatagtctctttcaggaagtagaggaggagtgaatgcttcccaactcactttataattgacatcactctgacactaagaccaaagacaataccaaataaggaaaatacaggccaatatccttcatgaacttagatgtaaaaatcatcaataaaatattaacaaatcaattctagcaatatgtaaaaagaataatacgtagcgaccaagtcaagtttttcctgggaatgtcagacttgtttagtatttaaaagtctgccaggcgcagtggctcacacctgtaatcccagaactttggaaggccgaggcaggtggattacctgaggtcaggagttcaagaccagactggccaacatggcgaaaccctgtctctaccaaaaaatacaaatattagccgggtgtggtggtgcatgcctgtagtcccagctactctggaggctgaggtgggagaatcacttgaacccggtaggcggaggttgcagtgagctgagatcatgccactgtactccagtctgagtgacagagagtgaggccctatctcaaaaaaaaaaaatttttttttaagttcagcatagaattatatataactcagcaattctactcctatgcatatgtatacctaacacaaatgaaaaaagtccacacaaaaacgtgtacatgaattttcatagcagcacagcctatcatggccaaaagctggaaacagtgcccatgcccatcaactgatgaatgaacagacacattatggcatctccatgcaatgcaagaatatttagcagtaaaaggaatgaagtggcgggcgcggtggctcatgcctgtaatcccaggactttgaggggccaagtcgggcagatcactttaggtcaggagatcgagacaagcctggccaaaatggcgaaatgttgtctctactaaaacaaaaactaggccaggcatggtggctcacgcctgtaatcccagcactttgggaggctgaggcggttggatcatctgaggtcaggagtttgagaccatcctgaccaacgtggagaaaccctgtctctaaagatacaaaattagccgagtcatggtggtgcatgcctgtagtcctagctacttgggaggctgaggcaggagaatcgcttgaacccgagaggcggaggttgtggtgaaccgagatcacgccattgcactccagcctgggcaacaagagcgaaactccatctcaaaaaataaaaaaaattagctgggcatcatggcgggtgcctgtagtcccggctacttggggaggctgagtaggagaatcgcttaaacctgggagggcagaggttgcagtgacccgagatcgtgccgctgcactccagcctgggcgacagagtgagactccatctcaaaaaaaaaaaaaaaaaaaaggaataaagtactgatacccgtaaaacactggtaagccttggacactttatgctgagggaaacaagccagacaccacggtcacaggttagacggttcccatttagacagaatgtctaggagaggcaaatatatagagatagcaagtaggttctaacaggctggggtctgggaaaaaatggagaatgactgctattggatacagggtttctttgcggggatcatggaaatgttccaaagttgacggcggcaatgctgtgcaactgtaaaaaccgttgaattgcatactttcaacgggtggaccgtgtggcgtgtgcattttcacccaacagaggtgttagtgaagtagtgcaggcatacacgcaaagacattctcacggagatgtagaacgtaaatggattcttttttttcttttctcctcaggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaactgataatttagtaagtaaaataaattttatttttagttttcaaaatgtgaaatctgttcatgaaattttaggcttctaagtagaactttagactgcttgtagttctgctaaaggagagactcatacaactctaaaagaatttttatggtgtgtgtaatgtggatatccccaagtcttccagccttctctaggtatcttttatttatttagtttttatttttagatttattttatttttgtagacacatcttactgtattcccccagatggtctcaaactcctggcctcaagcaatcttccctcctcagtctctcaaggcccaacctaccctttcctttaaaaataaaataaaataggccaggcgtggtggctcacacctgtaatcccagcactttgggaggccgaggtgggcagatcacaaggtcaggagttcgagaccagcctggccaacatctggtctcgatgttggccaaaatcccatctctactgaaaatacaaaattagccaggcatggtggcacatgcctgtagtcccagctactcaggaggctgaggcaggagaatcacttgaacgcaggaggcggaagttgcagtgagccgagattgtgccactgcactccagcctgggtgtcagagtgagactctgtctcaaaaaataaaaataaaataaaataaaataaaataatttgagcctccatgccaaatggacacggggattcagttctctgcacagtgtttgtaaaggtccgtagggctggggtgttcgggtggcatgtctgtgacctgtgtctgtccttggcttatcatggacatggacacagacttgagctgtattctccaagacagctctgtctttttttttttttttttttgagacggagtctcgctctgttgcccaggctggagtgcagtggtgtgatctcagctcactgcaagctccgcctcccaggttcaagccattctcctgcctcagcctcccgagtagctgggactacaggcacccgccaccacgcccggctaattttttttgtatttttagtagagacgggatttcaccgtgttagccaggatagtctcgatctcctgatcttgtgatctgcctgcctcagcctcccaaagtgcagggattacaggtgtgagccaccacgcccggcgacagctctgtcttgaggctgacagtgatttgtgatgccctccccccagggccagggctccaaaatccagcgttttctgtgccctccagaggcaatggagaacatcttggttccgtcatcactggattgctctgaatgagctgcacctgaggcacctgtacagcactgtcagctttgggcagaccacactctctgggtgtgctctcctgccagagtgtaaccacgtgtttacttctcagagctgggtacacaaagatccggcatcagggaaccttcactggattcccttcgagccatcttggtcccatatcaaaaccctggttagggccttcaacagaaaaggtttttggaaaactcatttttcctgaataaattgctgaggtcttagtttttaagaaaattctcattatatactcgatgcttaccatgaaacagattttgtgggtgagttatctgacttgaatctgtctcctcctctctgagatgagactaacagtgcatgctctttgggtgaggatccgatgctctctccacccctgagtctgtggtccacatccatcttcccattggcccacacctggcttggcccagtgagtagagcacaggtgtcctctgcaccccactaggctggcagggaccaaggttctcttgactggtgagtgtttagcacagggcctagcagagtttgacactccatcatttttgttactgagtgattcatttattcactgcatagatacctacgaattcctaccaccagatttacaggtgaaggagatgggcttcggagctgctgattcataggcagctggtgcttatgaaaatggctgcattattggtattagttatctattgctgtgggacaaattaccccaaaatgtagttacttaatataaaactatacaactttggccaggcgtggtggctcacgcctgtaatcccagcactttgggaggctgaggcaggtggatcacctgaggtcaggagttcgtgaacagcctgaccaacatggtgaaaccccatctctactaaaaatacaaaaattagctgggcatggtggtgcacacctgtaatcccagctactcaggaggctgaggcaggagaatcacttgaacccagaaggcagaggttgtagtgagctgagatcgcaccactgcacttcagcctccagcttgggcaataagagtgaaactctgtctcaaaaaacaaaacaaaacaaaatgatataacttttagaaaaatcgcaagagaaaatcttgaggatctagaactaggcaaagacaccaaaatggaactttatgaaaatgtagcactagcctagggtgagtgtggatgtatcactatttgtggatgtagaaacaggagtagatgagggtgagtcacttgtcctgcctgccacagagcgaatcagtggaagggctaggctttggctcacagcccacacacctagcactgggatgcaccgaggtcaccaccacgcgcctttgtcttccctgcacaccagatgcagccaaacaccaaagcccaggtcagtggcaccggaacaacacatcagtttagaggatttctgatgttattccactttggttattggcagtagagatggttctatctaatgactaagaactggtatgtaggatcatgataacttacaataatgccacctttttctctgaaagtcttcattttctctgctctagatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccaggtacttacatttgggggtctcgctttccctctctgccactgtgaacatctgcattgagtcatgagaccaccagctctttcagaattcactgggtcatctttatgactttctacaagaaggaccctctaggtctctgaccccagcctggtttgggaatgaactccctcagattatgaagtgagtcctcaatctgcatactgggcccccggtcccatgtttatggaaggcacaattccattcatttctttcttttatttcttctgaaaatattttacttattcttttgaaaaattgtgtaaaatacacataatataaaatttaccatcttagctattttaaaatttacagttcaatggtgttaagtttattcacattgttgggcaaccatcaacaccatccatctccagaactttctcatcttctcaaactcaaactctgaccccattaaacactcattccggattccccctcccctagcccctggaacccaccgttctactgtctgtctctgtgaattcgatgactccaggtctctcatgttaagcggaatcgtacagtgtttgtccttctggatcctttgcttgtttcattgtgcagaatgcctggagggttcatccatgcggaagcactattgtgttttagccattctgatgatatgtagtgatattaatatttctttgtggttttaattttcatttccctgatggctaataatgttgaacattattataccctctgtgtattttctttgataaaatgtctgctgcttatgtcttttgccttttttttttttttttttttgagacagagtctcgctccatcacccaggctggagtgcagtggcgcgatctcggcttactgcaaactccgcctcctgggttcatgccattctcctgcctcaccctcctgagtagctgggactacaggtgcctgccaccacacccggctaattttttgtatttttagtagagacggggtttcaccgtattagccaggatggtctcgatctcctgacctcgtgatccgcccgccttggcctcccaaagtgctgggattacaagcatgagctaccacgcctggccgtcttttgcgcattttttagttggatttttttttaacttctgagtgttgagagttctttgcttattgtagatactagttctctgttggatatgtggtttgcaagtgttttctccaagtctatagtagctaagtatttttctcatcctcttaacaggtctttttcagagccagcctttttaattttaataaagttcaatttattaggttttccttttatggatcattcttttggtgtcaagtctaagaactctttgcctaaccctaggtcccaaagacttcgtcttaagttttttcctaaaagtttttaaatagagacaaggtctcactatgttgcccaggcttgtcccaaactcctgggctcaagtgtgaaccaccatgcctggcctcaaaagttttatagttgtccattttgcatttaaatccgtgatccattttgagtggatttctctatagaataactctcaaagctgggcacattgtttcctcccaccctgtgattccttttcaaaattgtttagctgttctggttcctttgcctgtccacataaattttagaatgctcttgtctagagctacaaaaacatcttgcttagattttgataggaattgtattatacctgtatatcaatctggggagaattgacatctttactgcattaagtcttccagtccacaggtatggcatgtctctccattgattgacaactctgatttcattcatcagtgctttgtagtttttgacacataagttgtgtacatgcgtttttagaattatacccaagcatttcctttcctggcctgtgccatctcgaataagagtggcaagagcagacatccttgccttgtcaccgccttaggggacacctttcagtcgctcactgtcgatgatgttggttgcaggtttctttctagatgctctttatcaagttaaggaggttatcctatattgctttttttctgagagattttattttgttcaattttgttaaatgcttttccagcattgattgatatgattatgtgatttttcttctttagcctgttaataatggacattacatggattggttttttgaatattgaacaagccttctattcctggaataaactccacttggccatggcacataattcttttcatatgtattcttgaattctattggctaatattttgttcagcatttttgtctatatttgtaagggatattggtgtatagttttgtttttcatactgtctttggttttggtatcaaaatacacaaacttacataaaatggattgggaagtattccctcctcttatttttttctggagattatgtagacttggtgttatttcttaaatgtttgagaaatagaattgatctatttcacctaagatgttaaatttaggagtttagagttggtctagtattctcttcatagccttttggtgttagcagggtctatagtgatctcttcctgttttatttctgatattgatcttttgtgtctctattttttttttagtcagtctttctagaggtttatgtaattttcaaagaacagtattttgttttattgatttttttggttgtttttctgttttcagtttcattgatttcaccttgatctttattatttcctttcttctgctttcggttcatgatgttcctctttttctaagatcttaaggtggaagctgggatgattgatttgactagcttaacttttattacagcctaattaatgtggcaggctttaagcgtagccactaagcttacacattccgctcgatgatggcccacagaatcaccgccttggggtggcgtccccttatgctatgtaactgctcacatgtcagggcacatgagtgtgccaggcccggcactggaggctcctctcccctgccagctgcccacccaggcgtcacagtcagtggataaagtggcccatgtggatctaaccccagatgcatagagtcctccatggggcatgtagaaacatttgcatggggctcgctgtaggccgggcacagttccaagcactgtacaagcaagaacactggggaaagccaagatcacacttagtccgtgccggggtcaagagtcaaggtgggtgccaggggctgactccccagcacagcttggaatacctcagccctggtcacttctagtgcctcccaggcctgtgctataatctcttgaatgctcttatcggtcagggagagcttggttcatggaaaactcaagagtccaccaagccaagtctaatgaaaaagatgtgtgatcagaaagcagggtcttcctcgatatactcctgggctgtaaggcacgtggaatatggcagtgagatgaagataatcttttggaagccacagtgcaggctgacgttgcaggctggcttgttgtgtttaatacacagttgaacatctcttgctttccgtgtgtgctgcgtgcattctgaagccgcgtcatctgaggatgttctttccctcaagcttctctttccttttttaatggtgtcattatgctacttatgttaaagttttaaacatgggttttccgttttctagtaattccttcaacatgtgtgttctgacttgcagcagattcaaagtgccatcacaggcaccatcagccctcagggaattgtggtgccggcgtccgcgctgcagcagggaaacgtagccatggcgacggtggcaggtacgatgacagaaaaatggacacactctccatgagtttttgcagaaaatggtcctgtgtgttagaatgacagtataaatataatttcaagttcatgccattttctaatatagcaatgttagaagctagaggtctctgaatgcctctttcttgttaatactcaataacaaatattttatgcagattgtgtttctttgtttctctaccaaaaatatattggaaagaaaaaaggttttatgtaggaattgaaaatatacaccaaaaaccagttgtcattttcaaataacatagctttttgttgtgcttttaatagcaccgtgaaaatcttaagttttatcattaattgatgacaaataaaaatgcagtcttagcattggtattacttgtagaacaaaaccgttacaggaaagggacagattccagagttccctgatgcgtagagaacattgaaaacacaaagcatcatggaaatgggacacggcaaagagggaggggtagaaatttacaccaaagacctcacataatagcacaaagggaaacctcagtgggaaaaaaaaaagcaccattgatccaaaaatataactagaattaaaatagttattatttagtacccttggccaaatccttaacatgtgctaattttaggaaatagtagaaagcagaggctagcaaaaggaagggagccctcacaccccaggtcagttggtggtgtgtgagccgggctgtgtgggctgccaggcacatagcgcccacccacctgcccacccactgctgcaggtgcccgagtagcccacccagggagtttgttttgatactttatagtgacaagtcaactggcaaaggattgttgatcttttgaaatgattaaaaagctcatcaaaccagggattttattccttttgtaagtatatcaagaagagggctggtcgcagtgcctcacatctgtaattccagcactttgggaggccaaggcaggaggatcagttgaagccaggagttagagaccagcctgggcaacaaagcaatgtccctgtctctacaaaaaaaaaaaaaaaaaaaaaaagaagaatggtttaaatcattgagacttaaaagcagcctcatatttttattctccctttcgaggtggcacagtgtatcagcctgtcacggtcgtcactccccaaggccaagtggtcacacagacattgtcgcctgggacaattaggatccagaactcccaggtgcgtgcgccattttatggaaggctttgggggcgagtgctgcccacataggggcacaggtagaacaagcatgagcccttccctctgcctgaagagctttgtcttgtgtagcaatttctggtttctctgaatgtcagtgttttgtttctttgtactcttatctctcgcattgtagagaatttgcaaagttcagaaaattctgaaagaacaggaaaaaagtcactcataaccaccccctgccacccacacacacacacacacacacacacacacacacacacacacacacacacagagttatccagtgctaacgttggatcatgtgcacgtgcaccaggggcagaggtcttgtaggcacacactccccagggtccccacaaagggcacggcagaactgccaggcaagcttttcagaccagtgagcctggcccacacctccatcatgacaatgtcattgggccagggctttcaggcctctctgtcacccaggctggagtgcagtggcgctatctctgcggctgctgagccttgcccgtctttggtgtgtgttatcagttcttactttaagaacattgattctgggccgggcacggtgacgtctgtaatcccagtactttgggaggccaaggtggacagatcacgaggtcaggagttcaagactagcctggccagtatggtgaaaccctgtccttaaaaatacaaaaattagctgggtgcagtggtgcacgcctgtaatcccagctactcgggaggctgaggcaggagaatcgcttgaacccgggaagcagaggttgcagtgagctgagatcgtgccactgcactccagcctgagcgacagagtgagactccatctcaaaaaaaaaaaaaaaacattgattctggccgggtgcagtggctcacacctgtgatcccagcactttgggaggccgagatgggtggatctcttgaggttaggagtttgaggcgagcctgtccaacatagtggaaccccgtctctactaaagatgcaaaaattagctggatgtcgggtgcatgtctataatcccagctgctcgggaggctgaggcaggagaattgcttgacctgggaggtggaggttgcagtgagccgagatcgtgccacagcactccagcctgggcaacaagagcaaaactccatctcaaataaaataaaataaacaaaaaaaaaacacacatttttttgagactttgcaaacctaaaaatgagtttattttaatctcatatttgatatgcagtctgtttacttgtagaattctgggttgaaaatcctttctacccaacattgagaaagcattacttttgtttttctgagacgaagtctcactctgttgcccaggctggagtgtagtggtgtgatctcggctcactgcaacctccacctcccaagttcaagtgattctcctgcctcagcctcccgagtagctgggattacaagtgtgtgccactatgcctggctaatttttgtatttttagtagaaatgggtttcaccacgttggccagtctggtctcgaaatcctgggctcaagcagtccgcctgcctcggcctcccaaagtgctgggattacaggcgtgagctactgcacccagctctcaagaaggttggtgttcttttttccaatcttttgtgtttttctcatcttttagaagcttctctttttttgcaggtgctctgatttttttttttttttttttttttttaagagacggtctcgctctgttacccaggctggagtatagtggcacaaacacagctcactgaagcattgacctcccaggctcaagcaatcctcccaccttcacctcctgagtagtgggactacaggcatgtgccaccttgcccagttaatttttaaatgtttttgtaaagacggggtctcactatgttgcccatgctggtcttgaactcctgggctcaaatagtcctcctgccttggcctcccaaagtactgggattacaggtgtgagccactgtgcctggactaaagttaggtttatatgtgaactcttaaacaggctgacctatccatgctgcggaccctacggagcgattttgcttccttccttccttccctggtctgcgcagtgcgcagtggcagcatcatctcagcaggcacctggggagggagacgctgtgtgagggaggccgtgccagggcctggagcacggccttgtaacgagcagatcttctctcgtgttttgtgagaaggaatttaacaaagaaatgccattcacatctttttcttttaaaatgaagttggcagagtagcctacgctttcctgggtgacaggagggaaggtccgtatctctagtgcctgtggaggcgtctggaacaaggagtcagcctgtgccctcctgttctgcggaccctctttctgcctttgtgctgtttctgtttctttcccctctgctcccctggcgtgtcctgctcttgagagttggattttctggtgtccctgttcattctcattggtccttgacatcccttttcggctaggaagtcacatgttctcactgacctcgctgcaggaggcacaggtgggaacaggtggtgggtgagaggaccacggcattcctgcctgcagaggatgggctctgagcctccctgcctgagaggcctctgcagagccaagtcactagtgcaaagacttatcatgtgccagcctgggcaacagggcgagaccctgcctctacaaaaagtagaagaaattagctgggtgtggtgatgcgtggctgtggtcccagctacccaggaggctgagctggaagaatcacttgagcccaggagttcaaggctgcagtgagccgtgactgcaccactgcactccagcctgagtgacagagcaagatcctgtctcaaaaaaaagaaaggctggtcatgtggagggagccgtgtcctgaaacatcagtccacacagggttcccgtgcatgggcctcgactacaatcatttccctgtccgatccttggctgttttctccacctgcagttgtaagtacttggatatgtgagaatttcctatgctttctaatgttatttttcaactttaaaagcttcagttacagttaaaccaagatctcagcatcttgcatcaagatgatggttcatctaagaacaagaggggcgtcctgccaaagcatgccacgaacgtgatgcggtcctggctcttccagcacatcggggtaaggacggctgggccagcccttgccttgcagccctctgcgacgcttgctctctggcttatgtgtcatggaaaagggttacttctctgggctcagaaaatcaaaggcctgactttcaggactttgtggcatgtccataatgtggggagcgtggggcactgctgcagggaacttgaagggcaatgagggctgccgtgaaggagcacccgagcacatgtgaggcgtacacgtgtgtccgagacagcccaccacgaagggtgatggggtcaggtgagccagaaaagtgggcagagaagggatgttcttgggcagcagctggggaagttgctgtgtttctgtgtgttggattaacaaggaagctgagatgggttagagacatcgcagggccgggtgcacccacaggtgggccaccgggtgggtgcctttagctggaagcgagtttgtcccacagggcgcgccgttttgcccagcacgtgtgcacccggcttcctcccccgggccatggccgcgtcttctccctgtccccaggacatcttaggaagtgcagtggtgggcctgcttgctgagttgatgggggagacctgctctgcacgctgtgtggcaccattgctgccagcctgctgatccagggcaggagagagcaggcggggctctcctgggacaagcacagggaggccaaggcgggaaggcagacgccagtttggcttggccctaagtttgcccttctcccctgctgtcgccactgattgttgtgaggctgtggccatatccgcctgtgtcccagcctcctcctcctcggccttctgcactgcatctgccctgccctcccactgtctcctctccagggtgcctccgctggggctgaagcctgtttgtcctcagcactctgtccttgccctcccctgactgtgggcccctgagcccgtagccatctcgccatttcgcggcccactttcctctggctgcctcgggctcctcagttgaggatagggtccatgggagtgactggcctgagggcttgaaactggtgggtagtgttgctgagtggtcctgggaggagaagggccctctcctgggcagaaggcctggcaggagcctgggctgcgcctcttctgcttgcctgccctggcctcttggtctccaccgagccgcttccatgggcataaaaggtagcaagccacacatgtcaggagaaaggcgtgctacctgtgagcagcggggctgctccgagaaattggttcaaagagatcagtcacaagaaaacggaaagatttgtgtgtaagaatgttagtgtcgttcaatataataatggaaagcaggtcggcatgtagatggggacgtactggtttgatggagtatcatatgcatagttaacatgaggaatgagggctctaagcagtcgggaggtttagtgaaggataggaagtcaaaaggcagcatgttggtatatttacacacattgcgattattacagccaatcagtatatgtataacataatgatagaacaacaccaagtggtgggattgggtgagtactctcctttcaggtttcctttaatgttttaataatttctcaaacaataaaccctgcccatcatgtccagtgaagacgccgcgttttttcctgtggggcgtcctcagtccctcctcaccctcgtttcttggcagcgccgaccccctgtagtttcccgcatactctggggcagcatctctggctgtttggtgttttctgcttgtgtgctcgtgtttcctgccctgtttctattttatgagctttttaaagggggagaacagtatttctgtttccatgaccttgagctcagagccacacactcattgatggagtcaagttgagtcacactgccgttagtttgaggaaacaaacccatcactgctgaggcacatctgaggccgctccgtccccatgtgatgggcaggggtgtttccacgccgcactcagtgttcctttcacgtcaaagccaaagtaaactctcactgctgactttgctggtaccgttcattctcttgggtccttgttgatcccaaatcaagggctttagtgcattcaggttttagagtaaatgtcgtgttggtttccacatatagacagtcatcaaccttggagaaattatttaccatagctagaaatcattttcggttggtacttctgtgagttttgctatctagttctgattggattttttttttttatttttctgcactcccaggctggagtgcagtggcgcgatctcggctcactgcaacctccgcttcctgggttcaagcaattcttctgcctcagcctcccgaatagctgggactacaggtgtgtgccaccatgcccggctaattttttgtatttttagtagagataaggtttcaccgtgttagccaggatggtcttgatctcctgacctcgtgatctggccaccttggcctcccaaagtactgggattacaggcgtgagccaccacacctggccagatttttttttttttttcccagatggccaggctggtctcgaactcctgacctcaagttatccacctgcctcagcctcccaaagtgctgagattacaggcgtgaggcaccgcgcctggccctctggttggattttttgtatgtgaaatgtttcaatcatacataaaagaagaataccatagcaggcactcctgtcaccagccctgggttcagttccttactgacagcacaggtgaatccagcagagatctcaccccaggaaagccgtcgatggcatcagcttatcccagtgtcagttgattcctgtggtacccatgatggaaatttgtcccccagcctgcctggccatttcctactccacctgtttcaccagctgtgggatgggggcagtttgtaaacacttcatgcctcagtctcctcttctgtaaaataaagacactgacagtgactgtctcagcaggtgcttctgaggaatcagtgaattattatagaatggaccaaggtaattgaaatgtgctgtgtattgcttgtggcagaggctcccgggccagaacgcatccacccatcctctttatatggatgtagtttattgttcataagttaaagttcaataaagttgataaagaatctatagattgtatcaagcctggtgtagactcaccgctggactgcatagctgctcctcatgatgtcgctgctgttatcgtcaccgctgaaccgttaaacgtggggggcggtctgccttggcctatgcactaaccagccactgcagcactaggacattcctgggacgaggagaaacactttgttcgtgagactacagttaggttttggctagaagcactgttgacgtgaccattattttctaatgattatgtaatgctcacattttgcctaaatcgtcttgatttcctttgtaaactcgaaggccatggtaaccttctttttttattttcagcatccctacccaacagaggatgagaaaaaacagattgctgctcagacaaatttgacactactccaagtcaacaactggtaaggtgccctgcttcctgaaatcatgctgtcagcacggtagagcacttggaaaccctggcaccaatacatggtgaaatcttgctgaaaataggaggtctctctttttcttttttcccaactgagacggggtcttgctgtgttgcccaggctggtctcgaactcctggcctcaagtgatcctcccacctcagcttctcaaagtattgggatcatgggtgtgagtcactgcacccgactaaaaatatgagttcttttaatgggcaatgggagcaggagacttaggaataaaccaggttcaacctaagttttcatatcaatacctcattatggactgcatcctgcctgcctctttagagctgtttctctagggtgctactgtccccaagccccacattcatacaaaactgtgatgtgttgttagtggatgagcctctggatggtgggaggccaagagtgagaggtcctgccccatgaggggaccctctgccactctttcttgtgggggtcctgctccacagaagagtctgggagccattcctagcaaagaaacacccaggaggacatttcataaaacgtccccttctagtcctgctgtcaaacattgctgtggacacttagactctggccagatgtattttcttcagtaagggcttgtgcgtgttcctaggtggcactgaagtggggggtggtcttccattttggttattagtcacttgtcacattttttaaatttacttattcagatgtaggaaacagtttcagcttaataaaactggcatgcataaaagaagaaagcacaaattcttccagttgtaaacattattatctttatcttagctgtgctaaaatgtgaacttgttgaagttccagcaagaaagtctttgtctttgtgcagtcgtgtgtgcgggaggtatgcttcggggttgcataagtacttccatgatcctgcattcttgccattcttttagatgtgggtagtcacaacagactatactatttgcgttatttcctgttaaatcttttaaatagaatattaacaaaaatttaaagattctgagtatgttgttgctgcagtggttgttatattctgctcatgtgcttgttttcctggagctatgtggaaaccacatactttggttggggcacacctgtggtgggtgggctgaagtgggagggatgcgtctctggatgtgctggtgccccgtcactgctcagcaccctcctgcttttctgcattcatgatttcctggtgttccctgacttgctactatgttacattaacgaattgtcttatctaggtttagtatcaacttttaatttttagtaataataacagtttaataatataacttaaaaattccaaatttctgaaatctttaatatttgtagctacttttactttttgtgactttcttttcttttgtatttacaaacattacatcttggagtgagatacacacacccatcattagttcatgcctctgctggtagcagctttgaataagaatgatttaaaaacacattacaggccaggcgcggtggctcacacctgtaatcccagcactttgggaggccgaggtgggcagatcacgaggtcaggagttcaataccagcctgaccaacatggtgaaatcctgtctctactaaaaatagaaaaattagctgcgtgtggtggtgcacacctgtaatcccagctactgaggaggctaaggcagtagaatggcttgaactcgggaggtggaggttgcagtgagcccagatcgcaccattgcactccagcctgggcgacagggtgagactcagtctcaaaaaaaaagaaaacaaccaacacattacagtagcagtggggccttccctcccaggtctcgctggggttgtgggtggccatggagcttgtgctgcagggatcaccaggttcctctaaatgaagcatggcgggatccgatctgcttcattattattagactgtgtgctaatataattgtagatatttttaaatcttggacttttaaaattaagcaaccttagagctgatccagttctagtgttgttgttttgcagaggggggcattaaaaaaagaaagaagttgtcacagtgacaaaccagagtagaatctgagtctaaaagtaatgcttttgtttccctgatatcgtgaacatggctactcagctatccagatagagaagtctggcttttaatagatgagcaatgtgtgactctagcaagaggtcaactactttatcattcatgttactgaaaaaagaagacagaaacgaggccttaagcatggttggtattgctgcttttgcgttaggttggggtaatgcatgaatctggacgggttctggtttgataggcgctttcacgggacagatgttgtttttctttccgtttctttccatttcagctctttttgtagcaaagtggcccagtcagtggcatagggtggtgggtgcagcagaacgcatgtctggtttgctatctttgtcctctagtcactgcaggaggaaaagctggcctagggatttgagtctccttgcactttctcacatttaaaggcaacagctcatagcataagaatgggaactgaagacagcagcctttaatcttaatgtattttgagattgctatcatactcatttgatatgaaacaatgtccagcctgccttgccaacctgtgactgttgggccaggtgcagtggctcacatctgtaatcccagcactttcggagaccaaggcaggcagatcacaaggtgaagagatcgagaccatcttggccaacatggtgtaaccccgtttactaaaaatacaaaaatgagctgggcgaggtggtgggcgcctatagtcccacctactcaggaggctgaggcagcagaatcgcttaaacccaggaggcggaggttgcggtgagctgagatcgtgccactgcactccagcctgtgcgacagggcgagactccatctcaaaaatacagaaacaatgtccagcctgccctgccagcctgtgattgttgctgctctcgttctctgtggagtcttatcacaggcgtgagtgcctggtctgacagagtcgccagcgtctgtcggggatttcatcactgctggtgcctacgtgctgtgctggccacatgtctaggaccactggaggacttacgcctccagtcatctaagaaacagctcatcattgggaatggtttttgaaaagatgcagctcttgccttagatcgtgctttgtggtgaaacaagaggaggtggcagtcccattctctgatggctcagacacgttgccacccagaggctcggccccgttggtgatctggtgacgtccagacgagtgcagactgcccgatcgtctcaggcatgatggcactacagaaagtcttgcttctttaacatttttcttccttagggaaaacagtgtcagattcacaaattcaacagtatcatctatgtcgttatgagtatctagttcacaaacatgccctaaaggagttgagacaaaaaaaaaaatgccatggacgagttggtgcttatttgcatgatttttaaaacaacaggctctgtgtttctgggcatttagagaattcagaagagctgttgagtcctcttaagtagttactatagtggagaacttgagtcattctttgtagcgtgcttcgtagagcagcgtgtttgttagaaggatttgttaatcctgtatagggtctttacgaaggctgttttcatggaagcttctctttgttgactccaggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggtacaggtggccggccaaggccagacatggtggaccatggggtggggattatgaacaagaggcctggatcaggcctgttagctgtgagcctcaggtaatgtggtgaacgagagtgcgtggttctctttctctgcaactaaaacatgaggaagctgcattctgcgtgcacgggagctctcagtaagagttaggagcaccagtagtagagaatgtaaaacacgtgatagagatatgaaatcattaattctgtctcaaagacacagtcatgcccatggatcttctcctttgcttctgtgtttgctctccttttccctccgacgccgggtgtggaggagggacttaccccgttctcaccacgtggcttctttctcttcatcccccatgcccttctcttgtttttgcttgttccctgtggcctctgctctccatcccctgacgtaggcagccattctgatgtgttttataggcatctttctgttcgcatgaggtcttcatattttggatggttttgtgtgcatgtgtttttatttttttttatttgtttgctttgtttttttttttttttttttttgagacagagtctcactctgttgcccaggctggagtgcaatggcgcaatctcggctcactgaaacctctgcctaccaggttcccgccattctcctgcctcagcctcccgagtagctcggagtagctacaggtgcctgccaccacgcccggctaattttttgtatttttagtagagacggggtttcaccgtgttcaccaggatggtcttgatctcctgacctcgttatccgcctgcctcagcctcccaaagtgctgggattacaggcatgagctaccgcgcccggcccagaaacagtttcttaaatccctgttgaacattccctaaacatatataggtgttttattttaactttaggtcaaacgagcaaacagcacccaattgagtaataaagtgtttttctgtgagtactaatttaaataatgacacaccttcatcctgccgcaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagctggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggttttgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagaatgacattttttttttgagacagagttttgctcttgttgcccaggctggagggcaatggtgcaatctcagctcactgcaacctccacctcttatgttcaagcaattctccttccttagcctcctgagtagctgggattacaggcatgcgccaccacacccggctaattttgtatttttagtagagatgggtttctccatgttggtcgggctggtctcgaactcccgacctcaggtgatctgcctgcctcagcctcccaaagtgctgggattacaggtgtgagccaccgcgcccggccgagaatgacatcttaaagccaccattgcgttcctcatttgtgaactgtcttctcatattttaagtcaagtctataagatcatttttaacctaagttccaactttgttggactccttaaaataagcacccatgaaagccagccagcccttcctccttccctcaccaccctccgtctcttcggctgcttgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgaggctgcagtgcactatgcttgcacctgtgaatagccactgcactccatcttgggcaacacagtgagacccccatctataaaaagagagcactgcctgaacctcggtggcactgggaagctctggcctgagagttaaacacccatgctgaatgatacagtgtgcattctctccagctgcaaactttcttcaactttcctaaattcttactaaattcagaggaataggataaagatcacttagagaaagggtgcttatggacatagcctgagtttcctttaacctctctgcaatgggtgcttttaactagcttctacatggcaagctgtttcagtttgcaaaatcactgcccagcatgtttgaggtcagttggcaccttaaaacacctgttctccagcccttggacagtggagagaatctgtaaaagtgtgaccccctctaagatttcgttttaaatgatcagattcggttccagttttattcttgttgagtttttccctatgaaggctccttttgaatgtgtcttgagacccaaattgagcatgttgctgttattcctgccctgcacctgtggagcaggagtggcagggctggctgtgctgggttccagctcgctcccaccgagggactagcttggcctttgcgctttgattccagatagtaagatgagtggaagtgtttatcgagcatgcaaaagaaaccctcacggctaagggctctgggagttgtgtctgtgtgacctgagagtgatccatctcctgcctgtgtgaggtagcagtgggcacttttcattgagacaaactccagggtgtccagagggggttctgccccttgtgaaggcccattcctggcacttagagacagaaagaactcagcaatctttcgttctagttatattcggtctttgaaactgacaatctttgaaatgtgaatactgtaacaatatgttttcttggattgttgtctttaaaaaggatttttgtgaagcaattgatttatcaaagcaaaaaaattaaaaatagaaacttgctttatggatgttttattttataaagctcatgtcaccaaaagctgcttctccattttatgtaaaacattgagaatgttttcatgttttctggtgacatgtagggtctgtagtcacccctgcatattgagaaactaggaccacactgcatcggactagtcaggtccatttacatgtccaagaatcttttcttaaattccttactttgttcattcattggctgttcaggcagaaaatggaaacaggtagcttttatgttttttattatagttttccacaaatctaattattttgatagttacaagaagataatgattcatcagtaagctaacataatccctttcatagttcatattataaattttcatgacaagaaagttcctgaagatttaaaaggtacattaaaacaatttcagagggtttttaatctttgttgtccagagtgttataactcccaacaactgttcatgcttagaggctaaagtcagcagacttagtattttaaaaaccacatgcaaaattatgagtcttgttggtaattagtagtgacagctgactgtattgtttcaagcaatgttttcattggttacagaaaactgaggcactgtgttgtatttccagctcccttagttcagaggtgagaggacgggcatgaactttattaatgtggggcctcaggcagccccagtctctctaggcttccagggcttcatttatgaaaaggaagaactggcttataaggtttattctagccttacaatgatgtttatgactaataagattctatctctccatctaaagactgatgaggaagtgagtaatggtctagcaaatccagaaaataagaaatatttggattaaatatttagtgtttcacagtttttgaattatatgaatgtcataaacaatgtctactgtttttagctttcatgccattctattatgtatactctcagaagaaattcttagtacaaggccgggcgcggtggctcccgcctgtaatcccagcactttgtgaggccagggtgggcggatcacctgaggtcaggagtttgagatcagtctggccaacatggtgaaaccccatctctactacaaacacaaaaattagccaggcatggtggcaggcacctgtaatcccagctactcgggaagctgaggcaggagaatctcttgaatccgggaggcggaggttgcagtgagctgagattgtcccactgcactccagcctggggcatagagcgagactctgtctcaaaaaaaaaaaaaattcttagtacaaattatttttgcccttgtacagtgggatatttttaccttcactaagacctaggatagttgtttaactatcattgtttataaaatctgcgagactagtgactatatagcatctaagcacatgtgactgaaagcagtgaatgcccggggtggcatctgggcctggggccagcttttcccaatcccacgtcttcaccatgcagcccaggtcgggtctggcacctgcaggctcctctctgccaggcctcctcaggtctggcttttgtagtctataaaggactagttagtgttgcttacttggataatttgtaagtattctgtataaaaatcgtatttagaaggtattatcttatacagatgtttccattctttatctcccacagcaacccacactctcatggcttctgctgcgggaagcgctccttcctgggattccctggcacagttcagatgagtatttctccaccttcactggctgctctcctctagctccacagtctctacaacccaggtctacactaacacacaagacaatgtaaactgttaagggcttcacaacttatttctgacatggattgctgtgttaagataatatgaaagaaaactcagtgaatataaagtaaaatattttaaaatataactgatttttctacaggccattttctaaaaatgtctaagcagctaaggacttcaaccctgtaaaaagcaagaatggttttaatataaatcaggaattctagaccgggcgtggtggctcacacctttagtcccagcactttgggaggccgaggcaggcagatcacctgaggtcaggagtttgagaccagcctggccatcacggagaaacctggtctctactaaaaataaaaaaattagtcgggcatggtggtgggtgcctgaaatcccagctactcgggaagctcaggcaggagaatcgcttgaacccaggaggtggagattgtagtgagccgagaccacgccacttcactgcagtctgggcgacagagcaaggctctgccccaaaataaataaataaataaataaataaataaataaataaggaattcttttattccagcatctttcaaaagaaacattttaggctgggcgcagtggctcacacctgtaatcccagcactttgggaggccgaggccagtagatcacaaggtcaggagttccagaccagcctggccagtatggtgaaaccccgtctctactaaaaatataaaaaattagccgggcatggtggtgcatgcctgtagtcccggctacccgggaggctgaggcaggagaattccacgaacccgtgagaccgaagttgtggtgagccaagttcacaccactgcactccagcctgggcgacagagcgagactccgtctcaaaaaaaaaaaaaaagaaaagaaaagaaacattttaatgacagctttagttgcttagacatttttagaaaatggcctgtagaaaaatcagttatactttaaaatattttactttatattcactgagttttctttcatattatcttaacacagcaatccatgtcagaaataagttgtgaaacccttaacagtttacattgtcttgtgtgttagtgtagacctgggtcatagagaccgtggagctagaggagagcagccagcgaaggtggagaaatactcatctgaactgtgccagggaatcccaggaaggagcgcttcccgcagcagaagccgtgagagtgtgggttgctgtgggagggtagatggcaggaggacatggggctgggcagccgggagggactcgtggcctgggagacagcagtgaagaggagaggggagagcagaggcaggcgccatgggttctgggcatggccgtgagccactggaagatgatacgggagcttatctttgttcccttggggaagaagcccttattttgagacctcaaaggcataaatcctaaggcaaaatatgggtgatttggccagatcaaaattcagtttttctgtgcattggaggacacagaggaccattaacaggtagtgactgagaggagcactttcctcgttccttctttttaatggataaagccggcaaggagccagtgttagggggattcctgcaactcagcaggtaaccaactagaagtctctagaaccatgacagcggatattaatagttcattgaaaggagaccagatgaccaagcagcacgtgaagactgcacggcctcgccacgcccagggagtgtgagctggagcccaggggcgtgccgccccgtctgccggccgcaatgaggaagctgggattggggatctgcagaaacgggaacttgcgtggtgctggcgggaatatcacggggccagccattctggaatgaacctgacaggacagtcatgtgtcacttaacaatgggctgtgctctgagaaatgcctctgtaggggactccatcccgtaggaacatcacagcgcactcacacagctcactgtacacacagcctgtgcggcttagcctattgctcccagccatgggcctgtgcggcacgtgaccctgctgactaccctgggcaatcgtaacataatgtaaggatttgtgtgtctaaacagctaaattggccgggtactgtggctcacgcgtgtaatcccagcactctgggatgctggggcaggcagatcacttacgctgaggagctcaagagcggcctgggcaatagagtaagacttcatctctacaaaaaaatgtaaaaattagccaagcatggtggctcatgcctgtagccccagctactcagaggctgaggtgggaagatgtcttggactcaggagggaaaggtttcagtgagctgtgattacaccactgcatgccagcctgggcgacagagccagaccccgtctgaaaaaaaaatgctaaacaaaggtacagtaaaaatacagtctaaagtgttaaaaatagcaccgggcacttaccaggagctgctcggatgcctcagggagtgagggcgagtgagcatggaagcctaggatgttaccgtatgtacttacgtgcactggcagcaccacaaacacgggagatacactgtgctacatgttatgaggacagggacttctcagctcctgttgtaacctcacgggacctccttggtctgctcagtccattgttggctgaaacatcgtgggtagcacagacctgtgcagagacgctcactgcagcctcgcctgtggcggcaggggttacagaagcggcgtggacacccctgtggagggcaacggggtgagctgctgggcgtgtcgtgggggtgtggctatgtgacagttggcacaggacatgcttgggtctacttctgtcaacagctttatttcgtggcagtggattgcctgttgtttctctcatagtttattgaatgccggggtttttttgtagaatgtggagaccaagataaatagtcctcatgcccagaaacaggcactccccttcagacaggccctgggtgggtgtggtcaccaggtgagcgggctgtgggcttggggctgccttcgtccctgcaggcaccacaggcttccgattcttccagcagtggccatagccagcctgtgcatggtgtgggtgccagagtggccctgccccttcttagatgccagcaggccttggatgctgtgctgtgcctggtgtctgctcctgccctccctggcagagggctactgctgcttgcttccggctccttggcgtgctcctggcccagcctccatcgcaggtgggtcctatacccttggggtgcagggctcgtgcccactcctgctcctgctgccaaactctgccttatacctggacagtggcttgggcgggagagtgtctgagccagggcaggccttgagttgaaaatgtttcctgcctctccccggtggctctgtacctggtagaaggagggaagaggctgcaggttccccattccctgttttctcctttcctgccctctggcagctgccaaactcggggtgggcggggaggcctttgccctgcgctccggagtgcacacagagctctgtgcatggtgtgagagttcaacagaaacgggaatgaggaagggggaacagtcgggtttggaaatggtttttactcagagttgaaggcactgccttttaccttgagcaacgtaaagctgttctgattcctgattctctgtatggaaggattctctcgggcagtgtccagggtcttatggcaggaatgacatctccagtcccctgtccccctctggaattttgcctatccaggggatccccctctcttgaccctggggaggtttatgtggcctgctggggtggcaattgccatgtgactgacgggttgagggggctcaggcttggcccgggtgccatgttggaaggaagcccaggccgcggggataggccatgcaggtgtgctgtctgccagccgcgttgaccaccagctacacacaagtgagcctacaggtgcctcgagccaccccagctgatgagcagagcagagcagagcccagccgcccctgtgagccccgctccagatacagatgtgtgagcaaaataaatgttgccactgtctgaagccatttttctgggggttgtcgttaaacaggcttagtgcctgaggcgggactctgtggccggttctctgtcatgtcacattggaccttggcatgggccatgcccgtcgtgtgctgggcatgtgctggaccatgtcagccctgcaccagccttcctggggcctgccatggacccacgctgcccgccggcgatgccgtctctggatccagtcactgagcggggggtgttagacccataaagaagcaaagtttagggggagcttggaagggagtgggctgccccgggcctcttcacgcgacgccaacgccaccttggtgtgagccaacagagagggctgtgccccaggtgtggggttgcgggcaggagctgcccactcaggctctctgaggcgtctttgagtcgttctctctcagttcagacttccctccgacagcttcccaaagctttgatggagctgtcctgagtcacctgcacaaccttgctagctgcagcctaaggagacactgagcgagcacacggttcacatttctaaaatgatgctttaatcaaatatgttaagctaactctttttttttttttaacagagtcttgctctgtcacccaggctgaagtacagtggcacaatctcggctcactgcaacctccgcctcctgggttcaggcagttctcctgcctcagcctcccaagtatctgggattacaggcgtgtgccaccacacccagctaagttttatatttttagtagagacggggggtttcaccatattggccaggctggtcttgaacccctgacctcaggtgatctgcctgcctaggcctcccaaagtgctgggattacaggtgtgagccaccgaagagaacactttttaaatgttatttcggtgccagtacttgcttcaattaagcgctcattagttaaaaagaatgctagcctccatctgagccccaccaaggcctcactgtccttcctggcgggagaagccagcggatatgcccttgagctgagggctgtcgaggatgtggtggtccagggcatccctggactcactgtctgacaggcagggacagcccctgcagaggaagaggctgaacactggacaggggtgcctgccactccacagggcctgtccagtgcctatcctggtgggtgagtagcaggctcgctgcctactccgggcccaccaccaccaccagggctgtgctgcaggttgcaaaaggcccagcggcgcccgagccactccttatctggtgaggaagatgcccagacacagggcagctctcagcacgggaaaggaaaagcctgacctttgggccacatcacagacacctggttgatttaataagactgaatcgtggccgggcatagtggcttaagcctgtaatcccaacactttgggaggccaaggcaggtggatcacttgacctcaggagtttaagaccagcctggccaacatggcaaaactccatctataccaaaaatacaaaaattagctggcatggtggtgcatgcctgtagtcccagatacttgggaggctgagatggtaggatcactcgagcccaggaggtggaggttgcagtgacccaagatcgtgccactgcactccagcctgggcaacagcaccagaccttatctcacaaaaacccacaaaaatcctgaattgtaaagccactaatagactagctctgcaatgaagtactcaaagaaaggattagaaacccagtgttcctcagatgcagtctttaggacttaaataacttaaacggtggcctgtaatgagctgcacctgtgtccctgtgagggtgcctgccaagcctttgaagccatgtgttgtcttaggcgggttgcatgtcttcttgcactgctgtttttgctagacatttgctcacaatccttttttacatttttaaacaaatagcacaaatatgaacttgggctcggaccaagacagtagttctgagcttagtgaaattcacagcactagggtgaagtgactgggcacggcagtctcttgctgacagcctgtccttttatttgacatcatccttcgcctggctcctgctgtcactctcttgcgtgtaggtttttgtaagcattggcactttcaatgatcccttctggaaaccagccccccgcctgagctttcaggaatgtatctgtttccaccacctttcagcgattcttcctgctccctctgccaaggtctgtttctccaggatcggagggggtcgtgtgaatcagcccagatgctttcagcagtgaacaagaggccccagcacccggcttccgccccggggcgttggttctctggcgtctctgtggccatgggatgccaccatagcagccagggccacaccaggggatgctgttgctcccagccctctctgcagagccccgggacccaccctgtgtggactgctgaggtcacatgcccacccagactagtgactggccagggaatggcatgtacccattggcttctgtcaactgaggtcaatccctagtccctgctcctgccctcccatcatcgtggctgtgggaagaggcaaggagacctgaactgtcgggaatgaggaaggggatggatgctgagtagatcgacatccatgaccctgggtttcctccttcccccacctcgagagctttggcaagattagacaagtatgtaaggagaaggagcgggactggctcccctgaagctgagcagtcagggcctgaatgatttgaatgggatccaagtaaaccccatggccccacatggcagagtctttgcatggaatccagcctggactcacgaccctgctgcctcacaggcctggcacagcagtgcctgctagttccttgcctctggtgggtaggggactgattggtcctgctgatggcagcagcgggctgtctttggagcaaagttggagctaagttcaggtgctgtcatagcctgactgggtgtgcacatgcttggggcaatgctgacacgccagccccttgccacctcggccccctctggactttgggcactgataagcattaggaggaaagccaagtgggggctgagggcagcttgctgctggcctgcaggcacccttgacacctacagcccgggcatcatgaatggcagcaggaggcagataggttcctgggtggaagggggcaggttcttggtgaggccccaccttcaggccaagaagggcttgaaggctgggggccaggctgccagtcctgtggactggagtgggaacttatggtgcctttttcgggcctgcccatggccacccttggaccagttggcacagcatgcacttcctcccctttgaggcccataaaagccccaggctcagccagagctgggcaaatgttgggatgaccacctgcagacaggagcaacccactctagggccccctctttgctgaaagctgcagagatgatggaaagatgacagggagatgatgggacgaccagctgcagagaggagctaccctctctactgatagctgaacacttgttgggacgacttgcctaaccctttctgctaggagctgaacagacgttgggacaccctggctgcagaaaggagctgcccccctgtgggtttcctcagagctgttctgtcactcaataaagctcctcttcatctggctcactctccacttgtctgcttacctcattcttcttggacaagaactcaggacctgccaaatggcgaggctaaaagagctgtagcataaacagggctgagatgtaccctttgcttgccacattacaggtgaagtgaaggagagaagagctgcagccctttggggaacccagacctgggagctccccaagccagggctgtgattccttctttggggccctgtggttcctggtgtctctaaacttttgggtgccaccgtgttccccagtgccagctgtggaagctgcttgcagtgtgcttggtctggccgaagcctcacagggagccggcacctatagctgcttgccctgctgaagcagctggcacgtctgtgtgcagtggccagaccccacgcacgctcaaacacgcctcgccattccacgcctgactcgcccttggtaggcatgggactcaggcctgtagtgtgagcctagtgcagcctgccaggccaagtgggtgagatgagcccagcaggcctgagcaaaggtgccc

SEQ ID NO: 462 - DNA, 31971 bp, Homo sapiens
accgtgcccacccacaccctttcaaggccatgctgcctccctttgtagtctagtgaggaataggaggtggtgagcaaaccatgggctctgttgagacccatgccctcaagtagatccccaggtgaaggtggcagcctgacctggaggagcagcctgaattcatcaaaatggagttattgtggacaaaaatacagtatataagcatttttctgtatgtatagagacctaattcactcatattgttagtatcactggtggttggcaccctcaagtgtctttaaacattttttattatagaaaatttcaaaatatacaatgatagaactataaaataaactcccatctatccattatccagcttcaataattacctactcatagccaatcttatttcacctaaacctcacctatgccccaccctccactgggttcctttgatgcaagtctcaaatatcatatcactttatcaataaatacttcagtacatgtctctaaaatataaggattctttttttttctttcaagatggtctctctctgtcacccaggctggagtgcagtggtgcgatcatagctcactgcagccttgaatgccccgacttaagcagtccttttgccttagcctcccgagtagctgggactacaggcacacaccatcatgcccagccttttttttttttttttttctggtagagatgaggccttgttatgttgcccaggctagtcttaaagtcctgagctcaagtgatctttacttctcagcctcctaaagtgatgagatgaaaggcgtgaactaccatgcccagccagataaggatttttttttttttttttttgagttaggatctctctttgacacccaagcaagagtgcagtggccggatcatgactcactgcttcctcaacctcttgggctcaagccactccacccggcctcagataaggattcctgatgcatgcctctagtcaattgaccccaggaggctgaggctgcagtgagctatgatcacgccactacactccagcctgggcaacagaacaacactctgtctcttggggaagaaaaaaggattctttaaaaaatatgtaaccacaatgcctttcccatatctaaaaatctgtcatcaaacatcgttcaaatttccctgattatatatatatatatatatatatatatatatatatatatatatatatatatatttttacagtaggcttgtccaatgtcccttttaacctatagcagtgattctccagggggatggtggtggagtgattttgctcccccaggggacatttggcaatgcccagagacatttttggttgtcacaactggggaggatggccttggatggaggggtagaggccagggatgctgctaaacatcctacaatgaacaggacaaccctcaccagcaaaggagtagctgtcccaaaatgtcaagtgtcaactttgataaaccctgatccatagtttcccccaaaccccctacttttttttcttcacgatgtatttactgaagaaacctgcttatttgtcctacagtctttctctgtctggattttgttggttgcatccccaaagtgtcatttaatatgtttctctgtctcttaaatttcctttaaaccagtaaatccacaggcagtggctcacacctataattccagcacttcgggaggccaaggtgtgcagatcacctgaggtcaggagtttgagaccagtctggccaacatggtgaaaacctgtctctactaaaaatacgaaaaaaaaaaaattagctaggcatggtggtgggcacctgtaatcccagctactctggaggctgagatgggagaatagcttgaacctgagaggtggagactgcagtgagctgagatcgtgcctctacactctagcctaggtgacagagcaagactccatctcaaacaaacaaaaaaacaaaaaacctcgcctcatcaattatttggttactttgaggtacagttcacccagtaaatgcttgattctttcatttatcagttttcagaccaaagaattcattccctagcagcctgtaaaggtgaataccaaaggttttttgttttacactttttgttgttgttatcgcattttaatattccaggtctttcaagagataccattttacttttaatcatagcatcaatacatttcacacatgtactcaaacagaagcttattgggctgctcaggactttatcgatgaacagatacaggctgtactgtactttggagagctggggtggttggtggccagaggaattctctttccaggtttcctccttcagaacctcagatttcctgtaattcagccccgcccctgcagttctgggattcttagctcaggtcccctatgcctcgtcatcccctttgcggcaaagctctggcctgctgttaggtttgcatgagctcacactcctgggctttgtcccaccaaagggctgtggtgggtactcaggcaggatgctcagcagaaaaacctttggcctgtagcctccaggtctttctttccctctctggtggctggcgtttctccctcgctggttggctgggatggggcttggcaggaggctgtttcagagaccagtgctgcagtagggtgaggggactggagatggggcttcctgcctggctcctgcttttgctatcttcttattttttatttttatttattttttatatagagtctcactctttcacccaggctggagtgcagtggcgagatctcggctcattgcaacctctgcctcccgggttcaagtgattctcttgcctcagcctcccgagtacctgggattacaggcgtgtgccactgtgcttggctaatttttgtatttttagtagagacagggtttcatcatgttggccaggctggtcactaactcctgagctcaggtgatccaccaccttggcctcccaaagtgctgggattacggcatgagccataagccaactttccttattttcgtttctttgatgaaaataatgttcaatttcttgagcaactactgtgtgcccggccctgtgctaggtgttggggatagagtggagagtaaaacaagctgtggtacttcgcctcagcaagacattcatccgataatcgcaaaaatggacggcatatggaaactgtggcatgaatttataagaatgtgcttatacttgagatttccactgtattggtaatgagttcatgtgtactctctgtccccaggaagccttgaggtgtgcccaagcccacgaatcattcccccctccccaacctgtgcagaaaaggagctcccctggaagagtgggcagggggacctggcagtgtacgtgtcctcggaaaccaccaagattgtgcctgtggacatgcagacgggttggaaccagagcatctcatccctggagagcctagcgtcccctccctgtaaccaggccccaattctgacctgcctgcctccccatccacggggcactgaagagccccaggtccctctccacctaccttctgatccacgctctagcttcgccttcccaccgagcctggccaaggctggccgctctcgcagtgagagcagcgctgacctcccccagcagcaggagctgcagcccctcatgggccacaaggaccacacccatctcagcccaggcaccgctacctcccactggtgcatccagttcaacagaggcagccggctgtagctcaaggcctcggggaggagcaggaggtggaatccctgtgggaagtgctccctgggtgatgggtagagccctcgaaacttgacatggggccagaagggcctgggttgaagtagtaattgggcttccttggagctagtcagaggggtcacctaagctggtcctcacaggggcctttctcaccacctccctgctcctaacccctgccactttctgtttcattaaggcctctactctggctcaggacccagtccaggccttctacgggctaggcccagagacttgggttgctggtcccccttccctagtgggttttcccggggactctataggcagctgctcctgcccgcaaagcaagagcatcattcctattcttcagtggatgccagccttccctgccccaactccctccccagcactgggtcagtggtgtcctggcagtgaggctccgtgaggggctggcccttagaggaactggggtgggaggtggggcaggcctcacccttgggctttgctgccctgttgggtcagctacccatagtccatttttttagggcagtgggaacctctgcctccacttcctgctttagccccttccctttgctgccaggtattggggtaatatttcctccttttccaagaccaaggccaagaggctgggccaggcttcagttcaggcctgttgcttaactggggtcaccctgggatctgctgctctgggtctaagtctagacctttctgatccttgggtctgggttttttgaggaggggacatagtggcctctgggctgccatgtcaccacctgaacattccccaaacagagaaggaacccagcatctcagggccactgctccattgctctgggggctgggatgcctggctaagcaggggctgacagggtggcaggtgactttctagggatcagcacctgccctgtgttttgtaccttgaacctaagatatattaaacatctctcagatggatgggtgtcttgtgtccatgtgtcagggggttcttagggtggggggcaacaggggcatctggtgaaggaggtgagaacccaactgcctgccccagggattgagaatggaggggaatcctaggcaggactattcatccttctggtcccctgtcatgcattccccaatacttttccaatattgtccccttagcaggggtcctgcagtggtggtcaaggggatcactgttttggcatcgagtcacagaactaaaagtctgcaaaatgagaaaggctagcagggaaagaccccagaggtcaggtgccaagctgtcctgatgcagccaccacacacctaggaccagatgagcatttcttgaaaacctggatgcaggtacaggacacatgaacagaggtggccttttgcacatgacagacaggaaggcaatctcaagggctcacgggatttggttaccgtgtttattttttatttttggagacaggattttgttctatcacccaggctggagtgcagtgtcacaatcatagctcactgcagcctggaacccctgggctctaggaatattctcggcacagtctcccaagtagctaggactacaggtgtgtaccaccatgcctgctaaatttttagtttttgtttttattatatttatttatttttagaaacaggatctcactctgtcacccaggctagagtacagtggcatgatctcggcttactgcaacctctgcctcttgggttcaagcaattctgcctcagtctcctgagtagctgggactagaggcacatgccaccatgcctggctaattttttgtatttttagtagagacagagtttcaccacgttggccaggctggtctcgaactcctgacctcaagtgatctgcctgcctcagcctcccgaagtgctgggattacaggtgtaagccactgtgcctggcatatatatatataattatatataatatatataataatatatattatatattatatattaatataatatataatatatataatatatattatatataataaatatataatatataatatatattatatataataaatatataatattatataattatatattatataatatatattatatatattatataatatatatatttttttttcctggaggtagggcctcacaatgttgctcaggctgttcttgaactcctgacctcaaataatcctcctgctttgacctcctcaagtgttggaattacaggtgtgagccacctcacctggccatctctgagtgtttatgatgcaaatcagatagtgtggggtccagaaacatgaatagaaatccctagatggccgggcacagtggctcatgcctgtaatcccagcattttgggaggccaaggtgagtggatcacctgaggttgggagttcgagaccagcctgaccaacatggagaaacccagtctctactaaaaatacaaaattagctgggtgtggtgacacacgcctgtaatcccagctactcaggaaggctgaggtgggagaatcacctgaactcaggagaatagcttgaacccagaaggcagcggttgcagtgagccgagattgcaccattgcactccagcctgggcaacaagagcaaaactccatctcaaaaaaaagaaaaaaaaagaaaaaaaagaaatccctagataagagcagtcccaaatccaattcccctggtgtctaaaggacttaaaacaaaaacaaaaactttggcccagcacagtggctcacgcctgtaatcccagcactgtgggaggccgaggcaggtggatcacctaaggtcaagagttcaagaccagcctggccaacatggtgaaaccccatctctactaaaaataacaaaaattagccaggcatggtggcgctcacctgtaatcccacctactcgggaggctgaggcaggagaatggctggaacccgggaggcagaggttgcagtgagctgagatcgtgccactgtactccagcctggggggcagagagagactccatcttaaaaaaaaaaaatctttgagagctgggcacagtggctcatacctataatcccagcactttgggaggccaaggcaggcggttcgcttaaggccaggagttcaagactagcccgggcagcatagcaagaccctgtctctaccaaaaatccaaaaaattagctgggcgtgatgactcgcaactttagtcccagctacccaggaggctgaggcacaagaatagcttcaacccgggaggcggaggtttcagtgagccaagatcgcaccactgcactctagtctgggtgacagagcaagactccatctcaaaacacacacacacacacacacacacacacacacacacacacaccaaaaaaaccccatatatatatatatacacacacacacatacacacacatatatacacacgcatatatatacgcatatatatacacacacatgtatatacacatatacacacatatatacacatatacacacacatatacacatatatacacacacatatatacacatatatacacacacatacacacacatatacatatatacacacatatatacatatatacacacatatatatacatatatacacatatatatacacatatatatatatatatacacacacatatactgcactgcactgactagagtgcagtggtgcgatctcggctcactgcaacctctgcctcccgggttccagccattctcctgcctcagcctcccgagtaggtgggattacaggtgagcgccaccatgcctggctaatttttgttatttttagtagagatggggtttcaccatgttggccaggctggtcttgaactcttgaccttaggtgatccacctgcctcggcctcccacagtgctgggattacaggcgtgagccactgtgctgggccaaagtttttgtttttgttttaagtcctttagacaccaggggaattggatttgggactgctcttatctagggatttctttttttttttttttcttttttttgagatggagtttcgctcttgttgcccaggctggagtgcaatggtgcaatctcggctcactgcaaccgctgccttctgggttcaagctattctcctgattctcccacctcagccttcctgagtagctgagatatatttgagatataagtcacataccataaaaattcacccattttaagtgtacagttcagtgttttgaatatacccatagggttgtgcagcccttaccacaatctaagtttagaacattttcatcatcccccaaaaaaccctgtactcattagcagtcagtcctcatccctggccctcctcagccctaggtaataactaacctactttctggctgtctggatctgaaggacttttgacacacttggaaggttatacttttagccaacttacctttactttttctgcattatgcgcagggaaggtgtgatgagaaggaagagtgacttgggctttgcccttaggttgtttacaggccacagtgataaggcctcgtagttaactagtcgtcaacagtttatttttttaatttttattttttactctttttgagacagtctcagtcaggtcactcaggctggagtgcaatggtatgatcttggctcataacctctgcctcccaggttcaagcaattctcctgcttcagcctcccaagtagttggaattacaggtgcccaccaccatgcccggctaattttttgtatttttagtagagacagggttttgctatgttggccaggctggtctcgaacttctgacctcaggtgatccacccgcctcggcctcccaaagtgctgggattacaggcatgagccactgcgcccggccgtagtcaacagtttagagtcaacagccccagctgtcactcacaagtgtcattctgggtgtgttacatgctctctctgagcctcagtgtcctcatctctcaaatgagataatcatactcacttcataaggctgctgtcaggattaaatgacaaaatttaatgggaagaatctacccagggcctggctcaaggtaagggatcataaatgtcattatttgtcgggccgggtgcggtggctcatggttgtaatcccagcactttggtaggccaaggcgggtggatcccttgaggtcaggagtttgagatcagcctggccaacatgctgaaactccatctctactgaaaatacaaaaactagctgggcatggtggtgcatgcctgtaatcccagctactctggaggctgaggcaggagaatcacttgagcccaggagatggaggttgcagtggtgggggcagatgaacatggtgggtttgacagggaggcaggcaggtgacttggatgcaggagagcaagtgcgtcaagcgctcatccatgggtccttgccatgtgactgggcagggtggcctgagctgagagaacttggctggggtagtcttcgtgaaggagatgctgcacccaggcctcaaatgaggaaggattttgattaggggagatgggcatgggccttcaggaagaggagccagtgtgagactagactagtaatcagatttgttttccaggccagtctgggaggtagatgggaaggctgtgatgcctctaagtggccttgactgtcataccaaggagtttggagtttatttaggccaaaggcaagagaggtctggaagttctggggtatttgttgccctcagtatttggggtagtactgaagaggggtgtgcaaggtgaatgactgtgggtctgttgtcactagacccagtgaggcccagagccctcccctcctttttatttatttatttatttttgagacagagtctcgctttgtcacccaggctggagtgcagtggtgtgatcttgcctcactggaacccctgctttccaggttcatgtgattctcttgcctcagcctctcaagtagctgggattacaggcatgtgccaccacatctggctagtttttgtatttttagtagagatggggttttgccatgttggccaagctagtctggaactcccgacctcaggtgatctgcctgacttggccacccaaagtgctgggattttgtggcataagccacagtgcccggcccattttatttttgattgagtcatgttggcaagaaatgggaggctgagggagagttggggaagggccaggggagggaggcccattcccattttatgatctcagtggaaaaggctgctgtgagttgattctgctgccaggagagccacagagatgggccccatgagtcactgctcagtcctgcaagctcagcccacaaagcctgctgtggtcagccacccctggctggctccaggcccagctccccaatattccccactaggcctcagtgtgtcctcatttctatctgtacctttgccatcctgggccatgcaacctgtagctctcggcctcttctgtctcctttcaggctgagtctctgaatctgtctccatttgtgactctggtttccatgggatacatagatgtggagcctcaggagggcaggggtagtgtgatcagtgtcaggcgccccaaagcatttattctgtgccaggccctgtgctggatgctgaaagtacggaagtggataacatacagtctctgtttccatgaagcctacaatgcacattctctgtggagtggagaaaccagggcccagccctgcctctatctcagtatggctgtacctcccctgaatctgcctgctgtgcccagggtgccaggtcagctatagcctgtggcttgaggctcttctttgcctctggcattcacaggggtatgtgtgcccgccagcaggtcccccccggctcttagggctcctgggggacttggctggtgggtgctggtgggcagcagaaggggagggagggagcagaaggcagtgactcagtgggggtggccctgggacagaactggggaggaagccaaggttggatgatgcttcctgaagccaggagggtgggaagagaggtctggctgggagttagggatggagcaggacaactccaaggctcccctctggcagccagacctgctcatgaagaaggctcctcggtagctgcctgaaagtctggactctgggggctgggctgggctgggtggggagattgctgttggtcccactgtgcctgttgtaatccccaggttcatgaaagaggtgcctgccttagagccagggaagccgttgcacccggtgccccctctccccagggaccatgggcctgggcacactgtggggctcagggtcttctcctggtcgcagagctgaccttcccacaatcttcccacaaattctggggagtgtcgggccaggcccacatgccctaaagggacctcaaatcgcacagctacccacttgggtagctttcatcagttcaggattccctgactgcgggtgaaatgagggggcagggcaccaacacagcccgagtgctggcagcgggtgaacgtataacacagggagtcttccccagtcctcacggcaaccccaggagaaaaatgactttccatttttacaggtgaggagggtgaggctcaaagagcagagttcctggagcgcccccagcaggtaagtggagaagccaggcctgggctgggggctctggctccagaaccccacctcagcaccagcctcctgcaccggactttgtggagaagggggtaagggggtgccagggatggcaaaggggtagaggatctggtggactctggcaggcctgggtcagctccacccattggtctcactcccacccggatggcagccccatcccacgtgggatcatgcgacctgtctctgggtgcccgcggcgaggcagcaccccgcttccctacacagaaggccttcccctcccgtcggctcattcagccgcggaagcccctgggagaccccgccccgccccgtcccgcggtgccccccgcgcactcaccctcgctcacccacgcggccttcctggcgggagagcgcttccggcgtcctcgccaggcccggggagtgggcacggtggagctgccgaccgttggtcgctgccccaacccacgcactgcgacgccgcgggtgaggcgcgcggtctgcggggcccgggggtgcggcggggcggggctggcgggctgtccgggcccacggagaggacggcggcgggcgggggttgctgcagggcccgcaccttgtcttccgcgccggcagggctgtgccccgtcgagacctgctcgggctgtggctccgtcctccggcctccagggggcggcgcggcgctgcgcggcgccccggcggcactgccctcccttcccagcggccaggaggcggtgtcccgtgacgccgcgcggccgcgctgtagtggccgtcgaggccgccgtctgttcgaaggctgtccgacttcacggttccccgcggctcggcccgggggcgtgagtgtcgccagcgggcgacgggggggcgcgcggtaggccctgcaacaaggccagggcctgggggggccggcaggagagcgaacccgaggcatcgtggtgccatggcggggccgcccccacgggcatgggcctgcagagcgtggccgtgaggacgctgagggtgggcgcgcacggagcagaggcccacgggcgtccgacgggggacctggacagagggacacccttaacgttattccctcttcccaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcaggtaaggaaggctgggctagggaagtctgggaagggaatggggatgcctggagagatgagtgtcaagactttggaggtctctgaccctactcaggctgaagcccgggtccaagtaggggtctctggataggtggtccaaggcagacccaagtcatttcccttcccaagcccccagtggatccggcctccctaagcctgctgactgcctcctggcccaagacctctgttgggagctgctggccagtggtatggccaccttgccaggtagccaggcgggcctagaggcggtggaggtggagtggcccaatacggcaggagttcactgcttcctccccacagggactcgggatgtccaaggccgggcagtgctgcttctgtgtgcccacagcccagcctggcttcagtctgagtgcagcagccaggaactcatccgcctcctgctgtacctgcgaagcatccccaggtttgagggagggggttgggagactgagcctgagccagctgtgaggactgggagtcaggtactgaactgaagctcacccctttaggcccgaagtacaggcactgggactgacagtgctagttgatgcccgaatttgtgctccaagttcttccctcttctctgggctcagccaactacaagtgagtacaggattgtagctcccctcattccttttcttttctttttttttttttttgagacggagtcttgcctttgtcgcccaggctggagtgcagtggcgcaatcttggctcactgcaaactctatctccccgattcaagtgatcctcctgcctcagcctcccaattagctgagattacaggcacctgccaccatgcccagctgatttttgtattttttagtagagagggggtttcaccatgtgttgcccaggctgatctcgaactcctgaactcaggtgatcctcccgcctcgcctcccagagtgccgcaattacaggcgtgagccaccatgcccttttctgtagagttggggatagtgctgagctcaggttccttgcaggaagcagccccaggggccgtgtaccaggtgctgctagtgggaagcacgctgctgaaggaagtgccttccgggctgcaggtactaagcccagttggctaggggtagaggtggggtgcctccccccaggcctgggtcacaacaccttcttctcctgtagctggagcagttgccttctcagagcctgctgacccacatcccaacggcggggctgcccacttcgctaggaggaggcctgccttactgccaccaggcctggctggatttccgaagggtcagtacactgggtggggcatgggggcagtcatataggcaacttgggatcatggaggagcctctctggggctggcttgaaccagacaaagctggctgcagtggcctggaacccaggaagcccaggaccaacactgcatgctgctccggtcatgcctgcccctgcttacagcggctggaagctctactacagaactgccaggcagcttgtgccctgctccagggggccatcgaaagtgtgaaggctgtgccccagcccatggagcctggggtgagtgtcccctcccagtccctccatgaatgctccctgtctccctccttctctcccatggccacctccacagcttattgccctcaatcacaggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggtgagtgcaagcccggcccccagatcttgccccagcccaccatattctatgccaggactcatctggctagctcagaacctggtaggactgtggtgccaggacagggtggagtggtgcaaggcagggggtctaagatggtataccctacaccaggacggcaatggacaaggctgacgagctatatgaccgggtggatggattgctgcaccaactgaccctgcagagcaaccagcgaatacaggccctagagttggtccaaacactggaggcccgggaaagcggactgcaccaggtcggaactacttgcccagagtgggccctgccccgatctcagacgtgagcccccagtccatagcagctctcttcacttttccctgcttgtgctcctccagattgaagtgtggctgcagcaggtgggctggccagcactggaggaggctggggagccctcgctggacatgctgctccaggcccaaggctcttttcaggagctgtaccaggttgcccaggtatatgtggtcacttgttcatgccacgggtattgggatgcaatgccaggaactaggaatgcagaactgtgtgaaagcaattcaatcctttgctttcttagaccttatagtcccatagaagatatcagttgtaattaatcacagtcatatatgtgcctgtaaacccaggcaagatctctggagagaatcagtgcaggtgattctgcctgagggtataaccaagactttacccagcaggagtgtcaggcaagctttttttgggtgatttttgagctgagagttgaaagataagttgaggtcaaccaggcagaagagggttgaggatgggggcacattccaggcttggaagatagcatgtgcaaaggtcctgtggcaggatggaggacggtgtgcctgaggaatcataaggccagtgaggttgaaatgcagagcagagaggaagaaagagttgggggagttgcggtgggacaagcctggtcagtggccacatcactgggccctgtagcagtcagtgtggagtttaatcaggaaggccatgtaatcagatccatattctaggaagattgccttcgtttccgagtagacagtgacttggaggatgggcatggggagtgcagtgaagaggcaattgcagtagtctaggtgggaaatagtgcctcctctggccaggatagtggcaggggagacgggttggagaagttgatgggatttgctatgtacccatgtgggagggtaagggacaaggatgttgcaaggatgaatgggtgctgttccctgagagactaggagatgaggtcatcttgggggaagggcattcaagagtccggtcttgggcatgctcgagatggctgtgagggatgagaggagggcccttgggtcttgggcctggagctcagaggagaggtctagctggagaggatcacttggtgggtccaggtgtttggatgacatttgaagttggtcacacaagagtgcctgggagagcgagtgcactgtcctcaggatccccagtgtttaatggcctaggtgagggaaggggagcaggacgagccaccagagaagagtgaggagaatcaggagcgtggggaggagctgggggagcccagtagagagtgggctgaatgacgctgagagttggagtcagtgaggcctgagaagcgctggggacggggcagagtggagctggagagggctggtgcggagggcgagacgagacggtgaggacagatgattcctctaggaactttggctgtggagaaggggagtggatgtgggtggggagtaggagatacgggtagatgttccaccacaggacagacttgatggggacatgtcgatatgtcagcaggaagtatctgagtctgggggctagaccgccaggcctgggctggctgagcctagtctctgtctctgcaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggtgggtgagagtctccccagctccaagtgatccatgaggccggagggatggcagccccagcttcagcagagcctgagcttttcttggtcatgctgcctgttctcttccctggtcttcagtttgaccctaaaacccagtcactggggctgtgtcctggacagcatcctgtggggatggggagtgggtagaggagcagagtgcccagcaggcttggcaggatcttcctctaatgcttgtccggccctggtgttgcaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggtatgggcagtaggcagggcggggagggcagtaaaggagagatgtcttgggtcctgactccccatacctggtaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatgtaagcccgacaggccatgtggtatcagctcgttctgccacactcccgaagttgctgctgggcacatgcttggtgccagtccctgtgctatgagtatagctatgagcaagactggcaggctcctgcacctgagggtgctcttagtccagtagaggagacatagaagcaagaacgatacttgtagattatagttggggctaggaggaaaataagcaggatagatgcttgtgaattactggcggggcaggggctccactttagagggcctgagtgcggtgccaggacacctggtacaagaggaagtctttgagaggctgatgtttaagctgaggaataggggaggggctggagtgagtgtcccacccagaggaaagagcaagtacaaggtcgtgtggaggaaagggggcctgccaaggaggtggctgagtgtagtgagcaggacagtcccaggtgaggtgagctcttagagccgtgggaggagcagagctgaaggcaggagctcagtctgagggcaaggggcttcttccttgggggcctgtgggcacaccccctttgcccagtactgttcttgccaaatcaccccttgttcaaagcagggaagactgggtctgtaggggaggcctccctaagaggcatctactggcattttggtcctctcaagctgagggtggtctagcctgtgccagccttagggagctggcccctttgcactggggctgagccacatgtccttgtagagggtgcagtttgggatgtacgcgctctacagcaagaataagcctcgctccgatgccctgatgtcaagctatgggcacaccttcttcaaggtaagtgaacctgagattaggaggagtaggggatgcggggagtgcccccaaaccactcagtggcctcccatccgcccacaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgtgagtcatcccagggcaagggcagtgggtgtgaagaagaaggcagaagaggctggccacccaccagcccccaactctgcaggttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaaggtaggcctgcccaccccaggccccaccacttgttttcccgccccatgccttaccaagcccctctctcccgctggccacagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaagggtgggtccatgcccctccttcacgccacactcccctcactggagagcttacattgacccacaggagcccagagacctgggaaaagctcgggaagtggggagaaggcccagcgacagccaccagtgcaggagaaaggatttcaaagccaggcagccttgctgtcactgcctctgactttggacacaacgtgaacttctctgaatataaggggcatcatggctctctctctctttatttttggagacagggtctcgctctgtcgcccaggatggcgtgcagtggcatgatctttgctcattgtagcctctgcctcctgagctcaagcattcttcccacctaagcctcccaagtagctgagactacaggcatgtgccaccatgcctaatttgtaaaattttttcatagaggtctcattatattgcccagactggtcttgaactcctgggctcaaacaatcctcctacctcggcctcccaaagtgttgggattacaggcgtgagccactgcgcccagccaggggcctcatctttaaaaggggaatatggcacctgccccacaggattgttgggaggagagcacctggcactagaaaggctcagctcacaggacagttaatgtgctggatggaggtgtacaggaaagacttatctggggggtggtagaggcccaaggacaggcttatgtccagaagcatcccacttatgtccactctccacccagaggtgcgcatggctgagatggtgtccatgggtgtggggaacaaggccttccgagacattgctcccagcgaggaagccatcaacgaccgcaccgtcaactatgtcctgaagtgccgaggtagcaggcaggctacagggtgtgggggtgggagtaggaaagctgtgcgggaagcactgtggccctccattagtgctggcccgcactttccttgggatctggggccaggctaggctctggcctgtcccaacctgaccctctctcttatgcagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgagtatgtctgggcctagccagaggcaggagggcatggcttggggtctggggcttcccgtgctgacagttcacccagtctccctccctagctgctgaggactcagagatctcgtcccaatgcccatcagccagtggctccagtggctctgacagcagctgtgtgtcagggcaggccctgggtaggggcctggaggacttaccctgtgtgagtgccatttgccctatacccaccagcccttccccagcccaagctgagcctgtgactgtgaccagcccctccccagcccaggctaggcctttactttgggtagagcttggggtgggtgggccagagccattccccagacacctcctgggtccagagtcagggaagcaggcattcatgcctggcctggccctgcaggtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgcattctgggctatctccaattaaaatgagacttggcgggtggggcatgaggggctgcatctctgggcaccctagtcctcttgtaggtactttcccaggatggagtaagagacagacctagacaggcccctctggatgagcaggtccatgcatcggccatatttcctggcgaagggcagtgtaagctggaaggaaaggccagtcttatccctgatttcctggccagttgtctactctagctccatgtgggtggggttctcccattggggcagggacagggcaagcccggctgttggggacttttgatgctctagggcccagctctgccccagggcatctcacagggtggggctagaaatggctatcagggaacaaagcagaaagaccggaggttcaaaaatctgtttcctgctactggttttctgctttttagccatacatgctgacttcacctttacaaaccacatatgagccagatgcctaatggtaactgggtactagagggcttgtggtgaaaggtgttataataatgctcttgattatagaagtgtcagatcaatgagaaactgcctaaatcgtttcggcctcaatgttaaaattagattaaggaatcagaaaaggaaaaagaaaaaaacccttgatcattcctttgcccttactgaatattttcttttttttttttttttttttttttttttgagacggagtctcgctctgtcacccaggctggagtgcagtggcacgatctcggctcactacaagctccgcctcccgggtttacgccattctcctgcctcagcctcctgagtagctgggactacaggcgcccaccaccacgcctggctaatttttttgtgttttcagtagagacggggtttcactgtgttagccaggatggtctcgatctcctgacctcatgatccacccgcctcggcctcccaaagtgctgggattacaggcgtgagccaccgcgcccggcctaagaatgcttaaaagtagtttagaaatgaaaggaatgtacacaattggtgacatcgtggccagataggtgaagctggtatcactggttgaaaaggcctcactcccatatgagtcaaagcttgggctcatatgatatgtgtccctaagtgtggccagggttgttagtgatgaaggcacagctggtatcattggaggaaaactgtaaaaaccagtggcctgaatactgcttttggactactctggattggttaatttcatgcagtttctccctccctgggagcagtggcctaagctgcctgtctagccttctgggcagtgctggcccagccctggtgcagcaagacacacgtccatctgaggcatccacagggtcggtggattcccagggattgcaagtggccctcacctccacccagctgtacaggcgctcctgggtgtgccggtcatccttgaagccggtgatggccagcaaatctaccacaaactgcttggggctgatgtgcagggtctgccaggagagcccacagtcaggcagtgctagggcagctcctagcccctcagagtgagatgcagagtggggacttctctgggcccacagagccacaggggtagggggcgggcactgtcactgcaaatctgcctcttggccgaggctcagtccaggtgcaactgctctgcttgcctccctgtcccaccactcttctggccctggccttctccttaaccccatcttggcttacttcctcttgccttgcaccacttattgtggggcaggggaagaggtggagaaggtacagggtgccccagggcctgaggcctgtcacacatacccacagccgattggccagggagaccaccttggctgtgatggctttggggtccttttgcctgatggaatccatgatgatgtcagccaggaagcagtgacatttctgtgcataaaacatctcttcccaggacagagagaaactcaggaaagtcacttctgtggaggagggaaagtggatgtggccacatctgtcaatagctagggccttagagacagtgtgaggagggggagaggggtagggcccccaggggccactgtctctgcctgaagtaccctgggagggggctcaggcatcctcacgaggaggcgcagggctcggcctggctccagagcctcaccttggggctggggactggctgtgggtgttgtgtgcctgaggttgtccatctccgtggtatagatgatgctgtcctcaaagaacatgcagaagccatcgctgcccaccacgggggggtgagtcactttgaggataacccctaggctgtccacctcactggcctcgggcagaggctgctcaggggcagggctttctgtgaaaacaacatagggagggggctctccttttaaaaaaaaattttttttcaagatagagttttgcttttgttgcccaggctggagtgcaatggcacaatcttggctcactgcaacctctgcctcccaggttccagcgattctcctgcctcagcctcctgagtagctgggattacaggcacctgccaccacgcccggctaatttttgtatttttggtagagatggggtttcaccaggctggtctcgaactcctgaccttaggtgatccacccgcctcagcctcccaaagtgctgggattacaggcgtgagccacacgcacaggcttttaaaattcttttcttcaattaccatcaaatcttcataagcagggactctccttaagccacctcagagcccaagcaggaaggggacctctggtgacaggccagtacaatcaagtcaccccagccttgcaacagctgccacctctagtttctcagaagtgacaccctgggctggcaggggcctgtcctggccactcctctcttcattgccctggcatcactgcaagccaaatcctgaacattttggaactcgaagaaactccagattcctctgttgaactaagacgtatcaaatggggctgagggctggaaatctttataaaattttaagttgagaacttttggggccagcctttgatgcatgtccaaagagtggacatttgtcatcccaaccttgacagaccaacttagggctcacaggcaagagtccaagaaggcccctccaagcagggctggagccactaatagggaaggtgacaatactgcaggcagggctttgagggagcagaggcagcatcctggcacagcgattttcagcacagttccctggccaccttcccttagctggctacacaagctctctctccagttcagtccctgtagcccctgctgtctcctgggcttctccacctggatgtccctcggcatttcacactcagtatgtgcccttccccaagctctgctctttctcttacccacacctcagtaagggcctatccacccccttgcagtcccacaggctagaaacctggcttctccttggcccatccctccttccctccactacctgcctagcctgcttcccctagcctagaaagaactccaagtggcttcgaatacctagctcctgctgcatttcctctgctcctggagcaaactttctgatgggcacacctgaccccgtgctcttgtctaaaatccttcagacgctgctcactcccatcctggtcagaatggagtaccacgtcctgaagctggcccacgaggcctgtccttatgacttctgtcttcagcctcatcttttatcacgtctgcatgtgaagcctggcctccagctagacccatgccctgcgcttccaaacatcctggacttctccttccttcccctgctgactccccagccctcagcctcttttgtgctcctgcttcataggcacctccttcccacagcactcatcccttcgccgtgtgtgttctcctggcccctccagccatgccaatgtgccagtcatttctgtgtctgctgcctggcacagagatggcattggtgagcgggggggtctagtcctcctttgtcactaacttgctctgccatcttggccaaagagtttgccttctctgttgtgaataagacttagatcaaagggggacaggactcacctctctccttggtcctctgcttgctccagtccttcagggtgccagctctttttgggggtaagtatggcttgaaggttggctctggccccttgtctttcgctccagctccagcccctgcctgtggtcctggatccttctctgaggctgtggaatgggctttccaggcagctgaggtgctgggctgggaagcagcctcgcttcccaaggggagctgcagggtggcctcctccaaggggctgctccgtgtggctgtcagtggctggaattcccactgtttgcaattgaccatgtcccattctctcaccagggagatgagtttttgcatgggagtggcgggagggtctttggtttcagatttctgtgtgaggttgattgtggtgcatttcttctttggggggctctcagggtggctcccccagtgtccaggattggtacacaagccacggcagtgtgagtatgtgctagggttgccagccctcttggcatttcggcatagggacacctggatgggccgagtgtactgctcagcctcatccatctggttggacctgaccaggtttcccttagccttgttccatggagtcctgtcactgcagtcttcgaagtccacaggcatgtaggctgtggtctggggagggaagggcacagtaactctggataggttgggcatggacatcaacgccttgcccaagatctaataagctgggcctccaagacttcacttgctctccctgaacaatcccatccctgacaggggtcacccatttgagctttgctcaggctgagtggggatggtgccagcccagtggcctgtcattccaacaggagatacaatcagcatcgcaggccacaagtggccagtaagttcctgtgcctccttcacggttcagaagccaggtcctgtcctaggaacccatgtaggctctgctctttcattttgctgcacccaccagtagctgaacctacccccatccaccctgagcccggtggtagtggtttttgaggataacaccaaccagaggaggctggtgcttacttctttagtgtctctactgaactccaccagtgaccctggcccttctgtcaccacatgcagcctcctgatggaaaaagcttcttcattttcagattctttctcctgagtccatgacctgcagaaaccaagaggggttggttagtgagtagagacttccatcaggccattggccagttggtcagatctgctctttggctgggagttaatgctagacagcagggaagaaggggctcttaaagggttttgcctaggtcactggccaatcctgggcctgcttcactccctcaaccccaaggagatcaggatcctctaggagtaggacttaggacaggatttcaagaggaatttaaaggaccaaattctaaacatagagtcgtgataaagttttcttacttgtatgcttcacattgtgcaagggcttctgagagggatggaatgtggtattcctccacctcctggcagaagaggggccattccctgcaaacaacaaggagatatccagctgggcagctaggatgagggtgtgggagggagcatgagctcctggaactgccgctgccaacagttcccacgatggaaataaaataacctcctccctgaaggctgcaactcaggtctcctttgttgctaagggaggggtcagccttcgtgatttcatcttactgcgtccttgcttcacttacttaaattcagatggtaaaaacagtttgccaagtctcaggaagttgagaatgtgtcggaacatctggccatccccgtggatgagcagggtttgtccatatgtgatccagtacactctctgagggttggacagcagttctggatactggagggggttggacaccggactcagtctcagaggctaggtctttgcgaaggggcaggtcaatcttctctcactccccttttccaactacactagagcagaggctttgagattccatttccctgtcttgtcagtcacaaggaaccatggtggggagcagagcttccagggagaagcacatcatccctgcttcaacttttgatggcccctagaccaccctctcaaggcatttggaagcccaccgtacctccttctcagtccaggtccctcagagctggccccctccctatgcaaactctggagggccttcccagcaggccactcggtccacttgtgctctgttttgttttgttttttgaggcagagtcacactccgtcacccaggttggagtgcagtggcgcgatctcagctcactgcaacttctatctcctgggttcaaacaattctggtgcttcagcctcccaagtatctgggattacaggcacgtgccatcacacccagctaatttttgtatttttagtacagacggggtttcaccatgttggtcaggctggtcttgaactcctgatctcgtgatctgcccacctcagcctcccaaagtgctgggattacaggcatgagccaccgtgcctggcgggaaagcctttgttctaagcaagtgctggaagctgtgtgagggccaggtgatggcccccagagcagctcaggtggtgatgccagatggggagcagggcagccgaggccgtcagtaccttcagcagtgtctgcagggtggttgcgtaccagtggcttccaacatacactttgatgatctgttgtggggaatacacagtgatctctgccgtccactcatctatgggaatccaggagatagaacacatcatcatatggccagaagggaaagcaggtagggccctttggttagtagtgtatttcacgttaagtctcaatatctttcctcagtcatattgtgttgcctagtctgagaagcagcagaaatccctgacataaaccttgcttgctgcaaggtttcctgggtggtgaggcgggaaagggcactgcccctcttcacctgaccctcctccctcaggaaagctgggttgatgaccctgtccacctacaatgccagctgcctccggtttctggttgggtgtgtcctgagtgtgtagcttttcatgtggccactcagactgaagctaggaatctctctctgtgtgtttatgttcgtggtttggcaaatgtcatggagccaactctcatcaaatccctgtcacttttatgagactaagcctctaggcatgtctggagaatgggggctgtatgctggaaagatgaacccataacccttttcctggagatgactatatgtaggccttgttctgatgtttgggaagcagtttctaatgagctctgtaatgaatgaagggtatataactagattatataaccaagagataagatgtatagaactagaccgtgaactccaggaagaaagggactaagtctgtgttgcttacttctgtgccgccagtgtctactgctgtcctggtatatgaccggtactcaataaatgttggatgctgctaaatgatagtaatacagcttaaactttgtcccccaaatttttggtaataagaagttataggcagctggtgaaaacaacattagctttggactcagtcaaaccccagcttgaccactgtgtaacttgagtgagttttcttctctgaacctattttttggctgttaaatggacccagggacagctctgtttaacagaggaggctcctccctgcatggctgtgagaagcacagcaagtcagctcccagggtcaaggcaggcctgccctgggggtcctgcgtggccccagactgggtaacagccctgtctgctgctggagacgaattgtgggcttggaggtgaggagggagcacttaatatgaaagtttcccttttgtaaaaatccaaaatattggcctggctttcccctcctcctccatctacagttcctcgtcctggccacatcatctattccctccaatctcccagatactcccctgatgctaaattcaaacctagaagctttctcacttactgagcacatccatgggtgccaaagtccttggctccagatgagtcttcaaagcaactttgattggctcgtaggtgatgtcccttttgtctaggaaggcacagagctcatatacctcggaaatggtctctgtcaggggcagccggcaagtccccagccagttcctgcccagaggaaaggtctgtcatgaagaacatcagcattgtaccccaagagagtcgagcctgtaaactttccatgcctaggatgccttgccgcaacactggcttaaatcaggcatcattaacatcgtttccttgtattttttttttagatggagtctcactctgtcgccaggctgaagtgcagtgacgcaatcttggctcactgcaacctttgcctcccaggttcaagcaattctcctgcctcagcctcccaagtagctggaactacaggcacccgccaccacgcctggctaattttttgtatttttagtagagacggggtttctttttttttttttttctttttttgagacggagtctaactctgtcacccaggctggagtgcagtggcgcgatctcggctcactgcaagctccgcctccagggttcatgccattctcctacctcagcctcctgagtagctgggactacaggcacccgccaccatgcccggctaattttttgtatttttagtagagacggggtttcaccatgtaggccaggatggtctcaatctcttgacctcatgatctgcttgccttggcctcccaaagtgctgggattacaggtgtgagccaccgcgcccagcccgtttccttgttttaactggaaatctgtttaaccttgtaggagagtaagcctggacaaccggtcacatttttggagctgagcttgacttatttcagcaaagccctctaaatggactaatttcatgtctccaggccgtgtttccggttccagggccagcccagggcccagtcgctcccttcttgcctcatacgcatctgcccaagacatctcagtcactgtgttgcagcctgccacggtcttggaaaaaggctggggtctaaacatcaacccccttctccaaaccctcccttccaaggcacttgtctttgccctctgtgacatcagggtggacatctctgaaagatatggactttatgggctaaaagagcccaaaacaacaatattgggaaaagacagcattcagggtcagctgaccctctcccaggggctccagaaaacccacttctaccttccattttggtgccagtctgttttgtgaccctcagagagttgctctgctgttctgcacctcagtttgcccatctacaaaacagggttggattccttgcccctgcactaatgaggacatcctgagctcatcccataaggcaaaggctgaggatcagcacctctgggaagcctggcctggcctggcctgccctgccctgcttctaagggggctcacccctggctctggccattctgtgtgtccagtgagcctcccaagagtggcggaggacctttgtagaggggtctgcacagggaggtacccagctccctgactgtggcctggtcacctcagacctagcacagggctagaaccagggaaatggactgcagaggacagaaataggaaatggtctgaagcctttgaaccttggcaacccttgtaccttggcactagccctctcctttgaggccctaacctggtggtagtgtggcggtgctggtgatggtaatggctaaaatgatgggctggccccaaggacacacttcacctctggctagtgggaaaggccccaggttattcctagagggaagggcagagccaagggtgatgggactcagtgtgccctaaggaggacctcacttgacgtgctgaaagaggacgccattccctgtgatgtacagtcggcttccgtctagcgtgctctcgatgcgaagctggcccagcgcagagtccgggtacttgaccagcagacccaggg
